United States Patent
Amigorena et al.

(10) Patent No.: US 12,152,077 B1
(45) Date of Patent: *Nov. 26, 2024

(54) IMMUNOTHERAPY TARGETING TUMOR NEOANTIGENIC PEPTIDES

(71) Applicants: INSTITUT CURIE, Paris (FR); MNEMO THERAPEUTICS, Paris (FR); INSTITUT NATIONAL DE LA SANTE ET DE LA RECHERCHE MEDICAL (INSERM), Paris (FR)

(72) Inventors: Sebastian Amigorena, Paris (FR); Marianne Burbage, Paris (FR); Alexandre Houy, Vitry sur Seine (FR); Marc-Henri Stern, Paris (FR); Joshua Waterfall, Paris (FR); Benjamin Sadacca, Paris (FR); Antonela Merlotti Ippolito, Paris (FR); Yago Arribas De Sandoval, Paris (FR)

(73) Assignees: INSTITUT CURIE, Paris (FR); MNEMO THERAPEUTICS, Paris (FR); INSTITUT NATIONAL DE LA SANTE ET DE LA RECHERCHE MEDICALE (INSERM), Paris (FR)

(*) Notice: Subject to any disclaimer, the term of this patent is extended or adjusted under 35 U.S.C. 154(b) by 0 days.

This patent is subject to a terminal disclaimer.

(21) Appl. No.: 18/316,628

(22) Filed: May 12, 2023

Related U.S. Application Data

(63) Continuation of application No. 17/639,568, filed as application No. PCT/EP2020/074429 on Sep. 2, 2020.

(30) Foreign Application Priority Data

| Sep. 2, 2019 | (EP) | 19306064 |
| Dec. 20, 2019 | (EP) | 19218556 |
| Jul. 1, 2020 | (EP) | 20305743 |

(51) Int. Cl.
*C07K 16/28* (2006.01)
*C07K 14/74* (2006.01)
*C12N 5/078* (2010.01)

(52) U.S. Cl.
CPC .... *C07K 16/2833* (2013.01); *C07K 14/70539* (2013.01); *C12N 5/0634* (2013.01); *C07K 2317/92* (2013.01)

(58) Field of Classification Search
CPC .......... C07K 16/2833; C07K 14/70539; C07K 2317/92; C12N 5/0634
See application file for complete search history.

(56) References Cited

U.S. PATENT DOCUMENTS

| 4,235,871 A | 11/1980 | Papahadjopoulos et al. |
| 4,501,728 A | 2/1985 | Geho et al. |
| 4,722,848 A | 2/1988 | Paoletti et al. |
| 4,837,028 A | 6/1989 | Allen |
| 5,019,369 A | 5/1991 | Presant et al. |
| 5,204,253 A | 4/1993 | Sanford et al. |
| 5,279,833 A | 1/1994 | Rose |
| 5,580,859 A | 12/1996 | Felgner et al. |
| 5,589,466 A | 12/1996 | Felgner et al. |
| 6,410,319 B1 | 6/2002 | Raubitschek et al. |
| 6,451,995 B1 | 9/2002 | Cheung et al. |
| 7,070,995 B2 | 7/2006 | Jensen |
| 7,265,209 B2 | 9/2007 | Jensen |
| 7,354,762 B2 | 4/2008 | Jensen |
| 7,446,179 B2 | 11/2008 | Jensen et al. |
| 7,446,190 B2 | 11/2008 | Sadelain et al. |
| 7,446,191 B2 | 11/2008 | Jensen |
| 8,324,353 B2 | 12/2012 | Jensen et al. |
| 8,339,645 B2 | 12/2012 | Nakawaki et al. |
| 8,398,282 B2 | 3/2013 | Kuhlman et al. |
| 8,479,118 B2 | 7/2013 | Lyndersay et al. |
| 2002/0131960 A1 | 9/2002 | Sadelain et al. |

(Continued)

FOREIGN PATENT DOCUMENTS

| EP | 2537416 A1 | 12/2012 |
| WO | WO-1991/06309 A1 | 5/1991 |

(Continued)

OTHER PUBLICATIONS

Belancio et al. (Genome Medicine, 1(97): 1-8, 2009).*
Wright et al. (Trends in Cell Biology, 32(3): 243-251, 2022).*
Bantysh et al. (Biochemistry (Moscow), 74(12): 1393-1399, 2009).*
Vorechovsky (Hum Genet, 127: 135-154, 2010).*
Shah et al. (Nature Genetics, 55: 631-639, 2023).*

(Continued)

*Primary Examiner* — Nelson B Moseley, II
(74) *Attorney, Agent, or Firm* — RinLaures LLC; Li-Hsien Rin-Laures; Kristen A. Dola

(57) ABSTRACT

The present disclosure relates to a method for selecting a tumor neoantigenic peptide wherein said method comprises:
- a step of identifying, among mRNA sequences from cancer cells of a subject, a fusion transcript sequence comprising a transposable element (TE) sequence and an exonic sequence, and including an open reading frame (ORF), and
- a step of selecting a tumor neoantigenic peptide of at least 8 amino acids, encoded by a part of said ORF of the fusion transcript sequence, wherein said ORF overlaps the junction between the TE and the exonic sequence, is pure TE and/or is non-canonical, and wherein said tumor neoantigenic peptide binds to at least one Major Histocompatibility Complex (MHC) molecule of said subject.

The present disclosure also relates to tumor neoantigenic peptide obtained according to the present method, vaccine or immunogenic composition, antibodies and immune cells derived thereof and their use in therapy of cancer.

9 Claims, 19 Drawing Sheets
Specification includes a Sequence Listing.

(56) References Cited

U.S. PATENT DOCUMENTS

| | | |
|---|---|---|
| 2013/0149337 A1 | 6/2013 | Cooper et al. |
| 2013/0287748 A1 | 10/2013 | June et al. |
| 2014/0120622 A1 | 5/2014 | Gregory et al. |
| 2019/0177383 A1 | 6/2019 | Mahr et al. |

FOREIGN PATENT DOCUMENTS

| | | |
|---|---|---|
| WO | WO-1993/24640 A2 | 12/1993 |
| WO | WO-1996/18372 A2 | 6/1996 |
| WO | WO-2000/14257 A1 | 3/2000 |
| WO | WO-2012/129514 A1 | 9/2012 |
| WO | WO-2013/071154 A1 | 5/2013 |
| WO | WO-2013/123061 A1 | 8/2013 |
| WO | WO-2013/126726 A1 | 8/2013 |
| WO | WO-2013/166321 A1 | 11/2013 |
| WO | WO-2014/031687 A1 | 2/2014 |
| WO | WO-2014/055668 A1 | 4/2014 |
| WO | WO-2016/172722 A1 | 10/2016 |

OTHER PUBLICATIONS

An et al., NCG 5.0: updates of a manually curated repository of cancer genes and associated properties from cancer mutational screenings. *Nucl. Acids Res.*, 44(D1): 992-9 (2016).

Baeuerle et al., Bispecific T-cell engaging antibodies for cancer therapy. *Cancer Res.*, 69(12): 4941-4 (2009).

Boegel et al., HLA typing from RNA-Seq sequence reads. *Genome Med.*, 4(12): 102 (2012).

Boudousquie et al., Polyfunctional response by ImmTAC (IMCgpIOO) redirected CD8+ and CD4+ T cells. *Immunology*, 152(3): 425-38 (2017).

Bulik-Sullivan et al., Deep learning using tumor HLA peptide mass spectrometry datasets improves neoantigen identification. *Nat. Biotechnol.*, 37(1): 55-63 (2018).

Chiappinelli et al., Inhibiting DNA methylation causes an interferon response in cancer via dsRNA including endogenous retroviruses. *Cell*, 162(5): 974-86 (2015).

Chong et al., Integrated proteogenomic deep sequencing and analytics accurately identify non-canonical peptides in tumor immunopeptidomes. *Nat. Commun.*, 11(1): 1293 (2020).

Chothia et al., The outline structure of the T-cell alpha beta receptor. *EMBO J.*, 7(12): 3745-55 (1988).

Cohen et al., Recognition of fresh human tumor by human peripheral blood lymphocytes transduced with a bicistronic retroviral vector encoding a murine anti-p53 TCR. *J. Immunol.*, 175(9): 5799-808 (2005).

Davila et al., CD19 CAR-targeted T cells induce long-term remission and B Cell Aplasia in an immunocompetent mouse model of B cell acute lymphoblastic leukemia. *PLoS One*, 8(4): e61338 (2013).

Dobin et al., STAR: ultrafast universal RNA-seq aligner. *Bioinformatics*, 29(1): 15-21 (2013).

Felgner et al., Lipofection: a highly efficient, lipid-mediated DNA-transfection procedure. *Proc. Natl. Acad. Sci. U.S.A*, 84(21): 7413-17 (1987).

Graham et al., Allogeneic CAR-T cells: more than ease of access? *Cells*, 7(10): 155 (2018).

Hasan et al., Artificial antigen presenting cells: an off the shelf approach for generation of desirable T-cell populations for broad application of adoptive immunotherapy. *Adv. Genet. Eng.*, 4(3): 130 (2015).

Helman et al., Somatic retrotransposition in human cancer revealed by whole- genome and exome sequencing. *Genome Res.*, 24(7): 1053-63 (2014).

Javitt et al., Pro-inflammatory cytokines alter the immunopeptidome landscape by modulation of HLA-B expression. *Front Immunol.*, 10(141): 1-16 (2019).

Jores et al., Resolution of hypervariable regions in T-cell receptor beta chains by a modified Wu-Kabat index of amino acid diversity. *Proc. Natl. Acad. Sci U.S.A.*, 87(23): 9138-42 (1990).

Kim et al., The ABCs of artificial antigen presentation. *Nat. Biotechnol.*, 22(4): 403-10 (2004).

Kim et al., TopHat2: accurate alignment of transcriptomes in the presence of insertions, deletions and gene fusions. *Genome Biol.*, 14(4): R36 (2013).

Kim et al., HISAT: a fast spliced aligner with low memory requirements. *Nat. Methods*, 12(4): 357-60 (2015).

Kiyotani et al., Immunopharmacogenomics towards personalized cancer immunotherapy targeting neoantigens. *Cancer Sci.*, 109(3): 542-9 (2018).

Kong et al., Transposable element expression in tumors is associated with immune infiltration and increased antigenicity. *Nat. Commun.*, 10(1): 5228 (2019).

Langmead et al., Ultrafast and memory-efficient alignment of short DNA sequences to the human genome. *Genome Biol.*, 10: R25 (2009).

Laumont et al., Noncoding regions are the main source of targetable tumor- specific antigens. *Sci. Transl. Med.*, 10(470): 1-11 (2018).

Lefranc et al., IMGT unique numbering for immunoglobulin and T cell receptor variable domains and Ig superfamily V-like domains. *Dev. Comp. Immunol.*, 27(1): 55-77 (2003).

Li et al., Directed evolution of human T-cell receptors with picomolar affinities by phage display. *Nat. Biotechnol.*, 23(3): 349-54 (2005).

Lundegaard et al., NetMHC-3.0: accurate web accessible predictions of human, mouse and monkey MHC class I affinities for peptides of length 8-11. *Nucl. Acids Res.*, 36(Web Server issue): W509-12 (2008).

Neal et al., The basics of artificial antigen presenting cells in T cell-based cancer immunotherapies. *J. Immunol. Res. Ther.*, 2(1): 68-79 (2017).

Nielsen et al., NetMHCpan, a method for quantitative predictions of peptide binding to any HLA-A and -B locus protein of known sequence. *PLoS One*, 2(8): e796 (2007).

Parkhurst et al., Characterization of genetically modified T-cell receptors that recognize the CEA:691-699 peptide in the context of HLA-A2.1 on human colorectal cancer cells. *Clin. Cancer Res.*, 15(1): 169-80 (2009).

Pradeepkiran et al., CGMD: An integrated database of cancer genes and markers. *Sci. Rep.*, 5: 12035 (2015).

Rathe et al., Identification of candidate neoantigens produced by fusion transcripts in human osteosarcomas. *Sci. Rep.*, 9(1): 358 (2019).

Ren et al., Multiplex genome editing to generate universal Car T cells resistant to PD1 inhibition. Clin. Cancer Res., 23(9): 2255-66 (2017).

Sadelain et al., The basic principles of chimeric antigen receptor design. *Cancer Discov.*, 3(4): 388-98 (2013).

Schiavetti et al., A human endogenous retroviral sequence encoding an antigen recognized on melanoma by cytolytic T lymphocytes. *Cancer Res.*, 62(19): 5510-6 (2002).

Shen et al., Double agents: genes with both oncogenic and tumor-suppressor functions. *Oncogenesis*, 7(3): 25 (2018).

Stover et al., New use of BCG for recombinant vaccines. *Nature*, 351(6326): 456-60 (1991).

Szoka et al., Comparative properties and methods of preparation of lipid vesicles (liposomes). *Annu. Rev. Biophys. Bioeng.*, 9: 467-508 (1980).

Takahashi et al., Regression of human kidney cancer following allogeneic stem cell transplantation is associated with recognition of an HERV-E antigen by T cells. *J. Clin. Invest.*, 118(3): 1099-109 (2008).

Torikai et al., Toward eliminating HLA class I expression to generate universal cells from allogeneic donors. *Blood*, 122(8): 1341-9 (2013).

Turtle et al., Engineered T cells for anti-cancer therapy. *Curr. Opin. Immunol.*, 24(5): 633-9 (2012).

Varela-Rohena et al., Control of HIV-1 immune escape by CD8 T cells expressing enhanced T-cell receptor. *Nat. Med.*, 14(12): 1390-5 (2008).

Verhoef et al., Des-enkephalin-γ-endorphin (DEyE): biotransformation in rat, dog and human plasma. *Eur. J. Drug. Metab. Pharmacokin*, 11(4): 291-302 (1986).

(56) References Cited

OTHER PUBLICATIONS

Walseng et al., Soluble T-cell receptors produced in human cells for targeted delivery. *PLoS One,* 10(4): e0119559 (2015).

Wang et al., Bioengineering of artificial sntigen presenting cells and lymphoid organs. *Theranostics,* 7(14): 3504-16 (2017).

Wolff et al., Direct gene transfer into mouse muscle in vivo. *Science,* 247(4949): 1465-68 (1990).

Wu et al., Adoptive T-cell therapy using autologous tumor-infiltrating lymphocytes for metastatic melanoma: current status and future outlook. *Cancer J.,* 18(2): 160-75 (2012).

Yarchoan et al., Targeting neoantigens to augment antitumour immunity. *Nat. Rev. Cancer.,* 17(4): 209-22 (2017).

Zhao et al., TSGene 2.0: an updated literature-based knowledgebase for tumor suppressor genes. *Nucl. Acids Res.,* 44(D1): D1023-31 (2016).

\* cited by examiner

TE-derived epitopes expressed in B16F10-OVA cells

TE-derived epitopes expressed in MCA101-OVA cells

TE-derived epitopes shared between B16OVA and MCAOVA cells

N25 (expected size 313 bp)

N26 (expected size 379bp)

*Lung cancer*

*Breast cancer*

*Lung cancer*

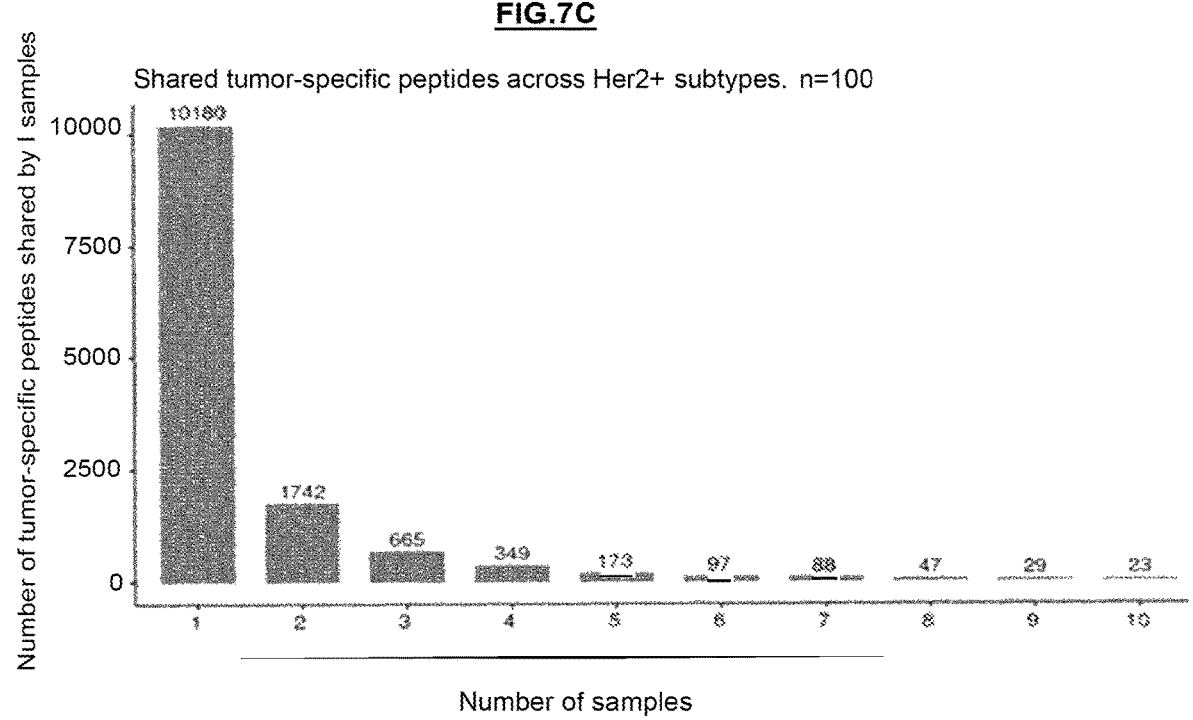
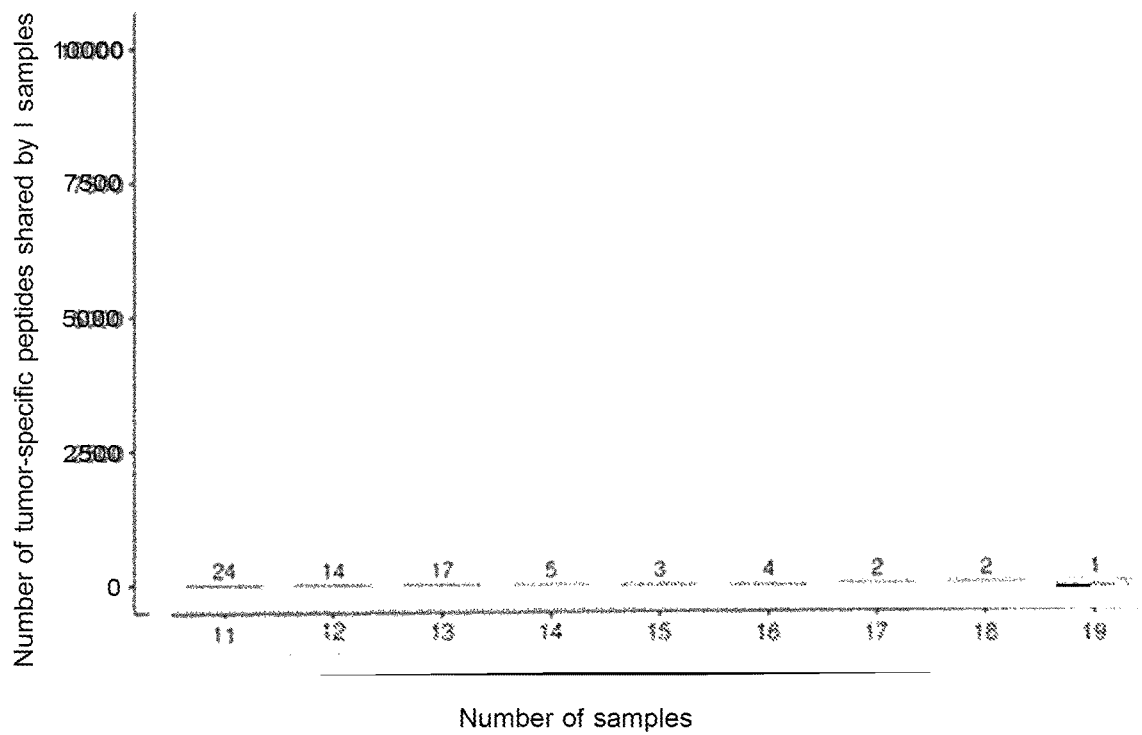
FIG.7C

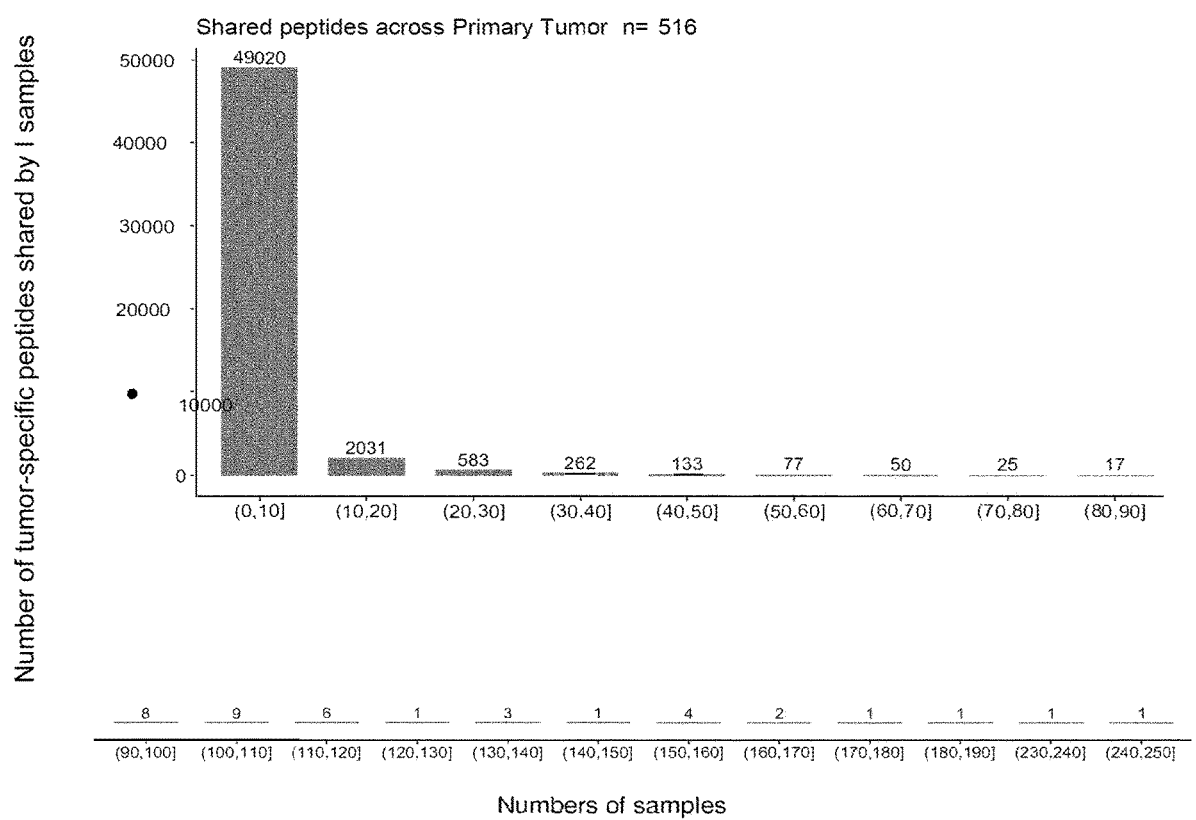

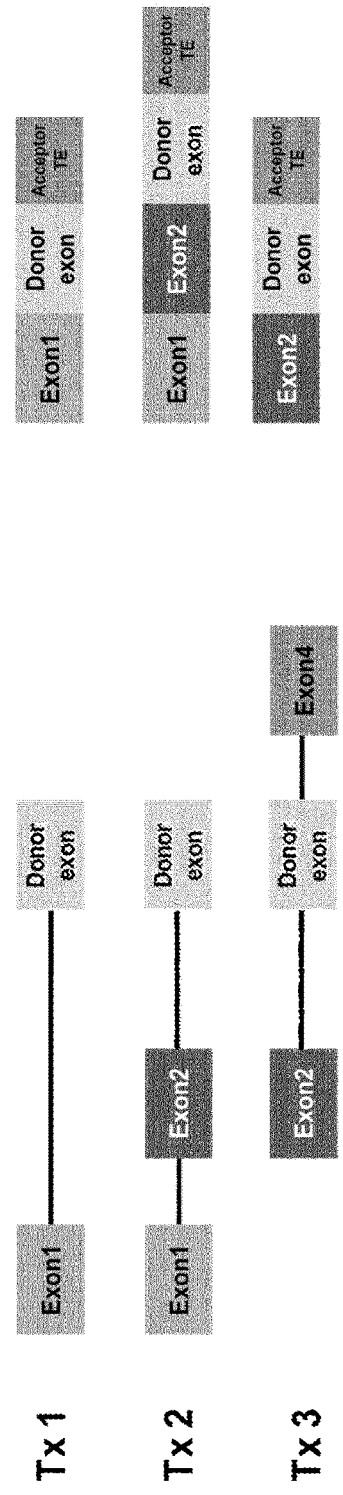

FIG. 12
Target cells: H1650
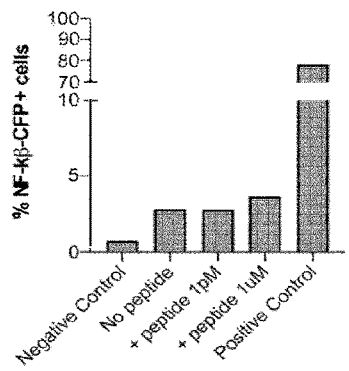
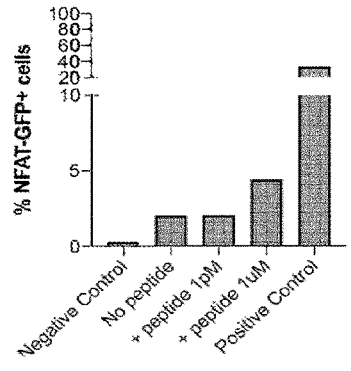
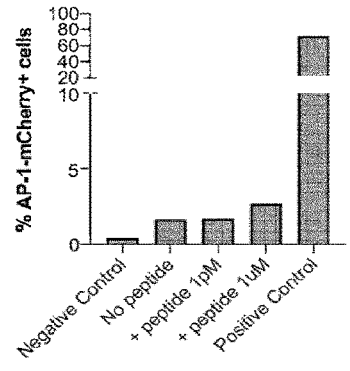
Target cells: H1395
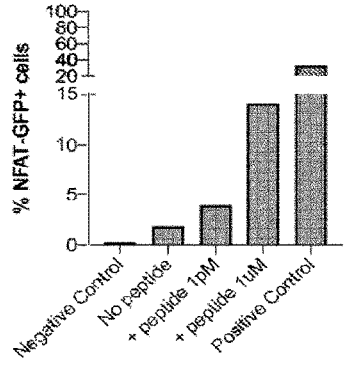
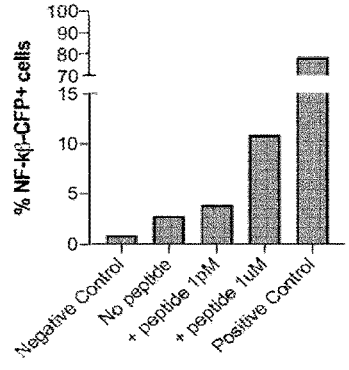
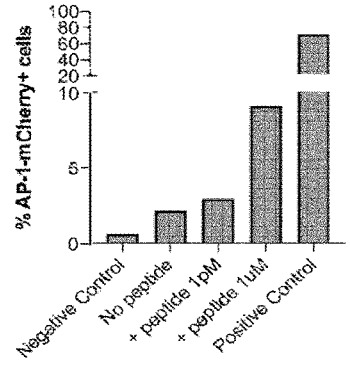

IMMUNOTHERAPY TARGETING TUMOR NEOANTIGENIC PEPTIDES

RELATED APPLICATIONS

This application is a continuation of U.S. patent application Ser. No. 17/639,568, filed Mar. 1, 2022, which is the national phase of International Patent Application No. PCT/EP2020/074429, filed Sep. 2, 2020, which claims priority to European Patent Application Nos. 19218556.9, filed Dec. 20, 2019; 19306064.7, filed Sep. 2, 2019 and 20305743.5, filed Jul. 1, 2020, all of which is hereby incorporated by reference in their entirety.

INCORPORATION BY REFERENCE OF SEQUENCE LISTING

This application includes, as a separate part of disclose, a Sequence Listing in computer-readable form (Filename: 1908CON.xml, Size: 40,972,698 bytes; Created: May 12, 2023). The contents of the Sequence Listing text file incorporated herein by reference in its entirety.

FIELD OF THE DISCLOSURE

The present disclosure provides neoantigenic peptides encoded by transposable element (TE)-exon fusion transcripts, nucleic acids, vaccines, antibodies and immune cells that can be used in cancer therapy.

BACKGROUND

Harnessing the immune system to generate effective responses against tumors is a central goal of cancer immunotherapy. Part of the effective immune response involves T lymphocytes specific for tumor antigens. T cell activation requires their interaction with antigen-presenting cells (APCs), commonly dendritic cells (DCs), expressing TCR-cognate peptides presented in the context of a major histocompatibility molecule (MHC) and co-stimulation signals. Subsequently, activated T cells can recognize peptide-MHC complexes presented by all cell types, even malignant cells. Neoplasms often contain infiltrating T lymphocytes reactive with tumor cells.

However, the efficiency of immune responses against tumors is severely dampened by various immunosuppressive strategies developed by tumors; e.g, tumor cells express receptors that provide inhibitory signals to infiltrating T cells, or they secrete inhibitory cytokines. The development of checkpoint blockade therapy has provided means to bypass some of these mechanisms, leading to more efficient killing of cancer cells. The promising results yielded by this approach have opened up new avenues for the development of T cell-based immunotherapy. Checkpoint inhibitors are, however, effective in a minority of patients and only in limited types of cancer.

A major goal in immunotherapy is to increase the proportion of responding patients and extend the cancer indications. Vaccination, administration of anti-tumor antibodies, or administration of immune cells specific for tumor antigens have all been proposed to increase the anti-tumor immune response, and can be administered alone, with other therapies such as chemotherapy or radiation, or as a combination therapy with checkpoint blockers. The selection of antigens able to trigger anti-tumor immunity without targeting healthy tissues has been a long-standing challenge.

The search for tumor neoantigens has mostly been focused on mutated sequences appearing as in cancer cells. These antigens are unique to each patient. Tumor antigens (the ones preferentially expressed in tumor cells) are, however, self-antigens that represent poor targets for vaccination (probably due to central tolerance). Identifying shared true neoantigens (absent from tissues) is a major challenge for the field.

A few prior reports regarding transposable elements (TE) in tumors include (Helman, E. et al. (2014). *Genome Res.*) (Schiavetti, F. et al. (2002). *Cancer Res.*, Takahashi, Y. et al. (2008). *J Clin. Invest.*). (Chiappinelli, K. B. et al. (2015). *Cell*, Roulois, D. et al. (2015). *Cell*). However, the relationship of TE to the antigenic landscape presented by tumor cells has not been investigated in depth.

New tumor neoantigens would be of interest and might improve or reduce the cost of cancer therapy in particular in the case of vaccination and adoptive cell therapy.

SUMMARY

The present disclosure provides a tumor neoantigenic peptide comprising at least 8 amino acids, wherein said neoantigenic peptide is encoded by a part of an open reading frame (ORF) from a fusion transcript sequence comprising a transposable element (TE) sequence and an exonic sequence.

Typically said ORF may
overlaps the junction between the TE and the exonic sequence,
be pure TE, and/or
be non-canonical.

The present disclosure also provides a method for selecting a tumor neoantigenic peptide which comprises:
a step of identifying, among mRNA sequences from cancer cells of a subject, a fusion transcript sequence comprising a transposable element (TE) sequence and exonic sequence, including an open reading frame (ORF), and
a step of selecting a tumor neoantigenic peptide of at least 8 amino acids, encoded by a part of said ORF of the fusion transcript sequence,
wherein said ORF overlaps the junction between the TE and the exonic sequence, is pure TE and/or is non-canonical, and
wherein said tumor neoantigenic peptide binds to at least one Major Histocompatibility Complex (MHC) molecule of said subject.

In one embodiment, the tumor neoantigenic peptide is 8 or 9 amino acids long, notably 8 to 11, and binds to at least one MHC class I molecule.

In another embodiment, the tumor neoantigenic peptide is from 13 to 25 amino acids long, and binds to at least one MHC class II molecule of said subject.

According to the present disclosure, "neoantigen peptide characteristics" include:
the TE sequence can be located in 5' end of the fusion transcript sequence and the exonic sequence can be located in 3' end of the fusion transcript sequence, and the part of the ORF of said fusion transcript sequence, which encodes the neoantigenic peptide, can overlap the junction;
the TE sequence can be located in 5' end of the fusion transcript sequence and the exonic sequence can be located in 3' end of the fusion transcript sequence, and the part of ORF which encodes said tumor neoantigenic peptide, can be downstream of the junction such that the open reading frame is non-canonical;

the TE sequence can be located in 3' end of the fusion transcript sequence and the exonic sequence can be located in 5' end of the fusion transcript sequence and the part of said fusion transcript sequence, which encodes the tumor neoantigenic peptide, can overlap the junction; or the TE sequence is located in 3' end of the fusion transcript sequence and the exonic sequence is located in 5' end of the chimeric transcript sequence, the part of the ORF which encodes a tumor neoantigenic peptide, is downstream of the junction between the exonic sequence and the TE sequence, optionally wherein the peptide sequence which is thus encoded by the pure TE sequence is non-canonical.

The TE sequences can be selected from the TE class I: Endogenous RetroVirus (ERVs), Long interspersed nuclear elements (LINEs) and short interspersed nuclear element (SINEs) and MaLR sequences or the DNA transposons of class II.

The present disclosure also encompasses peptides obtainable by the method as herein disclosed.

The present disclosure also provides neoantigenic peptides, comprising at least 8 amino acids and encoded by an open reading frame (ORF) of any one of the fusions transcripts of any of SEQ ID NO: 118-17492, preferably a peptide with one or more of the neoantigen peptide characteristics described above. More particularly neoantigenic peptide comprising at least 8 amino acids of any of SEQ ID NO: 1-117 are herein provided.

Said neoantigenic peptides are typically expressed at higher levels, or higher frequency, in tumor samples compared to normal, optionally said neoantigenic peptides are not expressed in normal tissue samples (i.e. normal healthy cells), or not detectably expressed in normal healthy samples.

In some embodiments said neoantigenic peptides are expressed in at least 1%, 5%, 10%, 15%, 20% 25% or even at least 30% of subjects from a population of subjects suffering from cancer and notably from a population of subjects suffering from cancer, notably from lung cancer, more particularly Non-small cell lung cancer (NSCLC), even more particularly from lung adenocarcinoma (LUAD).

Typically, the neoantigenic peptides bind MHC class I or class II with a binding affinity Kd of less than about $10^{-4}$, $10^{-5}$, $10^{-6}$, $10^{-7}$, $10^{-8}$ or $10^{-9}$ M (lower numbers indicating higher binding affinity).

Typically, the neoantigenic peptides bind MHC class I with a binding affinity of less than 2% percentile rank score predicted by NetMHCpan 4.0

Typically, the neoantigenic peptides bind MHC class II with a binding affinity of less than 10% percentile rank score predicted by NetMHCpanII 3.2.

The present disclosure also encompasses:
a population of autologous dendritic cells or antigen presenting cells that have been pulsed with one or more of the peptides as herein defined, or transfected with a polynucleotide encoding one or more of the peptides as herein described;
a vaccine or immunogenic composition, notably a sterile vaccine or immunogenic composition, capable of raising a specific T-cell response comprising
  a. one or more neoantigenic peptides as herein defined,
  b. one or more polynucleotides encoding a neoantigenic peptide as herein defined, optionally wherein the one or more polynucleotides are linked to a heterologous regulatory control nucleotide sequence; or
  c. a population of autologous dendritic cells or antigen presenting cells (notably artificial APC) that have been pulsed or loaded with one or more of the peptides as herein defined,
optionally in combination with a physiologically or pharmacologically acceptable buffer, carrier, excipient, immunostimulant and/or adjuvant.

an antibody, or an antigen-binding fragment thereof, a T cell receptor (TCR), or a chimeric antigen receptor (CAR) that has been selected for its binding affinity to a neoantigenic peptide as herein defined, or a composition comprising such antibody, antigen-binding fragment thereof, TCR or CAR.

a polynucleotide encoding a neoantigenic peptide, an antibody, a CAR or a TCR as herein defined, typically operatively linked to a heterologous regulatory control nucleotide sequence, and a vector encoding such polynucleotide, or a vaccine or immunogenic composition comprising such polynucleotide or vector;

an immune cell, or a population or immune cells that targets one or more neoantigenic peptides, as herein defined, wherein the population of immune cells preferably targets a plurality of different tumor neoantigenic peptides as herein disclosed, or a composition comprising such immune cells or population of immune cells optionally in combination with a physiologically or pharmacologically acceptable buffer, carrier, excipient, immunostimulant and/or adjuvant.

Typically, the antibody or antigen-binding fragment thereof, TCR or CAR binds a neoantigenic peptide, optionally in association with an MHC molecule, with a Kd affinity of about $10^{-6}$ M or less.

In some embodiments, the T cell receptor can be made soluble and fused to an antibody fragment directed to a T cell antigen, optionally wherein the targeted antigen is CD3 or CD16.

In some embodiments, the antibody can be a multispecific antibody that further targets at least an immune cell antigen, optionally wherein the immune cell is a T cell, a NK cell or a dendritic cell, optionally wherein the targeted antigen is CD3, CD16, CD30 or a TCR. In any of the embodiments relating to an antibody, the antibody can be chimeric, humanized, or human, and may be IgG, e.g. IgG1, IgG2, IgG3, IgG4.

The immune cell can be typically a T cell or a NK cell, a CD4+ and/or CD8+ cell, a TILs/tumor derived CD8 T cells, a central memory CD8+ T cells, a Treg, a MAIT, or a Yδ T cell. The cell can also be autologous or allogenic.

The T cell can comprises comprise a recombinant antigen receptor selected from T cell receptor and chimeric antigen receptor as herein defined, wherein the antigen is a tumor neoantigenic receptor as herein disclosed.

The present disclosure also encompasses a method of producing an antibody, TCR or CAR that specifically binds a neoantigenic peptide as herein defined and comprising the step of selecting an antibody, TCR or CAR that binds to a tumor neoantigen peptide of the present disclosure, optionally in association with an MHC or HLA molecule, optionally with a Kd binding affinity of about $10^{-6}$ M or less. Antibodies, TCRs and CARs selected by said method are also part of the present application, and thus any references to antibodies, TCRs or CARs herein also means an antibody, TCR or CAR that has been selected by said method.

A polynucleotide encoding a neoantigenic peptide as herein defined, or encoding an antibody, a CAR or a TCR as herein defined, optionally linked to a heterologous regulatory control sequence are also part of the present application.

As per the present disclosure, the neoantigenic peptide, the population of dendritic cells, the vaccine or immunogenic composition, the polynucleotide or the vector encoding the peptide can be used in cancer vaccination therapy of a subject; or for treating cancer in a subject suffering from cancer or at risk of cancer; or can be used for inhibiting proliferation of cancer cells. Typically the peptide(s) bind at least one MHC molecule of said subject.

As per the present disclosure, the antibody or the antigen-binding fragment thereof, the multispecific antibody, the TCR, the CAR, the polynucleotide, or the vector encoding such antibody, TCR or CAR, as herein defined can be used in the treatment of cancer in a subject in need thereof, the subject suffering from cancer or at risk of cancer, or can be used for inhibiting proliferation of cancer cells. Still as per the present disclosure, the population of immune cells as herein defined can be used in cell therapy of a subject suffering from cancer or at risk of cancer, or can be used for inhibiting proliferation of cancer cells.

Particularly, the neoantigenic peptide, the population of dendritic cells, the vaccine or immunogenic composition, the polynucleotide or the vector encoding the peptide, the antibody or the antigen-binding fragment thereof, the multispecific antibody, the TCR, the CAR, the polynucleotide, or the vector encoding such antibody, TCR or CAR or the population of immune cells (collectively referenced herein as the "Cancer Therapeutic Products") are used in the treatment of a subject who is suffering from NSCLC or who is at risk of suffering from NSCLC and/or in the treatment of NSCLC.

Pharmaceutical compositions comprising any of the foregoing, optionally with a sterile pharmaceutically acceptable excipient(s), carrier, and/or buffer are also contemplated as well as methods of using them.

In any of the embodiments described herein, the Cancer Therapeutic Products as above defined can be administered in combination with at least one further therapeutic agent. Such further therapeutic agent can typically be a chemotherapeutic agent, or an immunotherapeutic agent.

For example, according to the present disclosure, any of the Cancer Therapeutic Products can be administered in combination with an anti-immunosuppressive/immunostimulatory agent. For example, the subject is further administered with one or more checkpoint inhibitors typically selected from PD-1 inhibitors, PD-L1 inhibitors, Lag-3 inhibitors, Tim-3 inhibitors, TIGIT inhibitors, BTLA inhibitors, V-domain Ig suppressor of T-cell activation (VISTA) inhibitors and CTLA-4 inhibitors, or IDO inhibitors.

Various embodiments of the methods, neoantigenic peptides and Cancer Therapeutic Products are described in detailed below. Except for alternatives clearly mentioned, combinations of such embodiments are encompassed by the present application.

DETAILED DISCLOSURE

Transposable elements (TEs) expression in normal tissues is silenced by DNA methylation established early during embryonic development. An additional layer of inhibition is provided by histone modifications. TEs can be re-activated in tumor cells.

The Inventors have developed a method for selecting a tumor neoantigenic peptide encoded by a fusion transcript sequence comprising a part of a TE sequence and a part of an exonic sequence.

The neoantigenic tumor specific peptides identified by the method according to the present disclosure are highly immunogenic. Indeed, because they are derived from a fusion transcripts (composed of a transposable element, TE, and an exonic sequence) absent from normal cells, the peptides of the present disclosure are expected to exhibit very low immunological tolerance.

The present disclosure also allows selecting peptides having shared tumor neoepitopes among a population of patients. Such shared tumor peptides are of high therapeutic interest since they may be used in immunotherapy for a large population of patients.

Definitions

According to the present disclosure, the term "disease" refers to any pathological state, including cancer diseases, in particular those forms of cancer diseases described herein.

The term "normal" refers to the healthy state or the conditions in a healthy subject or tissue, i.e., non-pathological conditions, wherein "healthy" preferably means non-cancerous.

Cancer (medical term: malignant neoplasm) is a class of diseases in which a group of cells display uncontrolled growth (division beyond the normal limits), invasion (intrusion on and destruction of adjacent tissues), and sometimes metastasis (spread to other locations in the body via lymph or blood). These three malignant properties of cancers differentiate them from benign tumors, which are self-limited, and do not invade or metastasize. Most cancers form a tumor but some, like leukemia, do not.

Malignant tumor is essentially synonymous with cancer. Malignancy, malignant neoplasm, and malignant tumor are essentially synonymous with cancer.

As used herein, the term "tumor" or "tumor disease" refers to an abnormal growth of cells (called neoplastic cells, tumorigenous cells or tumor cells) preferably forming a swelling or lesion. By "tumor cell" is meant an abnormal cell that grows by a rapid, uncontrolled cellular proliferation and continues to grow after the stimuli that initiated the new growth cease.

Tumors show partial or complete lack of structural organization and functional coordination with the normal tissue, and usually form a distinct mass of tissue, which may be either benign, pre-malignant or malignant.

A benign tumor is a tumor that lacks all three of the malignant properties of a cancer. Thus, by definition, a benign tumor does not grow in an unlimited, aggressive manner, does not invade surrounding tissues, and does not spread to non-adjacent tissues (metastasize).

Neoplasm is an abnormal mass of tissue as a result of neoplasia. Neoplasia (new growth in Greek) is the abnormal proliferation of cells. The growth of the cells exceeds, and is uncoordinated with that of the normal tissues around it. The growth persists in the same excessive manner even after cessation of the stimuli. It usually causes a lump or tumor. Neoplasms may be benign, pre-malignant or malignant.

"Growth of a tumor" or "tumor growth" according to the present disclosure relates to the tendency of a tumor to increase its size and/or to the tendency of tumor cells to proliferate.

For purposes of the present disclosure, the terms "cancer" and "cancer disease" are used interchangeably with the terms "tumor" and "tumor disease".

Cancers are classified by the type of cell that resembles the tumor and, therefore, the tissue presumed to be the origin of the tumor. These are the histology and the location, respectively.

According to the present application, cancer may affect any one of the following tissues or organs: breast; liver; kidney; heart, mediastinum, pleura; floor of mouth; lip; salivary glands; tongue; gums; oral cavity; palate; tonsil; larynx; trachea; bronchus, lung; pharynx, hypopharynx, oropharynx, nasopharynx; esophagus; digestive organs such as stomach, intrahepatic bile ducts, biliary tract, pancreas, small intestine, colon; rectum; urinary organs such as bladder, gallbladder, ureter; rectosigmoid junction; anus, anal canal; skin; bone; joints, articular cartilage of limbs; eye and adnexa; brain; peripheral nerves, autonomic nervous system; spinal cord, cranial nerves, meninges; and various parts of the central nervous system; connective, subcutaneous and other soft tissues; retroperitoneum, peritoneum; adrenal gland; thyroid gland; endocrine glands and related structures; female genital organs such as ovary, uterus, cervix uteri; corpus uteri, vagina, vulva; male genital organs such as penis, testis and prostate gland; hematopoietic and reticuloendothelial systems; blood; lymph nodes; thymus.

The term "cancer" according to the disclosure therefore comprises leukemias, seminomas, melanomas, teratomas, lymphomas, neuroblastomas, gliomas, rectal cancer, endometrial cancer, kidney cancer, adrenal cancer, thyroid cancer, blood cancer, skin cancer, cancer of the brain, cervical cancer, intestinal cancer, liver cancer, colon cancer, stomach cancer, intestine cancer, head and neck cancer, gastrointestinal cancer, lymph node cancer, esophagus cancer, colorectal cancer, pancreas cancer, ear, nose and throat (ENT) cancer, breast cancer, prostate cancer, cancer of the uterus, ovarian cancer and lung cancer and the metastases thereof. Examples thereof are lung carcinomas, mamma carcinomas, prostate carcinomas, colon carcinomas, renal cell carcinomas, cervical carcinomas, or metastases of the cancer types or tumors described above. The term cancer according to the present disclosure also comprises cancer metastases and relapse of cancer.

The main types of lung cancer are small cell lung carcinoma (SCLC) and non-small cell lung carcinoma (NSCLC). There are three main sub-types of the non-small cell lung carcinomas: squamous cell lung carcinoma, lung adenocarcinoma (LUAD), and large cell lung carcinoma. Adenocarcinomas account for approximately 10% of lung cancers. This cancer usually is seen peripherally in the lungs, as opposed to small cell lung cancer and squamous cell lung cancer, which both tend to be more centrally located.

By "metastasis" is meant the spread of cancer cells from its original site to another part of the body. The formation of metastasis is a very complex process and depends on detachment of malignant cells from the primary tumor, invasion of the extracellular matrix, penetration of the endothelial basement membranes to enter the body cavity and vessels, and then, after being transported by the blood, infiltration of target organs. Finally, the growth of a new tumor, i.e. a secondary tumor or metastatic tumor, at the target site depends on angiogenesis. Tumor metastasis often occurs even after the removal of the primary tumor because tumor cells or components may remain and develop metastatic potential. In one embodiment, the term "metastasis" according to the present disclosure relates to "distant metastasis" which relates to a metastasis which is remote from the primary tumor and the regional lymph node system.

The cells of a secondary or metastatic tumor are like those in the original tumor. This means, for example, that, if ovarian cancer metastasizes to the liver, the secondary tumor is made up of abnormal ovarian cells, not of abnormal liver cells. The tumor in the liver is then called metastatic ovarian cancer, not liver cancer.

A relapse or recurrence occurs when a person is affected again by a condition that affected them in the past. For example, if a patient has suffered from a tumor disease, has received a successful treatment of said disease and again develops said disease said newly developed disease may be considered as relapse or recurrence. However, according to the present disclosure, a relapse or recurrence of a tumor disease may but does not necessarily occur at the site of the original tumor disease. Thus, for example, if a patient has suffered from ovarian tumor and has received a successful treatment a relapse or recurrence may be the occurrence of an ovarian tumor or the occurrence of a tumor at a site different to ovary. A relapse or recurrence of a tumor also includes situations wherein a tumor occurs at a site different to the site of the original tumor as well as at the site of the original tumor. Preferably, the original tumor for which the patient has received a treatment is a primary tumor and the tumor at a site different to the site of the original tumor is a secondary or metastatic tumor.

By "treat" is meant to administer a compound or composition as described herein to a subject in order to prevent or eliminate a disease, including reducing the size of a tumor or the number of tumors in a subject; arrest or slow a disease in a subject; inhibit or slow the development of a new disease in a subject; decrease the frequency or severity of symptoms and/or recurrences in a subject who currently has or who previously has had a disease; and/or prolong, i.e. increase the lifespan of the subject. In particular, the term "treatment of a disease" includes curing, shortening the duration, ameliorating, preventing, slowing down or inhibiting progression or worsening, or preventing or delaying the onset of a disease or the symptoms thereof.

By "being at risk" is meant a subject, i.e. a patient, that is identified as having a higher than normal chance of developing a disease, in particular cancer, compared to the general population. In addition, a subject who has had, or who currently has, a disease, in particular cancer, is a subject who has an increased risk for developing a disease, as such a subject may continue to develop a disease. Subjects who currently have, or who have had, a cancer also have an increased risk for cancer metastases.

The therapeutically active agents, vaccines and compositions described herein may be administered via any conventional route, including by injection or infusion.

The agents described herein are administered in effective amounts. An "effective amount" refers to the amount which achieves a desired reaction or a desired effect alone or together with further doses or together with further therapeutic agents. In the case of treatment of a particular disease or of a particular condition, the desired reaction preferably relates to inhibition of the course of the disease. This comprises slowing down the progress of the disease and, in particular, interrupting or reversing the progress of the disease. The desired reaction in a treatment of a disease or of a condition may also be delay of the onset or a prevention of the onset of said disease or said condition.

An effective amount of an agent described herein will depend on the condition to be treated, the severity of the disease, the individual parameters of the patient, including age, physiological condition, size and weight, the duration of treatment, the type of an accompanying therapy (if present), the specific route of administration and similar factors.

Accordingly, the doses administered of the agents described herein may depend on various of such parameters. In the case that a reaction in a patient is insufficient with an initial dose, higher doses (or effectively higher doses achieved by a different, more localized route of administration) may be used.

The pharmaceutical compositions as herein described are preferably sterile and contain an effective amount of the therapeutically active substance to generate the desired reaction or the desired effect.

The pharmaceutical compositions as herein described are generally administered in pharmaceutically compatible amounts and in pharmaceutically compatible preparation. The term "pharmaceutically compatible" refers to a nontoxic material which does not interact with the action of the active component of the pharmaceutical composition. Preparations of this kind may usually contain salts, buffer substances, preservatives, carriers, supplementing immunity-enhancing substances such as adjuvants, e.g. CpG oligonucleotides, cytokines, chemokines, saponin, GM-CSF and/or RNA and, where appropriate, other therapeutically active compounds. When used in medicine, the salts should be pharmaceutically compatible.

In the present application, the terms "fusion transcript" or "chimeric transcripts" are used indifferently as synonyms. A "fusion or a chimeric" "transcript or sequence", as per the present disclosure is defined as a transcript that aligns in part with an exon sequence and in part with a transposable element (TE) sequence and has a normalized number of read greater than $2.10^{-6}$. The normalized number of reads is defined as the number of reads that cover the fusion divided by the library size of the sample.

Unless specifically stated or obvious from context, as used herein, the term "about" is to be understood as within a range of normal tolerance in the art, for example within 2 standard deviations of the mean. About can be understood as within 50%, 45%, 40%, 35%, 30%, 25%, 20%, 15%, 10%, 9%, 8%, 7%, 6%, 5%, 4%, 3%, 2%, 1%, 0.5%, 0.1%, 0.05%, or 0.01% of the stated value. Unless otherwise clear from context, all numerical values provided herein are modified by the term about.

A "transposable element" is to be understood as both class I (retrotransposons, including those containing LTRs, LINEs and SINEs) and class II (DNA transposons) endogenously part of the genome (i.e.: not from infection). This includes both autonomous and non-autonomous elements from both classes. According to the present disclosure the TE sequences can be for example selected from TE of class I, such as retrotransposons including Endogenous RetroVirus (ERVs), Long interspersed nuclear elements (LINEs) and short interspersed nuclear element (SINEs) and mammalian long terminal repeat transposon (MaLR), and TE of class II, such as DNA transposons endogenously part of the genome.

A reading frame is a way of dividing the sequence of nucleotides in a nucleic acid (DNA or RNA) molecule into a set of consecutive, non-overlapping triplets.

An open reading frame (ORF) is the part of a reading frame that has the ability to be translated into a peptide. An ORF is a continuous stretch of codons that contain a start codon (for example AUG) at a transcription starting site (TSS) and a stop codon (for example UAA, UAG or UGA). An ATG codon within the ORF (not necessarily the first) may indicate where translation starts. The transcription termination site is located after the ORF, beyond the translation stop codon. In eukaryotic genes with multiple exons, ORFs span intron/exon regions, which may be spliced together after transcription of the ORF to yield the final mRNA for protein translation.

A "canonical ORF" as herein intended is a protein coding sequence with specified reading frame within a mRNA sequence which is described or annotated in databases such as for example Ensembl genome/transcriptome/proteome database collection (typically HG19). Typically, a canonical ORF is the same as one of the exons in normal healthy cells.

A "non-canonical ORF" as herein intended is a protein coding sequence with specified reading frame within a mRNA sequence which is not described (i.e. unannotated) in genome databases such as for example in Ensembl genome/transcriptome/proteome database. Typically a non-canonical ORF means thus that the reading frame is shifted compared to the usual reading frame of exons in normal healthy cells. In some embodiments however, a non-canonical can be described in genome databases (such as Ensembl database), but the mRNA sequence represents minor species in normal cells. By minor species it is typically intended less that 5%, notably less than 2%, or preferentially less than 1% species in normal cells.

An exon is any part of a gene that will encode a part of the final mature RNA produced by that gene after introns have been removed by RNA splicing. The term exon refers to both the DNA sequence within a gene and to the corresponding sequence in RNA transcripts. In RNA splicing, introns are removed and exons are covalently joined to one another as part of generating the mature messenger RNA. An exonic sequence as per the present applicant comprises at least a portion of one or more exon. Typically, the exonic sequence comprises at least a portion of one or 2 exons.

Thus, the untranslated sequences in 3'end and in 5' end (3'UTR and 5'UTR) present in mature RNA after splicing are exonic sequences, but are non-coding sequences because these sequences are located upstream of the start codon for the translation (5'UTR) or downstream of the stop codon ending the translation (3'UTR).

The term "peptide or polypeptide," is used interchangeably with "neoantigenic peptide or polypeptide" in the present specification to designate a series of residues, typically L-amino acids, connected one to the other, typically by peptide bonds between the α-amino and carboxyl groups of adjacent amino acids. The polypeptides or peptides can be a variety of lengths, either in their neutral (uncharged) forms or in forms which are salts, and either free of modifications such as glycosylation, side chain oxidation, or phosphorylation or containing these modifications, subject to the condition that the modification not destroy the biological activity of the polypeptides as herein described.

A "reference genome, or "representative genome" is a digital nucleic acid sequence data base, assembled by scientists as a representative example of species set of genes. As they are often assembled from the sequencing of DNA from a number of donors, reference genomes do not accurately represent the set of genes of any single individual (animal or person). Instead a reference provides a haploid mosaic of different DNA sequences from each donor.

Method for Selecting a Tumor Neoantigenic Peptide

The method for selecting a tumor neoantigenic peptide as per the present disclosure comprises
  a step of identifying, among mRNA sequences from a cancer cell sample of a subject, a fusion transcript sequence comprising a transposable element (TE) sequence and an exonic sequence, and including an open reading frame (ORF), and
  a step of selecting a tumor neoantigenic peptide of at least 8 amino acids, encoded by a part of said ORF of the fusion transcript sequence,
wherein said ORF overlaps the junction between the TE and the exonic sequence, is pure TE and/or is non-canonical, and wherein said tumor neoantigenic peptide binds to at least one Major Histocompatibility Complex (MHC) molecule of said subject.

Typically, a peptide translated from a part of non-canonical ORF of an exonic sequence is recognized as non-self by the immune system.

In some embodiments, the exonic sequence is from oncogene and/or a tumor suppressor gene and their mutated variants.

Conceptually, cancer is a result of consecutive somatic mutation accumulation. Many studies have shown that both the gain of function in oncogenes and the loss of function in tumor-suppressor genes are required for the development of cancer from a normal cell. For a diploid organism, gain-of-function mutations are often dominant or semi-dominant, whereas loss-of-function mutations are usually recessive. Two-hit hypothesis of oncogenesis proposes that the development of cancer is initiated by the loss of both alleles of a tumor-suppressor gene.

Oncogenes (also named cancer genes) are genes whose action positively promotes cell proliferation or growth. The normal nonmutant versions are known as proto-oncogenes. The mutant versions are excessively or inappropriately active leading to tumor growth. Oncogenes can be identified in the Cancer Gene Marker Database (CGMD) (Pradeepkiran, J., Sainath, S., Kramthi Kumar, K. et al. CGMD: Sci Rep 5, 12035 (2015) "*An integrated database of cancer genes and markers*"). Oncogenes (ONCs) can also be downloaded from Network of Cancer Genes database (NCG 5.0) (An O, Dall'Olio G M, Mourikis T P, Ciccarelli F D, Nucleic Acids Res. 2016 Jan. 4: 44 (D1): D992-9: "*NCG 5.0: updates of a manually curated repository of cancer genes and associated properties from cancer mutational screenings*"). Non-limitatives examples of oncogenes include: L-MYC, LYL-1, LYT-10, LYT-10/Cα1, MAS, MDM-2, MLL, MOS, MTG8 AML1, MYB, MYH11/CBFB, NEU, N-MYC, OST, PAX-5, PBX1/E2A, PIM-1, PRAD-1, RAF, RAR/PML, RAS-H, RAS-K, RAS-N, REL/NRG, RET, RHOM1, RHOM2, ROS, SKI, SIS, SET CAN, SRC, TAL1, TAL2, TAN-1, TIAM1, TSC2, and TRK.

Tumor suppressor genes (also named anti-oncogenes) represent the opposite side of cell growth control, normally acting to inhibit cell proliferation and tumor development. Thus tumor suppressor genes are genes that normally suppress cell division or growth. Loss of TSG function promotes uncontrolled cell division and tumor growth. Rb, a tumor suppressor gene that was identified by the genetic analysis of retinoblastoma an encoding a transcriptional regulatory protein, served as the prototype for the identification of additional tumor suppressor genes that contribute to the development of many different human cancers. Tumor suppressor genes are notably described in "Cooper G M. The Cell: A Molecular Approach. 2nd edition. Sunderland (MA): Sinauer Associates: 2000. Tumor Suppressor Genes". Tumor-suppressor genes (TSGs) can also be downloaded from Tumor Suppressor Gene database (TSGene 2.0) (see for reference Zhao M, Kim P, Mitra R, Zhao J, Zhao Z: Nucleic Acids Res. 2016 Jan. 4: 44 (D1): D1023-31: "*TSGene 2.0: an updated literature-based knowledgebase for tumor suppressor genes*"). In this context, non-limitative examples of tumor suppressor genes include: APC, BRCA1, BRCA2, DPC4, INK4, MADR2, NF1, NF2, p53, PTC, PTEN, Rb, RB1, VHL, WT1, BUB1, BUBR1, TGF-βRII, Axin, DPC4, p300, PPARγ, p16, DPC4, PTEN, and hSNF5.

Oncogenes, tumor suppressor genes or "double agent" genes (with both oncogenic and tumor-suppressor functions) can be systematically identified through database search and text mining. Indeed, information on oncogenes or tumor suppressor genes can typically be found in Ensembl database (but see also Shen L, Shi Q, Wang W. Double agents: genes with both oncogenic and tumor-suppressor functions. Oncogenesis. 2018: 7 (3): 25. Published 2018 Mar. 13). Double agent genes may be identified as genes overlapped between the two above mentioned databases (see also Shen et al., Oncogenesis 2018 above).

Without to be bound by any theory, the inventors believe that selection of fusion wherein the exonic sequence is from an oncogene and/or a tumor suppressor gene is of high relevance for the reason below:

TE insertion in oncogenes can alter their oncogenic activity. Insertion of TE sequences in oncogene active domains could therefore result in constitutive activity of the oncogenes, similar to driver mutations. These fusions giving chimeric oncogenes could thus represent a new family of oncogenic proteins. If this is the case, targeting the activity of these new "fusion oncogenes" with small molecule antagonists could represent a potential therapeutic approach for cancer where these chimeric oncogenes are expressed.

TE insertions in tumor suppressors could inactivate their suppressor functions, leading typically to a loss of function (for example through introduction of stop codons, changes in ORF or disruptive amino acid stretches), thereby contributing to the oncogenic process.

Fusions implicating cancer driver genes would be excellent targets for adoptive cell therapies, antibodies, ADCs, T cell engagers, etc. If they are involved in oncogenesis, fusions oncogenes are expected to be more specific for cancer cells, and thus to reduce the development of resistances (because of the oncogenic activity of the target).

In one embodiment, the TE sequence is located in 5' end of the fusion transcript sequence (it is also said that the TE sequence is the donor sequence) and the exonic sequence is located in 3' end of the fusion transcript sequence with respect to the junction (the exon sequence is thus called an acceptor sequence). The expression "is located in 5' end of the fusion transcript sequence" means that the element is located upstream of the junction in the fusion transcript sequence. The expression "is located in 3' end of the fusion transcript sequence" means that the element is located downstream of the junction in the fusion transcript sequence.

In a particular embodiment, the TE sequence is located in 5' end of the fusion transcript sequence and the exonic sequence is located in 3' end of the fusion transcript sequence, and the part of the ORF of said fusion transcript sequence, which encodes the neoantigenic peptide, overlaps the junction. In this case, the ORF can be canonical or non-canonical. It is understood that the ORF may comprise the junction but the neoantigenic peptide need not comprise the junction. In some embodiments, where the neoantigenic peptide comprises the junction, the obtained peptide is encoded by both TE sequence and exonic sequence.

The expression "the part of the ORF is overlapping or overlaps the junction between the TE sequence and the exonic sequence", means that said junction is contained in the part of the ORF of the fusion transcript sequence, which encodes said neoantigenic peptide.

In embodiments wherein (i) the part of the ORF encoding the neoantigenic peptide is overlapping the junction between the TE sequence and the exonic sequence, and (ii) the TE sequence and the exonic sequence are respectively in 5' end and 3'end of the fusion transcript sequence, said part of the ORF typically encodes a neoantigenic peptide of at least 8 amino acids, including at least between 1 to 6 amino acids, notably 2 to 6 from the TE sequence and at least between 1 and 6, notably 2 to 6 amino acids from the exonic sequence.

In another embodiment wherein the TE sequence is located in 5' end of the fusion transcript sequence and the exonic sequence is located in 3' end of the fusion transcript sequence, the part of ORF which encodes said neoantigenic peptide, is downstream of the junction and the ORF is thus non-canonical.

The expression "the part of the ORF is downstream of the junction" means that the part of the ORF encoding the neoantigenic peptide is not overlapping the junction, but it is contained in the 3'end part of said fusion transcript sequence with respect to the junction. In this embodiment, as the 3' end part with respect to the junction, is the exonic sequence, the part of the ORF encoding the neoantigenic peptide is thus contained in the exonic sequence. Thus, as the part of the ORF is only located in the exonic sequence, the obtained peptide is therefore encoded by the exonic sequence, in a non-canonical ORF. Thus, in the particular embodiment wherein the exonic sequence is located in 3' end of the fusion transcript sequence with respect to the junction, and wherein the part of the ORF which encodes the neoantigenic peptide is downstream of the junction with a non-canonical reading frame, the part of the ORF of the fusion transcript sequence encodes a neoantigenic peptide including 0 amino acid from the TE sequence, and at least 8 amino acids from the exonic sequence.

In another embodiment, the TE sequence is located in 3' end of the fusion transcript sequence and the exonic sequence is located in 5' end of the fusion transcript sequence with respect to the junction.

In some embodiments, the TE sequence is located in 3' end of the fusion transcript sequence and the exonic sequence is located in 5' end of the fusion transcript sequence and the part of the ORF of said fusion transcript sequence, which encodes a neoantigenic peptide, is overlapping the junction between the TE sequence and the exonic sequence. In this case, the ORF can also be canonical or non-canonical. The obtained peptide is encoded by both TE sequence and exonic sequence.

In the particular embodiment wherein the part of the ORF encoding the neoantigenic peptide, is overlapping the junction between the exonic sequence and the TE sequence, and wherein the exonic sequence and the TE sequence are respectively in 5' end and 3'end of the fusion transcript sequence, said part of the ORF encodes a neoantigenic peptide of at least 8 amino acids, including at least between 1 to 6, notably 2 to 6 amino acids from the TE sequence and at least between 1 and 6, notably 2 to 6 amino acids from the exonic sequence.

In still another embodiment, the TE sequence is located in 3' end of the fusion transcript sequence, the exonic sequence is located in 5' end of the fusion transcript sequence, and the part of the ORF which encodes a neoantigenic peptide, is downstream of the junction between the exonic sequence and the TE sequence. Optionally, the peptide sequence which is thus encoded by the pure TE sequence is non-canonical.

In this embodiment, as the 3' end part with respect to the junction is the TE sequence, the part of the ORF encoding the neoantigenic peptide is therefore encoded by the TE sequence. Thus, the part of the ORF encodes a neoantigenic peptide including no amino acid from the exonic sequence and at least 8 amino acids from the TE sequence. In the particular embodiment wherein the TE sequence is located in 3' end of the fusion transcript sequence with respect to the junction, and the part of the ORF which encodes the neoantigenic peptide is downstream the junction, the part of the ORF of the fusion transcript sequence encodes a neoantigenic peptide including 0 amino acid from the exonic sequence, and at least 8 amino acids from the TE sequence.

A tumor neoantigenic peptide is a peptide that arises from somatic alterations (classically mutations in the DNA sequence), is recognized as different from self, and is presented by antigen-presenting cells (APC), such as dendritic cells (DC) and tumor cells themselves. Cross-presentation plays an important role as the APC is able to translocate exogenous antigens from the phagosome into the cytosol for proteolytic cleavage into the major histocompatibility complex I (MHC I) epitopes by the proteasome.

In the present disclosure the alteration corresponds to the transcription of fusion mRNA sequences that comprise a transposable element (TE) sequence and an exonic sequence. This may arise from somatic (i.e.: specifically in the tumor clone) transposition. It may also arise not from de novo transposition but from tumor specific transcriptional de-repression such that a TE and nearby gene are co-transcribed.

A neoantigenic peptide according to the present disclosure may be completely absent from normal healthy samples (i.e., not expressed in normal healthy samples) and thus be specific to tumor samples. Alternatively, it may be expressed at low levels in normal cells and/or disproportionately expressed on tumor samples as compared to normal (healthy) samples.

It can also be selectively expressed by the cell lineage from which the cancer evolved.

Cancer or tumor samples according to the present disclosure can be isolated from any solid tumor or non-solid tumor of any of the tissues or organs as defined previously, for example, breast cancer, lung cancer and/or melanoma. In some embodiments cancer samples are from Acute Myeloid Leukemia, Adrenocortical Carcinoma, Bladder Urothelial Carcinoma, Breast Ductal Carcinoma, Breast Lobular Carcinoma, Cervical Carcinoma, Cholangiocarcinoma, Colorectal Adenocarcinoma, Esophageal Carcinoma, Gastric Adenocarcinoma, Glioblastoma Multiforme, Head and Neck Squamous Cell Carcinoma, Hepatocellular Carcinoma, Kidney Chromophobe Carcinoma, Kidney Clear Cell Carcinoma, Kidney Papillary Cell Carcinoma, Lower Grade Glioma, Lung Adenocarcinoma, Lung Squamous Cell Carcinoma, Mesothelioma, Ovarian Serous Adenocarcinoma, Pancreatic Ductal Adenocarcinoma, Paraganglioma & Pheochromocytoma, Prostate Adenocarcinoma, Sarcoma, Skin Cutaneous Melanoma, Testicular Germ Cell Cancer, Thymoma, Thyroid Papillary Carcinoma, Uterine Carcinosarcoma, Uterine Corpus Endometrioid Carcinoma or Uveal Melanoma samples. In a particular embodiment, cancer samples are from lung cancer samples, notably from LUAD samples.

Typically as per the present disclosure, the step of identifying said fusion transcript sequence is carried out by mapping mRNA sequences from cancer sample against a reference genome, and then distinguishing normal and abnormal junctions.

According to the present disclosure, normal junctions correspond to junctions donor and acceptor on the same strand and not too far apart (e.g.: not on different chromosomes).

According to the present disclosure, abnormal junctions correspond to junctions between donor and acceptor sequences on different chromosomes, or in cis but on different strands (no matter the order and the 5'-3' sense).

In one embodiment, the mRNA sequences can be mapped against a corresponding reference genome, with an adapted software, such as for example: Spliced Transcripts Alignment to a Reference (i.e.: STAR-see Dobin, Alexander et al. "STAR: ultrafast universal RNA-seq aligner." Bioinformatics (Oxford, England) vol. 29.1 (2013): 15-21), TopHat2 (Kim, Daehwan et al. "TopHat2: accurate alignment of transcriptomes in the presence of insertions, deletions and gene fusions." Genome biology vol. 14.4 R36. 25 Apr. 2013, doi: 10.1186/gb-2013-14-4-r36) or HISAT (Kim, Daehwan et al. "HISAT: a fast spliced aligner with low memory requirements." Nature methods vol. 12.4 (2015): 357-60. doi: 10.1038/nmeth.3317). STAR is a standalone software that uses sequential maximum mappable seed search followed by seed clustering and stitching to align RNA-seq reads. It is able to detect canonical junctions, non-canonical splices, and fusion/chimeric transcripts.

In a particular embodiment, the normal and abnormal junctions are determined in silico using dedicated databases, such as for example Ensembl and Repeatmasker databases, and the fusion transcripts having junctions between a TE and an exonic sequence are extracted in silico.

According to the present disclosure, the mRNA sequences can come from all types of cancer cell or tumor cell sample(s). The tumor may be a solid or a non-solid tumor. In particular, the mRNA sequences come from any tissues or organs affected by a cancer or tumor as previously defined, for example from breast cancer, lung cancer and/or melanoma. In a particular embodiment, mRNA sequences are from LUAD samples.

Typically, as per the present disclosure, the fusion transcript sequences are shared in more than 1%: notably more than 5%, more than 10%, more than 15%, more than 20% or even more than 25% of the cancer samples. In other words, a fusion transcript sequence as per the present disclosure is shared in cancer samples from more than 1%: notably more than 5%, more than 10%, more than 15%, more than 20% or even more than 25% of the subjects suffering from a cancer. The fusion transcript sequence may thus be specific for a cancer type of shared between several cancers.

According to the present disclosure, the fusion transcript sequences are expressed at higher levels in tumor cells compared to normal healthy cells. In some embodiments, the fusion transcript sequence is expressed in cancer cells and not in healthy cells, in particular not in thymus healthy cells. Such fusion transcript may be called tumor specific fusion as per the present disclosure. Fusion transcripts that are expressed at higher level(s) in tumor cells as compared to normal cell, typically that are disproportionally expressed in cancers cells as compared to normal cells as defined above may be called tumor associated fusion transcripts (TAF) as per the present disclosure. Tumor associated fusion transcripts may be selected according to the present application if they are present in more than 10% of the tumor samples and in less than 20% of the normal samples.

In some embodiments, the method further comprises a step of determining, optionally in silico or using in vitro techniques (see notably the example for illustration), the binding affinity of the tumor neoantigenic peptide with at least one MHC molecule of the said subject suffering from a cancer.

MHC class I proteins form a functional receptor on most nucleated cells of the body. There are 3 major MHC class I genes in HLA: HLA-A, HLA-B, HLA-C and three minor genes HLA-E, HLA-F and HLA-G. B2-microglobulin binds with major and minor gene subunits to produce a heterodimer. MHC molecules of class I consist of a heavy chain and a light chain and are capable of binding a peptide of about 8 to 11 amino acids, but usually 8 or 9 amino acids, if this peptide has suitable binding motifs, and presenting it to cytotoxic T-lymphocytes. The binding of the peptide is stabilized at its two ends by contacts between atoms in the main chain of the peptide and invariant sites in the peptide-binding groove of all MHC class I molecules. There are invariant sites at both ends of the groove which bind the amino and carboxy termini of the peptide. Variations in peptide length are accommodated by a kinking in the peptide backbone, often at proline or glycine residues that allow the required flexibility. The peptide bound by the MHC molecules of class I usually originates from an endogenous protein antigen. As an example, the heavy chain of the MHC molecules of class I is typically an HLA-A, HLA-B or HLA-C monomer, and the light chain is $\beta$-2-microglobulin, in humans.

There are 3 major and 2 minor MHC class II proteins encoded by the HLA. The genes of the class II combine to form heterodimeric ($\alpha\beta$) protein receptors that are typically expressed on the surface of antigen-presenting cells. The peptide bound by the MHC molecules of class II usually originates from an extracellular or exogenous protein antigen. As an example, the $\alpha$-chain and the $\beta$-chain are in particular HLA-DR, HLA-DQ and HLA-DP monomers, in humans. MHC class II molecules are capable of binding a peptide of about 8 to 20 amino acids, notably from 10 to 25 or from 13 to 25 if this peptide has suitable binding motifs and presenting it to T-helper cells. These peptides lie in an extended conformation along the MHC II peptide-binding groove which (unlike the MHC class I peptide-binding groove) is open at both ends. The peptide is held in place mainly by main-chain atom contacts with conserved residues that line the peptide-binding groove.

When the method is carried out on human samples, the method may comprise a step of determining the patient's class I or class I Major Histocompatibility Complex (MHC, aka human leukocyte antigen (HLA) alleles). It is to be noticed that as MHC alleles for laboratory mice are generally known such that this step may not be necessary in that particular context. In the present application, "MHC molecule" refers to at least one MHC class I molecule or at least one MHC Class II molecule.

A MHC allele database is carried out by analyzing known sequences of MHC I and MHC II and determining allelic variability for each domain. This can be typically determined in silico using appropriate software algorithms well-known in the field. Several tools have been developed to obtain HLA allele information from genome-wide sequencing data (whole-exome, whole-genome, and RNA sequencing data), including OptiType, Polysolver, PHLAT, HLAreporter, HLAforest, HLAminer, and seq2HLA (see Kiyotani K et al., Immunopharmacogenomics towards personalized cancer immunotherapy targeting neoantigens: Cancer Science 2018:109:542-549). For example, the seq2hla tool (see Boegel S. Lower M, Schafer M, et al. HLA typing from RNA-Seq sequence reads. Genome Med. 2012:4:102), which is well designed to perform the method as herein disclosed is an in silico method written in python and R, which takes standard RNA-Seq sequence reads in fastq format as input, uses a bowtie index (Langmead B, et al., Ultrafast and memory-efficient alignment of short DNA sequences to the human genome. Genome Biol. 2009, 10: R25-10.1186/gb-2009-10-3-r25) comprising all HLA alleles and outputs the most likely HLA class I and class II genotypes (in 4 digit resolution), a p-value for each call, and the expression of each class.

Typically, the sequences having junctions between a TE and an exonic sequence are extracted in silico. The affinity of all possible peptides encoded by each sequence for each MHC allele from the patient (or mouse) can be for example determined in silico using computational methods to predict peptide binding-affinity to HLA molecules. Indeed, accurate prediction approaches are based on artificial neural networks with predicted $IC_{50}$. For example, NetMHCpan software which has been modified from NetMHC to predict peptides binding to alleles for which no ligands have been reported, is well appropriate to implement the method as herein disclosed (Lundegaard C et al., NetMHC-3.0: accurate web accessible predictions of human, mouse and monkey MHC class I affinities for peptides of length 8-11: Nucleic Acids Res. 2008:36:W509-W512: Nielsen M et al. NetMHCpan, a method for quantitative predictions of peptide binding to any HLA-A and -B locus protein of known sequence. PLOS One. 2007:2:e796, but see also Kiyotani K et al., Immunopharmacogenomics towards personalized cancer immunotherapy targeting neoantigens: Cancer Science 2018:109: 542-549 and Yarchoan M et al., Nat rev. cancer 2017: 17 (4): 209-222). NetMHCpan software predicts binding of peptides to any MHC molecule of known sequence using artificial neural networks (ANNs). The method is trained on a combination of more than 180,000 quantitative binding data and MS derived MHC eluted ligands. The binding affinity data covers 172 MHC molecules from human (HLA-A, B, C, E), mouse (H-2), cattle (BoLA), primates (Patr, Mamu, Gogo) and swine (SLA). The MS eluted ligand data covers 55 HLA and mouse alleles.

In example embodiments, neoantigenic peptides encoded by fusion transcripts as above described and a Kd affinity of predicted peptides for MHC alleles of less than $10^{-4}$, $10^{-5}$, $10^{-6}$, $10^{-7}$ M or less than 500 nM, notably less than 50 nM are selected as tumor neoantigenic peptides.

As above mentioned, affinity of the selected peptide for MHC alleles can be determined in silico using appropriate software such as netMHCpan. Thus, in some embodiments, neoantigenic peptides bind MHC class I with a binding affinity of less than 2% percentile rank score predicted by NetMHCpan 4.0. In other embodiments, the neoantigenic peptides bind MHC class II with a binding affinity of less than 10% percentile rank score predicted by NetMHCpanII 3.2.

Affinity can also (alternatively or in addition) be estimated in vitro, for example using MHC tetramer formation assay as described in the results included therein (see example 2, point 2.1 and 2.2.2). Commercial assays for example from ImmunAware® can typically be used by the skilled person (EasYmers R; kits are from ImmunAware®; are notably used according to their training guide). Typically, binding affinity is determined as a percentage of binding to a positive control. Generally, peptides showing a percentage of binding of at least 30%, notably at least 40% or even at least 50% of the positive control are selected. Typically, the neoantigenic peptide as per the present disclosure, and typically obtainable as per the present method, binds at least one HLA/MHC molecule with an affinity sufficient for the peptide to be presented on the surface of a cell as an antigen. Generally, the neoantigenic peptide has an IC50 affinity of less than $10^{-4}$, or $10^{-5}$, or $10^{-6}$, or $10^{-7}$ or less than 500 nM, at least less than 250 nM, at least less than 200 nM, at least less than 150 nM, at least less than 100 nM, at least less than 50 nM or less for at least one HLA/MHC molecule (lower numbers indicating greater binding affinity), typically a molecule of said subject suffering from a cancer.

Further optional steps according to the present method may thus independently include:
- a step of exclusion of fusion transcripts or predicted peptides expressed at high levels or high frequency on healthy cells. An alignment of the fusion transcript sequence against the RNAseq data of healthy cells, typically allows determining the relative amount of fusion transcript sequence(s) present in healthy cells: In one embodiment, fusion transcripts or predicted peptides expressed on healthy cells are discarded.
- a step to confirm that a tumor neoantigenic peptide is not expressed in healthy cells of the subject. This step can be carried out using typically the Basic local alignment search tool (BLAST) and performing alignment of the sequence of the neoantigenic peptide against the proteome of healthy cells: Preferably, peptides that align against the proteome of normal healthy cells (for example using BLAST) are discarded.
- a step to confirm that the fusion transcript or predicted peptide is expressed in cancer cells of the subject. The presence of the selected fusion transcript sequence in cancer cells can be checked typically by RT-PCR in mRNA extracted from cancer cell sample.

Neoantigenic Peptides, Polynucleotides and Vectors

The present disclosure also relates to an isolated tumor neoantigenic peptide comprising at least 8, 9, 10, 11, or 12 amino acids, encoded by a portion of an open reading frame (ORF) from a fusion transcript that is a human mRNA sequence comprising a transposable element (TE) sequence and an exonic sequence. The peptide may be 8-9, 8-10, 8-11, 12-25, 13-25, 12-20, or 13-20 amino acids in length. Although the ORF overlaps a junction between a TE sequence and an exonic sequence, it is understood that the tumor neoantigenic peptide itself may not comprise the junction.

The present disclosure also more specifically encompasses an isolated tumor neoantigenic peptide encoded by a portion of a human fusion mRNA sequence from a cancer cell, said fusion mRNA comprising a TE sequence and an exonic sequence. In example embodiments the neoantigenic peptide comprising at least 8, 9, 10, 11 or 12 amino acids is encoded by a part of an open reading frame (ORF) of any of the fusion transcript sequences of any one of SEQ ID NO: 118-910, preferably a peptide with one or more of the neoantigen peptide characteristics described above.

The peptide may be 8-9, 8-10, 8-11, 12-25, 13-25, 12-20, or 13-20 amino acids in length and fulfills one or more of the neoantigen peptide characteristics described above. The N-terminus of the peptide of at least 8 amino acids may be encoded by the triplet codon starting at any of nucleotide positions 1, 2, 3, 4, 5, 6, 7, 8, 9, 10, 11, 12, 13, 14, 15, 16, 17, 18, and higher (it being understood that the disclosure contemplates a start position that is any of the integers between 1 and 8000 without having to list every number between 1 and 8000).

A peptide as above defined is typically obtainable according to the method of the present disclosure and thus encompasses one or more of the characteristics as previously described. In particular a neoantigenic peptide as per the present disclosure may exhibit one or a combination of the following further characteristics:
- It binds or specifically binds MHC class I of a subject and is 8 to 11 amino acids, notably 8, 9, 10, or 11 amino acids. Typically the neoantigenic peptide is 8 or 9 amino acids long, and binds to at least one MHC class I molecule of the subject: or alternatively, it binds to at least one MHC class II molecule of said subject and contains from 12 to 25 amino acids, notably is 12, 13, 14, 15, 16, 17, 18, 19, 20, 21, 22, 23, 24 or 25 amino acids long.

It binds at least one HLA/MHC molecule of said subject suffering from a cancer with an affinity sufficient for the peptide to be presented on the surface of a cell as an antigen. Typically the neoantigenic peptide has an IC50 of less than $10^{-4}$, or $10^{-5}$, or $10^{-6}$, or $10^{-7}$ or less than 500 nM, at least less than 250 nM, at least less than 200 nM, at least less than 150 nM, at least less than 100 nM, at least less than 50 nM or less (lower numbers indicating greater binding affinity).

It does not induce a significant autoimmune response and/or invoke immunological tolerance when administered to a subject.

It is expressed at higher levels in tumor samples compared to normal healthy samples. Typically, as per the present disclosure, a fusion transcript may be selected if it is present in more than 10% of the tumor samples and in less than 20% of the normal samples. In some embodiments, the neoantigenic is more specifically a tumor specific antigen (TSA), i.e.: it is only expressed in cancer sample and not in normal samples, or is expressed at relatively low levels in normal samples (e.g. the expressed mRNA sequences represent minor species in normal cells from normal samples).

It comprises the junction between the TE sequence and the exonic sequence, in other words it is encoded by a part of a TE sequence and a part of an exonic sequence, the ORF being either canonical or non-canonical or It is encoded by a non-canonical ORF of an exonic sequence or It is encoded by the TE sequence, optionally in a non-canonical ORF A tumor neoantigenic peptide may first be validated by RT transcription analysis of fusion transcripts sequence in tumors cell from a subject. Typically also, immunization with a tumor neoantigenic peptide as per the present disclosure elicits a T cell response In a particular embodiment, the present disclosure encompasses a NSCLC neoantigenic peptide comprising at least 8 amino acids of any one of SEQ ID NOS: 1-117. Typically, said neoantigenic peptides of SEQ ID NOS: 1-117 binds to HLA-A02 with an affinity sufficient for the peptide to be presented on the surface of cells as an antigen. Affinity for MHC alleles can be determined by known techniques in the field and notably in silico or in vitro as exemplified above:

In a particular embodiment, a tumor neoantigenic peptide as per the present disclosure binds to a MHC molecule present in at least 1%, 5%, 10%, 15%, 20%, 25% or more of subjects. Notably, a tumor neoantigenic peptide as herein disclosed is expressed in at least 1%, 5%, 10%, 15%, 20%, 25% of subjects from a population of subjects suffering from cancer More particularly, a tumor neoantigenic peptide of the present disclosure is capable of eliciting an immune response against a tumor present in at least 1%, 5%, 10%, 15%, 20%, or 25% of the subjects in the population of subjects suffering from cancer.

As previously defined, cancer may affect any one of the following tissues or organs: breast; liver: kidney: heart, mediastinum, pleura: floor of mouth: lip: salivary glands: tongue: gums; oral cavity: palate: tonsil: larynx: trachea: bronchus, lung: pharynx, hypopharynx, oropharynx, nasopharynx: esophagus: digestive organs such as stomach, intrahepatic bile ducts, biliary tract, pancreas, small intestine, colon: rectum: urinary organs such as bladder, gallbladder, ureter: rectosigmoid junction: anus, anal canal: skin: bone: joints, articular cartilage of limbs: eye and adnexa: brain: peripheral nerves, autonomic nervous system; spinal cord, cranial nerves, meninges; and various parts of the central nervous system; connective, subcutaneous and other soft tissues: retroperitoneum, peritoneum: adrenal gland; thyroid gland: endocrine glands and related structures: female genital organs such as ovary, uterus, cervix uteri: corpus uteri, vagina, vulva: male genital organs such as penis, testis and prostate gland: hematopoietic and reticuloendothelial systems: blood: lymph nodes: thymus. For example, the tumors or cancers as per the present application includes leukemias, seminomas, melanomas, teratomas, lymphomas, neuroblastomas, gliomas, rectal cancer, endometrial cancer, kidney cancer, adrenal cancer, thyroid cancer, blood cancer, skin cancer, cancer of the brain, cervical cancer, intestinal cancer, liver cancer, colon cancer, stomach cancer, intestine cancer, head and neck cancer, gastrointestinal cancer, lymph node cancer, esophagus cancer, colorectal cancer, pancreas cancer, ear, nose and throat (ENT) cancer, breast cancer, prostate cancer, cancer of the uterus, ovarian cancer and lung cancer and the metastases thereof. Examples thereof are lung carcinomas, mamma carcinomas, prostate carcinomas, colon carcinomas, renal cell carcinomas, cervical carcinomas, or metastases of the cancer types or tumors described above. The term cancer according to the present disclosure also comprises cancer metastases and relapse of cancer.

Typically a neoantigenic peptide as per the present disclosure does not induce a significant autoimmune response and/or invoke immunological tolerance when administered to a subject. Tolerating mechanisms involve clonal deletion, ignorance, anergy, or suppression in the host w the reduction in the number of high-affinity self-reactive T cells.

The neoantigenic peptide can also be modified by extending or decreasing the compound's amino acid sequence, e.g., by the addition or deletion of amino acids. The peptides can also be modified by altering the order or composition of certain residues, it being readily appreciated that certain amino acid residues essential for biological activity, e.g., those at critical contact sites or conserved residues, may generally not be altered without an adverse effect on biological activity. The non-critical amino acids need not be limited to those naturally occurring in proteins, such as L-α-amino acids, or their D-isomers, but may include non-natural amino acids as well, such as β-γ-δ-amino acids, as well as many derivatives of L-α-amino acids.

Typically, a series of peptides with single amino acid substitutions are employed to determine the effect of electrostatic charge, hydrophobicity, etc. on binding. For instance, a series of positively charged (e.g., Lys or Arg) or negatively charged (e.g., Glu) amino acid substitutions are made along the length of the peptide revealing different patterns of sensitivity towards various MHC molecules and T cell receptors. In addition, multiple substitutions using small, relatively neutral moieties such as Ala, Gly, Pro, or similar residues may be employed. The substitutions may be homo-oligomers or hetero-oligomers. The number and types of residues which are substituted or added depend on the spacing necessary between essential contact points and certain functional attributes which are sought (e.g., hydrophobicity versus hydrophilicity). Increased binding affinity for an MHC molecule or T cell receptor may also be achieved by such substitutions, compared to the affinity of the parent peptide. In any event, such substitutions should employ amino acid residues or other molecular fragments chosen to avoid, for example, steric and charge interference which might disrupt binding.

Amino acid substitutions are typically of single residues. Substitutions, deletions, insertions or any combination thereof may be combined to arrive at a final peptide. Substitutional variants are those in which at least one residue of a peptide has been removed and a different residue inserted in its place. Such substitutions are generally made in accordance with the following Table 1 when it is desired to finely modulate the characteristics of the peptide.

TABLE 1

| Original residue | Exemplary substitution |
| --- | --- |
| Ala | Ser |
| Arg | Lys, His |
| Asn | Gln |
| Asp | Glu |
| Cys | Ser |
| Gln | Asn |
| Glu | Asp |
| Gly | Pro |
| His | Lys, Arg |
| Ile | Leu, Val |
| Leu | Ile, Val |
| Lys | Tyr, Trp |
| Met | Thr |
| Phe | Ser |
| Ser | Tyr, Phe |
| Tyr | Trp, Phe |
| Val | Ile, Leu |
| Pro | Gly |

Substantial changes in function (e.g., affinity for MHC molecules or T cell receptors) are made by selecting substitutions that are less conservative than those in above Table, i.e., selecting residues that differ more significantly in their effect on maintaining (a) the structure of the peptide backbone in the area of the substitution, for example as a sheet or helical conformation, (b) the charge or hydrophobicity of the molecule at the target site or (c) the bulk of the side chain. The substitutions which in general are expected to produce the greatest changes in peptide properties will be those in which (a) hydrophilic residue, e.g. seryl, is substituted for (or by) a hydrophobic residue, e.g. leucyl, isoleucyl, phenylalanyl, valyl or alanyl: (b) a residue having an electropositive side chain, e.g., lysl, arginyl, or histidyl, is substituted for (or by) an electronegative residue, e.g. glutamyl or aspartyl: or (c) a residue having a bulky side chain, e.g. phenylalanine, is substituted for (or by) one not having a side chain, e.g., glycine.

The peptides and polypeptides may also comprise isosteres of two or more residues in the neoantigenic peptide or polypeptides. An isostere as defined here is a sequence of two or more residues that can be substituted for a second sequence because the steric conformation of the first sequence fits a binding site specific for the second sequence. The term specifically includes peptide backbone modifications well known to those skilled in the art. Such modifications include modifications of the amide nitrogen, the α-carbon, amide carbonyl, complete replacement of the amide bond, extensions, deletions or backbone crosslinks. See, generally, Spatola, Chemistry and Biochemistry of Amino Acids, Peptides and Proteins, Vol. VII (Weinstein ed., 1983).

In addition, the neoantigenic peptide may be conjugated to a carrier protein, a ligand, or an antibody. Half-life of the peptide may be improved by PEGylation, glycosylation, polysialylation, HESylation, recombinant PEG mimetics, Fc fusion, albumin fusion, nanoparticle attachment, nanoparticulate encapsulation, cholesterol fusion, iron fusion, or acylation.

Modifications of peptides and polypeptides with various amino acid mimetics or unnatural amino acids are particularly useful in increasing the stability of the peptide and polypeptide in vivo. Stability can be assayed in a number of ways. For instance, peptidases and various biological media, such as human plasma and serum, have been used to test stability. See, e.g., Verhoef et al., Eur. J. Drug Metab Pharmacokin. 11:291-302 (1986). Half life of the peptides of the present disclosure is conveniently determined using a 25% human serum (v/v) assay. The protocol is generally as follows. Pooled human serum (Type AB, non-heat inactivated) is delipidated by centrifugation before use. The serum is then diluted to 25% with RPMI tissue culture media and used to test peptide stability. At predetermined time intervals a small amount of reaction solution is removed and added to either 6% aqueous trichloracetic acid or ethanol. The cloudy reaction sample is cooled (4° C.) for 15 minutes and then spun to pellet the precipitated serum proteins. The presence of the peptides is then determined by reversed-phase HPLC using stability-specific chromatography conditions.

The peptides and polypeptides may be modified to provide desired attributes other than improved serum half-life. For instance, the ability of the peptides to induce CTL activity can be enhanced by linkage to a sequence which contains at least one epitope that is capable of inducing a T helper cell response. Particularly preferred immunogenic peptides/T helper conjugates are linked by a spacer molecule. The spacer is typically comprised of relatively small, neutral molecules, such as amino acids or amino acid mimetics, which are substantially uncharged under physiological conditions. The spacers are typically selected from, e.g., Ala, Gly, or other neutral spacers of nonpolar amino acids or neutral polar amino acids. It will be understood that the optionally present spacer need not be comprised of the same residues and thus may be a hetero- or homo-oligomer. When present, the spacer will usually be at least one or two residues, more usually three to six residues. Alternatively, the peptide may be linked to the T helper peptide without a spacer.

The neoantigenic peptide may be linked to the T helper peptide either directly or via a spacer either at the amino or carboxy terminus of the peptide. The amino terminus of either the neoantigenic peptide or the T helper peptide may be acylated. Exemplary T helper peptides include tetanus toxoid 830-843, influenza 307-319, malaria circumsporozoite 382-398 and 378-389

Multiple neoantigenic peptides described herein can also be linked together, optionally by a spacer.

Proteins or peptides may be made by any technique known to those of skill in the art, including the expression of proteins, polypeptides or peptides through standard molecular biological techniques, the isolation of proteins or peptides from natural sources, or the chemical synthesis of proteins or peptides. The nucleotide and protein, polypeptide and peptide sequences corresponding to various genes have been previously disclosed, and may be found at computerized databases known to those of ordinary skill in the art. One such database is the National Center for Biotechnology Information's Genbank and GenPept databases located at the National Institutes of Health website. The coding regions for known genes may be amplified and/or expressed using the techniques disclosed herein or as would be known to those of ordinary skill in the art. Alternatively, various commercial preparations of proteins, polypeptides and peptides are known to those of skill in the art.

In a further aspect the present disclosure provides a nucleic acid (e.g. polynucleotide) encoding a neoantigenic peptide as herein disclosed. The polynucleotide may be selected from DNA, cDNA, PNA, CNA, RNA, either single- and/or double-stranded, or native or stabilized forms of polynucleotides, such as for example polynucleotides with a phosphorothiate backbone, or combinations thereof and it may or may not contain introns so long as it codes for the peptide. Only peptides that contain naturally occurring amino acid residues joined by naturally occurring peptide bonds are encodable by a polynucleotide.

A still further aspect of the disclosure provides an expression vector capable of expressing a neoantigenic peptide as herein disclosed. Expression vectors for different cell types are well known in the art and can be selected without undue experimentation. Generally, the DNA is inserted into an expression vector, such as a plasmid, in proper orientation and correct reading frame for expression. The expression vector will comprise the appropriate heterologous transcriptional and/or translational regulatory control nucleotide sequences recognized by the desired host. The polynucleotide encoding the tumor neoantigenic peptide may be linked to such heterologous regulatory control nucleotide sequences or may be non-adjacent yet operably linked to such heterologous regulatory control nucleotide sequences. The vector is then introduced into the host through standard techniques. Guidance can be found for example in Sambrook et al. (1989) Molecular Cloning, A Laboratory Manual, Cold Spring Harbor Laboratory, Cold Spring Harbor, N.Y.

Antigen Presenting Cells (APCs)

The present disclosure also encompasses a population of antigen presenting cells that have been pulsed with one or more of the peptides as previously defined and/or obtainable in a method as previously described. Preferably, the antigen presenting cells are dendritic cell (DCs) or artificial antigen presenting cells (aAPCs) (see Neal, Lillian R et al. "The Basics of Artificial Antigen Presenting Cells in T Cell-Based Cancer Immunotherapies." Journal of immunology research and therapy vol. 2.1 (2017): 68-79). Dendritic cells (DC) are professional antigen-presenting cells (APC) that have an extraordinary capacity to stimulate naive T-cells and initiate primary immune responses to pathogens. Indeed, the main role of mature DCs are to sense antigens and produce mediators that activate other immune cells, particularly T cells. DCs are potent stimulators for lymphocyte activation as they express MHC molecules that trigger TCRs (signal 1) and co-stimulatory molecules (signal 2) on T cells. Additionally, DCs also secrete cytokines that support T cell expansion. T cells require presented antigen in the form of a processed peptide to recognize foreign pathogens or tumor. Presentation of peptide epitopes derived from pathogen/tumor proteins is achieved through MHC molecules. MHC class I (MHC-I) and MHC class II (MHC-II) molecules present processed peptides to CD8+ T cells and CD4+ T cells, respectively. Importantly, DCs home to inflammatory sites containing abundant T cell populations to foster an immune response. Thus, DCs can be a crucial component of any immunotherapeutic approach, as they are intimately involved with the activation of the adaptive immune response. In the context of vaccines, DC therapy can enhance T cell immune responses to a desired target in healthy volunteers or patients with infectious disease or cancer. In one embodiment, APCS are artificial APC, which are genetically modified to express the desired T-cell co-stimulatory molecules, human HLA alleles and/or cytokines. Such artificial antigen presenting cells (aAPC) are able to provide the requirements for adequate T-cell engagement, co-stimulation, as well as sustained release of cytokines that allow for controlled T-cell expansion. These cells are not subject to the constraints of time and limited availability and can be stored in small aliquots for subsequent use in generating T-cell lines from different donors, thus representing an off the shelf reagent for immunotherapy applications. Expression of potent co-stimulatory signals on these aAPC endows this system with higher efficiency lending to increased efficacy of adoptive immunotherapy. Furthermore, aAPC can be engineered to express genes directing release of specific cytokines to facilitate the preferential expansion of desirable T-cell subsets for adoptive transfer: such as long lived memory T-cells (see for review Hasan A H et al. Artificial Antigen Presenting Cells: An Off the Shelf Approach for Generation of Desirable T-Cell Populations for Broad Application of Adoptive Immunotherapy: Adv Genet Eng. 2015: 4 (3): 130, Kim J V, Latouche J B, Rivière I, Sadelain M. The ABCs of artificial antigen presentation. Nat Biotechnol. 2004:22:403-410 or Wang C. Sun W. Ye Y. Bomba H N, Gu Z. Bioengineering of Artificial Antigen Presenting Cells and Lymphoid Organs. Theranostics 2017: 7 (14): 3504-3516.).

Typically, the dendritic cells are autologous dendritic cells that are pulsed with a neoantigenic peptide as herein disclosed. The peptide may be any suitable peptide that gives rise to an appropriate T-cell response. The antigen-presenting cell (or stimulator cell) typically has an MHC class I or II molecule on its surface, and in one embodiment is substantially incapable of itself loading the MHC class I or II molecule with the selected antigen. The MHC class I or II molecule may readily be loaded with the selected antigen in vitro.

As an alternative the antigen presenting cell may comprise an expression construct encoding a tumor neoantigenic peptide as herein disclosed. The polynucleotide may be any suitable polynucleotide as previously defined and it is preferred that it is capable of transducing the dendritic cell, thus resulting in the presentation of a peptide and induction of immunity Thus the present disclosure encompasses a population of APCs than can be pulsed or loaded with the neoantigenic peptide as herein disclosed, genetically modified (via DNA or RNA transfer) to express at least one neoantigenic peptide as herein disclosed, or that comprise an expression construct encoding a tumor neoantigenic peptide of the present disclosure. Typically the population of APCs is pulsed or loaded, modified to express or comprises at least one, at least 5, at least 10, at least 15, or at least 20 different neoantigenic peptide or expression construct encoding it.

The present disclosure also encompasses compositions comprising APCs as herein disclosed. APCs can be suspended in any known physiologically compatible pharmaceutical carrier, such as cell culture medium, physiological saline, phosphate-buffered saline, cell culture medium, or the like, to form a physiologically acceptable, aqueous pharmaceutical composition. Parenteral vehicles include sodium chloride solution, Ringer's dextrose, dextrose and sodium chloride, lactated Ringer's. Other substances may be added as desired such as antimicrobials. As used herein, a "carrier" refers to any substance suitable as a vehicle for delivering an APC to a suitable in vitro or in vivo site of action. As such, carriers can act as an excipient for formulation of a therapeutic or experimental reagent containing an APC. Preferred carriers are capable of maintaining an APC in a form that is capable of interacting with a T cell. Examples of such carriers include, but are not limited to water, phosphate buffered saline, saline, Ringer's solution, dextrose solution, serum-containing solutions, Hank's solution and other aqueous physiologically balanced solutions or cell culture medium. Aqueous carriers can also contain suitable auxiliary substances required to approximate the physiological conditions of the recipient, for example, enhancement of chemical stability and isotonicity. Suitable auxiliary substances include, for example, sodium acetate, sodium chloride, sodium lactate, potassium chloride, calcium chloride, sorbitan monolaurate, triethanolamine oleate, and other substances used to produce phosphate buffer, Tris buffer, and bicarbonate buffer.

Vaccine Compositions

The present disclosure further encompasses a vaccine or immunogenic composition capable of raising a specific T-cell response comprising:
  one or more neoantigenic peptides as herein defined,
  one or more polynucleotides encoding a neoantigenic peptide as herein defined; and/or
  a population of antigen presenting cells (such as autologous dendritic cells or artificial APC) as described above.

Preferably, neoantigenic peptide which are encoded by tumor specific fusions as previously defined are used in vaccine compositions as per the present disclosure. Said neoantigenic peptide can be also named tumor specific peptides. Preferably also polynucleotides encoding tumor specific peptides are used as per the present disclosure.

A suitable vaccine or immunogenic composition will preferably contain between 1 and 20 neoantigenic peptides, more preferably 2, 3, 4, 5, 6, 7, 8, 9, 10, 11, 12, 13, 14, 15, 16, 17, 18, 19, 20, 21, 22, 23, 24, 25 different neoantigenic peptides, further preferred 6, 7, 8, 9, 10 11, 12, 13, or 14 different neoantigenic peptides, and most preferably 12, 13 or 14 different neoantigenic peptides.

The neoantigenic peptide(s) may be linked to a carrier protein. Where the composition contains two or more neoantigenic peptides, the two or more (e.g. 2-25) peptides may be linearly linked by a spacer molecule as described above, e.g. a spacer comprising 2-6 nonpolar or neutral amino acids.

In one embodiment of the present disclosure the different neoantigenic peptides, encoding polynucleotides, vectors, or APCs are selected so that one vaccine or immunogenic composition comprises neoantigenic peptides capable of associating with different MHC molecules, such as different MHC class I molecules. Preferably, such neoantigenic peptides are capable of associating with the most frequently occurring MHC class I molecules, e.g. different fragments capable of associating with at least 2 preferred, more preferably at least 3 preferred, even more preferably at least 4 preferred MHC class I molecules. In some embodiments, the compositions comprise peptides, encoding polynucleotides, vectors, or APCs capable of associating with one or more MHC class II molecules. The MHC is optionally HLA-A, -B, -C, -DP, -DQ, or -DR.

The vaccine or immunogenic composition is capable of raising a specific cytotoxic T-cells response and/or a specific helper T-cell response.

Thus in a particular embodiment, the present disclosure also relates to a neoantigenic peptide as described above, wherein the neoantigenic peptide has a tumor specific neoepitope and is included in a vaccine or immunogenic composition. A vaccine composition is to be understood as meaning a composition for generating immunity for the prophylaxis and/or treatment of diseases. Accordingly, vaccines are medicines which comprise or generate antigens and are intended to be used in humans or animals for generating specific defense and protective substance by vaccination. An "immunogenic composition" is to be understood as meaning a composition that comprises or generates antigen(s) and is capable of eliciting an antigen-specific humoral or cellular immune response, e.g. T-cell response.

In a preferred embodiment, the neoantigenic peptide according to the disclosure is 8 or 9 residues long, or from 13 to 25 residues long. When the peptide is less than 20 residues, in order to have a peptide better suited for in vivo immunization, said neoantigenic peptide, is optionally flanked by additional amino acids to obtain an immunization peptide of more amino acids, usually more than 20.

Pharmaceutical compositions (i.e., the vaccine or immunogenic composition) comprising a peptide as herein described may be administered to an individual already suffering from cancer. In therapeutic applications, compositions are administered to a patient in an amount sufficient to elicit an effective CTL response to the tumor antigen and to cure or at least partially arrest symptoms and/or complications. An amount adequate to accomplish this is defined as "therapeutically effective dose." Amounts effective for this use will depend on, e.g., the peptide composition, the manner of administration, the stage and severity of the disease being treated, the weight and general state of health of the patient, and the judgment of the prescribing physician, but generally range for the initial immunization (that is for therapeutic or prophylactic administration) from about 1.0 μg to about 50,000 μg of peptide for a 70 kg patient, followed by boosting dosages or from about 1.0 μg to about 10,000 μg of peptide pursuant to a boosting regimen over weeks to months depending upon the patient's response and condition by measuring specific CTL activity in the patient's blood. It must be kept in mind that the peptide and compositions of the present invention may generally be employed in serious disease states, that is, life-threatening or potentially life threatening situations, especially when the cancer has metastasized. In such cases, in view of the minimization of extraneous substances and the relative nontoxic nature of the peptide, it is possible and may be felt desirable by the treating physician to administer substantial excesses of these peptide compositions.

For therapeutic use, administration should begin at the detection or surgical removal of tumors. This is followed by boosting doses until at least symptoms are substantially abated and for a period thereafter.

The vaccine or immunogenic compositions for therapeutic treatment are intended for parenteral, topical, nasal, oral or local administration. Preferably, the pharmaceutical compositions are administered parenterally, e.g., intravenously, subcutaneously, intradermally, or intramuscularly. The compositions may be administered at the site of surgical excision to induce a local immune response to the tumor.

The vaccine or immunogenic composition may be a pharmaceutical composition which additionally comprises a pharmaceutically acceptable adjuvant, immunostimulatory agent, stabilizer, carrier, diluent, excipient and/or any other materials well known to those skilled in the art. Such materials should be non-toxic and should not interfere with the efficacy of the active ingredient. The carrier is preferably an aqueous carrier but its precise nature of the carrier or other material will depend on the route of administration. A variety of aqueous carriers may be used, e.g., water, buffered water, 0.9% saline, 0.3% glycine, hyaluronic acid and the like. These compositions may be sterilized by conventional, well known sterilization techniques, or may be sterile filtered. The resulting aqueous solutions may be packaged for use as is, or lyophilized, the lyophilized preparation being combined with a sterile solution prior to administration. The compositions may further contain pharmaceutically acceptable auxiliary substances as required to approximate physiological conditions, such as pH adjusting and buffering agents, tonicity adjusting agents, wetting agents and the like, for example, sodium acetate, sodium lactate, sodium chloride, potassium chloride, calcium chloride, sorbitan monolaurate, triethanolamine oleate, etc. See, for example, Butterfield, B M J. 2015 22:350 for a discussion of cancer vaccines.

Example adjuvants that increase or expand the immune response of a host to an antigenic compound include emulsifiers, muramyl dipeptides, avridine, aqueous adjuvants such as aluminum hydroxide, chitosan-based adjuvants, saponins, oils, Amphigen, LPS, bacterial cell wall extracts, bacterial DNA, CpG sequences, synthetic oligonucleotides, cytokines and combinations thereof. Emulsifier include, for example, potassium, sodium and ammonium salts of lauric and oleic acid, calcium, magnesium and aluminum salts of fatty acids, organic sulfonates such as sodium lauryl sulfate, cetyltrhethylammonlum bromide, glycerylesters, polyoxyethylene glycol esters and ethers, and sorbitan fatty acid esters and their polyoxyethylene, acacia, gelatin, lecithin and/or cholesterol. Adjuvants that comprise an oil component include mineral oil, a vegetable oil, or an animal oil. Other adjuvants include Freund's Complete Adjuvant (FCA) or Freund's Incomplete Adjuvant (FIA). Cytokines useful as additional immunostimulatory agents include interferon alpha, interleukin-2 (IL-2), and granulocyte macrophage-colony stimulating factor (GM-CSF), or combinations thereof.

The concentration of peptides as herein described in the vaccine or immunogenic formulations can vary widely, i.e., from less than about 0.1%, usually at or at least about 2% to as much as 20% to 50% or more by weight, and will be selected primarily by fluid volumes, viscosities, etc., in accordance with the particular mode of administration selected.

The peptides as herein described may also be administered via liposomes, which target the peptides to a particular cells tissue, such as lymphoid tissue. Liposomes are also useful in increasing the half-life of the peptides. Liposomes include emulsions, foams, micelles, insoluble monolayers, liquid crystals, phospholipid dispersions, lamellar layers and the like. In these preparations the peptide to be delivered is incorporated as part of a liposome, alone or in conjunction with a molecule which binds to, e.g., a receptor prevalent among lymphoid cells, such as monoclonal antibodies which bind to the CD45 antigen, or with other therapeutic or immunogenic compositions. Thus, liposomes filled with a desired peptide of the invention can be directed to the site of lymphoid cells, where the liposomes then deliver the selected therapeutic/immunogenic peptide compositions. Liposomes for use in the invention are formed from standard vesicle-forming lipids, which generally include neutral and negatively charged phospholipids and a sterol, such as cholesterol. The selection of lipids is generally guided by consideration of, e.g., liposome size, acid lability and stability of the liposomes in the blood stream. A variety of methods are available for preparing liposomes, as described in, e.g., Szoka et al., Ann. Rev. Biophys. Bioeng. 9:467 (1980), U.S. Pat. Nos. 4,235,871, 4,501,728 4,501,728, 4,837,028, and 5,019,369.

For targeting to the immune cells, a ligand to be incorporated into the liposome can include, e.g., antibodies or fragments thereof specific for cell surface determinants of the desired immune system cells. A liposome suspension containing a peptide may be administered intravenously, locally, topically, etc. in a dose which varies according to, inter alia, the manner of administration, the peptide being delivered, and the stage of the disease being treated.

For solid compositions, conventional or nanoparticle nontoxic solid carriers may be used which include, for example, pharmaceutical grades of mannitol, lactose, starch, magnesium stearate, sodium saccharin, talcum, cellulose, glucose, sucrose, magnesium carbonate, and the like. For oral administration, a pharmaceutically acceptable nontoxic composition is formed by incorporating any of the normally employed excipients, such as those carriers previously listed, and generally 10-95% of active ingredient, that is, one or more peptides of the invention, and more preferably at a concentration of 25%-75%.

For aerosol administration, the immunogenic peptides are preferably supplied in finely divided form along with a surfactant and propellant. Typical percentages of peptides are 0.01%-20% by weight, preferably 1%-10%. The surfactant must, of course, be nontoxic, and preferably soluble in the propellant. Representative of such agents are the esters or partial esters of fatty acids containing from 6 to 22 carbon atoms, such as caproic, octanoic, lauric, palmitic, stearic, linoleic, linolenic, olesteric and oleic acids with an aliphatic polyhydric alcohol or its cyclic anhydride. Mixed esters, such as mixed or natural glycerides may be employed. The surfactant may constitute 0.1%-20% by weight of the composition, preferably 0.25-5%. The balance of the composition is ordinarily propellant. A carrier can also be included as desired, as with, e.g., lecithin for intranasal delivery.

Cytotoxic T-cells (CTLs) recognize an antigen in the form of a peptide bound to an MHC molecule rather than the intact foreign antigen itself. The MHC molecule itself is located at the cell surface of an antigen presenting cell. Thus, an activation of CTLs is only possible if a trimeric complex of peptide antigen, MHC molecule, and antigen presenting cell (APC) is present. Correspondingly, it may enhance the immune response if not only the peptide is used for activation of CTLs, but if additionally APCs with the respective MHC molecule are added. Therefore, in some embodiments the vaccine or immunogenic composition according to the present disclosure alternatively or additionally contains at least one antigen presenting cell, preferably a population of APCs.

The vaccine or immunogenic composition may thus be delivered in the form of a cell, such as an antigen presenting cell, for example as a dendritic cell vaccine. The antigen presenting cells such as a dendritic cell may be pulsed or loaded with a neoantigenic peptide as herein disclosed, may comprise an expression construct encoding a neoantigenic peptide as herein disclosed, or may be genetically modified (via DNA or RNA transfer) to express one, two or more of the herein disclosed neoantigenic peptides, for example at least 2, 3, 4, 5, 6, 7, 8, 9, or 10 neoantigenic peptides.

Suitable vaccines or immunogenic compositions may also be in the form of DNA or RNA relating to neoantigenic peptides as described herein. For example, DNA or RNA encoding one or more neoantigenic peptides or proteins derived therefrom may be used as the vaccine, for example by direct injection to a subject. For example, DNA or RNA encoding at least 2, 3, 4, 5, 6, 7, 8, 9, 10, 11, 12, 13, 14, 15, 16, 17, 18, 19, 20, 21, 22, 23, 24 or 25 neoantigenic peptides or proteins derived therefrom.

A number of methods are conveniently used to deliver the nucleic acids to the patient. For instance, the nucleic acid can be delivered directly, as "naked DNA". This approach is described, for instance, in Wolff et al., Science 247:1465-1468 (1990) as well as USAU.S. U.S. Pat. Nos. 5,580,859 and 5,589,466. The nucleic acids can also be administered using ballistic delivery as described, for instance, in U.S. Pat. No. 5,204,253. Particles comprised solely of DNA can be administered. Alternatively, DNA can be adhered to particles, such as gold particles.

The nucleic acids can also be delivered complexed to cationic compounds, such as cationic lipids. Lipid-mediated gene delivery methods are described, for instance, in 9618372WOAWO 96/18372: 9324640WOAWO 93/24640: Mannino & Gould-Fogerite, BioTechniques 6 (7): 682-691 (1988): U.S. Pat. No. 5,279,833 USA Rose U.S. Pat. No. 5,279,833; 9106309WOAWO 91/06309; and Felgner et al., Proc. Natl. Acad. Sci. USA 84:7413-7414 (1987).

Delivery systems may optionally include cell-penetrating peptides, nanoparticulate encapsulation, virus like particles, liposomes, or any combination thereof. Cell penetrating peptides include TAT peptide, herpes simplex virus VP22, transportan, Antp. Liposomes may be used as a delivery system. Listeria vaccines or electroporation may also be used.

The one or more neoantigenic peptides may also be delivered via a bacterial or viral vector containing DNA or RNA sequences which encode one or more neoantigenic peptides. The DNA or RNA may be delivered as a vector itself or within attenuated bacteria virus or live attenuated virus, such as vaccinia or fowlpox. This approach involves the use of vaccinia virus as a vector to express nucleotide sequences that encode the peptide of the invention.

Upon introduction into an acutely or chronically infected host or into a noninfected host, the recombinant vaccinia virus expresses the immunogenic peptide, and thereby elicits a host CTL response. Vaccinia vectors and methods useful in immunization protocols are described in, e.g., U.S. Pat. No. 4,722,848 . . . . Another vector is BCG (Bacille Calmette Guerin). BCG vectors are described in Stover et al. (Nature 351:456-460 (1991)). A wide variety of other vectors useful for therapeutic administration or immunization of the peptides of the invention, e.g., *Salmonella* typhivectors and the like, will be apparent to those skilled in the art from the description herein.

An appropriate mean of administering nucleic acids encoding the peptides as herein described involves the use of minigene constructs encoding multiple epitopes. To create a DNA sequence encoding the selected CTL epitopes (minigene) for expression in human cells, the amino acid sequences of the epitopes are reverse translated. A human codon usage table is used to guide the codon choice for each amino acid. These epitope-encoding DNA sequences are directly adjoined, creating a continuous polypeptide sequence. To optimize expression and/or immunogenicity, additional elements can be incorporated into the minigene design. Examples of amino acid sequence that could be reverse translated and included in the minigene sequence include: helper T lymphocyte, epitopes, a leader (signal) sequence, and an endoplasmic reticulum retention signal. In addition, MHC presentation of CTL epitopes may be improved by including synthetic (e.g. poly-alanine) or naturally-occurring flanking sequences adjacent to the CTL epitopes.

The minigene sequence is converted to DNA by assembling oligonucleotides that encode the plus and minus strands of the minigene. Overlapping oligonucleotides (30-100 bases long) are synthesized, phosphorylated, purified and annealed under appropriate conditions using well known techniques. The ends of the oligonucleotides are joined using T4 DNA ligase. This synthetic minigene, encoding the CTL epitope polypeptide, can then cloned into a desired expression vector.

Standard regulatory sequences well known to those of skill in the art are included in the vector to ensure expression in the target cells. Thus, the DNA or RNA encoding the neoantigenic peptide(s) may typically be operably linked to one or more of:

a promoter that can be used to drive nucleic acid molecule expression. AAV ITR can serve as a promoter and is advantageous for eliminating the need for an additional promoter element. For ubiquitous expression, the following promoters can be used: CMV (notably human cytomegalovirus immediate early promoter (hCMV-IE)), CAG, CBh, PGK, SV40, RSV, Ferritin heavy or light chains, etc. For brain expression, the following promoters can be used: SynapsinI for all neurons, CaMKIIalpha for excitatory neurons, GAD67 or GAD65 or VGAT for GABAergic neurons, etc. Promoters used to drive RNA synthesis can include: Pol III promoters such as U6 or HI. The use of a Pol II promoter and intronic cassettes can be used to express guide RNA (gRNA). Typically, the promoter includes a down-stream cloning site for minigene insertion. For examples of suitable promoters sequences, see notably U.S. Pat. Nos. 5,580,859 and 5,589,466.

Transcriptional transactivators or other enhancer elements, which can also increase transcription activity, e.g. the regulatory R region from the 5' long terminal repeat (LTR) of human T-cell leukemia virus type 1 (HTLV-1) (which when combined with a CMV promoter has been shown to induce higher cellular immune response).

Translation optimizing sequences e.g. a Kozak sequence flanking the AUG initiator codon (ACCAUGG) within mRNA, and codon optimization.

Additional vector modifications may be desired to optimize minigene expression and immunogenicity. In some cases, introns are required for efficient gene expression, and one or more synthetic or naturally-occurring introns could be incorporated into the transcribed region of the minigene. The inclusion of mRNA stabilization sequences can also be considered for increasing minigene expression. It has recently been proposed that immunostimulatory sequences (ISSs or CpGs) play a role in the immunogenicity of DNA' vaccines. These sequences could be included in the vector, outside the minigene coding sequence, if found to enhance immunogenicity.

In some embodiments, a bicistronic expression vector, to allow production of the minigene-encoded epitopes and a second protein included to enhance or decrease immunogenicity can be used.

DNA vaccines or immunogenic compositions as herein described can be enhanced by co-delivering cytokines that promote cell-mediated immune responses, such as IL-2, IL-12, IL-18, GM-CSF and IFNγ. CXC chemokines such as IL-8, and CC chemokines such as macrophage inflammatory protein (MIP)-1α, MIP-3α, MIP-3β, and RANTES, may increase the potency of the immune response. DNA vaccine immunogenicity can also be enhanced by co-delivering plasmid-encoded cytokine-inducing molecules (e.g. LeIF), co-stimulatory and adhesion molecules, e.g. B7-1 (CD80) and/or B7-2 (CD86). Helper (HTL) epitopes could be joined to intracellular targeting signals and expressed separately from the CTL epitopes. This would allow direction of the HTL epitopes to a cell compartment different than the CTL epitopes. If required, this could facilitate more efficient entry of HTL epitopes into the MHC class II pathway, thereby improving CTL induction. In contrast to CTL induction, specifically decreasing the immune response by co-expression of immunosuppressive molecules (e.g. TGF-β) may be beneficial in certain diseases.

Once an expression vector is selected, the minigene is cloned into the polylinker region downstream of the promoter. This plasmid is transformed into an appropriate *E. coli* strain, and DNA is prepared using standard techniques. The orientation and DNA sequence of the minigene, as well as all other elements included in the vector, are confirmed using restriction mapping and DNA sequence analysis. Bacterial cells harboring the correct plasmid can be stored as a master cell bank and a working cell bank.

Purified plasmid DNA can be prepared for injection using a variety of formulations. The simplest of these is reconstitution of lyophilized DNA in sterile phosphate-buffer saline (PBS). A variety of methods have been described, and new techniques may become available. As noted above, nucleic acids are conveniently formulated with cationic lipids. In addition, glycolipids, fusogenic liposomes, peptides and compounds referred to collectively as protective, interactive, non-condensing (PINC) could also be complexed to purified plasmid DNA to influence variables such as stability, intra-muscular dispersion, or trafficking to specific organs or cell types.

Vaccines or immunogenic compositions comprising peptides may be administered in combination with vaccines or immunogenic compositions comprising polynucleotide encoding the peptides. For example, administration of peptide vaccine and DNA vaccine may be alternated in a prime-boost protocol. For example, priming with a peptide immunogenic composition and boosting with a DNA immunogenic composition is contemplated, as is priming with a DNA immunogenic composition and boosting with a peptide immunogenic composition.

The present disclosure also encompasses a method for producing a vaccine composition comprising the steps of:
 a) Optionally, identifying at least one neoantigenic peptide according to the method as previously described;
 b) producing said at least one neoantigenic peptide, at least one polypeptide encoding neoantigenic peptide (s), or at least a vector comprising said polypeptide(s) as described herein; and
 c) optionally adding physiologically acceptable buffer, excipient and/or adjuvant and producing a vaccine with said at least one neoantigenic peptide, polypeptide or vector.

Another aspect of the present disclosure, is a method for producing a DC vaccine, wherein said DCs present at least one neoantigenic peptide as herein disclosed.

Antibodies TCRs, CARs and Derivatives Thereof

The present disclosure also relates to an antibody or an antigen-binding fragment thereof that specifically binds a neoantigenic peptide as herein defined.

In some embodiments, the neoantigenic peptide is in association with an MHC or HLA molecule.

Typically, said antibody, or antigen-binding fragment thereof binds a neoantigenic peptide as herein defined, alone or optionally in association with an MHC or HLA molecule, with a Kd binding affinity of $10^{-7}$ M or less, $10^{-8}$ M or less, $10^{-9}$ M or less, $10^{-10}$ M or less, or $10^{-11}$ M or less.

To promote the infiltration and recognition of tumor cells by lymphocytes T (LT), another strategy consists in using antibodies capable of recognizing more than one antigenic target simultaneously and more particularly two antigenic targets simultaneously. There are many formats of bispecific antibodies. BiTE (bi-specific T-cell engager) are the first to have been developed. These are proteins of fusion consisting of two scFvs (variable domains heavy VH and light VL chains) from two antibodies linked by a binding peptide: one recognizes the LT marker (CD3+) and the other a tumor antigen. The goal is to favor recruitment and activation of LTs in contact with tumor, thus leading to cell lysis tumor (See for review Patrick A. Baeuerle and Carsten Reinhardt: Bispecific T-Cell Engaging Antibodies for Cancer Therapy; Cancer Res 2009:69: (12). Jun. 15, 2009; and Galaine et al., Innovations & Thérapeutiques en Oncologie, vol. 3-no 3-7, mai-août 2017).

In a particular embodiment, said antibody is a bi-specific T-cell engager that targets a tumor neoantigenic peptide as herein defined, optionally in association with a MHC or an HLA molecule and which further targets at least an immune cell antigen. Typically, the immune cell is a T cell, a NK cell or a dendritic cell. In this context, the targeted immune cell antigen may be for example CD3, CD16, CD30 or a TCR.

The term "antibody" herein is used in the broadest sense and includes polyclonal and monoclonal antibodies, including intact antibodies and functional (antigen-binding) antibody fragments, including fragment antigen binding (Fab) fragments, F(ab') 2 fragments, Fab' fragments, Fv fragments, recombinant IgG (rIgG) fragments, variable heavy chain (VH) regions capable of specifically binding the antigen, single chain antibody fragments, including single chain variable fragments (scFv), and single domain antibodies (e.g., VHH antibodies, sdAb, sdFv, nanobody) fragments. The term encompasses genetically engineered and/or otherwise variants modified forms of immunoglobulins, such as intrabodies, peptibodies, chimeric antibodies, fully human antibodies, humanized antibodies, and heteroconjugate antibodies, multispecific, e.g., bispecific, antibodies, diabodies, triabodies, and tetrabodies, tandem di-scFv, tandem tri-scFv. Unless otherwise stated, the term "antibody" should be understood to encompass functional antibody and fragments thereof. The term also encompasses intact or full-length antibodies, including antibodies of any class or sub-class, including IgG and sub-classes thereof, IgG1, IgG2, IgG3, IgG4, IgM, IgE, IgA, and IgD. In some embodiments, the antibody comprises a light chain variable domain and a heavy chain variable domain, e.g. in an scFv format.

Antibodies include variant polypeptide species that have one or more amino acid substitutions, insertions, or deletions in the native amino acid sequence, provided that the antibody retains or substantially retains its specific binding function. Conservative substitutions of amino acids are well known and described above.

The present disclosure further includes a method of producing an antibody, or antigen-binding fragment thereof, comprising a step of selecting antibodies that bind to a tumor neoantigen peptide as herein defined, optionally in association with an MHC or HLA molecule, with a Kd binding affinity of about $10^{-6}$ M or less, $10^{-7}$ M or less, $10^{-8}$ M or less, $10^{-9}$ M or less, $10^{-10}$ M or less, or $10^{-11}$ M or less.

In some embodiments, the antibodies are selected from a library of human antibody sequences. In some embodiments, the antibodies are generated by immunizing an animal with a polypeptide comprising the neoantigenic peptide, optionally in association with an MHC or HLA molecule, followed by the selection step.

Antibodies including chimeric, humanized or human antibodies can be further affinity matured and selected as described above. Humanized antibodies contain rodent-sequence derived CDR regions: typically the rodent CDRs are engrafted into a human framework, and some of the human framework residues may be back-mutated to the original rodent framework residue to preserve affinity, and/or one or a few of the CDR residues may be mutated to increase affinity. Fully human antibodies have no murine sequence, and are typically produced via phage display technologies of human antibody libraries, or immunization of transgenic mice whose native immunoglobin loci have been replaced with segments of human immunoglobulin loci.

Antibodies produced by said method, as well as immune cells expressing such antibodies or fragments thereof are also encompassed by the present disclosure.

The present disclosure also encompasses pharmaceutical compositions comprising one or more antibodies as herein disclosed alone or in combination with at least one other agent, such as a stabilizing compound, which may be administered in any sterile, biocompatible pharmaceutical carrier and optionally formulated with formulated with sterile pharmaceutically acceptable buffer(s), diluent(s), and/or excipient(s). Pharmaceutically acceptable carriers typically enhance or stabilize the composition, and/or can be used to facilitate preparation of the composition. Pharmaceutically acceptable carriers include solvents, dispersion media, coatings, antibacterial and antifungal agents, isotonic and absorption delaying agents, and the like that are physiologically compatible and in some embodiments pharmaceutically inert.

Administration of a pharmaceutical composition comprising antibodies as herein disclosed can be accomplished orally or parenterally. Methods of parenteral delivery include topical, intra-arterial (directly to the tumor), intramuscular, spinal, subcutaneous, intramedullary, intrathecal, intraventricular, intravenous, intraperitoneal, or intranasal administration.

Thus, in addition to the active ingredients, these pharmaceutical compositions may contain suitable pharmaceutically acceptable carriers comprising excipients and auxiliaries which facilitate processing of the active compounds into preparations which can be used pharmaceutically. Further details on techniques for formulation and administration may be found in the latest edition of Remington's Pharmaceutical Sciences (Ed. Maack Publishing Co, Easton, Pa.).

Depending on the route of administration, the active compound, i.e., antibody, bispecific and multispecific molecule, may be coated in a material to protect the compound from the action of acids and other natural conditions that may inactivate the compound.

The composition is typically sterile and preferably fluid. Proper fluidity can be maintained, for example, by use of coating such as lecithin, by maintenance of required particle size in the case of dispersion and by use of surfactants. In many cases, it is preferable to include isotonic agents, for example, sugars, polyalcohols such as mannitol or sorbitol, and sodium chloride in the composition. Long-term absorption of the injectable compositions can be brought about by including in the composition an agent which delays absorption, for example, aluminum monostearate or gelatin.

Pharmaceutical compositions for oral administration can be formulated using pharmaceutically acceptable carriers well known in the art in dosages suitable for oral administration. Such carriers enable the pharmaceutical compositions to be formulated as tablets, pills, dragees, capsules, liquids, gels, syrups, slurries, suspensions and the like, for ingestion by the patient.

Pharmaceutical preparations for oral use can be obtained through combination of active compounds with solid excipient, optionally grinding a resulting mixture, and processing the mixture of granules, after adding suitable auxiliaries, if desired, to obtain tablets or dragee cores. Suitable excipients are carbohydrate or protein fillers such as sugars, including lactose, sucrose, mannitol, or sorbitol: starch from corn, wheat, rice, potato, or other plants: cellulose such as methyl, cellulose, hydroxypropylmethylcellulose, or sodium carboxymethylcellulose; and gums including arabic and tragacanth; and proteins such as gelatin and collagen. If desired, disintegrating or solubilizing agents may be added, such as the cross-linked polyvinyl pyrrolidone, agar, alginic acid, or a salt thereof, such as sodium alginate.

Dragee cores are provided with suitable coatings such as concentrated sugar solutions, which may also contain gum arabic, talc, polyvinylpyrrolidone, carbopol gel, polyethylene glycol and/or titanium dioxide, lacquer solutions, and suitable organic solvents or solvent mixtures. Dyestuffs or pigments may be added to the tablets or dragee coatings for product identification or to characterize the quantity of active compound, ie. dosage.

Pharmaceutical preparations that can be used orally include push-fit capsules made of gelatin, as well as soft, sealed capsules made of gelatin and a coating such as glycerol or sorbitol. Push-fit capsules can contain active ingredients mixed with a filler or binders such as lactose or starches, lubricants such as talc or magnesium stearate, and optionally, stabilizers. In soft capsules, the active compounds may be dissolved or suspended in suitable liquids, such as fatty oils, liquid paraffin, or liquid polyethylene glycol with or without stabilizers.

Pharmaceutical formulations for parenteral administration include aqueous solutions of active compounds. For injection, the pharmaceutical compositions of the invention may be formulated in aqueous solutions, preferably in physiologically compatible buffers such as Hank's solution, Ringer's solution, or physiologically buffered saline. Aqueous injection suspensions may contain substances that increase viscosity of the suspension, such as sodium carboxymethyl cellulose, sorbitol, or dextran. Additionally, suspensions of the active compounds may be prepared as appropriate oily injection suspensions. Suitable lipophilic solvents or vehicles include fatty oils such as sesame oil, or synthetic fatty acid esters, such as ethyl oleate or triglycerides, or liposomes. Optionally, the suspension may also contain suitable stabilizers or agents which increase the solubility of the compounds to allow for the preparation of highly concentrated solutions.

For topical or nasal administration, penetrants appropriate to the particular barrier to be permeated are used in the formulation. Such penetrants are generally known in the art.

Pharmaceutical compositions of the disclosure can be prepared in accordance with methods well known and routinely practiced in the art. See. e.g., Remington: The Science and Practice of Pharmacy, Mack Publishing Co., 20th ed., 2000; and Sustained and Controlled Release Drug Delivery Systems, J R. Robinson, ed., Marcel Dekker, Inc., New York, 1978. Pharmaceutical compositions are preferably manufactured under GMP conditions.

The present disclosure also encompasses a T cell receptor (TCR) that targets a neoantigenic peptide as herein defined in association with an MHC or HLA molecule.

The present disclosure further includes a method of producing a TCR, or an antigen-binding fragment thereof, comprising a step of selecting TCRs that bind to a tumor neoantigen peptide as herein defined, optionally in association with an MHC or HLA molecule, with a Kd binding affinity of about $10^{-6}$ M or less, $10^{-7}$ M or less, $10^{-8}$ M or less, $10^{-9}$ M or less, $10^{-10}$ M or less, or $10^{-11}$ M or less.

Nucleic acid encoding the TCR can be obtained from a variety of sources, such as by polymerase chain reaction (PCR) amplification of naturally occurring TCR DNA sequences, followed by expression of antibody variable regions, followed by the selecting step described above. In some embodiments, the TCR is obtained from T-cells isolated from a patient, or from cultured T-cell hybridomas. In some embodiments, the TCR clone for a target antigen has been generated in transgenic mice engineered with human immune system genes (e.g., the human leukocyte antigen system, or HLA). See, e.g., tumor antigens (see, e.g., Parkhurst et al. (2009) Clin Cancer Res. 15:169-180 and Cohen et al. (2005) J Immunol. 175:5799-5808. In some embodiments, phage display is used to isolate TCRs against a target antigen (see, e.g., Varela-Rohena et al. (2008) Nat Med. 14:1390-1395 and Li (2005) Nat Biotechnol. 23:349-354.

A "T cell receptor" or "TCR" refers to a molecule that contains a variable α and β chains (also known as TCRa and TCRb, respectively) or a variable γ and δ chains (also known as TCRg and TCRd, respectively) and that is capable of specifically binding to an antigen peptide bound to a MHC receptor. In some embodiments, the TCR is in the αβ form. Typically, TCRs that exist in αβ and γδ forms are generally structurally similar, but T cells expressing them may have distinct anatomical locations or functions. A TCR can be found on the surface of a cell or in soluble form. Generally, a TCR is found on the surface of T cells (or T lymphocytes) where it is generally responsible for recognizing antigens bound to major histocompatibility complex (MHC) molecules. In some embodiments, a TCR also can contain a constant domain, a transmembrane domain and/or a short cytoplasmic tail (see, e.g., Janeway et ah, Immunobiology: The Immune System in Health and Disease, 3 rd Ed., Current Biology Publications, p. 4:33, 1997). For example, in some aspects, each chain of the TCR can possess one N-terminal immunoglobulin variable domain, one immunoglobulin constant domain, a transmembrane region, and a short cytoplasmic tail at the C-terminal end. In some embodiments, a TCR is associated with invariant proteins of the CD3 complex involved in mediating signal transduction. Unless otherwise stated, the term "TCR" should be understood to encompass functional TCR fragments thereof. The term also encompasses intact or full-length TCRs, including TCRs in the αβ form or γδ form.

Thus, for purposes herein, reference to a TCR includes any TCR or functional fragment, such as an antigen-binding portion of a TCR that binds to a specific antigenic peptide bound in an MHC molecule, i.e. MHC-peptide complex. An "antigen-binding portion" or antigen-binding fragment" of a TCR, which can be used interchangeably, refers to a molecule that contains a portion of the structural domains of a TCR, but that binds the antigen (e.g. MHC-peptide complex) to which the full TCR binds. In some cases, an antigen-binding portion contains the variable domains of a TCR, such as variable α chain and variable β chain of a TCR, sufficient to form a binding site for binding to a specific MHC-peptide complex, such as generally where each chain contains three complementarity determining regions.

In some embodiments, the variable domains of the TCR chains associate to form loops, or complementarity determining regions (CDRs) analogous to immunoglobulins, which confer antigen recognition and determine peptide specificity by forming the binding site of the TCR molecule and determine peptide specificity. Typically, like immunoglobulins, the CDRs are separated by framework regions (FRs) {see, e.g., Jores et al., Pwc. Nat'l Acad. Sci. U.S.A. 87:9138, 1990: Chothia et al., EMBO J. 7:3745, 1988; see also Lefranc et al., Dev. Comp. Immunol. 27:55, 2003). In some embodiments, CDR3 is the main CDR responsible for recognizing processed antigen, although CDR1 of the alpha chain has also been shown to interact with the N-terminal part of the antigenic peptide, whereas CDR1 of the beta chain interacts with the C-terminal part of the peptide. CDR2 is thought to recognize the MHC molecule. In some embodiments, the variable region of the β-chain can contain a further hypervariability (HV4) region.

In some embodiments, the TCR chains contain a constant domain. For example, like immunoglobulins, the extracellular portion of TCR chains {e.g., α-chain, β-chain) can contain two immunoglobulin domains, a variable domain {e.g., Va or Vp: typically amino acids 1 to 116 based on Kabat numbering Kabat et al., "Sequences of Proteins of Immunological Interest, US Dept. Health and Human Services, Public Health Service National Institutes of Health, 1991, 5th ed.) at the N-terminus, and one constant domain {e.g., a-chain constant domain or Ca, typically amino acids 117 to 259 based on Kabat, β-chain constant domain or Cp, typically amino acids 117 to 295 based on Kabat) adjacent to the cell membrane. For example, in some cases, the extracellular portion of the TCR formed by the two chains contains two membrane-proximal constant domains, and two membrane-distal variable domains containing CDRs. The constant domain of the TCR domain contains short connecting sequences in which a cysteine residue forms a disulfide bond, making a link between the two chains. In some embodiments, a TCR may have an additional cysteine residue in each of the α and β chains such that the TCR contains two disulfide bonds in the constant domains.

In some embodiments, the TCR chains can contain a transmembrane domain. In some embodiments, the transmembrane domain is positively charged. In some cases, the TCR chains contain a cytoplasmic tail. In some cases, the structure allows the TCR to associate with other molecules like CD3. For example, a TCR containing constant domains with a transmembrane region can anchor the protein in the cell membrane and associate with invariant subunits of the CD3 signaling apparatus or complex.

Generally, CD3 is a multi-protein complex that can possess three distinct chains (γ, δ, and ε) in mammals and the ζ-chain. For example, in mammals the complex can contain a CD3y chain, a CD35 chain, two CD3s chains, and a homodimer of CD3ζ chains. The CD3y, CD35, and CD3s chains are highly related cell surface proteins of the immunoglobulin superfamily containing a single immunoglobulin domain. The transmembrane regions of the CD3y, CD35, and CD3s chains are negatively charged, which is a characteristic that allows these chains to associate with the positively charged T cell receptor chains. The intracellular tails of the CD3y, CD35, and CD3s chains each contain a single conserved motif known as an immunoreceptor tyrosine-based activation motif or ITAM, whereas each CD3ζ chain has three. Generally, ITAMs are involved in the signaling capacity of the TCR complex. These accessory molecules have negatively charged transmembrane regions and play a role in propagating the signal from the TCR into the cell. The CD3- and ζ-chains, together with the TCR, form what is known as the T cell receptor complex.

In some embodiments, the TCR may be a heterodimer of two chains α and β (or optionally γ and δ) or it may be a single chain TCR construct. In some embodiments, the TCR is a heterodimer containing two separate chains (α and β chains or γ and δ chains) that are linked, such as by a disulfide bond or disulfide bonds.

While T-cell receptors (TCRs) are transmembrane proteins and do not naturally exist in soluble form, antibodies can be secreted as well as membrane bound. Importantly, TCRs have the advantage over antibodies that they in principle can recognize peptides generated from all degraded cellular proteins, both intra- and extracellular, when presented in the context of MHC molecules. Thus TCRs have important therapeutic potential.

The present disclosure also relates to soluble T-cell receptors (sTCRs) that contain the antigen recognition part directed against a tumor neoantigenic peptide as herein disclosed (see notably Walseng E, Wälchli S, Fallang L-E, Yang W, Vefferstad A, Areffard A, et al. (2015) Soluble T-Cell Receptors Produced in Human Cells for Targeted Delivery. PLOS ONE 10 (4): e0119559). In a particular embodiment, the soluble TCR can be fused to an antibody fragment directed to a T cell antigen, optionally wherein the targeted antigen is CD3 or CD16 (see for example Boudousquie, Caroline et al. "Polyfunctional response by ImmTAC (IMCgp100) redirected CD8+ and CD4+ T cells." Immunology vol. 152.3 (2017): 425-438. doi: 10.1111/imm.12779).

The present disclosure also encompasses a chimeric antigen receptor (CAR) which is directed against a tumor neoantigenic peptide as herein disclosed. CARs are fusion proteins comprising an antigen-binding domain, typically derived from an antibody, linked to the signalling domain of the TCR complex. CARs can be used to direct immune cells such T-cells or NK cells against a tumor neoantigenic peptide as previously defined with a suitable antigen-binding domain selected.

The antigen-binding domain of a CAR is typically based on a scFv (single chain variable fragment) derived from an antibody. In addition to an N-terminal, extracellular antibody-binding domain, CARs typically may comprise a hinge domain, which functions as a spacer to extend the antigen-binding domain away from the plasma membrane of the immune effector cell on which it is expressed, a transmembrane (TM) domain, an intracellular signalling domain (e.g. the signalling domain from the zeta chain of the CD3 molecule (CD3ζ) of the TCR complex, or an equivalent) and optionally one or more co-stimulatory domains which may assist in signalling or functionality of the cell expressing the CAR. Signalling domains from co-stimulatory molecules including CD28, OX-40 (CD134), and 4-1BB (CD137) can be added alone (second generation) or in combination (third generation) to enhance survival and increase proliferation of CAR modified T cells. Potential co-stimulatory domains also include ICOS-1, CD27, GITR, and DAP10.

Thus, the CAR may include
(1) In its extracellular portion, one or more antigen binding molecules, such as one or more antigen-binding fragment, domain, or portion of an antibody, or one or more antibody variable domains, and/or antibody molecules.
(2) In its transmembrane portion, a transmembrane domain derived from human T cell receptor-alpha or -beta chain, a CD3 zeta chain, CD28, CD3-epsilon, CD45, CD4, CD5, CD8, CD9, CD16, CD22, CD33, CD37, CD64, CD80, CD86, CD134, CD137, ICOS, CD154, or a GITR. In some embodiments, the transmembrane domain is derived from CD28, CD8 or CD3-zeta.
(3) One or more co-stimulatory domains, such as co-stimulatory domains derived from human CD28, 4-1BB (CD137), ICOS-1, CD27, OX 40 (CD137), DAP10, and GITR (AITR). In some embodiments, the CAR comprises co-stimulating domains of both CD28 and 4-1BB.
(4) In its intracellular signalling domain, an intracellular signalling domain comprising one or more ITAMs, for example, the intracellular signalling domain is CD3-zeta, or a variant thereof lacking one or two ITAMs (e.g. ITAM3 and ITAM2), or the intracellular signalling domain is derived from FcεRIγ.

The CAR can be designed to recognize tumor neoantigenic peptide alone or in association with an HLA or MHC molecule.

Exemplary antigen receptors, including CARs and recombinant TCRs, as well as methods for engineering and introducing the receptors into cells, include those described, for example, in international patent application publication numbers WO200014257, WO2013126726, WO2012/129514, WO2014031687, WO2013/166321, WO2013/071154, WO2013/123061 U.S. patent application publication numbers US2002131960, US2013287748, US20130149337, U.S. Pat. Nos. 6,451,995, 7,446,190, 8,252,592, 8,339,645, 8,398,282, 7,446,179, 6,410,319, 7,070,995, 7,265,209, 7,354,762, 7,446,191, 8,324,353, and 8,479,118, and European patent application number EP2537416, and/or those described by Sadelain et al., Cancer Discov. 2013 April: 3 (4): 388-398; Davila et al. (2013) PLOS ONE 8 (4): e61338; Turtle et al., Curr. Opin. Immunol., 2012 October: 24 (5): 633-39; Wu et al., Cancer, 2012 Mar. 18 (2): 160-75. In some aspects, the genetically engineered antigen receptors include a CAR as described in U.S. Pat. No. 7,446,190, and those described in International Patent Application Publication No.: WO/2014055668 A1.

The present disclosure also encompasses polynucleotides encoding antibodies, antigen-binding fragments or derivatives thereof, TCRs and CARs as previously described as well as vector comprising said polynucleotide(s).

Immune Cells

The present disclosure further encompasses immune cells which target one or more tumor neoantigenic peptides as previously described.

As used herein, the term "immune cell" includes cells that are of hematopoietic origin and that play a role in the immune response. Immune cells include lymphocytes, such as B cells and T cells, natural killer cells, myeloid cells, such as monocytes, macrophages, eosinophils, mast cells, basophils, and granulocytes.

As used herein, the term "T cell" includes cells bearing a T cell receptor (TCR), in particular TCR directed against a tumor neoantigenic peptide as herein disclosed. T-cells according to the present disclosure can be selected from the group consisting of inflammatory T-lymphocytes, cytotoxic T-lymphocytes, regulatory T-lymphocytes, Mucosal-Associated Invariant T cells (MAIT), γδ T cell, tumour infiltrating lymphocyte (TILs) or helper T-lymphocytes included both type 1 and 2 helper T cells and Th17 helper cells. In another embodiment, said cell can be derived from the group consisting of CD4+ T-lymphocytes and CD8+ T-lymphocytes. Said immune cells may originate from a healthy donor or from a subject suffering from a cancer.

Immune cells can be extracted from blood or derived from stem cells. The stem cells can be adult stem cells, embryonic stem cells, more particularly non-human stem cells, cord blood stem cells, progenitor cells, bone marrow stem cells, induced pluripotent stem cells, totipotent stem cells or hematopoietic stem cells. Representative human cells are CD34+ cells.

T-cells can be obtained from a number of non-limiting sources, including peripheral blood mononuclear cells, bone marrow; lymph node tissue, cord blood, thymus tissue, tissue from a site of infection, ascites, pleural effusion, spleen tissue, and tumors. In certain embodiments, T-cells can be obtained from a unit of blood collected from a subject using any number of techniques known to the skilled person, such as FICOLL™ separation. In one embodiment, cells from the circulating blood of a subject are obtained by apheresis. In certain embodiments, T-cells are isolated from PBMCs. PBMCs may be isolated from buffy coats obtained by density gradient centrifugation of whole blood, for instance centrifugation through a LYMPHOPREP™ gradient, a PERCOLL™ gradient or a FICOLL™ gradient. T-cells may be isolated from PBMCs by depletion of the monocytes, for instance by using CD14 DYNABEADS®. In some embodiments, red blood cells may be lysed prior to the density gradient centrifugation.

In another embodiment, said cell can be derived from a healthy donor, from a subject diagnosed with cancer. The cell can be autologous or allogeneic.

In allogeneic immune cell therapy, immune cells are collected from healthy donors, rather than the patient. Typically these are HLA matched to reduce the likelihood of graft vs. host disease. Alternatively, universal "off the shelf" products that may not require HLA matching comprise modifications designed to reduce graft vs. host disease, such as disruption or removal of the TCRαβ receptor. See Graham et al., Cells. 2018 October: 7 (10): 155 for a review. Because a single gene encodes the alpha chain (TRAC) rather than the two genes encoding the beta chain, the TRAC locus is a typical target for removing or disrupting TCRαβ receptor expression. Alternatively, inhibitors of TCRαβ signalling may be expressed, e.g. truncated forms of CD3ζ can act as a TCR inhibitory molecule. Disruption or removal of HLA class I molecules has also been employed. For example, Torikai et al., Blood. 2013:122: 1341-1349 used ZFNs to knock out the HLA-A locus, while Ren et al., Clin. Cancer Res. 2017:23:2255-2266 knocked out Beta-2 microglobulin (B2M), which is required for HLA class I expression. Ren et al. simultaneously knocked out TCRαβ, B2M and the immune-checkpoint PD1. Generally, the immune cells are activated and expanded to be utilized in the adoptive cell therapy. The immune cells as herein disclosed can be expanded in vivo or ex vivo. The immune cells, in particular T-cells can be activated and expanded generally using methods known in the art. Generally the T-cells are expanded by contact with a surface having attached thereto an agent that stimulates a CD3/TCR complex associated signal and a ligand that stimulates a co-stimulatory molecule on the surface of the T cells.

In one embodiment of the present disclosure, the immune cell can be modified to be directed to tumor neoantigenic peptides as previously defined. In a particular embodiment, said immune cell may express a recombinant antigen receptor directed to said neoantigenic peptide its cell surface. By "recombinant" is meant an antigen receptor which is not encoded by the cell in its native state, i.e. it is heterologous, non-endogenous. Expression of the recombinant antigen receptor can thus be seen to introduce new antigen specificity to the immune cell, causing the cell to recognise and bind a previously described peptide. The antigen receptor may be isolated from any useful source. In some embodiments, the cells comprise one or more nucleic acids introduced via genetic engineering that encode one or more antigen receptors, wherein the antigen include at least one tumor neoantigenic peptide as per the present disclosure.

Among the antigen receptors as per the present disclosure are genetically engineered T cell receptors (TCRs) and components thereof, as well as functional non-TCR antigen receptors, such as chimeric antigen receptors (CAR) as previously described.

Methods by which immune cells can be genetically modified to express a recombinant antigen receptor are well known in the art. A nucleic acid molecule encoding the antigen receptor may be introduced into the cell in the form of e.g. a vector, or any other suitable nucleic acid construct. Vectors, and their required components, are well known in the art. Nucleic acid molecules encoding antigen receptors can be generated using any method known in the art, e.g. molecular cloning using PCR. Antigen receptor sequences can be modified using commonly-used methods, such as site-directed mutagenesis.

The present disclosure also relates to a method for providing a T cell population which targets a tumor neoantigenic peptide as herein disclosed.

The T cell population may comprise CD8+ T cells, CD4+ T cells or CD8+ and CD4+ T cells. T cell populations produced in accordance with the present disclosure may be enriched with T cells that are specific to, i.e. target, the tumor neoantigenic peptide of the present disclosure.

That is, the T cell population that is produced in accordance with the present disclosure will have an increased number of T cells that target one or more tumor neoantigenic peptide. For example, the T cell population of the disclosure will have an increased number of T cells that target a tumor neoantigenic peptide compared with the T cells in the sample isolated from the subject. That is to say, the composition of the T cell population will differ from that of a "native" T cell population (i.e. a population that has not undergone the identification and expansion steps discussed herein), in that the percentage or proportion of T cells that target a tumor neoantigenic peptide will be increased.

T cell populations produced in accordance with the present disclosure may be enriched with T cells that are specific to, i.e. target, tumor neoantigenic peptide. That is, the T cell population that is produced in accordance with the present disclosure will have an increased number of T cells that target one or more tumor neoantigenic peptide of the present disclosure. For example, the T cell population of the present disclosure will have an increased number of T cells that target a tumor neoantigenic peptide compared with the T cells in the sample isolated from the subject. That is to say, the composition of the T cell population will differ from that of a "native" T cell population (i.e. a population that has not undergone the identification and expansion steps discussed herein), in that the percentage or proportion of T cells that target a tumor neoantigenic peptide will be increased.

The T cell population according to the present disclosure may have at least about 0.2, 0.3, 0.4, 0.5, 0.6, 0.7, 0.8, 0.9, 1, 2, 3, 4, 5, 6, 7, 8, 9, 10, 11, 12, 13, 14, 15, 16, 17, 18, 19, 20, 25, 30, 35, 40, 45, 50, 55, 60, 65, 70, 75, 80, 85, 90, 95 or 100% T cells that target a tumor neoantigenic peptide as herein disclosed. For example, the T cell population may have about 0.2%-5%, 5%-10%, 10-20%, 20-30%, 30-40%, 40-50%, 50-70% or 70-100% T cells that target a tumor neoantigenic peptide of the present disclosure.

An expanded population of tumor neoantigenic peptide-reactive T cells may have a higher activity than a population of T cells not expanded, for example, using a tumor neoantigenic peptide. Reference to "activity" may represent the response of the T cell population to restimulation with a tumor neoantigenic peptide, e.g. a peptide corresponding to the peptide used for expansion, or a mix of tumor neoantigenic peptide. Suitable methods for assaying the response are known in the art. For example, cytokine production may be measured (e.g. IL2 or IFNy production may be measured). The reference to a "higher activity" includes, for example, a 1-5, 5-10, 10-20, 20-50, 50-100, 100-500, 500-1000-fold increase in activity. In one aspect the activity may be more than 1000-fold higher.

In a preferred embodiment present disclosure provides a plurality or population, i.e. more than one, of T cells wherein the plurality of T cells comprises a T cell which recognizes a clonal tumor neoantigenic peptide and a T cell which recognizes a different clonal tumor neoantigenic peptide. As such, the present disclosure provides a plurality of T cells which recognize different clonal tumor neoantigenic peptide. Different T cells in the plurality or population may alternatively have different TCRs which recognize the same tumor neoantigenic peptide.

In a preferred embodiment the number of clonal tumor neoantigenic peptide recognized by the plurality of T cells is from 2 to 1000. For example, the number of clonal neoantigens recognized may be 2, 3, 4, 5, 6, 7, 8, 9, 10, 20, 50, 100, 150, 200, 250, 300, 350, 400, 450, 500, 550, 600, 650, 700, 750, 800, 850, 900, 950 or 1000, preferably 2 to 100. There may be a plurality of T cells with different TCRs but which recognize the same clonal neo-antigen.

The T cell population may be all or primarily composed of CD8+ T cells, or all or primarily composed of a mixture of CD8+ T cells and CD4+ T cells or all or primarily composed of CD4+ T cells.

In particular embodiments, the T cell population is generated from T cells isolated from a subject with a tumor. For example, the T cell population may be generated from T cells in a sample isolated from a subject with a tumor. The sample may be a tumor sample, a peripheral blood sample or a sample from other tissues of the subject.

In a particular embodiment the T cell population is generated from a sample from the tumor in which the tumor neoantigenic peptide is identified. In other words, the T cell population is isolated from a sample derived from the tumor of a patient to be treated. Such T cells are referred to herein as 'tumor infiltrating lymphocytes' (TILs).

T cells may be isolated using methods which are well known in the art. For example, T cells may be purified from single cell suspensions generated from samples on the basis of expression of CD3, CD4 or CD8. T cells may be enriched from samples by passage through a Ficoll-paque gradient.

Cancer Therapeutic Methods

In any of the embodiments, the Cancer Therapeutic Products described herein may be used in methods for inhibiting proliferation of cancer cells. The Cancer Therapeutic Products described herein may also be used in the treatment of cancer, in patients suffering from cancer, or for the prophylactic treatment of cancer, in patients at risk of cancer.

Cancers that can be treated using the therapy described herein include any solid or non-solid tumors as previously defined. Of particular interest according to the present disclosure are breast cancer, melanoma and lung cancer. In a specific embodiment of the present disclosure, the cancer is non-small cell lung cancer (NSCLC).

Cancers includes also the cancers which are refractory to treatment with other chemotherapeutics. The term "refractory, as used herein refers to a cancer (and/or metastases thereof), which shows no or only weak antiproliferative response (e.g., no or only weak inhibition of tumor growth) after treatment with another chemotherapeutic agent. These are cancers that cannot be treated satisfactorily with other chemotherapeutics. Refractory cancers encompass not only (i) cancers where one or more chemotherapeutics have already failed during treatment of a patient, but also (ii) cancers that can be shown to be refractory by other means, e.g., biopsy and culture in the presence of chemotherapeutics.

The therapy described herein is also applicable to the treatment of patients in need thereof who have not been previously treated.

A subject as per the present disclosure is typically a patient in need thereof that has been diagnosed with cancer or is at risk of developing cancer. The subject is typically a human, dog, cat, horse or any animal in which a tumor specific immune response is desired.

The present disclosure also pertains to a neoantigenic peptide, a population of APCs, a vaccine or immunogenic composition, a polynucleotide encoding a neoantigenic peptide or a vector as previously defined for use in cancer vaccination therapy of a subject or for treating cancer in a subject, wherein the peptide(s) binds at least one MHC molecule of said subject.

The present disclosure also provides a method for treating cancer in a subject comprising administering a vaccine or immunogenic composition as described herein to said subject in a therapeutically effective amount to treat the subject. The method may additionally comprise the step of identifying a subject who has cancer.

The present disclosure also relates to a method of treating cancer comprising producing an antibody or antigen-binding fragment thereof by the method as herein described and administering to a subject with cancer said antibody or antigen-binding fragment thereof, or with an immune cell expressing said antibody or antigen-binding fragment thereof, in a therapeutically effective amount to treat said subject.

The present disclosure also relates to an antibody (including variants and derivatives thereof), a T cell receptor (TCR) (including variants and derivatives thereof), or a CAR (including variants and derivatives thereof) which are directed against a tumor neoantigenic peptide as herein described, optionally in association with an MHC or HLA molecule, for use in cancer therapy of a subject, wherein the tumor neoantigenic peptide binds at least one MHC molecule of said subject.

The present disclosure also relates to an antibody (including variants and derivatives thereof), a T cell receptor (TCR) (including variants and derivatives thereof), or a CAR (including variants and derivatives thereof) which are directed against a tumor neoantigenic peptide as herein described, optionally in association with an MHC or HLA molecule, or an immune cell which targets a neoantigenic peptide, as previously defined, for use in adoptive cell or CAR-T cell therapy in a subject, wherein the tumor neoantigenic peptide binds at least one MHC molecule of said subject.

Typically, the skilled person is able to select an appropriate antigen receptor which binds and recognizes a tumor neoantigenic peptide as previously defined with which to redirect an immune cell to be used for use in cancer cell therapy. In a particular embodiment, the immune cell for use in the method of the present disclosure is a redirected T-cell, e.g. a redirected CD8+ and/or CD4+ T-cell.

In some embodiments, cancer treatment, vaccination therapy and/or adoptive cell cancer therapy as above described are administered in combination with additional cancer therapies. In particular, the T cell compositions according to the present disclosure may be administered in combination with checkpoint blockade therapy, co-stimulatory antibodies, chemotherapy and/or radiotherapy, targeted therapy or monoclonal antibody therapy.

Checkpoint inhibitors include, but are not limited to, PD-1 inhibitors, PD-L1 inhibitors, Lag-3 inhibitors, Tim-3 inhibitors, TIGIT inhibitors, BTLA inhibitors, V-domain Ig suppressor of T-cell activation (VISTA) inhibitors and CTLA-4 inhibitors, IDO inhibitors for example. Co-stimulatory antibodies deliver positive signals through immune-regulatory receptors including but not limited to ICOS, CD137, CD27 OX-40 and GITR. In a preferred embodiment the checkpoint inhibitor is a CTLA-4 inhibitor.

A chemotherapeutic entity as used herein refers to an entity which is destructive to a cell, that is the entity reduces the viability of the cell. The chemotherapeutic entity may be a cytotoxic drug. A chemotherapeutic agent contemplated includes, without limitation, alkylating agents, anthracyclines, epothilones, nitrosoureas, ethylenimines/methylmelamine, alkyl sulfonates, alkylating agents, antimetabolites, pyrimidine analogs, epipodophylotoxins, enzymes such as L-asparaginase: biological response modifiers such as IFNa, IL-2, G-CSF and GM-CSF; platinum coordination complexes such as cisplatin, oxaliplatin and carboplatin, anthracenediones, substituted urea such as hydroxyurea, methylhydrazine derivatives including N-methylhydrazine (MIH) and procarbazine, adrenocortical suppressants such as mitotane (o,p'-DDD) and aminoglutethimide: hormones and antagonists including adrenocorticosteroid antagonists such as prednisone and equivalents, dexamethasone and aminoglutethimide: progestin such as hydroxyprogesterone caproate, medroxyprogesterone acetate and megestrol acetate: estrogen such as diethylstilbestrol and ethinyl estradiol equivalents: antiestrogen such as tamoxifen: androgens including testosterone propionate and fluoxymesterone/ equivalents: antiandrogens such as flutamide, gonadotropin-releasing hormone analogs and leuprolide; and non-steroidal antiandrogens such as flutamide.

'In combination' may refer to administration of the additional therapy before, at the same time as or after administration of the T cell composition according to the present disclosure.

In addition or as an alternative to the combination with checkpoint blockade, the T cell composition of the present disclosure may also be genetically modified to render them resistant to immune-checkpoints using gene-editing technologies including but not limited to TALEN and Crispr/Cas. Such methods are known in the art, see e.g. US20140120622. Gene editing technologies may be used to prevent the expression of immune checkpoints expressed by T cells including but not limited to PD-1, Lag-3, Tim-3, TIGIT, BTLA CTLA-4 and combinations of these. The T cell as discussed here may be modified by any of these methods.

The T cell according to the present disclosure may also be genetically modified to express molecules increasing homing into tumours and or to deliver inflammatory mediators into the tumour microenvironment, including but not limited to cytokines, soluble immune-regulatory receptors and/or ligands.

In a particular embodiment, said tumor neoantigenic peptide is used in cancer vaccination therapy in combination with another immunotherapy such as immune checkpoint therapy, more particularly in combination with antibodies anti-PD1, anti-PDL1, anti-CTLA-4, anti-TIM-3, anti-LAG3, anti-GITR.

BRIEF DESCRIPTION OF THE DRAWINGS

FIG. 5A: Number of fusion transcript sequence (TE-exon fusions) in different subtypes of breast cancer (HER2+, TNBC, normal breast tissue and luminal). FIG. 5B Number of fusion transcript sequence (TE-exon fusions) in different subtypes of lung cancer (primary lung adenocarcinomas, normal lung tissue).

FIG. 6A: Samples of different subtypes of breast cancer (HER2+, TNBC, normal breast tissue and luminal). FIG. 6B: Samples of different subtypes of lung cancer (non-small cell lung cancer, normal lung tissue).

FIG. 7A: Numbers of tumor-specific HLA-binding peptides per subtypes of breast cancer patient are shown. FIG. 7B: Numbers of predicted tumor neoantigenic peptides shared across luminal subtypes samples (n=784) (abscissa). FIG. 7C: Numbers of predicted tumor neoantigenic peptides shared across HER2+ subtypes samples (n=100) (abscissa). FIG. 7D: Numbers of predicted tumor neoantigenic peptides shared across TNBC subtypes samples (n=197) (abscissa).

FIG. 8B: Distribution of tumor-specific peptides per patient across lung adenocarcinomas. Numbers of predicted tumor neoantigenic peptides shared across primary tumor subtypes samples (n=516) (abscissa).

FIGS. 9A-9B: Reconstruction of the fusion nucleotide sequence when the donor is the exon (FIG. 9A) and when the donor is the TE (FIG. 9B).

FIG. 11A: Percentage of tetramer positive CD8 T cells for the indicated fusion transcript-derived peptides induced by autologous moDCs in immunogenicity assays for the 6 healthy donors analyzed. FIG. 11B: Cytokine secretion of CTL-clones after stimulation with different concentration of specific peptide. On the right is listed the CTL-clones generated and their peptide specificity. FIG. 11C: Killing assay for CTL-clone 9 in co-culture with target cells loaded with 2 different peptide concentration in combination with anti-MHC-I antibodies or Isotype control (Left panel), or with un-loaded targets cells at different ratios (Right panel). FIG. 11D: Killing assays for CTL-clone 9, 80 and 64 when co-cultured with peptide unloaded target cells in combination with anti-MHCI-I antibodies or isotype control. Effector:Target ratio is indicated in each individual plot. H1650 were used as target cells for each plot of this figure.

FIG. 12. Expression of TCR recognizing fusion-derived peptides. Transduced Jurkat-reporter cells with TCR sequence derived from CTL-clone 9 co-cultured with target cells alone, or loaded with 2 different peptide concentration. Plots show percentage of positive Jurkat cells for the 3 reporter genes evaluated by flow cytometry, using H1650 cell line as target cells (upper plots) or H1395 cell line as target cells (lower plots). Negative control: non-transduced Jurkat cells. No peptide: transduced Jurkat cells co-cultured with peptide unloaded target cells. Positive control: Transduced Jurkat cells stimulated with PMA/ionomycin.

FIG. 14B is shown the percentage of Naïve (CCR7+CD45+), Central Memory (CM, CCR7+CD45−), Effector Memory (EM, CCR7-CD45−) and Terminal Effector (TE, CCR7-CD45+) cells of tetramer positive parental cell population.

EXAMPLES

Figure 1A:
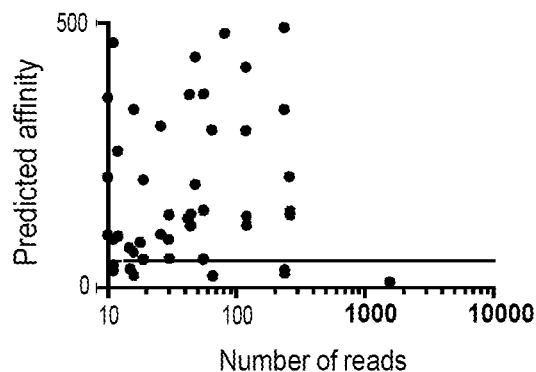
FIGS. 1A-1C: Tumor neoantigenic peptides (or TE-derived epitopes) having a predicted affinity for MHC alleles of less than 500 nM, identified by the in silico method according to the disclosure in the tumor mouse lines B16F10-OVA cells (FIG. 1A) and in MCA101-OVA cells (FIG. 1B) and identified both in the two lines (FIG. 1C).

1. Example 1: Identification of Fusion Transcript Sequence Encoded Tumor Neoantigenic Peptide 1.1 Proof of Concept in Mice To detect individual and shared tumor neoantigenic peptide issued from fusion transcripts sequences, a bioinformatics pipeline has been developed. This pipeline is designed to identify tumor-specific mRNA sequences composed in part of a TE sequence and in part of an exonic sequence. This pipeline implies determining the MHC alleles. For each human sample, the Class I and Class II MHC alleles can be determined using the seq2hla (v2.2) tool (bitbucket.org/sebastian_boegel/seq2hla). For mouse models, murine H-2 alleles are generally known. The bioinformatics method comprises the mapping of transcripts from RNA-sequencing against the reference genome. For the proof of concept analyses described here, mm10) was used for mouse and hg19 for human. Different versions of assembled genomes can be used for example hg19, hg38, mm9 or mm10. This mapping is carried out with STAR (v2.5.3a) (github.com/alexdobin/STAR), with the following setting:

For allowing multi-hits mapping the parameter outFilterMultimapNmax which sets the maximum number of loci, the read is allowed to map to, is set at 1000, and For detecting the abnormal junction (fusion), the parameter chimSegmentMin which sets the minimum length of fusion segment, is set at 10, the parameter chimJunctionOverhangMin which sets the minimum overhang for a fusion junction is set at 10.

Normal (from SJ.out.tab output file) and abnormal (from Chimeric.out.junction output file) junctions are annotated using Ensembl and repeatmasker databases. Normal junctions define all the junctions that match the parameters used for the mapping (maximum intron length <=1 000 000 bp (set by --alignIntronMax), same chromosome and well oriented) and abnormal ones are junctions that do not match with at least one of the previous criteria. This mean that a TE/Exon junction could be in both junction type but a Exon/Exon junction must be in normal file (SJ.out.tab). Transcript sequences comprising a junction between a TE sequence and an exonic sequence are extracted in silico. From the area of the transcript sequence which overlaps the junction, or downstream of the junction when out-of-frame (reading frame non-canonical), the software predicts, in all reading frames, all possible peptides of 8 or 9 mers. Then, the binding affinity of all these possible peptides for the MHC alleles previously defined for is the matched sample determined netMHCpan (v3.4) (cbs.dtu.dk/services/NetMHCpan/). There are currently more than a dozen various prediction algorithms for predicting the binding affinity of peptides, with NetMHC being the most widely used and validated algorithm for neoantigen prediction pipelines.

Peptides with either less than 500 nM or with a percentile rank less than 2% are considered as potential neo-antigens. Each splice site (donor or acceptor) is uniquely annotated as TE or as Exon. The part in the 5' end is qualified "donor", and the part in the 3' is qualified "acceptor".

Predicted HLA-binding peptides shared between cancer and normal tissues are excluded from further analyses.

This method has been applied to RNAseq data obtained from 7 well-characterized murine tumor cell lines (B16F10, B16F10-OVA, MCA101, MCA101-OVA, MC38, MC38-

GFP, MC38-GFP-OVA). The cell lines with the extension-OVA corresponding to the same model but further expressing ovalbumin. In this study, this line is considered as the similar model, that is to say for example that an assay carried out on the cell line from B16F10-OVA is considered as a repeat of an assay carried out on the cell line from B16F10.

Figure 1B:
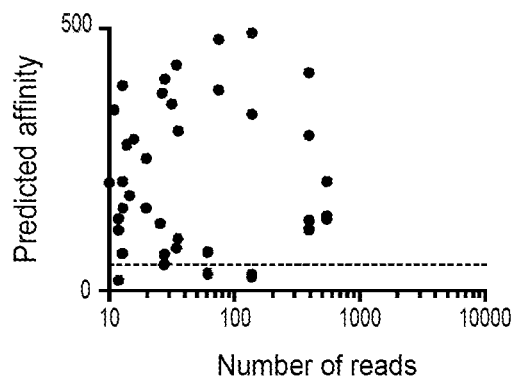
Figure 1C:
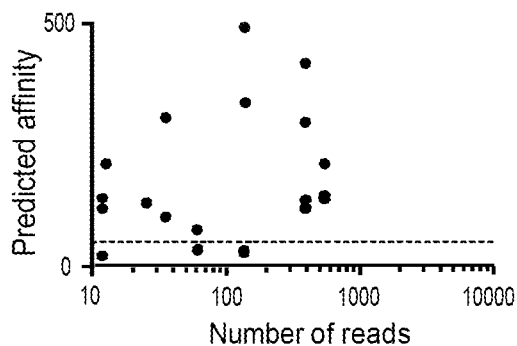

A list of candidate peptides has been obtained with these parameters (FIGS. 1A, 1B and 1C), some were specific to particular cell lines (FIGS. 1A and 1B), and some were shared between the two tumor cell lines (FIG. 1C).

For validation, we selected a range of peptides, expressed either in B16F10-OVA or MCA101-OVA, with predicted affinities less than 500 nM. Peptides were selected trying to optimize the ratio between number of reads and predicted affinity for MHC-I.

Four predicted tumor neoantigenic peptides were selected and characterized by identifying the TE and the exonic sequence (table 3).

TABLE 2

Characterization of 4 predicted tumor neoantigenic peptides selected by the method

| Peptide | Cell line | Donor | Acceptor | Predicted affinity |
| --- | --- | --- | --- | --- |
| N25 | B16/B16-OVA | ERV-MaLR (subfamily MTA) | Chmp3, exon2 | H2-Db, 51.8937 |
| N26 | MCA/MCA-OVA MC38-GFP/MC38-OVAGFP | SINE-Alu(B1F) | Angel2, exon2 | H2-Kb, 392.0384 |
| N90 | MCA/MCA-OVA | Predicted gene 45873 | ERVL-MaLR (subfamily ORR1A2-int) | H2-Kb, 403.8959 and 50.5416 |
| N94 | MCA/MCA-OVA MC38-GFP/MC38-OVAGFP | Rsrc1 | ERV1 (subfamily RLTR4 MM-int) | H2-Kb, 431.0564 |

1.2 Validation by RT-PCR of the Fusion Transcript Sequence

First, a validation by regular RT-PCR has been performed, using primer pairs with one primer in the TE sequence, and the other one in the exonic sequence.

For the RNA extraction and reverse transcription, $3-5 \cdot 10^6$ cells were lyzed in 500 µL Trizol, and 100 µL phenol-chloroform added to the lyzates prior centrifugation. Aqueous phase was collected, mixed in a 1:1 ratio with 100% EtOH and transferred to RNAeasy minikit columns. RNA was then collected following manufacturer's instructions (including on column DNAse treatment). After RNA elution, DNA contaminants were further removed by treatment with Turbo DNAse (Fisher scientific), according to manufacturer's instructions). RNA concentration was measured using a nanodrop, and 1 µg of RNA used for reverse transcription. First strand synthesis was performed with Superscript III (Life technologies) using oligodT (15) as primers, according to manufacturer's instructions. Primers were ordered from Eurogentec. PCR reactions were performed using Taq polymerase. After identification of optimal conditions for each reaction, PCR products were extracted from agarose gels, and sequencing was performed using GATC lightrun. Sequence alignment was checked with APE software.

Figure 2A:
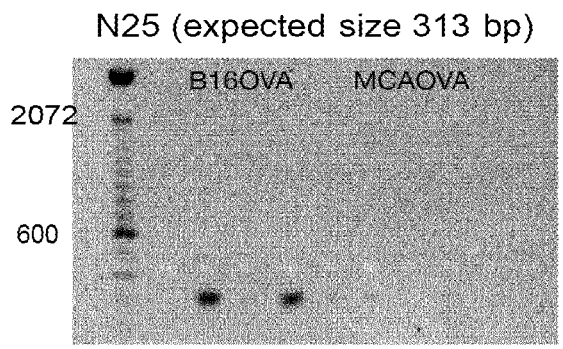
FIG. 2A: RT-PCR gels of amplification of the fusion transcript sequence encoding the neoantigenic peptide N25, in cDNA of tumor mouse lines B16F10-OVA and MCA101-OVA.
Figure 2B:
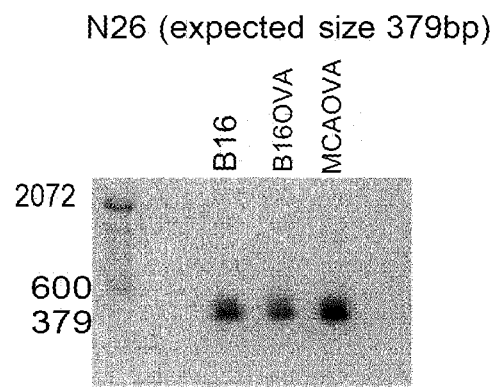
FIG. 2B: RT-PCR gels of amplification of the fusion transcript sequence encoding the neoantigenic peptide N26, in cDNA of tumor mouse lines B16F10, B16F10-OVA and MCA101-OVA.

Using this approach, bands matching predicted size for N25, N26, N90 and N94 were detected, respectively in the cell lines identified in Table 1 (See FIG. 2A for N25). Interestingly, although N26 was detected only in MCA and MC38 cells in silico by RNAseq as previously described in the pipeline, using RT-PCR we detected a band corresponding to N26 in B16F10-OVA cells (FIG. 2B), indicating that this sequence is shared between three independent tumor cell lines (MCA, MC38 and B16F10). By re-analyzing the RNAseq data, we found that the N26 junction was present in B16F10-OVA cells, but below the detection threshold of the algorithm. Moreover, sequencing of the RT-PCR product showed exact match with sequences predicted by the algorithm.

1.3 In Vivo Immunization of Mice

Figure 3A:
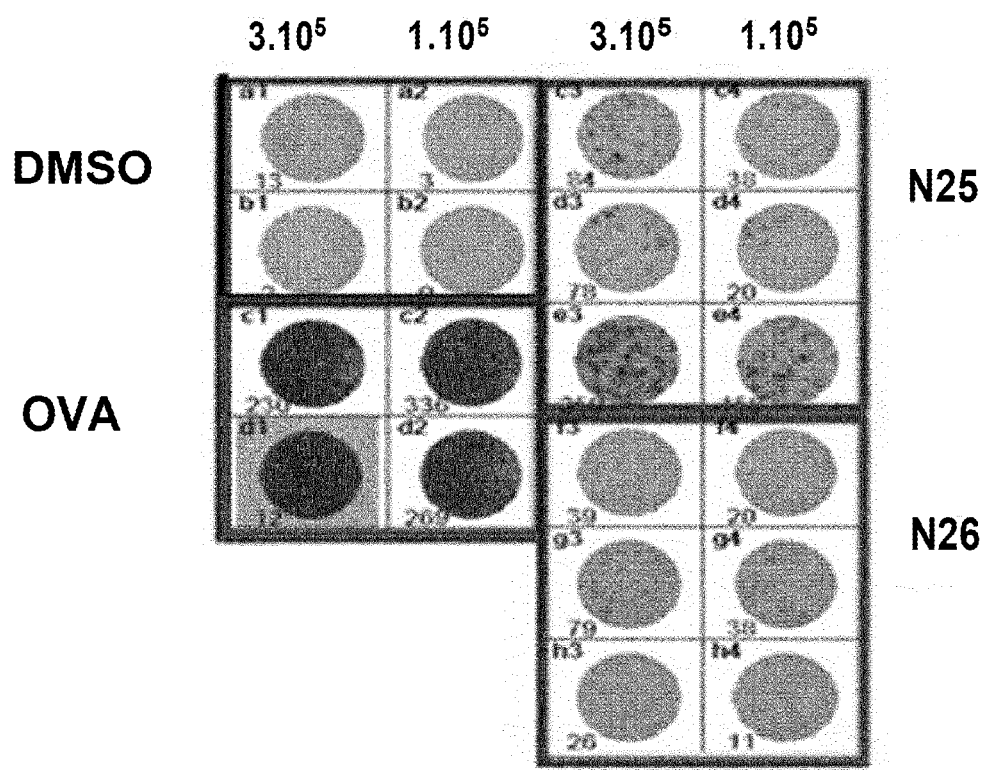
FIG. 3A: Detection of peptide-reactive IFNg-secreting cells by ELISPOT in inguinal lymph nodes from immunized animals with DMSO (negative control), OVA (ovalbumine) (positive control), peptide N25 or peptide N26.
Figure 3B:
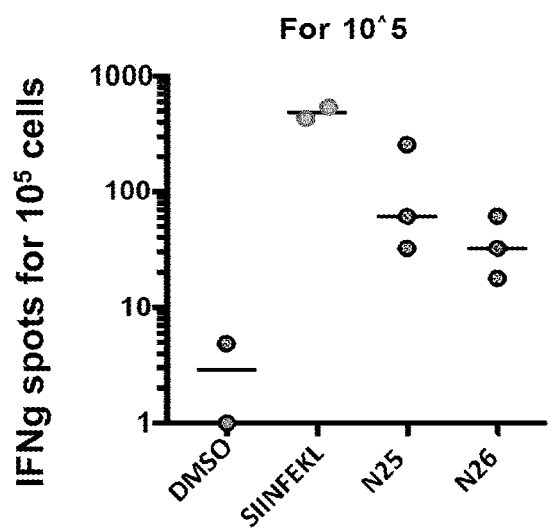
FIG. 3B: IFNg spots for 10^5 cells for immunized animals with DMSO (negative control), SIINFEKL (positive control), N25 or N26 peptide.

To validate these candidates in vivo, short (9-mers) peptides corresponding to neoantigenic peptide which binds to the MHC class I sequences, were synthetized. For the in vivo assays, long (27-mers) peptides, which include the flanking regions to the predicted MHC-binding short peptides of 9 mers, were synthetized, because this length is better suited for in vivo immunization. B16F10 OVA and MCA101-OVA were maintained in RPMI, Glutamax, 10% FCS, 1% penicillin-streptomycin and passaged using TrypLE. Cells were kept in culture for a maximum of one month, and new vials were thawed for each in vivo experiment. C57BL6J recipient mice were immunized with 100 µg long peptide (N25L or N26L), SIINFEKL peptide (short OVA peptide), OVA (Sigma) or DMSO, each with 50 µg polyI: C, by subcutaneous injection into the flank. Immunizations were repeated 7 days after primary immunization. 3 days later (10 days after primary immunization), animals were sacrificed and numbers of peptide-specific IFNg-secreting CD8 T cells in inguinal lymph nodes were detected by ELISPOT (FIG. 3A). Short peptides (N25, N26, or SIINFEKL) or DMSO at 10 µg·mL$^{-1}$ were used to restimulate T cells. Alternatively, 7 days after secondary immunization, animals were injected subcutaneously with $2.5 \cdot 10^5$ B16F10-OVA or $5 \cdot 10^5$ MCA-OVA cells in PBS. We found that N25, and to a lesser extent N26 were able to induce immune responses (FIG. 3B).

1.4 In Vivo Treatment of Mice with Tumor

To test whether these peptides were protective against tumor cells, we immunized C57BL6 mice with 100 mg peptides N25L or N26L, or OVA (control peptide) and 50 µg polyI: C in PBS at d0 and d7, and at d14, we injected $2.5 \cdot 10^5$ B16F10-OVA cells to mice immunized with OVA, N25L and N26L. B16F10 OVA and MCA101-OVA were maintained in RPMI, Glutamax, 10% FCS, 1% penicillin-streptomycin and passaged using TrypLE. Cells were kept in culture for a maximum of one month, and new vials were thawed for each in vivo experiment. C57BL6J recipient mice were immunized with 100 µg long peptide (N25L or N26L), OVA (Sigma) or DMSO, each with 50 µg polyI: C, by subcutaneous injection into the flank. Immunizations were repeated 7 days after primary immunization.

Figure 4A:
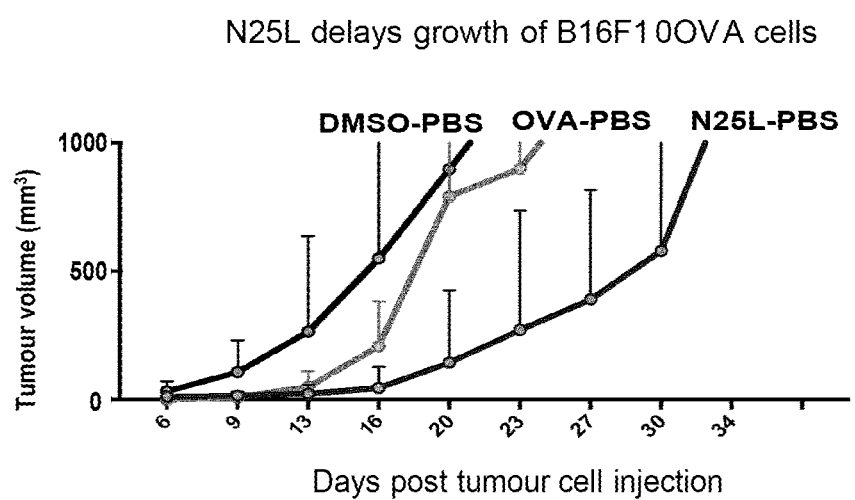
FIG. 4A: Evolution of the tumor volume (mm3) in mice beforehand immunized with DMSO, OVA or N25L peptide, following the days after the injection of tumor cells B16F10-OVA into said immunized mice.
Figure 4B:
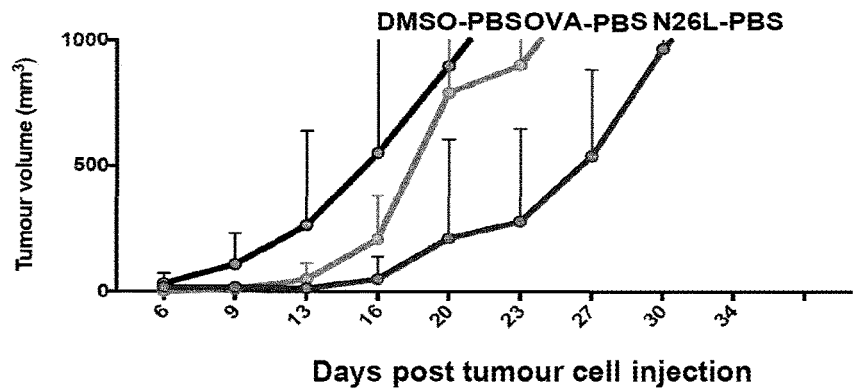
FIG. 4B: Evolution of the tumor volume (mm3) in mice beforehand immunized with DMSO, OVA or N26L peptide, following the days after the injection of tumor cells B16F10-OVA into said immunized mice.
Figure 5A:
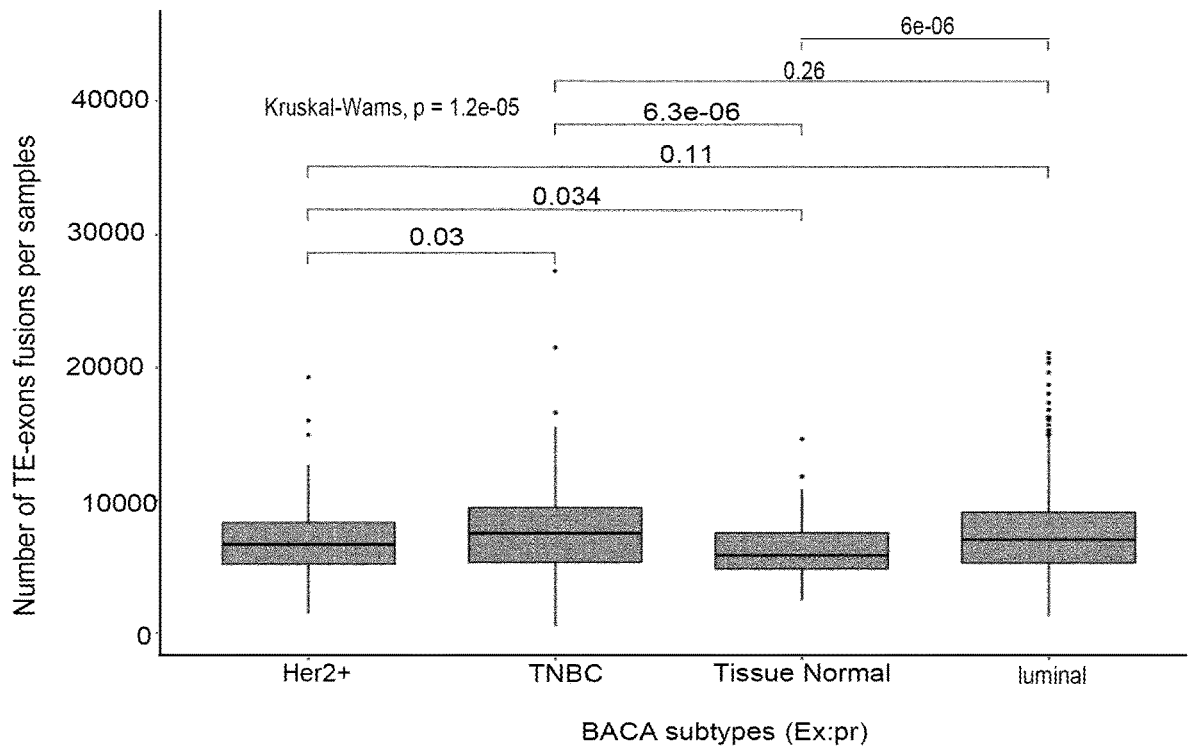
FIGS. 5A-5B: TCGA data sets for 784 luminal, 100 HER2+, 197 TNBC, 112 normal breast tissue, 516 primary lung adenocarcinomas (primary tumor) and 59 normal lung tissue (solid tissue normal), were analyzed by the method for identifying fusion transcript sequence encoded tumor neoantigenic peptide described.
Figure 5B:
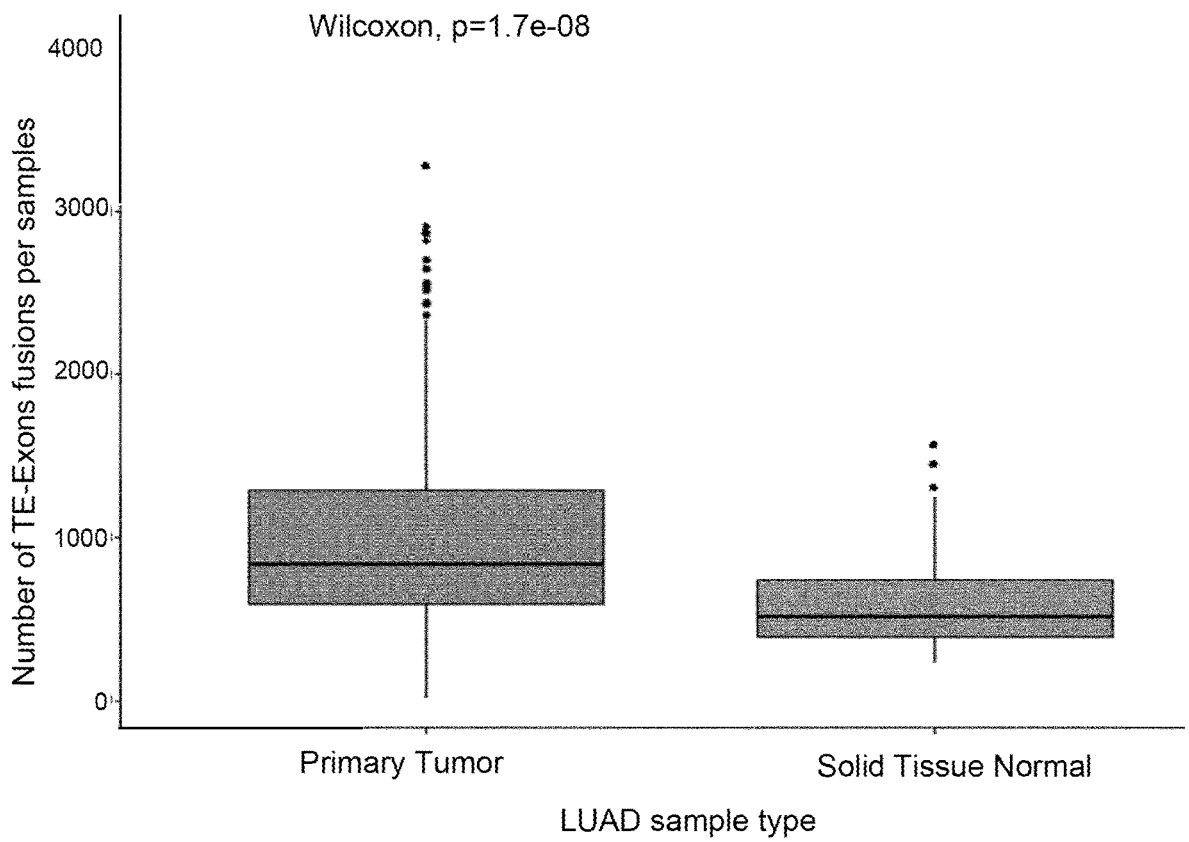
Figure 6A:
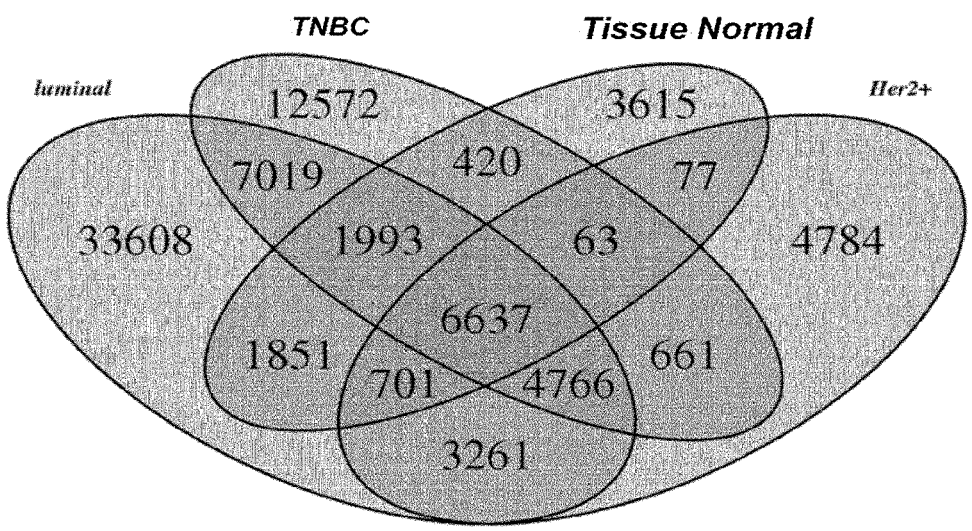
FIGS. 6A-6B: 8-9 amino acid-long peptides predicted from TE-gene fusion products from each sample were tested in silico for binding to the predicted HLA alleles expressed in the same sample. Shown are peptides with predicted affinity below 500 nM for at least one HLA-A, -B, or -C allele from each sample.
Figure 6B:
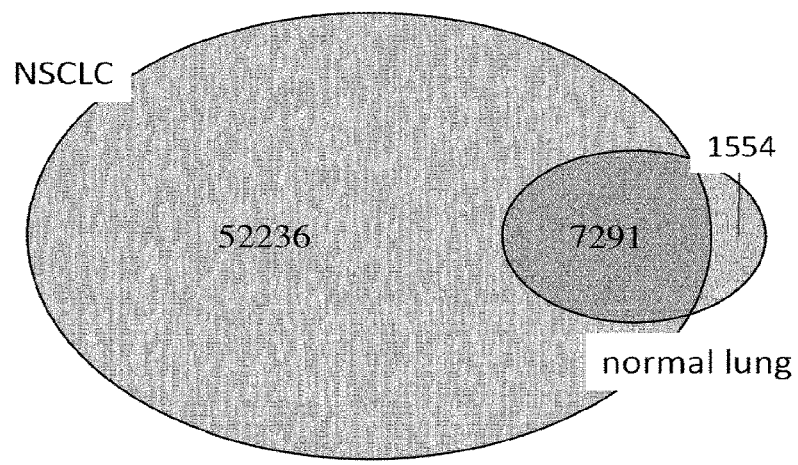
Figure 7A:
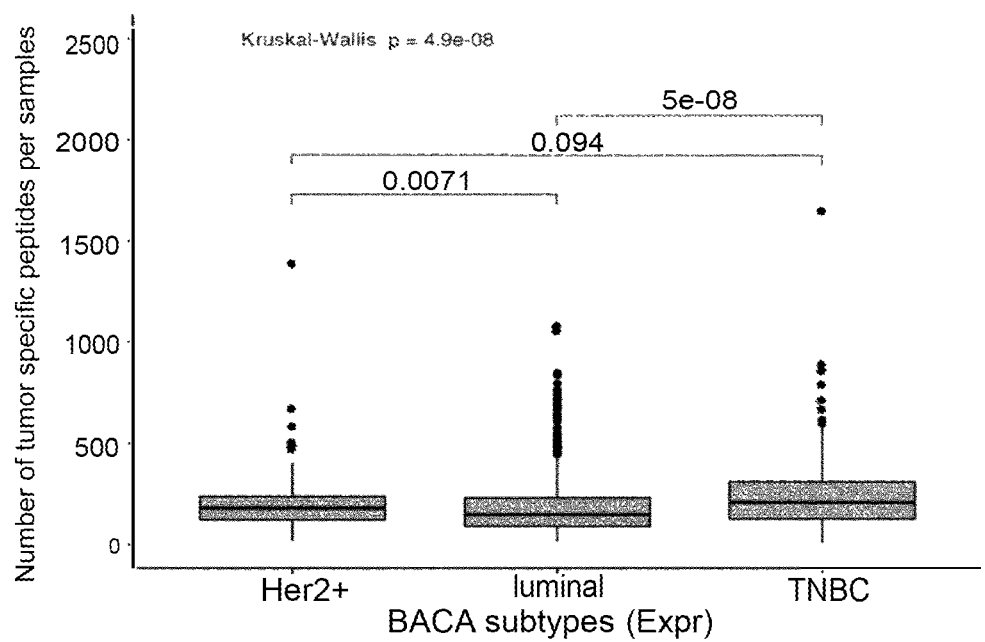
FIGS. 7A-7D: Distribution of tumor-specific peptides per patient across breast tumor subtypes.
Figure 7B:
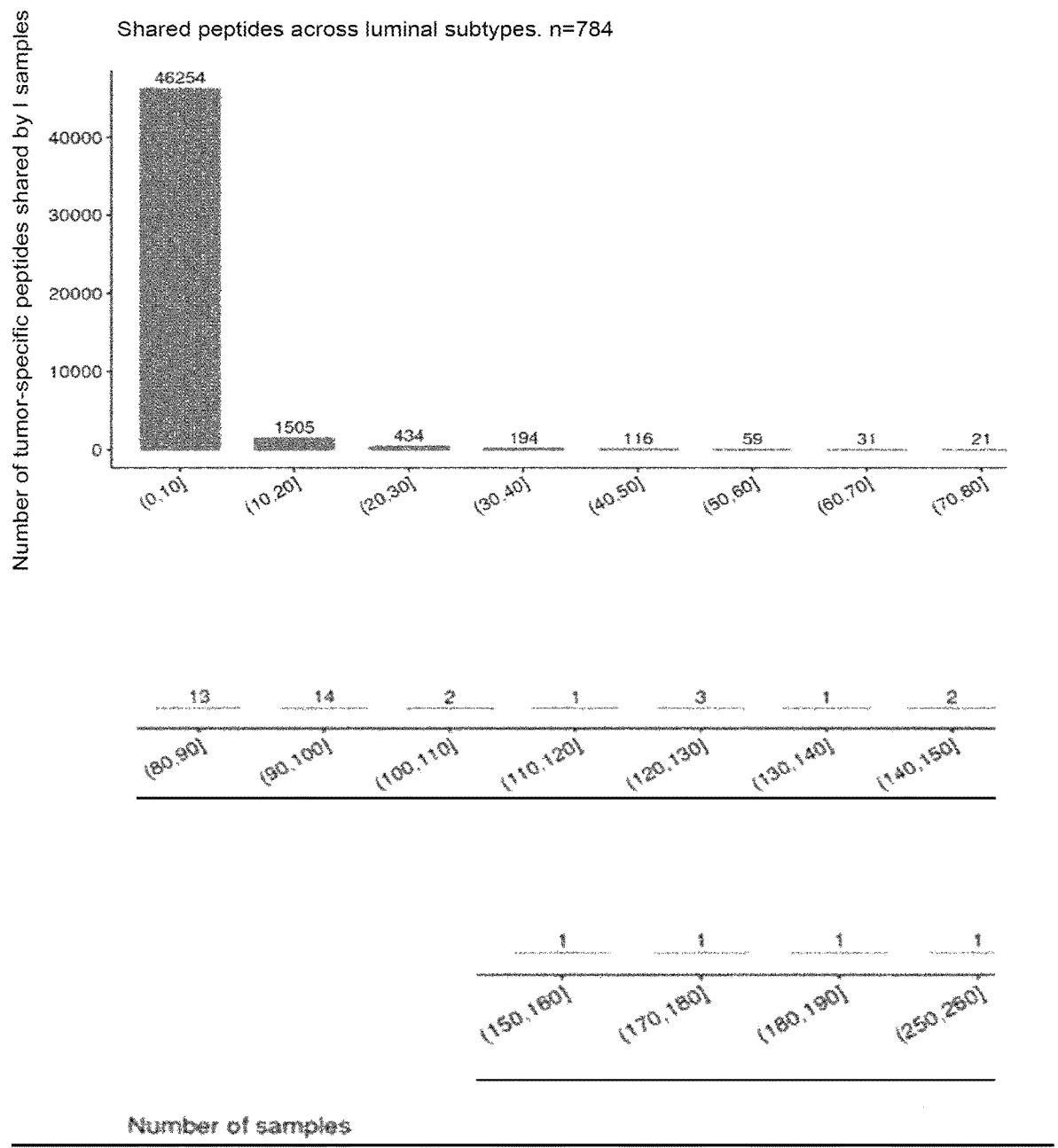
Figure 7C:
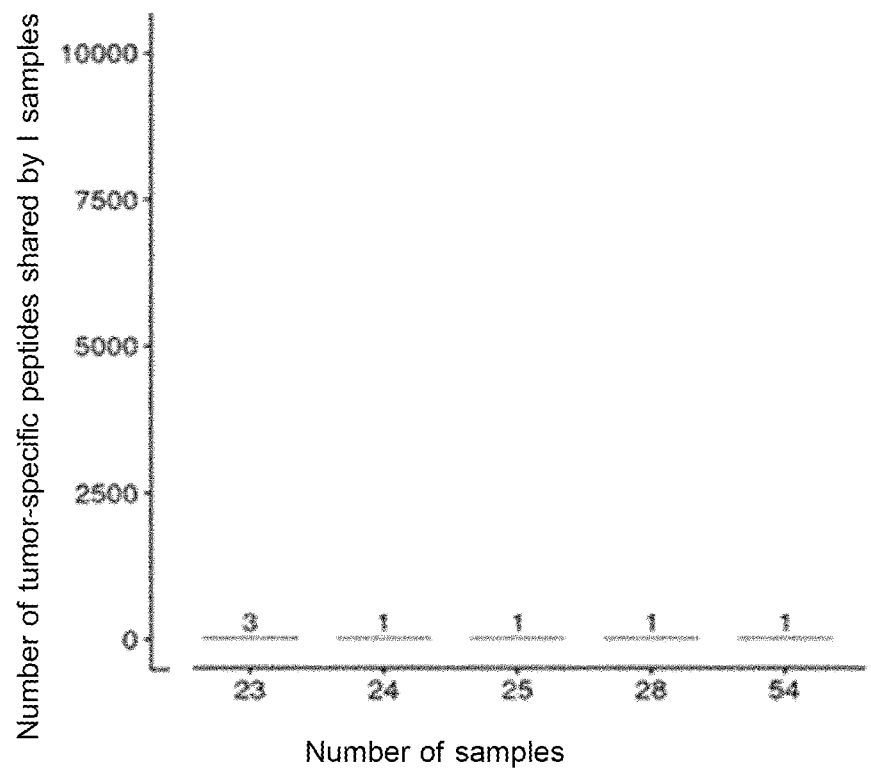
Figure 7D:
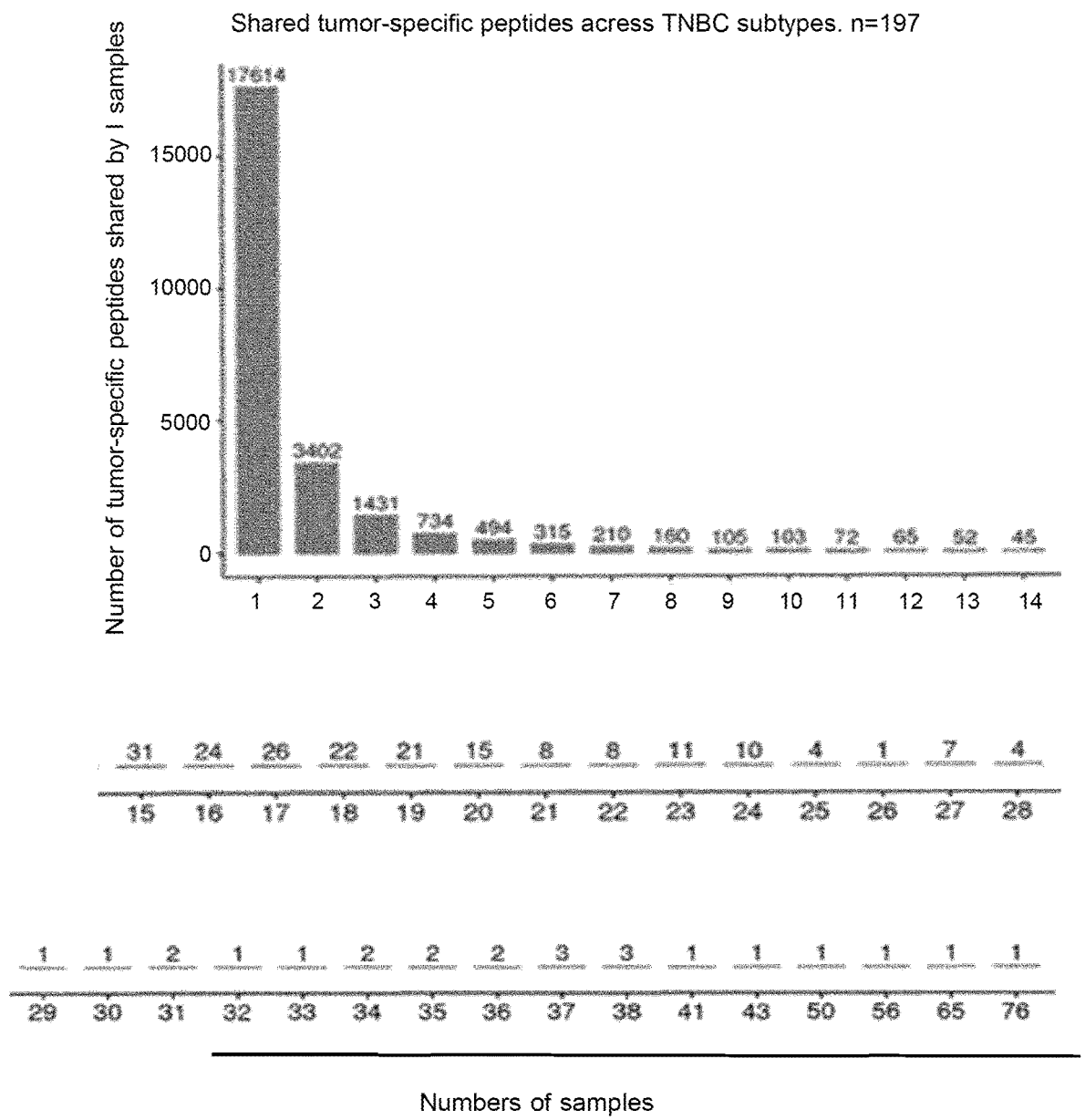
Figure 8A:
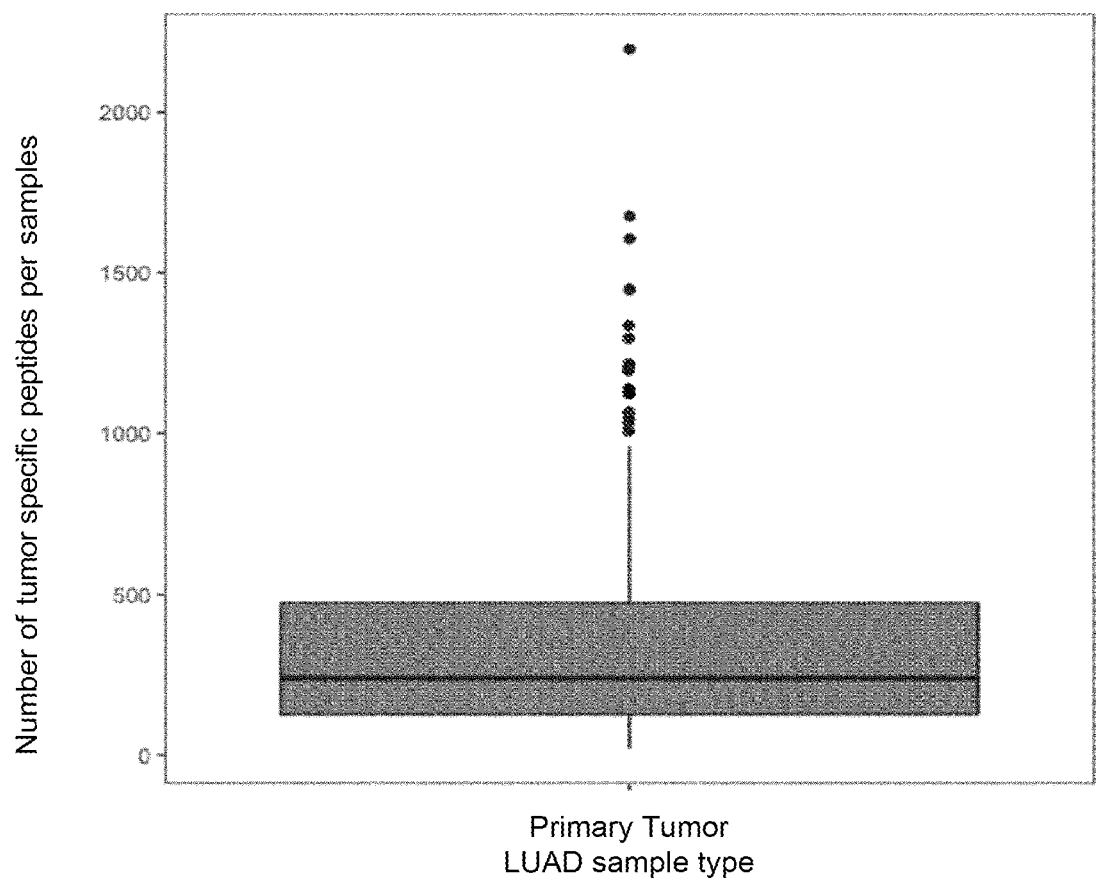
FIG. 8A: Numbers of tumor-specific HLA-binding peptides per primary lung adenocarcinomas (LUAD) sample (lung cancer).

Short peptides (N25, N26, or SIINFEKL) or DMSO at 10 µg·mL-1 were used to restimulate T cells. Alternatively, 7 days after secondary immunization, animals were injected subcutaneously with $2.5 \cdot 10^5$ B16F10-OVA or $5 \cdot 10^5$ MCA-OVA cells in PBS. Tumor size was measured twice weekly using a manual caliper, and animal health status monitored throughout the experiment timeframe (FIGS. 4A and 4B). Animals were sacrificed when tumor volume reached 1 mm3. Strikingly, we observed that N25L significantly delayed the formation of B16OVA tumors, in a more efficient way than OVA. Moreover, we obtained a similar result upon N26L immunization.

2 Example 2: Identification of Human Lung Adenocarcinoma (LUAD) Neoantigenic Peptides Derived from Fusion Transcripts Composed of a TE Element and an Exonic Sequence 2.1 Material and Methods RNA extraction. Tumour and juxtatumour samples were cut into pieces of #1 mm3 and resuspended in 700 μl RTL lysis buffer (Quiagen) supplemented with 1% β-mercaptoethanol and homogenized using Perecellys 24 Tissue Homogenizer (Bertin Technologies). Total RNA isolation was performed using RNeasy Micro Kit (Qiagen) following manufacturer instructions. Total RNA from tumour cell lines were extracted from $5 \cdot 10^6$ tumor cell lines using the same procedure.

PCR and Sequencing. Primers were designed using APE software. For each sample, 1 μg of RNA was retrotranscribed into cDNA using SuperScript III Reverse transcriptase (ThermoFisher), as indicated by the provider. PCR reaction was performed using GoTaq G2 Hot Start Polymarase (Promega). All primers were used in a concentration of 0.5 μM. Reactions were carried out in Veriti™ 96-Well Thermal Cycler (ThermoFisher). PCR products were loaded in LabChip GX (Caliper LifeSciences) and analysed by LabChip GX Software (v4.2).

PCR reactions were repeated for those samples with an amplification product on the expected size. Then, the PCR products were run in a 2% agarose gel SYBR Free Dye (1/10000) (Invitrogen). The specific bands were cut and the DNA products were purified using QIAquick Gel Extraction Kit (Qiagen) following manufacturer instructions. Finally, these products were sequenced by EuroFins Scientific. The resulting sequences were compared to the expected one using Serial Cloner software.

Tetramer formation. HLA-A2 monomers were purchased from ImmunAware® and the formation of tetramers was evaluated with synthetic ER-derived peptides following manufacturer instructions. Briefly, synthetic HLA-A2 monomers were incubated with synthetic peptides during 48 h at 18° C. Tetramerization was done by further incubation of monomers with biotinylated-sepharose. Finally, tetramer formation was measured by flow cytometry using a PE-conjugated anti-β2-microglobulin antibody. As a positive control we used a peptide derived from CMV provided by the manufacturer.

In experiments addressed to evaluate the presence of specific CD8+ T cells, the tetramerization step was performed by incubating the monomers with different combinations of fluorescent streptavidin (PE, APC, PE-Cy5, PE-CF594, BV421, BV711 and FITC).

Priming of naïve CTLs. PBMCs were obtained by Ficoll gradient separation from HLA-A2+ healthy blood donors. CD14+, CD4+ and CD8+ cells were purified by positive selection using magnetic beads (Miltenyi Biotec). While CD4+ and CD8+ T cells were cryopreserved until the experiment day, CD14+ fraction was cultured in the presence of IL-4 (50 ng/mL) and GM-CSF (10 ng/ml) at $10^6$ cells/mL during 5 days to obtain moDCs. After this period of time, the moDCs were maturated with LPS and incubated with synthetic ER-derived peptides at a final concentration of 1 μg/mL for 2 hours. Finally, peptide-loaded moDCs were co-cultured with autologous CD4+ and CD8+ T cells in culture medium supplemented with with IL-2 (10 U/ml) and IL-7 (100 ng/ml). The ER-derived peptide stimulation of specific CD8+ CTL populations was assessed by MHC-I tetramer staining by flow cytometry using a combination of two-color tetramer for each peptide.

Tetramer Staining. Cells were resuspended in PBS, stained with Live/Dead Aqua-405 nm (ThermoFisher) during 20 minutes at 4° C. and washed once. After that, cells were resuspended in PBS-1% BSA containing the mix of SA-coupled tetramers and incubated in the dark at room temperature during 20 minutes. Without further washing, surface antibodies were added in PBS-1% BSA and cells were incubated 20 minutes in the dark at 4° C. Surface antibodies were a combination of anti-CD3-BV650+ anti-CD8-PECy7 in combination with anti-CCR7-AF700+ anti-CD45RA-BUV395 when required. Finally, cells were washed twice and resuspended in FACS buffer for flow cytometry analysis.

CTL-clones generation. Tetramer positive cells were single-cell FACS sorted (ARIA-sorter, BD) in U bottom 96-well plates. Sorted cells were collected in 100 μl of RPMI 10% human serum AB (Sigma-Aldrich) containing 150.000 feeders' cells. Finally, 100 μl of AIM-medium containing IL-2 (3000 IU/ml) and anti-CD3 (100 μg/ml. OKT3 clone from Miltenyi) were added and cells were cultured during 15-20 days maximum. When evident cell growth was observed in wells, we perform a second round of expansions with new feeders' cells for an additional period of 15 days maximum. Cells were feed and split as necessary during this period with the same culture media (AIM-RPMI 50/50+5% Human Serum) but only containing IL-2 at 500 IU/ml. Finally, expanded clones were checked for their specificity by FACs-tetramer staining and only clones with >85% of tetramer positive clones were used for further analysis.

Killing assays. To perform killing assays, xCELLigence RTCA S16 Real Time Cell Analyzer was used. H1650 cell-line were plated at $0.5 \times 10^6$ cells/ml in pre-coated 16 well plates. One day after, cells were incubated or not during 1 h with different concentration of the correspondent synthetic peptides. After that, cells were washed twice with culture medium and incubated or not for additional 30 minutes with anti-MHC-I antibodies (clone W6/32, 50 μg/well) or isotype control at the same concentration. Without additional wash, CTL-clones were added at the correspondent ratio. The complete assay was done in free-serum culture medium in a final volume of 200 at 37° C. connected to the xCELLigence system. Impedance variation (cell-index) was measured in real-time during 40 h. Each condition was performed by duplicates.

Cytokine secretion and Jurkat cells activation. 50.000 H1650 cells were plated in 96-well plate in culture medium supplemented with 5% of fetal bovine serum. The day after, cells were culture during 1-2 h with synthetic peptides at different final concentrations. After that, cells were washed twice, CTL-clones were added at 1:1 ratio and co-cultured during 18 h with peptide-loaded target cells. Culture supernatants were collected and cytokine concentration analyzed by cytokine beads arrays (CBA, BD Biosciences) following manufacturer's instructions.

The same experiment was performed using transduced Jurkat cells instead of CTL-clones and two different types of target cells: H1650 and H1395 cell lines. In this assay, after co-cultured with peptide-loaded target cells, Jurkat cells were assessed by flow cytometry analyzing the expression of reporter markers. PMA/Ionomycin was used as positive control to activate Jurkat cells.

Tissues and Blood samples. Lung tumor, juxta tumor and lymph nodes samples were cut into small pieces and digested using a mix of collagenase-I (2 mg/ml), hyaluronidase (2 mg/ml) and DNasa (25 µg/ml) in a final volume of 2 ml culture medium (CO2 independent medium+5) during 40 min at 37° C. After digestion single cell suspensions were collected through a cell Strainer and washed. Tumor and Juxta tumor suspensions were enriched on lymphocyte fractions by a ficoll gradient. After that cells were staining for tetramer analysis by FACs as described before.

Blood samples were seeded on a ficoll gradient and PBMCs were isolated. After that, PBMCs were enriched for CD8+ T cells using EasyStep Human CD8+ T cell Enrichment Kit (STEMCELL Technologies). Finally, enriched cells were stained for tetramer analysis as described before.

Tumor infiltrating lymphocytes (TILs) cultures. Tumor tissue was cut into small pieces (1-3 mm3 size, 6-12 pieces maximum). Each tumor fragment was transferred into individual wells from 24-well plates and cultured in a final volume of 2 ml RPMI 10% Human Serum+IL-2 6000 IU/ml. Cells were feed/split as necessary during 15-20 days and cryopreserve or analyzed for tetramer staining.

TCR cloning. Total RNA was extracted from CTL-clones and retrotranscribed into cDNA using SuperScript III (ThermoFisher). TCRα and β were amplified by PCR as described in Li et al 2019. DNA products were run in 2% agarose gels and sequenced after gel band extraction (Qiagen). TCR V regions (α and β) were concatenated with murine TCR constant chain and cloned into a PEW-pEF1A-inactEGFP vector and amplified in transformed bacteria.

Jurkat transduction. Lentivirus particles were produced by HEK-293 FT cell line transfected with TCR-expression plasmids together with envelope (pVSVG) and packaging (psPAX2) plasmids. After 64 h, supernatant was collected and lentivirus particles were concentrated using 100 kDa centrifugal filter (Sigma-Aldrich). Lentivirus suspension was transferred by spinoculation into TCR-negative Jurkat cells expressing reporter genes (NFAT-GPF, NF-KB-CFP and AP-1-mCherry). After 5 days, transduction efficiency was evaluated by FACS using anti-murine TCR-B antibody (Clone H57-597). This Jurkat cells were described in Rosskopf S. et al. 2018.

Mass spectrometry data analysis. Public immunopeptidomics raw data derived from MHC-eluted peptides were analysed using ProteomeDiscoverer 1.4 (ThermoFisher) with the following parameters: no-enzyme, peptide length 8-15 aa, precursor mass tolerance 20 ppm and fragment mass tolerance 0.02 Da. Methionine was enabled as variable modification and a false discovery rate (FDR) of 1% was applied. MS/MS spectra were searched against the human proteome from Uniprot/SwissProt (updated 6 Mar. 2020) concatenated with the list of all fusion transcripts-derived proteins from lung TCGA projects. Finally, peptides matching with Uniprot database or with translated fusion transcripts present in lung normal samples were discarded.

2.2 Results: Identification of Fusion Transcript Sequences Encoding Tumor Neoantigenic Peptide in Human Subject 2.2.1 Characterization of Neoantigens First the TE-Exon fusion transcript landscape was characterized in normal samples from TCGA public database. A total of 8876 unique fusions were identified in 679 normal samples from 19 different tissues (bile duct, bladder, brain, breast, cervical, colon, head and neck, kidneys, liver, pancreas, PCPG, prostate, rectum, sarcoma, skin, thymus, thyroid, uterine). Specific fusions to each tissue type were found with a very small portion of pan-tissue fusion transcripts. These results suggest that a dedicated tissue specific regulatory mechanism is associated with these fusion transcripts.

Then the number of identified fusions in 514 LUAD samples from TCGA has been compared to their 59 normal associated pulmonary samples present in TCGA. On average, 235 fusions were identified in NSCLC samples, compared with 200 in healthy lung samples (Wilcoxon pvalue=$9\times10^{-10}$). 8269 total unique fusions were identified in NSCLC tumors.

A first category of fusions called TSF (tumor specific fusion) was obtained as those found in at least 1% of tumor samples and in none of the normal samples. 210 fusions were thus defined as TSF.

Some high-frequency fusion transcripts in tumors and low frequency in normal cells may also be good candidates for neo-antigens. Thus, a second category called TAF (tumor associated fusion) was notably defined as fusions present in less than 4% of normal tissues, notably less than 2%, and more than 10% of the tumors and that is over expressed in tumors compared to normal tissue samples.

Tables 3 and 4 (see below) describe the fusion according to whether the Exon or the TE is the donor. The first column indicates the frequency of the fusion in the NSCLC cohort. The columns Donor and Acceptor introduce the type of each element. All the columns starting with "Donor" (respectively "Acceptor") are information relative to the donor (resp. the acceptor). The sequence of the fusion can be retrieved as follow:

Donor sequence: on chromosome "Donor_Chromosome_X" starting from "Donor_start_X" to "Donor_Breakpoint_X" on strand "Donor_strand_X"

Acceptor sequence: on chromosome "Acceptor_Chromosome_X" starting from "Acceptor_Breakpoint_X" to "Acceptor_end_X" on strand "Donor_strand_X"

Care should be taken to take the reverse complement of the sequence if the fusion is present on the minus strand.

Fusion Sequence:

In order to reconstruct the fusion nucleotide sequence, the sequence of the donor on chromosome "Donor_Chromosome_X" from "Donor_start_X" to "Donor_Breakpoint_X" on strand "Donor_strand_X" and the acceptor sequence on the chromosome "Acceptor_Chromosome_X" starting from "Acceptor_Breakpoint_X" to "Acceptor_end_X" on the strand "Acceptor_strand_X" have been extracted from the Ensembl HG19 human assembly database. It is to be noted that the use of the Ensembl HG19 human database is not limitative and that any other adapted database may be used such as NCBI reference Sequence Database (RefSeq).

Care should be taken to take the reverse complement of the sequence if the fusion is present on the minus strand.

The "fusion sequence" consists of the donor sequence followed by the acceptor sequence.

Nucleotide Sequence of the Fusion Transcript:

On the basis of the known canonical transcripts in which the exon is involved, all the "fusion transcripts" were reconstructed.

When the donor is the exon (see FIG. 9A)

it starts with the beginning of the canonical transcript to the donor exon and replace the complete canonical exon sequence with the fusion sequence. In this case, the fusion transcript stops after the TE sequence of the acceptor.

When the donor is the TE (FIG. 9B)
The sequence begins at the canonical position of the acceptor exon in the transcript and forget all exons upstream. The canonical sequence of the acceptor exon was replaced with the fusion sequence and the transcript was reconstructed until the end.

Each nucleotide sequence of size k (i.e. from 24 to 75 nucleotides) of the fusion transcript (translation of the first k-mer starts at the first nucleotide of the fusion transcript, translation of the second k-mer starts at the second nucleotide of the fusion transcript, etc.) was then translated into a peptide sequence.

The obtained peptides are then further analyzed with NetMHCpan for MHC binding prediction. Affinity for binding to at least one of the known human alleles was thus predicted, (see also example 1 for further illustration) for each k-mer present in the sequence.

Table 3. Coordinates of the fusion sequences for which the donor is the exon. The names of the columns are the following:

1. Frequency in LUAD cohort
2. Donor Chromosome Exon
3. Donor start Exon
4. Donor Breakpoint Exon
5. Donor strand Exon
6. Donor transcript (i.e. Donor_tx_name_Exon)
7. Acceptor Chromosome TE
8. Acceptor Breakpoint TE
9. Acceptor end TE
10. Acceptor strand TE
11. Fusion type The fusion transcript sequence of table 3 correspond in the same order to SEQ ID NO: 118-431 (typically line 1 is SEQ ID NO: 118, line 2 is SEQ ID NO: 119, line 3 corresponds to SEQ ID NO: 120 and 121, because of the 2 donor transcripts (ENST00000296474 and ENST00000344206 respectively as indicated in col. 6), etc.).

| 1 | 2 | 3 | 4 | 5 | 6 | 7 | 8 | 9 | 10 | 11 |
|---|---|---|---|---|---|---|---|---|---|---|
| 31% | chr19 | 42265157 | 42265435 | + | ENST00000199764 | chr19 | 42274707 | 42275202 | + | TSA |
| 17% | chr12 | 71509630 | 71509630 | − | ENST00000549357 | chr12 | 71504233 | 71504376 | − | TSA |
| 15% | chr3 | 49927357 | 49927357 | − | ENST00000296474;ENST000003442066 | chr3 | 49927248 | 49927342 | − | TSA |
| 12% | chr5 | 82554349 | 82554496 | + | ENST00000282268;ENST000003386335;ENST00000396027;ENST00000511817 | chr5 | 82606608 | 82606935 | + | TSA |
| 10% | chr3 | 98600384 | 98600384 | − | ENST00000449482;ENST000003268400;ENST00000326857 | chr3 | 98586282 | 98586295 | − | TSF |
| 8% | chrX | 100169327 | 100169610 | − | ENST00000328526;ENST000003729566 | chrX | 100143801 | 100143850 | − | TSF |
| 7% | chrX | 100177782 | 100177782 | − | ENST00000328526;ENST000003729566 | chrX | 100143801 | 100143850 | − | TSF |
| 6% | chr1 | 225156461 | 225156576 | + | ENST00000430092;ENST00000400952;ENST00000366849;ENST00000439375 | chr1 | 225157336 | 225158402 | + | TSF |
| 6% | chr8 | 63502273 | 63502353 | + | ENST00000523211;ENST000003284722 | chr8 | 63546747 | 63547118 | + | TSF |
| 4% | chr4 | 57319769 | 57319927 | + | ENST00000514888;ENST00000264221;ENST00000505164;ENST00000399688;ENST000000512576 | chr4 | 57321183 | 57321327 | + | TSF |
| 4% | chr12 | 113623819 | 113623826 | + | ENST00000552495 | chr12 | 113623998 | 113624117 | + | TSF |
| 4% | chr3 | 32280465 | 32280611 | + | ENST00000458535;ENST000003075266 | chr3 | 32324083 | 32324625 | + | TSF |
| 4% | chr19 | 3868963 | 3868963 | − | ENST00000586578;ENST00000262961;ENST00000438164;ENST00000587212;ENST000004390866 | chr19 | 3855694 | 3856396 | − | TSF |
| 4% | chr4 | 56230241 | 56230438 | + | ENST00000264228 | chr4 | 56252510 | 56252750 | + | TSF |
| 3% | chr10 | 126205749 | 126205840 | + | ENST00000368842 | chr10 | 126251911 | 126252288 | + | TSF |
| 3% | chr1 | 241803184 | 241803184 | − | ENST00000366554;ENST000000331838 | chr1 | 241771682 | 241771840 | − | TSF |

-continued

| 1 | 2 | 3 | 4 | 5 | 6 | 7 | 8 | 9 | 10 | 11 |
|---|---|---|---|---|---|---|---|---|---|---|
| 3% | chr12 | 56742313 | 56742313 | − | ENST00000314128; ENST0000055723 5 | chr12 | 56740986 | 56741274 | − | TSF |
| 3% | chr1 | 234546191 | 234546191 | − | ENST00000040877 | chr1 | 234545319 | 234545408 | − | TSF |
| 3% | chr7 | 81964451 | 81964451 | − | ENST00000356860; ENST0000035625 3;ENST000004235 88 | chr7 | 81929467 | 81929664 | − | TSF |
| 3% | chr2 | 89160398 | 89160398 | − | ENST00000390239 | chr2 | 89129384 | 89129429 | − | TSF |
| 3% | chr5 | 54993674 | 54993674 | − | ENST00000396865; ENST0000053976 8;ENST000003186 72;ENST00000508 124;ENST0000051 1233;ENST000005 03891;ENST00000 513993;ENST0000 0505563;ENST000 00506624;ENST00 000507109 | chr5 | 54993040 | 54993109 | − | TSF |
| 3% | chrX | 119708406 | 119708406 | − | ENST00000404115 | chrX | 119705855 | 119706010 | − | TSF |
| 3% | chr2 | 135223685 | 135223685 | − | ENST00000281924 | chr2 | 135216236 | 135216307 | − | TSF |
| 3% | chr11 | 20981978 | 20982106 | + | ENST00000298925; ENST0000035713 4;ENST000003253 19;ENST00000532 434 | chr11 | 21041136 | 21041271 | + | TSF |
| 2% | chr13 | 53307354 | 53307354 | − | ENST00000431550; ENST0000044890 4;ENST000003779 62 | chr13 | 53304269 | 53304818 | − | TSF |
| 2% | chr3 | 138289160 | 138289160 | − | ENST00000264982; ENST0000054223 7;ENST000004848 88;ENST00000474 781;ENST0000048 1834;ENST000004 68900;ENST00000 462419;ENST0000 0464035 | chr3 | 138261631 | 138262493 | − | TSF |
| 2% | chr1 | 1255836 | 1255836 | − | ENST00000435064; ENST0000054043 7;ENST000004509 26;ENST00000545 578;ENST0000052 8879;ENST000004 34694;ENST00000 526797;ENST0000 0527719;ENST000 00530031;ENST00 000534345;ENST0 0000498476 | chr1 | 1255085 | 1255253 | − | TSF |
| 2% | chr2 | 135470770 | 135470770 | − | ENST00000281924 | chr2 | 135443800 | 135443808 | − | TSF |
| 2% | chr5 | 23976106 | 23976159 | + | ENST00000512559; ENST0000050793 6 | chr5 | 24177946 | 24178380 | + | TSF |
| 2% | chr9 | 125054028 | 125054119 | + | ENST00000297908; ENST0000034464 1;ENST000003737 23;ENST00000373 729;ENST0000039 4315 | chr9 | 125068067 | 125068171 | + | TSF |
| 2% | chrX | 117900807 | 117900939 | + | ENST00000371666 | chrX | 117902549 | 117902902 | + | TSF |
| 2% | chr5 | 31493314 | 31493314 | − | ENST00000511367; ENST0000034462 4;ENST000004427 43;ENST0000513 349 | chr5 | 31489188 | 31489272 | | TSF |
| 2% | chr2 | 89416833 | 89416936 | − | ENST00000490686 | chr2 | 89370042 | 89370075 | − | TSF |

-continued

| 1 | 2 | 3 | 4 | 5 | 6 | 7 | 8 | 9 | 10 | 11 |
|---|---|---|---|---|---|---|---|---|----|----|
| 2% | chr20 | 29632611 | 29632721 | + | ENST00000278882; ENST00000358464 | chr20 | 29652086 | 29652324 | + | TSF |
| 2% | chr14 | 66096210; 66096217 | 66096324 | + | ENST00000360689; ENST00000394586;ENST00000342677;ENST00000394585;ENST000003 58307;ENST00000557164 | chr14 | 66099743 | 66101298 | + | TSF |
| 2% | chr | 130678687 | 130678687 | − | ENST00000335791 | chr9 | 130678527 | 130678564 | − | TSF |
| 2% | chr1 | 180283827 | 180283827 | − | ENST00000367595 | chr1 | 180281457 | 180281879 | − | TSF |
| 2% | chr20 | 44333136 | 44333136 | − | ENST00000335769 | chr20 | 44322980 | 44322991 | − | TSF |
| 2% | chr2 | 89512908 | 89512947 | − | ENST00000498435 | chr2 | 89389297 | 89389324 | − | TSF |
| 2% | chr8 | 62546242 | 62546242 | − | ENST00000541428; ENST00000379454;ENST00000522919;ENST00000356457;ENST00000519234;ENST00000518068;ENST00000517903;ENST00000445642;ENST00000517847;ENST00000522835 | chr8 | 62544521 | 62544571 | − | TSF |
| 2% | chr4 | 1102131 | 1102131 | − | ENST00000382968; ENST00000433731;ENST00000511620;ENST00000510715;ENST00000333673 | chr4 | 1101132 | 1101138 | − | TSF |
| 2% | chr6 | 24551662 | 24551662 | − | ENST00000430948; ENST00000535378;ENST00000378214;ENST00000543707 | chr6 | 24548828 | 24548834 | − | TSF |
| 2% | chr1 | 11115838 | 11115838 | − | ENST00000490101; ENST00000376957 | chr1 | 11115464 | 11115465 | − | TSF |
| 2% | chr7 | 55270210 | 55270401 | + | ENST00000455089 | chr7 | 55272949 | 55272949 | + | TSF |
| 2% | chr8 | 42924698; 42924750 | 42924802 | + | ENST00000534420; ENST00000302279;ENST00000533998;ENST00000342116;ENST00000531266;ENST00000533336;ENST00000525699;ENST00000529687 | chr8 | 42925245 | 42925476 | + | TSF |
| 2% | chr2 | 176860281; 176860286 | 176860286 | − | ENST00000392540; ENST00000272748;ENST00000544803;ENST00000445472 | chr2 | 176859008 | 176859011 | − | TSF |
| 2% | chr1 | 63955754 | 63955754 | − | ENST00000371092; ENST00000271002;ENST00000489099;ENST00000283568 | chr1 | 63952444 | 63952998 | − | TSF |
| 2% | chr16 | 2825452 | 2825452 | − | ENST00000262306; ENST00000409906; ENST00000409477;ENST00000494946 | chr16 | 2823822 | 2823948 | − | TSF |
| 2% | chr7 | 16900083; 16900124 | 16900124 | − | ENST00000402239; ENST00000310398;ENST00000414935 | chr7 | 16894536 | 16894625 | − | TSF |
| 2% | chr17 | 79532346; 79532531 | 79532531 | − | ENST00000374747; ENST00000539314;ENST000005727 | chr17 | 79527702 | 79527706 | − | TSF |

| 1 | 2 | 3 | 4 | 5 | 6 | 7 | 8 | 9 | 10 | 11 |
|---|---|---|---|---|---|---|---|---|---|---|
|  |  |  |  |  | 60;ENST00000573876;ENST0000033 1134;ENST000005 73519;ENST00000 571714;ENST0000 0572824;ENST000 00573212 |  |  |  |  |  |
| 2% | chr19 | 55178145; 55178148 | 55178200 | + | ENST00000391733; ENST0000039173 6;ENST000002704 52;ENST00000430 952;ENST0000039 1734;ENST000004 34286 | chr19 | 55178294 | 55178458 | + | TSF |
| 2% | chr3 | 48715987; 48715997 | 48715997 | − | ENST00000413374; ENST0000034152 0;ENST000004166 49;ENST00000294 129 | chr3 | 48702393 | 48702506 | − | TSF |
| 2% | chr3 | 137906397; 137906427 | 137906441 | + | ENST00000469044; ENST0000046160 0;ENST000004618 22;ENST00000470 821;ENST0000047 1709;ENST000005 38260;ENST00000 463485;ENST0000 0393058 | chr3 | 137907243 | 137907252 | + | TSF |
| 2% | chr12 | 93873164 | 93873248 | + | ENST00000549982; ENST0000036163 0;ENST000005522 17;ENST00000393 128;ENST0000054 7098;ENST000005 49561;ENST00000 548545 | chr12 | 93876129 | 93876286 | + | TSF |
| 2% | chr1 | 53558226 | 53558226 | − | ENST00000371494 | chr1 | 53556655 | 53556736 | − | TSF |
| 2% | chr2 | 143743517 | 143743590 | + | ENST00000264170; ENST0000037577 3;ENST000004095 12 | chr2 | 143745513 | 143745682 | + | TSF |
| 1% | chr12 | 117537030 | 117537030 | − | ENST00000470612 ENST0000033520 9;ENST000005412 10;ENST00000462 502;ENST0000039 2545 | chr12 | 117513606 | 117513652 | − | TSF |
| 1% | chr11 | 63365533 | 63365533 | − | ENST00000323646; ENST0000041582 6 | chr11 | 63360665 | 63361041 | − | TSF |
| 1% | chr16 | 14782022 | 14782022 | − | ENST00000438167; ENST0000056746 2 | chr16 | 14779702 | 14779829 | − | TSF |
| 1% | chr7 | 22532184 | 22532184 | − | ENST00000406890; ENST0000040436 9;ENST000004243 63 | chr7 | 22512853 | 22512874 | − | TSF |
| 1% | chr5 | 1802435 | 1802488 | + | ENST00000274137; ENST0000046917 6 | chr5 | 1811112 | 1811428 | + | TSF |
| 1% | chr7 | 93516573 | 93516573 | − | ENST00000451238; ENST0000022254 3 | chr7 | 93492029 | 93492238 | − | TSF |
| 1% | chr14 | 106235574 | 106235574 | − | ENST00000390551 | chr14 | 106216701 | 106216951 | − | TSF |
| 1% | chr22 | 47071365 | 47071449 | + | ENST00000406902; ENST0000036103 4;ENST000004080 31 | chr22 | 47078308 | 47078350 | + | TSF |
| 1% | chr16 | 16381600 | 16381719 | + | ENST00000399336; ENST0000026301 2;ENST000005384 68 | chr16 | 16382422 | 16382605 | + | TSF |

-continued

| 1 | 2 | 3 | 4 | 5 | 6 | 7 | 8 | 9 | 10 | 11 |
|---|---|---|---|---|---|---|---|---|---|---|
| 1% | chr7 | 22532184 | 22532184 | − | ENST00000406890;ENST00000404369;ENST00000424363 | chr7 | 22531483 | 22531483 | − | TSF |
| 1% | chr18 | 56807181 | 56807267 | + | ENST00000587834;ENST00000299714;ENST00000588875 | chr18 | 56814218 | 56814267 | + | TSF |
| 1% | chr22 | 48885405 | 48885516 | + | ENST00000402357;ENST00000336769 | chr22 | 48915770 | 48916108 | + | TSF |
| 1% | chr10 | 75555297 | 75555421 | + | ENST00000604729;ENST00000603114;ENST00000604524;ENST00000398706;ENST00000605216;ENST00000433366;ENST00000492395;ENST00000603187;ENST00000412198;ENST00000604754 | chr10 | 75556079 | 75556138 | + | TSF |
| 1% | chr16 | 4401233 | 4401233 | − | ENST00000577031;ENST00000318059;ENST00000571986;ENST00000576217;ENST00000571178 | chr16 | 4398819 | 4398944 | − | TSF |
| 1% | chr1 | 220240644 | 220240644 | − | ENST00000322067;ENST00000469520;ENST00000354807;ENST00000544404;ENST00000414869;ENST00000463953;ENST00000498791;ENST00000480959 | chr1 | 220237757 | 220238024 | − | TSF |
| 1% | chr14 | 106092109 | 106092109 | − | ENST00000390543 | chr14 | 105470421 | 105470731 | − | TSF |
| 1% | chr1 | 53569018 | 53569018 | − | ENST00000371494 | chr1 | 53568657 | 53568729 | − | TSF |
| 1% | chr9 | 5163913 | 5164179 | − | ENST00000381641 | chr9 | 4992433 | 4992489 | − | TSF |
| 1% | chr7 | 8198157 | 8198157 | − | ENST00000402384;ENST00000406470;ENST00000265577;ENST00000396675;ENST00000339809;ENST00000401396;ENST00000422063;ENST00000407906;ENST00000317367 | chr7 | 8197727 | 8198053 | − | TSF |
| 1% | chr8 | 17872093 | 17872349 | + | ENST00000325083;ENST00000519253;ENST00000327578;ENST00000522275 | chr8 | 17873210 | 17873221 | + | TSF |
| 1% | chr2 | 192546672; 192546682 | 192546743 | + | ENST00000307849;ENST00000451500;ENST00000425611;ENST00000435931;ENST00000307834;ENST00000410026;ENST00000409510 | chr2 | 192548016 | 192548103 | + | TSF |
| 1% | chr11 | 67786242 | 67786362 | + | ENST00000539229 ENST00000316367;ENST00000007633;ENST00000342456 | chr11 | 67786535 | 67786588 | + | TSF |
| 1% | chr8 | 62546242 | 62546242 | − | ENST00000541428;ENST00000379454;ENST00000522919;ENST00000356457;ENST00000519234;ENST000005 | chr8 | 62544404 | 62544571 | − | TSF |

| 1 | 2 | 3 | 4 | 5 | 6 | 7 | 8 | 9 | 10 | 11 |
|---|---|---|---|---|---|---|---|---|---|---|
| 1% | chr12 | 102547647 | 102547754 | + | 18068;ENST00000517903;ENST00000445642;ENST00000517847;ENST00000522835 ENST00000327680; ENST000003781 28;ENST000005413 94;ENST00000358 383;ENST0000039 2911;ENST000004 12715;ENST00000 417507;ENST0000 0457614 | chr12 | 102548605 | 102548938 | + | TSF |
| 1% | chr19 | 18710375 | 18710375 | − | ENST00000392386 | chr19 | 18709961 | 18710215 | − | TSF |
| 1% | chr10 | 79796952 | 79797062 | + | ENST00000435275; ENST0000044069 2;ENST000003723 60;ENST00000360 830 | chr4 | 176584518 | 176584519 | + | TSF |
| 1% | chrX | 41598637 | 41598637 | − | ENST00000421587; ENST0000031858 8;ENST000003619 62;ENST00000378 163;ENST0000037 8158;ENST000003 78166;ENST00000 442742;ENST0000 0378154 | chrX | 41557348 | 41557352 | − | TSF |
| 1% | chr10 | 5037511 | 5037511 | − | ENST00000380753; ENST0000042119 6;ENST000004076 74 | chr10 | 5023140 | 5023482 | − | TSF |
| 1% | chr20 | 37384500 | 37384682 | + | ENST00000243903 | chr20 | 37390296 | 37390409 | + | TSF |
| 1% | chr4 | 169086398 | 169086477 | + | ENST00000359299 | chr4 | 169090666 | 169090754 | + | TSF |
| 1% | chr22 | 23165476 | 23165642 | + | ENST00000390317 | chr22 | 23175722 | 23175755 | + | TSF |
| 1% | chr4 | 25759156 | 25759156 | − | ENST00000399878; ENST0000026486 8;ENST000005029 49;ENST00000510 448 | chr4 | 25723603 | 25724054 | − | TSF |

Table 4. Coordinates of the fusion sequences for which the donor is the TE. The names of the columns are the following:
1. Frequency in LUAD cohort
2. Donor Chromosome TE
3. Donor start TE
4. Donor Breakpoint TE
5. Donor strand TE
6. Acceptor Chromosome exon
7. Acceptor Breakpoint exon
8. Acceptor end exon
9. Acceptor strand exon
10. Acceptor transcript
11. Fusion type The fusion transcript sequences of table 4 correspond in the same order to SEQ ID NO: 432-910 (with same reasoning as table 3 above).

| 1 | 2 | 3 | 4 | 5 | 6 | 7 | 8 | 9 | 10 | 11 |
|---|---|---|---|---|---|---|---|---|---|---|
| 51% | chr12 | 122430912 | 122431655 | + | chr12 | 122437622 | 122437850 | + | ENST00000288912 | TSA |
| 50% | chr12 | 122430912 | 122431578 | + | chr12 | 122437622 | 122437850 | + | ENST00000288912 | TSA |
| 42% | chr8 | 104389530 | 104389551 | + | chr8 | 104390255 | 104390471 | + | ENST00000330295; ENST00000520337 | TSA |
| 36% | chr12 | 122430912 | 122431615 | + | chr12 | 122437622 | 122437850 | + | ENST00000288912 | TSA |
| 36% | chr17 | 80440912 | 80441180 | + | chr17 | 80441592 | 80441655; 80441659 | + | ENST00000390006; ENST00000309794; ENST00000345415; ENST00000457415; ENST00000577432; ENST00000584513; ENST00000412079 | TSA |
| 32% | chr20 | 44420870 | 44421070 | + | chr20 | 44421316 | 44421386 | + | ENST00000372622; ENST00000449078; ENST00000456939 | |

-continued

| 1 | 2 | 3 | 4 | 5 | 6 | 7 | 8 | 9 | 10 | 11 |
|---|---|---|---|---|---|---|---|---|---|---|
| 32% | chr6 | 80021194 | 80022085 | − | chr6 | 79924739 | 79924739 | − | ENST00000275036; ENST00000344726 | TSF |
| 24% | chr7 | 116364854 | 116364901 | + | chr7 | 116371722 | 116371913 | + | ENST00000397752; ENST00000318493; ENST00000436117 | TSA |
| 23% | chr17 | 70713482 | 70713885 | − | chr17 | 70645407 | 70645407 | − | ENST00000255559; ENST00000542342; ENST00000582769 | TSF |
| 22% | chr10 | 5077666 | 5077808 | + | chr10 | 5138602 | 5138769 | + | ENST00000602997; ENST00000605149; ENST00000380554 | TSA |
| 19% | chr10 | 5059958 | 5060092 | − | chr10 | 5043873 | 5043873 | − | ENST00000380753; ENST00000421196; ENST00000407674; ENST00000604507; ENST00000455190 | TSA |
| 18% | chr11 | 423924 | 423942 | − | chr11 | 421198 | 421198 | − | ENST00000332826 | TSA |
| 17% | chr5 | 66178759 | 66178848 | + | chr5 | 66195779 | 66195810 | + | ENST00000404260; ENST00000403625; ENST00000406374; ENST00000406039; ENST00000452953; ENST00000432817; ENST00000434115; ENST00000411628; ENST00000490016; ENST00000403666; ENST00000450827 | TSA |
| 16% | chr4 | 100015102 | 100021056 | − | chr4 | 100006367 | 100006367 | − | ENST00000296412; ENST00000512659; ENST00000503130; ENST00000502590; ENST00000505652 | TSA |
| 16% | chr11 | 93467948 | 93468129 | − | chr11 | 93467826 | 93467826 | − | ENST00000393259; ENST00000527169 | TSA |
| 15% | chr17 | 70670228 | 70670643 | − | chr17 | 70645407 | 70645407 | − | ENST00000255559; ENST00000542342; ENST00000582769 | TSA |
| 14% | chr5 | 822923 | 823504 | − | chr5 | 822010 | 822010 | − | ENST00000424784; ENST00000283441 | TSA |
| 12% | chr20 | 31764878 | 31764929 | + | chr20 | 31765953 | 31766034 | + | ENST00000253362; ENST00000354932 | TSA |
| 10% | chr5 | 1474878 | 1475076 | − | chr5 | 1474800 | 1474800 | − | ENST00000475622; ENST00000283415 | TSF |
| 9% | chr19 | 14129234 | 14129243 | + | chr19 | 14141522 | 14141549; 14141760 | + | ENST00000585987; ENST00000431365 | TSF |
| 9% | chr7 | 48039432 | 48039725 | − | chr7 | 48035743 | 48035743 | − | ENST00000453071; ENST00000297325; ENST00000412371; ENST00000412142; ENST00000395572; ENST00000453192; ENST00000438771 | TSF |
| 8% | chr10 | 33505378 | 33505616 | − | chr10 | 33502645 | 33502645 | − | ENST00000432372; ENST00000374875; ENST00000265371; ENST00000374867; ENST00000395995; ENST00000374821; ENST00000374822; ENST00000374823; ENST00000374816 | TSF |
| 7% | chrX | 107293989 | 107294242 | + | chrX | 107301268 | 107301431 | + | ENST00000415430; ENST00000217957; ENST00000458383 | TSF |
| 5% | chr7 | 7558677 | 7558760 | − | chr7 | 7557468 | 7557468 | − | ENST00000399429; ENST00000444268 | TSF |
| 5% | chr3 | 182832430 | 182833262 | − | chr3 | 182812393 | 182812393 | − | ENST00000265594; ENST00000497830; ENST00000495767; ENST00000476176; ENST00000487634; ENST00000466650; ENST00000486226 | TSF |
| 5% | chr3 | 98584565 | 98586135 | − | chr3 | 98568442 | 98568442 | − | ENST00000449482; ENST00000326840; ENST00000326857 | TSF |

| 1 | 2 | 3 | 4 | 5 | 6 | 7 | 8 | 9 | 10 | 11 |
|---|---|---|---|---|---|---|---|---|---|---|
| 4% | chr2 | 143794737 | 143794842 | + | chr2 | 143797997 | 143798227 | + | ENST00000264170; ENST00000409512 | TSF |
| 4% | chr10 | 5056485 | 5057095 | − | chr10 | 5043873 | 5043873 | − | ENST00000380753; ENST00000421196; ENST00000407674; ENST00000604507; ENST00000455190 | TSF |
| 4% | chr12 | 122430912 | 122432103 | + | chr12 | 122437622 | 122437850 | + | ENST00000288912 | TSF |
| 4% | chr12 | 122430912 | 122431795 | + | chr12 | 122437622 | 122437850 | + | ENST00000288912 | TSF |
| 4% | chr22 | 22899861 | 22899965 | − | chr22 | 22893511 | 22893511 | − | ENST00000406503; ENST00000398743; ENST00000398741; ENST00000543184; ENST00000405655; ENST00000402697; ENST00000439106; ENST00000438888; ENST00000420709; ENST00000403441; ENST00000442481 | TSF |
| 4% | chr12 | 117498474 | 117498567 | − | chr12 | 117494691 | 117494691 | − | ENST00000470612; ENST00000335209; ENST00000392545; ENST00000462502 | TSF |
| 4% | chr8 | 104389530 | 104389536 | + | chr8 | 104390255 | 104390471 | + | ENST00000330295; ENST00000520337 | TSF |
| 4% | chr2 | 38982396 | 38983253 | − | chr2 | 38977336 | 38977336 | − | ENST00000313117; ENST00000425778; ENST00000425941; ENST00000446327; ENST00000409276; ENST00000431066; ENST00000443213 | TSF |
| 4% | chr5 | 66178759 | 66179020 | + | chr5 | 66195779 | 66195810 | + | ENST00000404260; ENST00000403625; ENST00000406374; ENST00000406039; ENST00000452953; ENST00000432817; ENST00000434115; ENST00000411628; ENST00000490016; ENST00000403666; ENST00000450827 | TSF |
| 4% | chr20 | 45337040 | 45337192 | + | chr20 | 45353680 | 45354963 | + | ENST00000359271 | TSF |
| 4% | chr4 | 57559029 | 57559845 | − | chr4 | 57522178 | 57522178 | − | ENST00000420433; ENST00000554144; ENST00000508121; ENST00000557328 | TSF |
| 4% | chr7 | 56018506 | 56018522 | + | chr7 | 56020872 | 56021011 | + | ENST00000426595 | TSF |
| 4% | chr6 | 117763522 | 117763597 | − | chr6 | 117739669 | 117739669 | − | ENST00000368507; ENST00000368508 | TSF |
| 3% | chr19 | 1114639 | 1114676 | − | chr19 | 1114421 | 1114421 | − | ENST00000361757; ENST00000587024; ENST00000438103 | TSF |
| 3% | chr5 | 147244208 | 147245387 | + | chr5 | 147261009 | 147261211 | + | ENST00000296694 | TSF |
| 3% | chr17 | 39974832 | 39974893 | + | chr17 | 39975462 | 39975651 | + | ENST00000321562 | TSF |
| 3% | chr12 | 122430912 | 122432282 | + | chr12 | 122437622 | 122437850 | + | ENST00000288912 | TSF |
| 3% | chr4 | 57559029 | 57559885 | − | chr4 | 57522178 | 57522178 | − | ENST00000420433; ENST00000554144; ENST00000508121; ENST00000557328 | TSF |
| 3% | chr4 | 872984 | 873014 | − | chr4 | 871597 | 871597 | − | ENST00000314167; ENST00000511163 | TSF |
| 3% | chr22 | 42509838 | 42511212 | − | chr22 | 42483179 | 42483179 | − | ENST00000602404; ENST00000498737 | TSF |
| 3% | chr22 | 29117270 | 29117506 | − | chr22 | 29115473 | 29115473 | − | ENST00000348295; ENST00000382566; ENST00000382578; ENST00000404276; ENST00000328354; ENST00000405598; ENST00000382580; ENST00000433728; | TSF |

-continued

| 1 | 2 | 3 | 4 | 5 | 6 | 7 | 8 | 9 | 10 | 11 |
|---|---|---|---|---|---|---|---|---|---|---|
| | | | | | | | | | ENST00000402731; ENST00000403642; ENST00000439200; ENST00000448511 | |
| 3% | chr8 | 117816470 | 117816753 | + | chr8 | 117861127 | 117861256; 117861276 | + | ENST00000517820; ENST00000520733 | TSF |
| 3% | chr16 | 66461229 | 66461334 | + | chr16 | 66503505 | 66503768 | + | ENST00000536005 | TSF |
| 3% | chr17 | 70713482 | 70713885 | − | chr17 | 70709120 | 70709120 | − | ENST00000581581 | TSF |
| 3% | chr17 | 39976225 | 39976301 | + | chr17 | 39976521 | 39976713 | + | ENST00000321562; ENST00000455106; ENST00000544340 | TSF |
| 3% | chr1 | 223720296 | 223720355 | − | chr1 | 223718212 | 223718212 | − | ENST00000430824; ENST00000366872 | TSF |
| 3% | chrX | 151404470 | 151410406 | − | chrX | 151393317 | 151393317 | − | ENST00000370314; ENST00000535043 | TSF |
| 3% | chr16 | 74833176 | 74833256 | − | chr16 | 74774013 | 74774013 | − | ENST00000219368; ENST00000567683; ENST00000569949 | TSF |
| 2% | chr16 | 4708255 | 4708353 | + | chr16 | 4714710 | 4714776 | + | ENST00000262370; ENST00000415496; ENST00000536343; ENST00000587747; ENST00000399577; ENST00000588994; ENST00000586183; ENST00000590790 | TSF |
| 2% | chr1 | 1422590 | 1422685 | + | chr1 | 1423243 | 1423294 | + | ENST00000308647 | TSF |
| 2% | chr7 | 44158104 | 44158351 | − | chr7 | 44157663 | 44157663 | − | ENST00000406581; ENST00000223361; ENST00000452185; ENST00000433715; ENST00000456038; ENST00000418438 | TSF |
| 2% | chr10 | 5059958 | 5060092 | − | chr10 | 5043777 | 5043873 | − | ENST00000380753; ENST00000421196; ENST00000407674; ENST00000604507; ENST00000455190 | TSF |
| 2% | chr8 | 121656402 | 121662337 | − | chr8 | 121644891 | 121644891 | − | ENST00000395601; ENST00000517992 | TSF |
| 2% | chr15 | 43467899 | 43467988 | + | chr15 | 43470805 | 43470909 | + | ENST00000260403 | TSF |
| 2% | chr5 | 58596413 | 58596862 | − | chr5 | 58511794 | 58511794 | − | ENST00000340635; ENST00000360047; ENST00000507116; ENST00000503258; ENST00000405755; ENST00000502484; ENST00000546160; ENST00000309641; ENST00000502575 | TSF |
| 2% | chr14 | 106258470 | 106258725 | − | chr14 | 106209234 | 106209408 | − | ENST00000390548; ENST00000390549; ENST00000390542 | TSF |
| 2% | chrX | 149996757 | 149996779 | − | chrX | 149963959 | 149963959 | − | ENST00000370377; ENST00000466436; ENST00000418547 | TSF |
| 2% | chr14 | 106258470 | 106258725 | − | chr14 | 106237569 | 106237742 | − | ENST00000390551 | TSF |
| 2% | chrX | 123617772 | 123617816 | − | chrX | 123615814 | 123615814 | − | ENST00000371130; ENST00000422452 | TSF |
| 2% | chrX | 100654643 | 100654732 | − | chrX | 100653934 | 100653934 | − | ENST00000218516 | TSF |
| 2% | chr1 | 156716126 | 156716133 | − | chr1 | 156715165 | 156715165 | − | ENST00000357325; ENST00000537739; ENST00000368209; ENST00000368206 | TSF |
| 2% | chr18 | 70839859 | 70840073 | − | chr18 | 7082920 | 70829208 | − | ENST00000581011; ENST00000581862 | TSF |
| 2% | chr5 | 132737208 | 132737281 | − | chr5 | 132736678 | 132736678 | − | ENST00000265342; ENST00000510685 | TSF |
| 2% | chr2 | 89366766 | 89370031 | − | chr2 | 89292018 | 89292223 | − | ENST00000495489 | TSF |
| 2% | chr6 | 32745845 | 32746483 | − | chr6 | 32731247 | 32731247 | − | ENST00000411527; ENST00000435145; ENST00000437316 | TSF |
| 2% | chr1 | 236485526 | 236485567 | − | chr1 | 236433294 | 236433294 | − | ENST00000354619; ENST00000327333 | TSF |

-continued

| 1 | 2 | 3 | 4 | 5 | 6 | 7 | 8 | 9 | 10 | 11 |
|---|---|---|---|---|---|---|---|---|---|---|
| 2% | chr1 | 224527533 | 224527861 | + | chr1 | 224553581 | 224553693 | + | ENST00000465271; ENST00000366858; ENST00000366857; ENST00000366856 | TSF |
| 2% | chr16 | 74834260 | 74834274 | − | chr16 | 74774013 | 74774013 | − | ENST00000219368; ENST00000567683; ENST00000569949 | TSF |
| 2% | chr18 | 71976895 | 71977013 | − | chr18 | 71930712 | 71930712 | − | ENST00000340533; ENST00000494131; ENST00000397914 | TSF |
| 2% | chr2 | 85823332 | 85823377 | + | chr2 | 85823642 | 85823772 | + | ENST00000441634; ENST00000306368; ENST00000414390; ENST00000443647; ENST00000456023 | TSF |
| 2% | chr14 | 92119780 | 92119864 | − | chr14 | 92105594 | 92105594 | − | ENST00000256343; ENST00000557036 | TSF |
| 2% | chr4 | 57559029 | 57559962 | − | chr4 | 57522178 | 57522178 | − | ENST00000420433; ENST00000554144; ENST00000508121; ENST00000557328 | TSF |
| 2% | chr8 | 144690895 | 144690934 | − | chr8 | 144690296 | 144690296 | − | ENST00000220966; ENST00000433751 | TSF |
| 2% | chr12 | 104681506 | 104681628 | + | chr12 | 104682709 | 104682818 | + | ENST00000378070; ENST00000525566; ENST00000429002; ENST00000526691; ENST00000388854; ENST00000542918 | TSF |
| 2% | chr5; chr5 | 52897435; 52897700 | 52897704 | +  + | chr5 | 52899282 | 52899360 | + | ENST00000502423; ENST00000296684; ENST00000506974; ENST00000506765 | TSF |
| 2% | chr11 | 60694460 | 60694542 | + | chr11 | 60694676 | 60694890 | + | ENST00000453848; ENST00000005286 | TSF |
| 2% | chr1 | 23762004 | 23762216 | − | chr1 | 23761111 | 23761111 | − | ENST00000495646; ENST00000336689; ENST00000437606 | TSF |
| 2% | chr7 | 50763231 | 50763289 | − | chr7 | 50742355 | 50742355 | − | ENST00000439599; ENST00000398812; ENST00000403097; ENST00000357271; ENST00000401949; ENST00000439044 | TSF |
| 2% | chr15 | 34452835 | 34453416 | − | chr15 | 34446885 | 34446885 | − | ENST00000256544; ENST00000557877; ENST00000560108; ENST00000559515 | TSF |
| 2% | chr12 | 6458902 | 6458996 | − | chr12 | 6458387 | 6458387 | − | ENST00000360168; ENST00000358945; ENST00000540037; ENST00000228916; ENST00000543768 | TSF |
| 2% | chr7 | 95053024 | 95053104 | − | chr7 | 95045609 | 95045609 | − | ENST00000536183; ENST00000455123; ENST00000433091; ENST00000222572 | TSF |
| 2% | chr19 | 11140024 | 11140045 | + | chr19 | 11141406 | 11141569 | + | ENST00000358026; ENST00000344626; ENST00000429416; ENST00000541122; ENST00000589677; ENST00000444061; ENST00000590574; ENST00000413806; ENST00000450717 | TSF |
| 2% | chr12 | 58189709 | 58189746 | + | chr12 | 58189960 | 58189980; 58190044; 58190366 | + | ENST00000540550; ENST00000457189; ENST00000454289; ENST00000323833; ENST00000350762 | TSF |
| 2% | chr14 | 70466641 | 70466673 | + | chr14 | 70477471 | 70477663 | + | ENST00000361956; ENST00000381280 | TSF |
| 2% | chr10 | 3133726 | 3133857 | + | chr10 | 3141467 | 3141544 | + | ENST00000607886; ENST00000381125; ENST00000381075; ENST00000407806 | TSF |

-continued

| 1 | 2 | 3 | 4 | 5 | 6 | 7 | 8 | 9 | 10 | 11 |
|---|---|---|---|---|---|---|---|---|---|---|
| 2% | chr7 | 134212336 | 134212386 | + | chr7 | 134215479 | 134215562 | + | ENST00000359579 | TSF |
| 2% | chr2 | 135250006 | 135250213 | − | chr2 | 135223796 | 135223796 | − | ENST00000281924 | TSF |
| 2% | chr7 | 30468003 | 30468120 | − | chr7 | 30465326 | 30465326 | − | ENST00000222823 | TSF |
| 2% | chr17 | 90088 | 90313 | − | chr17 | 69527 | 69527 | − | ENST00000331302; ENST00000323434; ENST00000536489 | TSF |
| 1% | chr7 | 6423751 | 6423803 | + | chr7 | 6426843 | 6426914 | + | ENST00000348035; ENST00000356142 | TSF |
| 1% | chr7 | 95053024 | 95053140 | − | chr7 | 95045609 | 95045609 | − | ENST00000536183; ENST00000455123; ENST00000433091; ENST00000222572 | TSF |
| 1% | chr10 | 5049827 | 5050220 | − | chr10 | 5043873 | 5043873 | − | ENST00000380753; ENST00000421196; ENST00000407674; ENST00000604507; ENST00000455190 | TSF |
| 1% | chr15 | 43431174 | 43431330 | + | chr15 | 43440953 | 43441077 | + | ENST00000564698; ENST00000260403; ENST00000564494 | TSF |
| 1% | chr19 | 50492001 | 50492051 | − | chr19 | 50491749 | 50491749 | − | ENST00000593919; ENST00000316763; ENST00000377011; ENST00000599538; ENST00000443401; ENST00000601341; ENST00000594948; ENST00000601912; ENST00000594092; ENST00000593912 | TSF |
| 1% | chr1 | 26595323 | 26595855 | + | chr1 | 26595951 | 26596105 | + | ENST00000451429; ENST00000476272; ENST00000252992; ENST00000453146 | TSF |
| 1% | chr20 | 43561150 | 43561175 | + | chr20 | 43561713 | 43561826 | + | ENST00000255136; ENST00000217073 | TSF |
| 1% | chr10 | 5059958 | 5060092 | − | chr10 | 5043783 | 5043873 | − | ENST00000380753; ENST00000421196; ENST00000407674; ENST00000604507; ENST00000455190 | TSF |
| 1% | chr2 | 26947307 | 26947428 | + | chr2 | 26950535 | 26951436 | + | ENST00000302909 | TSF |
| 1% | chr10 | 99600727 | 99601513 | + | chr10 | 99619215 | 99619340 | + | ENST00000370602 | TSF |
| 1% | chr20 | 58402976 | 58403213 | + | chr20 | 58411560 | 58411615 | + | ENST00000359926; ENST00000371015; ENST00000395639; ENST00000541461; ENST00000355648; ENST00000361300; ENST00000395636 | TSF |
| 1% | chr14 | 105641713 | 105641815 | − | chr14 | 105639598 | 105639598 | − | ENST00000392568 | TSF |
| 1% | chr5 | 34913998 | 34914032 | − | chr5 | 34913683 | 34913683 | − | ENST00000382038; ENST00000341754 | TSF |
| 1% | chr4 | 39516293 | 39516533 | − | chr4 | 39515804 | 39515804 | − | ENST00000316423; ENST00000501493; ENST00000506179; ENST00000515021; ENST00000514106; ENST00000509391; ENST00000505698 | TSF |
| 1% | chr8 | 140818301 | 140818376 | − | chr8 | 140744445 | 140744445 | − | ENST00000389327; ENST00000389328; ENST00000520857; ENST00000438773 | TSF |
| 1% | chr20 | 44442461 | 44442685 | + | chr20 | 44443023 | 44443109 | + | ENST00000356455; ENST00000405520; ENST00000335046; ENST00000372568 | TSF |
| 1% | chr17 | 66244121 | 66244199 | + | chr17 | 66244785 | 66244846 | + | ENST00000584837 | TSF |
| 1% | chr17 | 17051276 | 17051346 | + | chr17 | 17053458 | 17053547 | + | ENST00000395811; ENST00000444976; ENST00000395804; ENST00000341712; ENST00000584067 | TSF |

-continued

| 1 | 2 | 3 | 4 | 5 | 6 | 7 | 8 | 9 | 10 | 11 |
|---|---|---|---|---|---|---|---|---|---|---|
| 1% | chr6 | 39267897 | 39268149 | − | chr6 | 39267513 | 39267513 | − | ENST00000373231 | TSF |
| 1% | chr20 | 25840234 | 25840376 | − | chr20 | 25755948 | 25755948; 25755972 | − | ENST00000376403; ENST00000584071 | TSF |
| 1% | chr2 | 90168849 | 90168893 | + | chr2 | 90193334 | 90193424 | + | ENST00000390275 | TSF |
| 1% | chr19 | 50174724 | 50174836 | + | chr19 | 50176955 | 50177005; 50177034 | + | ENST00000441864; ENST00000246785; ENST00000598306; ENST00000600947 | TSF |
| 1% | chr11 | 85339945 | 85340247 | + | chr11 | 85342731 | 85342852 | + | ENST00000358867; ENST00000534341 | TSF |
| 1% | chr19 | 17421511 | 17421655 | + | chr19 | 17424832 | 17424912 | + | ENST00000593466; ENST00000359866; ENST00000596582 | TSF |
| 1% | chr3 | 32323981 | 32324151 | + | chr3 | 32398865 | 32399038 | + | ENST00000307526 | TSF |
| 1% | chr4 | 57559029 | 57559925 | − | chr4 | 57522178 | 57522178 | − | ENST00000420433; ENST00000554144; ENST00000508121; ENST00000557328 | TSF |
| 1% | chrX | 107265928 | 107266261 | + | chrX | 107301268 | 107301431 | + | ENST00000415430; ENST00000217957; ENST00000458383 | TSF |
| 1% | chr2 | 143715736 | 143715823 | + | chr2 | 143718193 | 143718339 | + | ENST00000264170; ENST00000375773; ENST00000409512 | TSF |
| 1% | chr20 | 25841897 | 25842039 | − | chr20 | 25755948 | 25755948; 25755972 | − | ENST00000376403; ENST00000584071 | TSF |
| 1% | chr8 | 98817265 | 98817331 | + | chr8 | 98817581 | 98817692 | + | ENST00000445593; ENST00000521545; ENST00000517924 | TSF |
| 1% | chr17 | 45698288 | 45698367 | + | chr17 | 45699134 | 45699286 | + | ENST00000530173; ENST00000322157; ENST00000544660; ENST00000528565 | TSF |
| 1% | chr19 | 46194383 | 46194670 | − | chr19 | 46191824 | 46191824 | − | ENST00000342669; ENST00000588301; ENST00000590212 | TSF |
| 1% | chr21 | 38272435 | 38272892 | − | chr21 | 38269431 | 38269431 | − | ENST00000336648; ENST00000399120 | TSF |
| 1% | chr4 | 162585892 | 162585968 | − | chr4 | 162577646 | 162577646 | − | ENST00000306100; ENST00000379164; ENST00000536695; ENST00000427802 | TSF |
| 1% | chr4 | 40352026 | 40352049 | + | chr4 | 40355996 | 40356537 | + | ENST00000310169 | TSF |
| 1% | chr20 | 25843554 | 25843696 | − | chr20 | 25755948 | 25755948; 25755972 | − | ENST00000376403; ENST00000584071 | TSF |
| 1% | chrX | 138072586 | 138072670 | − | chrX | 137939841 | 137939841 | − | ENST00000370603; ENST00000436198; ENST00000455663; ENST00000448673 | TSF |
| 1% | chr2 | 97560868 | 97560977 | − | chr2 | 97559788 | 97559788 | − | ENST00000327896; ENST00000417561; ENST00000490605 | TSF |
| 1% | chr11 | 60933230 | 60933962 | − | chr11 | 60901679 | 60901679 | − | ENST00000301765; ENST00000538036 | TSF |
| 1% | chr9 | 130929707 | 130929818 | − | chr9 | 130929443 | 130929443 | − | ENST00000372954; ENST00000393608; ENST00000541172; ENST00000325721; ENST00000357558; ENST00000538431; ENST00000277465; ENST00000372948; ENST00000372938; ENST00000415526 | TSF |
| 1% | chr21 | 39513161 | 39513404 | + | chr21 | 39528398 | 39528496 | + | ENST00000357704; ENST00000400477 | TSF |
| 1% | chr8 | 63314966 | 63315263 | + | chr8 | 63492098 | 63492235 | + | ENST00000523211; ENST00000524201; ENST00000328472 | TSF |
| 1% | chr4 | 186460593 | 186460994 | − | chr22 | 23243156 | 23243475 | − | ENST00000390323 | TSF |
| 1% | chr12 | 8864869 | 8864879 | + | chr12 | 8866407 | 8866637 | + | ENST00000537189 | TSF |
| 1% | chr10 | 5059958 | 5060040 | − | chr10 | 5043873 | 5043873 | − | ENST00000380753; ENST00000421196; ENST00000407674; ENST00000604507; ENST00000455190 | TSF |

-continued

| 1 | 2 | 3 | 4 | 5 | 6 | 7 | 8 | 9 | 10 | 11 |
|---|---|---|---|---|---|---|---|---|---|---|
| 1% | chr7 | 65418154 | 65418399 | + | chr7 | 65419061 | 65419287; 65419400 | + | ENST00000360768; ENST00000434382 | TSF |
| 1% | chr1 | 156305244 | 156305264 | − | chr1 | 156304709 | 156304709 | − | ENST00000295688; ENST00000368258; ENST00000413555; ENST00000496684; ENST00000478640; ENST00000415548 | TSF |

The peptides were then further screened against a reference proteome, typically for human subject against all sequences present in Uniprot (representing all the sequences encoded in the human exome). Peptides were considered equal to those in Uniprot if they had the same amino acid sequence or if they only differed in the amino acid in the first or last position. All these equal sequences were then discarded from the candidate list. 117 peptide sequences derived from these 230 fusion transcripts where thus predicted to bind to HLA-A2: 01 (see table 5 below).

TABLE 5

Peptides LUAD

| SEQ ID | Peptide sequence |
|---|---|
| 1 | RLLHLESFL |
| 2 | TLMNLVQVL |
| 3 | ILHSLVTGV |
| 4 | FMMEQVGLA |
| 5 | AMDGKELSL |
| 6 | TLAYGKYYI |
| 7 | GLIQLIWLA |
| 8 | GMVDGGSNI |
| 9 | YLWTTFFPL |
| 10 | ALWEAKMII |
| 11 | WLSSRVTQL |
| 12 | AILPKANTV |
| 13 | VLLFEVELV |
| 14 | GLDTGLQGM |
| 15 | SLLDGTQLF |
| 16 | GLPTGYLFV |
| 17 | LLDRFGYHV |
| 18 | SLLEETQAI |
| 19 | MLLVQPAEL |
| 20 | GLLNISHTA |
| 21 | HLYEPWFPV |
| 22 | YLQGLPLPL |
| 23 | KAVEGILAV |
| 24 | MIYEENNRL |

TABLE 5-continued

Peptides LUAD

| SEQ ID | Peptide sequence |
|---|---|
| 25 | YLPYFLKSL |
| 26 | GLYSLSSVV |
| 27 | LMISRTPEV |
| 28 | LLGGPSVFL |
| 29 | ILSGYGPCV |
| 30 | FLPDLDRPL |
| 31 | AMDGKELSL |
| 32 | RMDFEDLGL |
| 33 | TLIFNPTEI |
| 34 | LLPGLLLLL |
| 35 | LLLVHQHAV |
| 36 | FLDDAPPGT |
| 37 | VLIRYVWTL |
| 38 | YLCGHLHTL |
| 39 | VLSQLTILI |
| 40 | TLGGLMPVL |
| 41 | FLQGSITFI |
| 42 | MLLLYIWQV |
| 43 | YLKIMPVHL |
| 44 | HTLGGLMPV |
| 45 | YIMARVLFV |
| 46 | FILRTDHYI |
| 47 | IMSSAIAYL |
| 48 | FIIGILQLA |
| 49 | YLLQEIYGI |
| 50 | GVFPVVIQA |
| 51 | ALVHLPSQL |
| 52 | GLHPAKPQV |
| 53 | MLVTWELAL |
| 54 | VLLTNTIWL |

TABLE 5-continued

Peptides LUAD

| SEQ ID | Peptide sequence |
|---|---|
| 55 | ALVHLPSQL |
| 56 | CLIDEMPEA |
| 57 | ALMGGFMKT |
| 58 | LLLHLPLXL |
| 59 | TLQDKNLGL |
| 60 | ILANLPPAL |
| 61 | PLWDGMAGL |
| 62 | GLDHQTHPL |
| 63 | GMFLLPPQL |
| 64 | RLADHLSFC |
| 65 | RMRDQLPAL |
| 66 | GLLHAEVAL |
| 67 | SLQNCQVSV |
| 68 | VISAFPSEV |
| 69 | ALAIAALEL |
| 70 | VLDGLDVLL |
| 71 | ELFPPLFMA |
| 72 | FLIVAEILI |
| 73 | IVAEILISL |
| 74 | KAVEGILAV |
| 75 | YLPHLPQVL |
| 76 | MLLDPMGGI |
| 77 | RLLHLESFL |
| 78 | YLAYILYFV |
| 79 | LMTSSIMSV |
| 80 | MLMKTVWQA |
| 81 | SLQPEDMAL |
| 82 | KILTYFPMV |
| 83 | FLGTRVTRV |
| 84 | SLMQSGSPV |
| 85 | VLMWTMAHL |
| 86 | LLGETKVYV |
| 87 | KILTYFPMV |
| 88 | SLLERGLEA |
| 89 | VLSSLNVPL |
| 90 | FLERKSIRV |
| 91 | FVGSSTFYL |
| 92 | FLYTGDFFL |
| 93 | SVGPFALTV |
| 94 | NLALPLPKV |
| 95 | VLESGLYQV |
| 96 | MLVAITVLI |
| 97 | FMDDAKILF |
| 98 | ALVHLPSQL |
| 99 | ILTASITSI |
| 100 | AMDGKELSL |
| 101 | SLGWNISGV |
| 102 | MISAFPNEV |
| 103 | RLTHELPGI |
| 104 | LLFSDGEKV |
| 105 | RLNESTTFV |
| 106 | KLEELKSFV |
| 107 | SINEEIQTV |
| 108 | RLHDGPLRA |
| 109 | MISAFPNEV |
| 110 | ILHTSVPFL |
| 111 | YLENMVSGV |
| 112 | QLLGRLESL |
| 113 | RLLHLESFL |
| 114 | ALLRQMEGI |
| 115 | TLNKDFQEV |
| 116 | IMEQGDLSV |
| 117 | RLLHLESFL |

2.2.2 Validation on HLA-A2 Associated Peptides

Given that HLA-A2 allele is expressed in almost 50% of the Caucasian population, together with the existence of different technical tools, validations were focused on HLA-A2-associated peptides.

In the following paragraphs TE-Exon derived-transcripts is used interchangeably with "fusion transcripts" and the term "TE-derived peptides" is used interchangeably with "fusion transcripts-derived peptides.

Expression of TE-Exon Derived-Transcripts in Lung Adenocarcinoma Samples

To experimentally validate the predicted TE-Exon transcripts, the expression by PCR in LUAD tumor samples and tumor cell lines was validated firstly. Specific primers for each chimeric fusion were thus designed, in order to have one of them binding to the TE part and the other to the Exon part of the fusion. The results were further confirmed by sequencing of the PCR products.

In particular, specific primers were designed in such a way that the forward primer was binding in the "donor" sequence and the reverse primer was binding in the "acceptor" sequence of the reconstructed fusion sequence. PCR reactions were run on RNA derived from lung tumor samples and human tumor cell lines. Amplifications products were seeded on agarose gels and bands found on the expected size were cut and sequenced. Finally, sequenced PCR products were compared with the reconstructed fusion sequence. Using this approach, it was possible to confirm the presence of predicted fusion transcripts both in LUAD tumor samples and tumor cell lines. Table 6 below summarizes the results found for 8 of the most frequent chimeric fusions with a predicted peptide associated to bind with high affinity to HLA-A2 allele.

Table 6: Most frequent fusion transcript validation. The most frequent fusions peptides were validated by PCR in 15 LUAD tumor samples and 6 LUAD tumor cell lines. The status 'Yes' or 'No' in the table below indicates the presence or absence of the PCR product on the expected size. When the PCR product was further validated by sequencing, is denoted as 'Yes'.

Figure 11A:
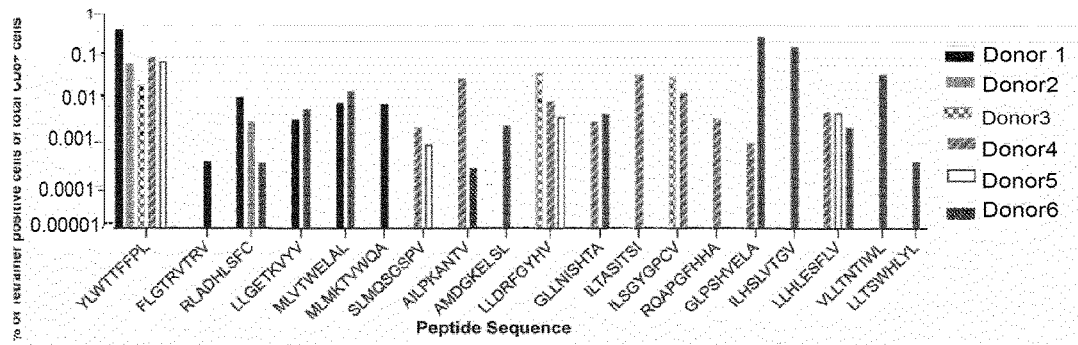
FIGS. 11A-11D: Immunogenicity of fusion transcripts-derived peptides and reactive CD8+ T cells generation.

PBMCs from HLA-A2+ healthy donors were used to generate monocyte derived-DCs (moDCs). After loading the moDCs with a mix of synthetic peptides, autologous co-culture was performed with CD4+ and CD8+ T cells. Finally, the expansion of specific CD8+ T cells was analysed by flow cytometry using two-colours tetramer staining. As a control of specific expansion, the co-culture was performed in the absence of peptides. By using this approach in one donor, it has been possible to identify and expand specific CD8+ T cells recognizing 6 of the most frequent chimeric fusion derived-peptides (RLLHLESFL, LLGETKVYV, AILPKANTV, RLADHLSFC, FLIVAEILI, YLWTTFFPL). This result is evidenced by an increase in at least one magnitude order of the percentage of tetramer positive cells compared to control test among total CD8+ T cells. The same experiment was performed in order to evaluate the response in additional 5 donors. FIG. 11A summarizes the results obtained for the total of 6 donors analyzed in which we found specific CD8+ T expansions for 21 of the most frequent fusions transcripts-derived peptides

|  |  | TE-Exon fusion derived-peptides asociated to bind HLA-A2 | | | | | | | |
|---|---|---|---|---|---|---|---|---|---|
|  | Frequency | 119 | 48 | 28 | 24 | 23 | 19 | 18 | 16 |
|  | peptide sequence | RLLHL ESFL | MLMKT VWQA | FLGTR VTRV | AILPKA NTV | YLPYF LKSL | AMDG KELSL | FLIVAEILI | RLADHLSFC |
| LUAD tumor cell lines | H1975 | Yes | Yes | No | No | Yes | No | No | No |
|  | H1650 | Yes | No | No | No | No | No | No | Yes |
|  | H1299 | Yes | No | No | No | No | No | No | Yes |
|  | A549 | Yes | Yes | No | No | Yes | No | No | No |
|  | H2052 | Yes | No | No | No | No | No | No | No |
|  | HCC827 | Yes | Yes | No | No | Yes | yes | No | No |
| LUAD tumor samples | Tumor 1 | Yes | No | No | No | Yes | Yes | No | Yes |
|  | Tumor 2 | Yes | Yes | No | No | Yes | Yes | No | No |
|  | Tumor 3 | Yes | No | No | No | Yes | No | No | Yes |
|  | Tumor 4 | Yes | No | No | No | Yes | Yes | No | No |
|  | Tumor 5 | Yes | No | No | No | No | No | No | No |
|  | Tumor 6 | Yes | No | No | Yes | Yes | Yes | Yes | Yes |
|  | Tumor 7 | Yes | No | No | No | No | Yes | No | No |
|  | Tumor 8 | Yes | No | No | No | Yes | Yes | No | No |
|  | Tumor 9 | Yes | No | No | No | No | Yes | Yes | No |
|  | Tumor 10 | Yes | Yes | Yes | Yes | Yes | Yes | Yes | No |
|  | Tumor 11 | Yes | Yes | No | No | Yes | Yes | Yes | No |
|  | Tumor 12 | Yes | Yes | Yes | Yes | Yes | Yes | No | No |
|  | Tumor 13 | Yes | Yes | No | Yes | Yes | No | No | Yes |
|  | Tumor 14 | Yes | Yes | Yes | Yes | Yes | Yes | No | Yes |
|  | Tumor 15 | No | No | No | No | No | Yes | No | No |

Binding of ER-Derived Peptides to HLA-A2 Molecule

Figure 10:
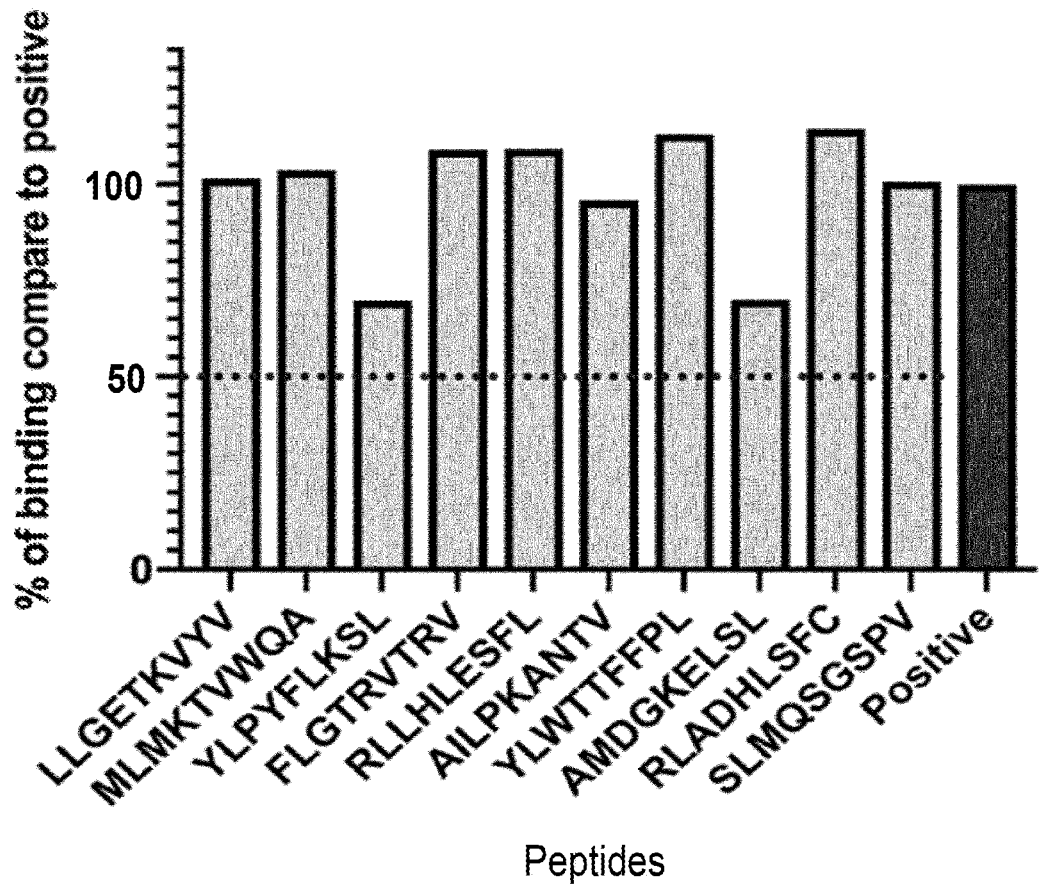
FIG. 10: Binding of chimeric transcripts-derived peptides to HLA-A2. Binding to HLA-A2 allele of predicted peptides from the most frequent chimeric fusions were validated by flow cytometry using tetramer formation assay. The results are shown as percentage of binding relative to positive control. Dotted line indicates the threshold considered to confirm the binding to this allele.

Once confirmed the expression of chimeric transcripts, the derived-peptides were synthetized and their binding to HLA-A2 was confirmed. Because monomer stabilization and tetramer formation are only possible in the presence of a high affinity binding peptide, the formation of HLA-A2 tetramers was estimated in the presence of synthetized peptides by flow cytometry. All predicted peptides were able to stabilize tetramer formation, showing a percentage of fluorescence higher than 50% relative to positive control. As positive control, a known high affinity binding peptide to HLA-A2 derived from Cytomegalovirus (CMV) was used. This result confirmed the predicted high affinity binding to HLA-A2 allele. FIG. 10 shows the result for 10 peptides derived from the most frequent fusions peptides.

Immunogenicity of ER-Derived Peptides

The following step after binding validation to HLA-A2 allele, was to test the immunogenicity of predicted peptides. Priming assays were thus performed to test the ability of identified peptides to expand specific cytotoxic T cells.

(YLWTTFFPL, FLGTRVTRV, RLADHLSFC, LLGETKVYV, MLVTWELAL, MLMKTVWQA, SLMQSGSPV, AILPKANTV, AMDGKELSL, LLDRFGYHV, GLLNISHTA, ILTASITSI, ILSGYGPCV, RQAPGFHHA, GLPSHVELA, ILHSLVTGV, LLHLESFLV, VLLTNTIWL, LLTSWHLYL). These experiments show that these peptides are able to induce an immune response and confirms the immunogenicity of ER-derived peptides.

Generation of Cytotoxic T Lymphocytes Clones Recognizing ER-Derived Peptides

Expanded CD8+ tetramer positive T-cells from immunogenicity assays (FIG. 11A) were single cell FACS-sorted in order to generate cytotoxic T lymphocytes (CTLs) clones. We generated 10 clones recognizing 5 different ER-derived peptides: YLWTTFFPL, LLGETKVYV, MLVTWELAL, MLMKTVWQA, RLADHLSF. These peptides are listed in Table 5 as peptide 9, 86, 53, 80 and 64 respectively. We will refer to these numbers to indicate the specificity of each generated CTL-clone. Example, CTL-clone 9 recognize ER-derived peptide 9.

In order to evaluate the cytotoxic capacity of generated CTL-clones, two different functional assays were conducted using the H1650 cell line as target cells. This is a LUAD-derived tumor cell line expressing HLA-A2 allele.

Figure 11B:
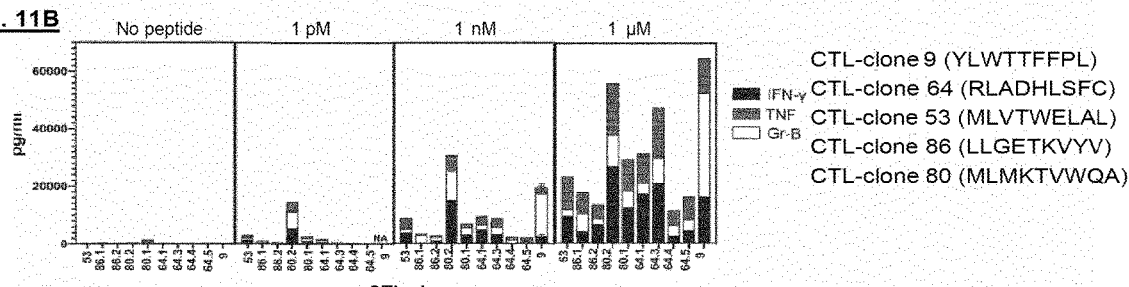

First, we measure the ability of CTL-clones to secret cytokines after exposure to ER-derived peptides. After co-cultured CTL-clones with target cells loaded with the specific ER-derived peptides during 18 h, secretion of INF-γ, TNF and Granzyme-B (Gr-B) was measured in culture supernatants. All CTL-clones were activated after exposure specific ER-derived peptides, secreting cytokines in a dose-dependent manner (FIG. 11B).

In a second set of experiments, CTL clones killing capacity was assessed. CTL-clones were co-cultured in different conditions with target cells loaded or not with ER-derived peptides. Using xCELLigence system we measure the real-time impedance variation in a target cells monolayer. In these assays, a decrease in cell-index is related with a decrease in the number of cells in the monolayer reflecting cell viability.

Figure 11C:
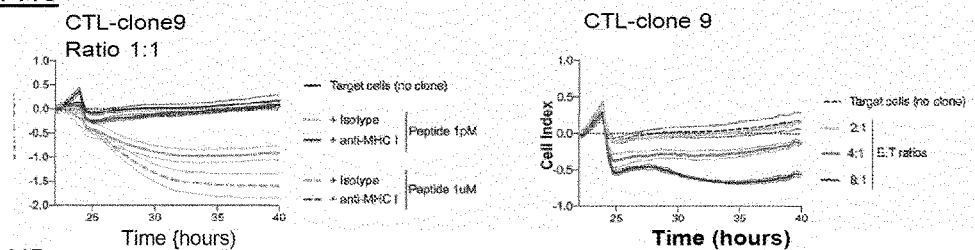

When CTL-clone 9 was co-culture in 1:1 ratio with target cells loaded with ER-derived peptide 9, we saw a decrease in cell-index over time compared to the control cells (target cells alone). This decrease in the cell index was inhibited when co-culture is performed in presence of blocking anti-MHC-I antibody (+ anti-MHC-I). Performing the co-culture using the same concentration of isotype control (+ isotype) did not inhibit the decrease in cell-index. Moreover, these decrease increases when target cells were loaded with higher concentration of peptide (1 pM compared to 1 uM) (FIG. 11C, left panel). This result show that a cytotoxic T cell that recognizes a peptide identified by the methods disclosed herein, CTL clone 9, is killing target tumor cells.

We reasoned that if ER-derived peptides are naturally expressed and presented by target cells, we should be able to kill them by co-culturing with CTL-clones without external addition of peptides. To this aim, we performed co-culture of CTL-clone 9 with H1650 target cells at different ratios to find the one in which effectors are sufficient to kill target cells. In the right panel of FIG. 11C, we saw that CTL-9 was able to kill target cells at a ratio effector-target 4:1 compared with the control cells (target cells alone). Moreover, killing is increased at bigger ratios (8:1). No killing of target cells was evidenced at lower ratios (2:1).

Figure 11D:
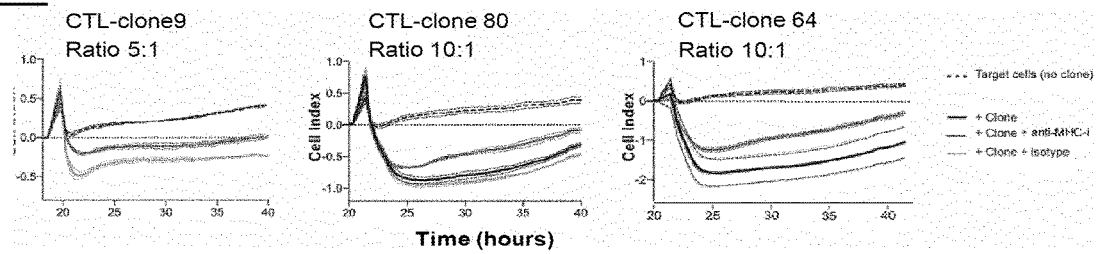

Finally, similar experiments were performed with CTL-clone 9, CTL-clone 64, and CTL-clone 80 showing a specific killing of target cells that could be also inhibited when the co-culture is performed in the presence of anti-MCH-I antibodies (FIG. 11D).

All together, these results confirm that cytotoxic T cells that recognizes several different peptides identified by the methods disclosed herein are able to recognize and kill tumor cells expressing specific fusion transcripts-derived peptides and that this effect is due to the specific recognition of peptides in the context of MHC-I molecules. Moreover, the fact that CTL-clones are able to kill target cells without addition of external peptides, indicates that fusion transcripts-derived peptides 9, 64 and 80 are naturally expressed and presented by H1650 LUAD tumor cell line.

Generation of Engineered T-Cells Recognizing Fusion-Derived Peptides

Jurkat cells transduced with lentiviral vector encoding for CTL-9 TCR sequence were co-cultured with two different target cells, H1650 and H1395. Both are LUAD-derived cell lines expressing HLA-A2 allele. TCR-mediated activation of Jurkat cells was evaluated by flow cytometry analyzing an increase in the fluorescence of reporter genes (NFAT-GPF, NF-KB-CFP and AP-1-mCherry). Preliminary results show that Jurkat cells are activated when co-cultured with both target cells compared to negative control (non-transduced Jurkat cells). Furthermore, this activation increased in a dose-dependent manner when the co-culture was performed with target cells loaded with specific peptides. PMA/ionomycin was used as positive control (FIG. 12). These results are in line with the results shown in FIGS. 11 C and D, suggesting that LUAD-derived tumor cells express TE-derived peptides. Furthermore, we demonstrated the potential use of CTL-clones TCR sequences in the development of engineered T cells.

Presence of CD8+ Cells Recognizing Fusion-Derived Peptides in LUAD Patients

We aimed to identify presence of CTL cells recognizing fusion-derived peptides in LUAD tumor samples.

Figure 13A:
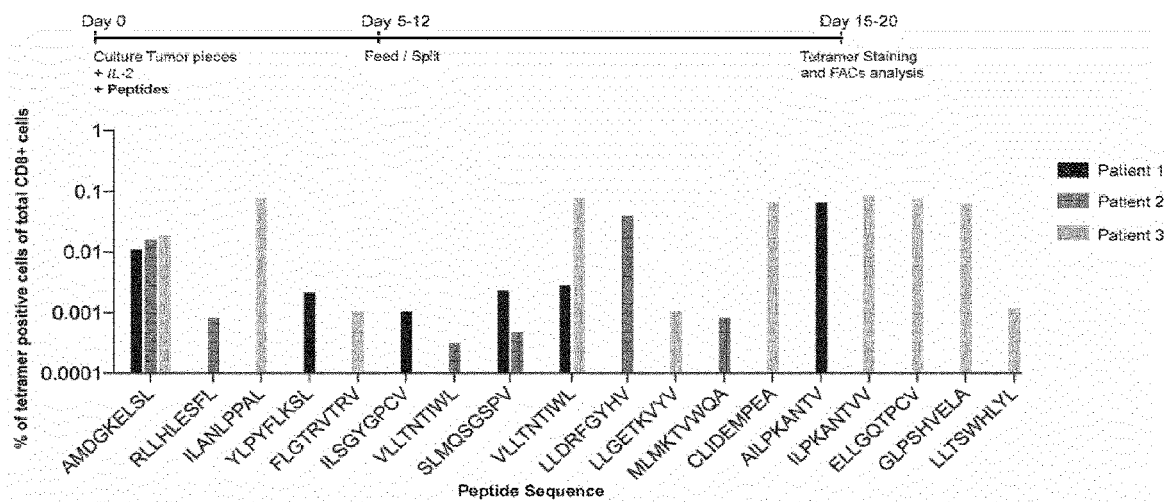
FIGS. 13A-13B: Tumor infiltrating lymphocytes recognizing fusion transcripts-derived peptides. Percentage of tetramer positive CD8 T cells for the indicated fusion transcript-derived peptides found in tumor infiltrating lymphocytes (TILs) expanded in the presence of fusion transcripts-derived peptide's mix+IL2 (FIG. 13A) or only with IL-2 (FIG. 13B).

In a first set of experiments tumor infiltrating lymphocytes (TILs) expanded with a mix of TE-derived peptides and Il-2, or only with Il-2, were analyzed by tetramer staining. As is shown in FIGS. 13A and B, we found CD8+ T-cells cells recognizing fusion-derived peptides in TILs derived from LUAD patients.

Figure 13B:
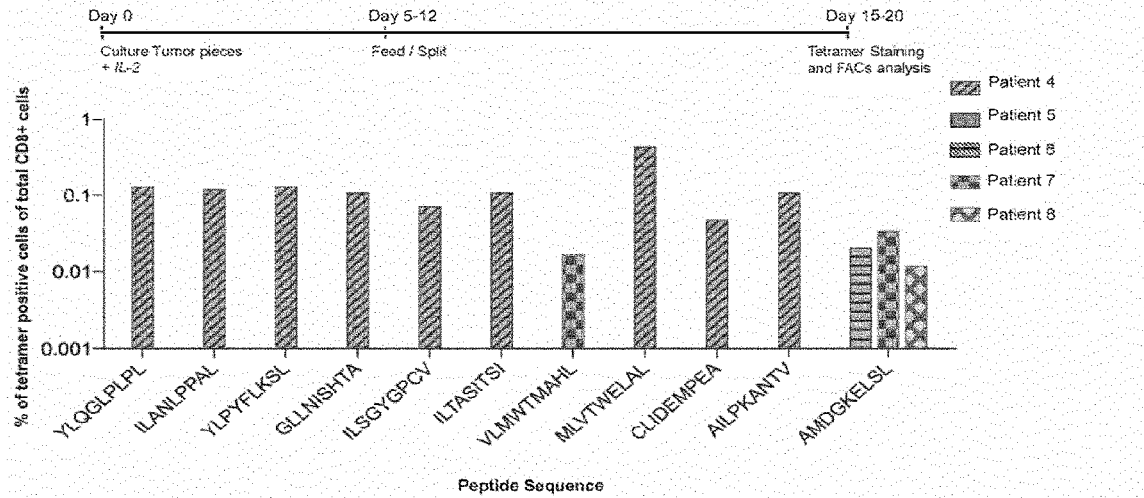
Figure 14A:
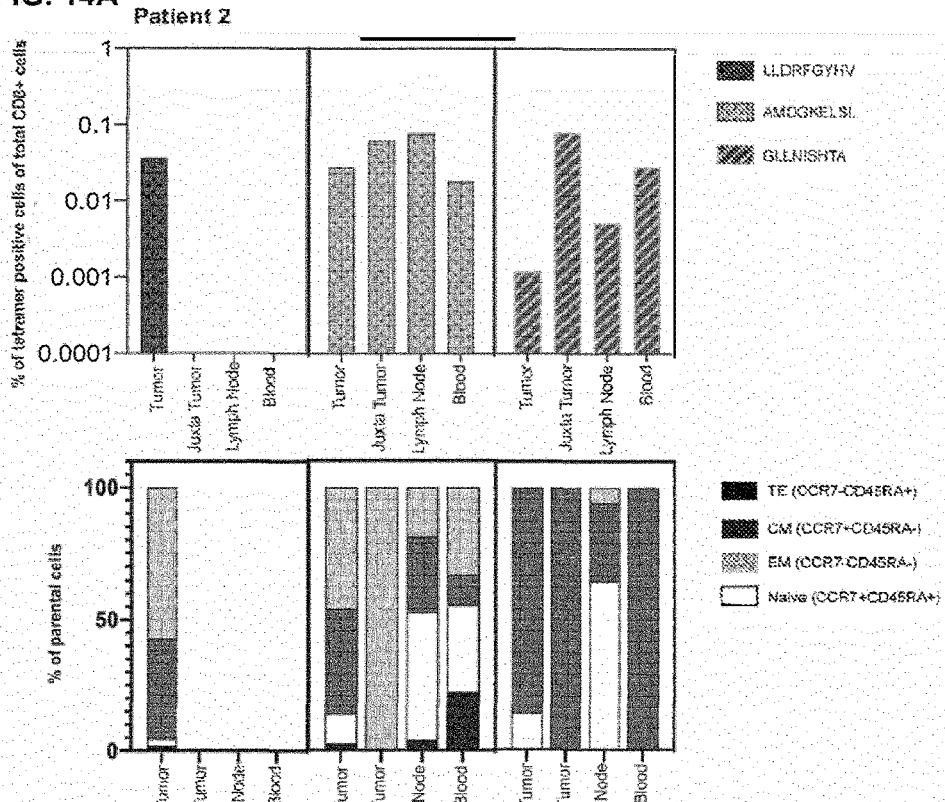
FIGS. 14A-14B: Phenotype of CD8+ T cells recognizing fusion transcripts-derived peptides in LUAD patient's derived samples. Percentage of tetramer positive CD8 T cells recognizing fusion transcripts-derived peptides present in tumor, juxta tumor, lymph nodes and blood samples derived from LUAD Patient 2 (FIG. 14A, upper panel) and Patient 3 (FIG. 14B, upper panel). In lower panel of FIG. 14A
Figure 14B:
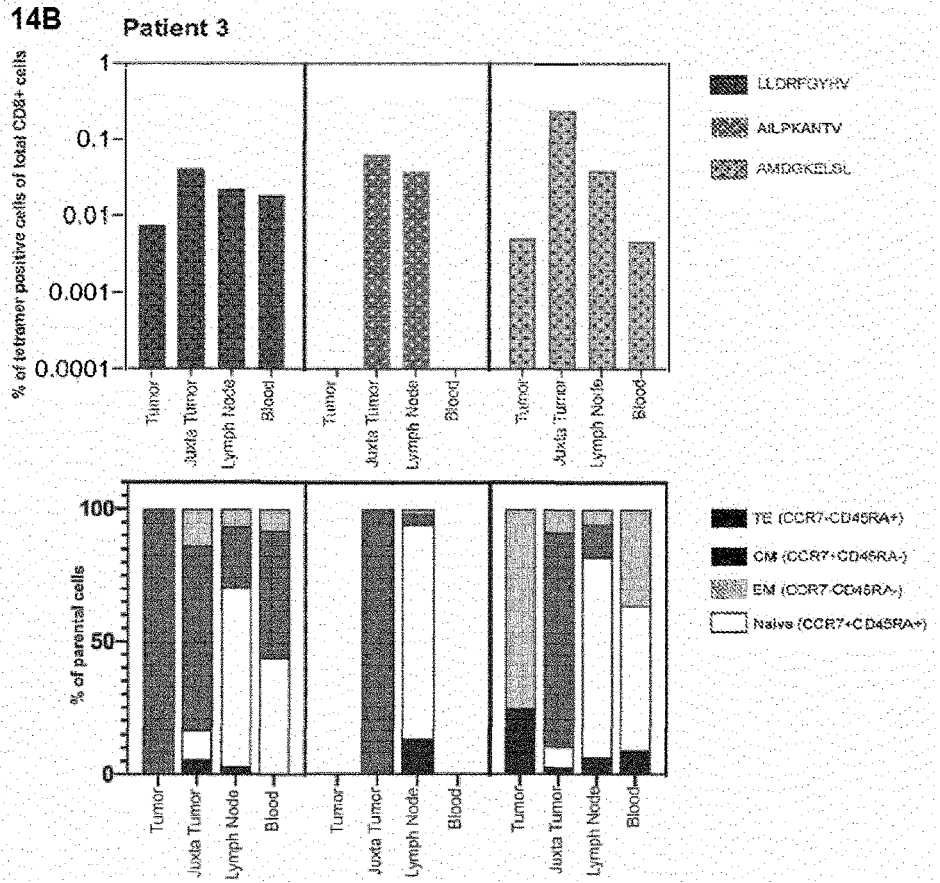

Then, we analyzed whether if we detect tetramer positive cells and their phenotype in non-expanded CD8+ T cells derived from fresh tumor samples. Using this strategy, we analyzed CD8+ T cells present in Tumor, juxta-tumor, invaded lymph-nodes and blood derived from LUAD patient samples. Phenotype was determined considering the expression of surface markers CCR7 and CD45RA as Naïve (CCR7+CD45+), Central Memory (CM, CCR7+CD45RA−) Effector Memory (EM, CCR7-CD45−) and Terminal Effectors (TE, CCR7-CD45+). Interestingly, tetramer positive cells found in tumor tissues shared preferentially a memory phenotype whereas naïve cells (CCR7+CD45+) are found mostly cells derived from lymph nodes (FIGS. 14A and B). Patient 2 and 3 are the same in FIG. 13 and FIG. 14.

All samples tested derived from HLA-A2+ patients.

Presence of tetramer positive cells with a memory phenotype in tumor tissues, together with the presence of tetramer positive cells in TILs, are consistent with an immune response generated against TE-derived peptides in these patients. Moreover, the existence of naïve tetramer positive cells in lymph nodes suggest the potential capacity to generate an immune response against these particularly TE-derived peptides.

Peptide Identification by Mass Spectrometry in LUAD Biopsies.

Presentation by MHC class I molecules on the tumour cell surface is required for ER-derived peptides in order to be recognized by cytotoxic T cells. In order to confirm that predicted peptides are express on MHC class I molecules, public data from MHC I immunopeptidome derived from 3 LUAD biopsies (Laumont C M et al., "Noncoding regions are the main source of targetable tumor-specific antigens" Sci Transl Med. 2018 10 (470)) were used. OpenMS Software was used to analyse the raw data uploaded to PRIDE database from MHC-I immunopurification of 3 LUAD tumours (PXD009752, PXD009754 and PXD009755). Having in mind that data-dependent acquisition in proteomics only allows the identification of those sequences contained in a target database (generally the whole human proteome): the peptides as per the present application had not been previously identified because they derive from non-coding sequences. The MS/MS identifications incorporating the sequences of the herein predicted peptides in the target database has been re-analyzed. Five peptides among the 3 samples biopsies (peptides ID: 3304, 269, 757, 1810, 3953)

were found. To perform this analysis, all predicted peptides derived from chimeric fusions present in at least 5 samples in the TCGA binding to any MHC I allele were considered. This result confirms the expression of chimeric fusion-derived peptides on MHC class I molecules in LUAD tumors.

Figure 15:
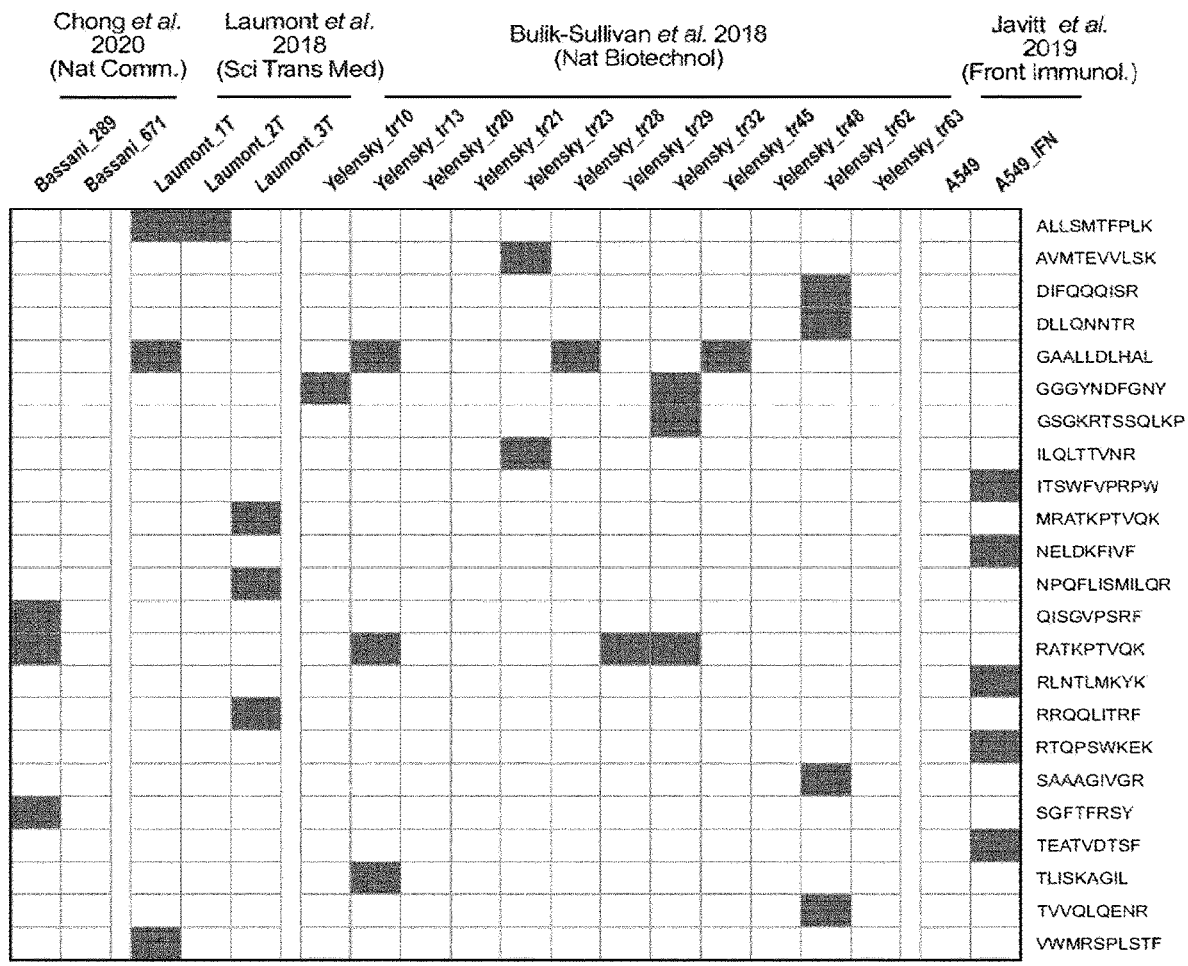
FIG. 15. Immunopeptidomics analysis of lung tumor samples. Fusion transcript-derived peptide sequences were searched in public MHC-I immunopeptidomes datasets. Each column represents a different sample. Each row represents a different peptide sequence (specify on the right). Colored squares indicate in which sample is found each fusion transcript-derived peptide. Publications describing each sample data-sets are annotated on the top.

Later, we extended our analysis to new lung immunopeptidomics datasets (Bulik-Sullivan et al. Nat. Biotec 2018, Chong et al. Nat. Comm. 2020 and Javitt et al. Front Immunol 2019). Of note, all datasets were generated with fresh lung tumor samples with the exception of Javitt et al. Front Immunol 2019 containing LUAD tumor cell line. For this second analysis, ProteomeDiscoverer 1.4 Software was used to identify the ER-derived peptides. Considering the 4 datasets, 23 unique ER-derived peptides were present in at least one of the total 19 immunopeptidomic samples. In FIG. 15, ER-derived peptides (rows) identified in each MHC sample (column) are indicated with a grey square. On the right, the peptide sequence found is indicated. Interestingly, some of them were observed in more than 1 MHC sample indicating that they are shared across samples. These results confirm that fusion transcripts-derived peptides are processed and presented by HLA-I molecules on tumor cells surface.

Peptide RLADHLSFC derived from a fusion transcript where the gene part of the fusion is a tumor suppressor gene (Fusion ID: chr22: 29117506:→chr22: 29115473:-/gene involved: CHEK2) and peptide GLPSHVELA derived from a fusion transcript where the gene part is an oncogene (Fusion ID: chr6: 117763597:→chr6: 117739669:-/gene involved: ROS1). Interestingly, both peptides were found to be immunogenic (FIG. 11A) and particularly for peptide RLADHLSFC, results show in FIG. 11 D indicate that could be express by H1650 cell line. Furthermore, we found TILs recognizing peptide GLPSHVELA (FIG. 12A), which indicates that this fusion transcript-derived peptide could be express in LUAD tumor samples.

3 Example 3: Identification Neoantigenic Peptides Derived from Fusion Transcripts Composed of a TE Element and an Exonic Sequence from Various Cancer Samples 9184 samples from 32 different cancer types (Acute Myeloid Leukemia, Adrenocortical Carcinoma, Bladder Urothelial Carcinoma, Breast Ductal Carcinoma, Breast Lobular Carcinoma, Cervical Carcinoma, Cholangiocarcinoma, Colorectal Adenocarcinoma, Esophageal Carcinoma, Gastric Adenocarcinoma, Glioblastoma Multiforme, Head and Neck Squamous Cell Carcinoma, Hepatocellular Carcinoma, Kidney Chromophobe Carcinoma, Kidney Clear Cell Carcinoma, Kidney Papillary Cell Carcinoma, Lower Grade Glioma, Lung Adenocarcinoma, Lung Squamous Cell Carcinoma, Mesothelioma, Ovarian Serous Adenocarcinoma, Pancreatic Ductal Adenocarcinoma, Paraganglioma & Pheochromocytoma, Prostate Adenocarcinoma, Sarcoma, Skin Cutaneous Melanoma, Testicular Germ Cell Cancer, Thymoma, Thyroid Papillary Carcinoma, Uterine Carcinosarcoma, Uterine Corpus Endometrioid Carcinoma and Uveal Melanoma) were analyzed according to the method as previously described.

Fusion transcripts of SEQ ID NO: 911-17492 were identified.

In the following tables, columns will be referenced as follow:

1. Frequency in the cohort
2. Donor Chromosome Exon/2' Donor Chromosome Exon
3. Donor start Exon/3' Donor start TE
4. Donor Breakpoint Exon/4'Donor Breakpoint TE
5. Donor strand Exon/5' Donor strand TE
6. Donor transcript (i.e. Donor_tx_name_Exon)/6' Acceptor chromosome exon
7. Acceptor Chromosome TE/7' acceptor breakpoint exon
8. Acceptor Breakpoint TE/8' acceptor end exon
9. Acceptor end TE/9' acceptor strand exon
10. Acceptor strand TE/10' acceptor transcript (i.e. Acceptor_tx_name_Exon)
11. Fusion type/11' fusion type

TABLE 5

Transcript fusion for Adrenocortical carcinoma Coordinates of the fusion sequences for which the donor is the exon.

| 1 | 2 | 2 | 4 | 5 | 6 | 7 | 8 | 9 | 10 | 11 |
|---|---|---|---|---|---|---|---|---|---|---|
| 59% | chr14 | 101200486 | 101200513 | + | ENST00000341267;ENST000003312 24 | chr14 | 101473144 | 101473392 | + | TAF |
| 29% | chr5 | 147649636 | 147649705 | + | ENST00000512953;ENST000003984 50 | chr5 | 147650500 | 147650640 | + | TAF |
| 27% | chr7 | 95125070 | 95125369 | + | ENST00000428113;ENST000003258 85 | chr7 | 95147506 | 95147874 | + | TAF |
| 24% | chrX | 152830379 | 152830561 | + | ENST00000349466;ENST000003701 86;ENST00000393842;ENST000003 59149;ENST00000263519;ENST000 00370181 | chrX | 152831276 | 152831321 | + | TAF |
| 24% | chrX | 152830379 | 152830561 | + | ENST00000349466;ENST000003701 86;ENST00000393842;ENST000003 59149;ENST00000263519;ENST000 00370181 | chrX | 152831276 | 152831321 | + | TAF |
| 22% | chr7 | 95165749 | 95165862 | + | ENST00000325885 | chr7 | 95168895 | 95169198 | + | TAF |
| 22% | chr5 | 147649636 | 147649705 | + | ENST00000512953;ENST000003984 50 | chr5 | 147650360 | 147650640 | + | TAF |
| 22% | chr18 | 33767503 | 33767644 | + | ENST00000261326 | chr18 | 33773430 | 33773774 | + | TAF |
| 22% | chrX | 49054298 | 49054174 | − | ENST00000263233;ENST000004798 08;ENST00000469389;ENST000004 66635 | chrX | 49053735 | 49053463 | − | TSF |

TABLE 5-continued

Transcript fusion for Adrenocortical carcinoma Coordinates of the fusion sequences for which the donor is the exon.

| 1 | 2 | 2 | 4 | 5 | 6 | 7 | 8 | 9 | 10 | 11 |
|---|---|---|---|---|---|---|---|---|---|---|
| 20% | chr3 | 48716169 | 48715997 | − | ENST00000341520;ENST00000416649;ENST00000294129;ENST00000413374 | chr3 | 48702393 | 48702198 | − | TSF |
| 20% | chr3 | 48716169 | 48715997 | − | ENST00000341520;ENST00000416649;ENST00000294129;ENST00000413374 | chr3 | 48702393 | 48702198 | − | TSF |
| 20% | chr3 | 48716169 | 48715997 | − | ENST00000341520;ENST00000416649;ENST00000294129;ENST00000413374 | chr3 | 48702393 | 48702198 | − | TSF |
| 19% | chr22 | 24323139 | 24323226 | + | ENST00000215780;ENST00000402588 | chr22 | 24324557 | 24324632 | + | TAF |
| 19% | chr5 | 74984990 | 74984837 | − | ENST00000428202;ENST00000514838;ENST00000380475;ENST00000510798;ENST00000446329 | chr5 | 74983153 | 74982863 | − | TAF |
| 19% | chr5 | 74984990 | 74984837 | − | ENST00000428202;ENST00000514838;ENST00000380475;ENST00000510798;ENST00000446329 | chr5 | 74983153 | 74982863 | − | TAF |
| 19% | chr5 | 74984990 | 74984837 | − | ENST00000428202;ENST00000514838;ENST00000380475;ENST00000510798;ENST00000446329 | chr5 | 74983153 | 74982863 | − | TAF |
| 19% | chr5 | 74984990 | 74984837 | − | ENST00000428202;ENST00000514838;ENST00000380475;ENST00000510798;ENST00000446329 | chr5 | 74983153 | 74982863 | − | TAF |
| 16% | chr6 | 10749855; 10749898 | 10749931 | + | ENST00000379542;ENST00000473166;ENST00000463448;ENST00000460341;ENST00000480294;ENST00000473807;ENST00000461342;ENST00000475942;ENST00000379530;ENST00000463100;ENST00000481240;ENST00000467317;ENST00000478732 | chr6 | 10829240 | 10829256 | + | TAF |
| 16% | chr6 | 10749855; 10749898 | 10749931 | + | ENST00000379542;ENST00000473166;ENST00000463448;ENST00000460341;ENST00000480294;ENST00000473807;ENST00000461342;ENST00000475942;ENST00000379530;ENST00000463100;ENST00000481240;ENST00000467317;ENST00000478732 | chr6 | 10829240 | 10829256 | + | TAF |
| 16% | chr19 | 50984141 | 50984234 | + | ENST00000334976;ENST00000376918;ENST00000598585 | chr19 | 51009025 | 51009080 | + | TAF |
| 16% | chr20 | 32247538; 32247356 | 32247303 | − | ENST00000246190;ENST00000375238;ENST00000480994 | chr20 | 32246861 | 32246725 | − | TAF |
| 16% | chr20 | 32247538; 32247356 | 32247303 | − | ENST00000246190;ENST00000375238;ENST00000480994 | chr20 | 32246861 | 32246725 | − | TAF |
| 16% | chr20 | 32247538; 32247356 | 32247303 | − | ENST00000246190;ENST00000375238;ENST00000480994 | chr20 | 32246861 | 32246725 | − | TAF |
| 15% | chr10 | 104650301 | 104650435 | + | ENST00000369880 | chr10 | 104654553 | 104654816 | + | TAF |
| 15% | chr17 | 19568261 | 19568360 | + | ENST00000176643;ENST00000581518;ENST00000395575;ENST00000339618;ENST00000579855;ENST00000571163 | chr17 | 19588588 | 19589107 | + | TAF |
| 15% | chr17 | 19568261 | 19568360 | + | ENST00000176643;ENST00000581518;ENST00000395575;ENST00000339618;ENST00000579855;ENST00000571163 | chr17 | 19588588 | 19589107 | + | TAF |
| 15% | chr8 | 74939024 | 74939076 | + | ENST00000284818;ENST00000518893 | chr8 | 74944554 | 74944936 | + | TAF |
| 15% | chr8 | 74939024 | 74939076 | + | ENST00000284818;ENST00000518893 | chr8 | 74944554 | 74944936 | + | TAF |
| 15% | chr17 | 72861942 | 72861841 | − | ENST00000293195;ENST00000544854;ENST00000420580;ENST00000581530;ENST00000455107;ENST00000583917;ENST00000442102;ENST00000582944;ENST00000413947;ENST00000579893 | chr17 | 72861374 | 72861251 | − | TSF |
| 15% | chr17 | 72861942 | 72861841 | − | ENST00000293195;ENST00000544854;ENST00000420580;ENST00000581530;ENST00000455107;ENST00000583917;ENST00000442102;ENST00000582944;ENST00000413947;ENST00000579893 | chr17 | 72861374 | 72861251 | − | TSF |
| 15% | chr17 | 72861942 | 72861841 | − | ENST00000293195;ENST00000544854;ENST00000420580;ENST00000581530;ENST00000455107;ENST000 | chr17 | 72861374 | 72861251 | − | TSF |

TABLE 5-continued

Transcript fusion for Adrenocortical carcinoma Coordinates of the fusion sequences for which the donor is the exon.

| 1 | 2 | 3 | 4 | 5 | 6 | 7 | 8 | 9 | 10 | 11 |
|---|---|---|---|---|---|---|---|---|----|----|
| 15% | chr17 | 72861942 | 72861841 | − | 00583917;ENST00000442102;ENST00000582944;ENST00000413947;ENST00000579893 ENST00000293195;ENST000005448 54;ENST00000420580;ENST000005 81530;ENST00000455107;ENST000 00583917;ENST00000442102;ENST 00000582944;ENST00000413947;EN ST00000579893 | chr17 | 72861374 | 72861251 | − | TSF |
| 15% | chr17 | 72861942 | 72861841 | − | ENST00000293195;ENST000005448 54;ENST00000420580;ENST000005 81530;ENST00000455107;ENST000 00583917;ENST00000442102;ENST 00000582944;ENST00000413947;EN ST00000579893 | chr17 | 72861374 | 72861251 | − | TSF |
| 15% | chr17 | 72861942 | 72861841 | − | ENST00000293195;ENST000005448 54;ENST00000420580;ENST000005 81530;ENST00000455107;ENST000 00583917;ENST00000442102;ENST 00000582944;ENST00000413947;EN ST00000579893 | chr17 | 72861374 | 72861251 | − | TSF |
| 15% | chr17 | 72861942 | 72861841 | − | ENST00000293195;ENST000005448 54;ENST00000420580;ENST000005 81530;ENST00000455107;ENST000 00583917;ENST00000442102;ENST 00000582944;ENST00000413947;EN ST00000579893 | chr17 | 72861374 | 72861251 | − | TSF |
| 15% | chr17 | 72861942 | 72861841 | − | ENST00000293195;ENST000005448 54;ENST00000420580;ENST000005 81530;ENST00000455107;ENST000 00583917;ENST00000442102;ENST 00000582944;ENST00000413947;EN ST00000579893 | chr17 | 72861374 | 72861251 | − | TSF |
| 15% | chr17 | 72861942 | 72861841 | − | ENST00000293195;ENST000005448 54;ENST00000420580;ENST000005 81530;ENST00000455107;ENST000 00583917;ENST00000442102;ENST 00000582944;ENST00000413947;EN ST00000579893 | chr17 | 72861374 | 72861251 | − | TSF |
| 14% | chr20 | 35842163 | 35842268 | + | ENST00000237530;ENST000003736 22 | chr20 | 35844460 | 35844765 | + | TAF |
| 14% | chr20 | 35842163 | 35842268 | + | ENST00000237530;ENST000003736 22 | chr20 | 35844460 | 35844765 | + | TAF |
| 14% | chr7 | 75611542; 75611580; 75611597 | 75611640 | + | ENST00000461988;ENST000004198 40;ENST00000394893;ENST000004 12064;ENST00000447222;ENST000 00545601;ENST00000450476;ENST 00000439269 | chr7 | 75612546 | 75612675 | + | TAF |
| 14% | chr7 | 75611542; 75611580; 75611597 | 75611640 | + | ENST00000461988;ENST000004198 40;ENST00000394893;ENST000004 12064;ENST00000447222;ENST000 00545601;ENST00000450476;ENST 00000439269 | chr7 | 75612546 | 75612675 | + | TAF |
| 14% | chr7 | 75611542; 75611580; 75611597 | 75611640 | + | ENST00000461988;ENST000004198 40;ENST00000394893;ENST000004 12064;ENST00000447222;ENST000 00545601;ENST00000450476;ENST 00000439269 | chr7 | 75612546 | 75612675 | + | TAF |
| 14% | chr7 | 75611542; 75611580; 75611597 | 75611640 | + | ENST00000461988;ENST000004198 40;ENST00000394893;ENST000004 12064;ENST00000447222;ENST000 00545601;ENST00000450476;ENST 00000439269 | chr7 | 75612546 | 75612675 | + | TAF |
| 14% | chr7 | 75611542; 75611580; 75611597 | 75611640 | + | ENST00000461988;ENST000004198 40;ENST00000394893;ENST000004 12064;ENST00000447222;ENST000 00545601;ENST00000450476;ENST 00000439269 | chr7 | 75612546 | 75612675 | + | TAF |
| 14% | chr7 | 75611542; 75611580; 75611597 | 75611640 | + | ENST00000461988;ENST000004198 40;ENST00000394893;ENST000004 12064;ENST00000447222;ENST000 00545601;ENST00000450476;ENST 00000439269 | chr7 | 75612546 | 75612675 | + | TAF |

TABLE 5-continued

Transcript fusion for Adrenocortical carcinoma Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 14% | chr7 | 75611542; 75611580; 75611597 | 75611640 | + | ENST00000461988;ENST00000419840;ENST00000394893;ENST00000412064;ENST00000447222;ENST00000545601;ENST00000450476;ENST00000439269 | chr7 | 75612546 | 75612675 | + | TAF |
| 14% | chrX | 152602138 | 152602168 | + | ENST00000370251;ENST00000421401 | chrX | 152617375 | 152617427 | + | TSF |
| 13% | chr19 | 52671325 | 52671311 | − | ENST00000597252;ENST00000322146;ENST00000596428;ENST00000597065 | chr19 | 52666101 | 52665762 | − | TSF |
| 13% | chr15 | 74631109 | 74630912 | − | ENST00000358632;ENST00000268053;ENST00000419019 | chr15 | 74624041 | 74623995 | − | TSF |
| 13% | chr15 | 74631109 | 74630912 | − | ENST00000358632;ENST00000268053;ENST00000419019 | chr15 | 74624041 | 74623995 | − | TSF |
| 11% | chr11 | 110306558 | 110306682 | + | ENST00000260270 | chr11 | 110313385 | 110313534 | + | TAF |
| 11% | chr7 | 27582719 | 27582586 | − | ENST00000265395;ENST00000425715 | chr7 | 27581374 | 27579272 | − | TAF |
| 11% | chr7 | 27582719 | 27582586 | − | ENST00000265395;ENST00000425715 | chr7 | 27581374 | 27579272 | − | TAF |
| 11% | chr17 | 7130588 | 7130409 | − | ENST00000005340;ENST00000575458;ENST00000575086 | chr17 | 7130277 | 7130132 | − | TAF |
| 11% | chr17 | 7130588 | 7130409 | − | ENST00000005340;ENST00000575458;ENST00000575086 | chr17 | 7130277 | 7130132 | − | TAF |
| 11% | chr17 | 7130588 | 7130409 | − | ENST00000005340;ENST00000575458;ENST00000575086 | chr17 | 7130277 | 7130132 | − | TAF |
| 10% | chr8 | 63502273 | 63502353 | + | ENST00000523211;ENST00000328472 | chr8 | 63546747 | 63547118 | + | TSF |
| 9% | chr5 | 147649636 | 147649705 | + | ENST00000512953;ENST00000398450 | chr5 | 147650327 | 147650640 | + | TSF |
| 8% | chr16 | 50666192 | 50666319 | + | ENST00000268459 | chr16 | 50682755 | 50682972 | + | TSF |
| 8% | chr19 | 48382387 | 48382293 | − | ENST00000222002 | chr19 | 48379566 | 48379257 | − | TSF |
| 8% | chr1 | 173157708 | 173157660 | − | ENST00000367718;ENST00000281834 | chr1 | 173142495 | 173142335 | − | TSF |
| 8% | chr1 | 173157708 | 173157660 | − | ENST00000367718;ENST00000281834 | chr1 | 173142495 | 173142335 | − | TSF |

TABLE 6

Transcript fusion for Adrenocortical carcinoma Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 84% | chr9 | 111648536 | 111648048 | − | chr9 | 111644467 | 111644405 | − | ENST00000495759; ENST00000374647; ENST00000537196 | TAF |
| 84% | chr9 | 111648536 | 111648048 | − | chr9 | 111644467 | 111644405 | − | ENST00000495759; ENST00000374647; ENST00000537196 | TAF |
| 75% | chr2 | 132281819 | 132281839 | + | chr2 | 132287220 | 132287264 | + | ENST00000295171; ENST00000409856; ENST00000434330 | TAF |
| 75% | chr2 | 132281819 | 132281839 | + | chr2 | 132287220 | 132287264 | + | ENST00000295171; ENST00000409856; ENST00000434330 | TAF |
| 75% | chr2 | 132281819 | 132281839 | + | chr2 | 132287220 | 132287264 | + | ENST00000295171; ENST00000409856; ENST00000434330 | TAF |
| 70% | chr12 | 94167005 | 94167262 | + | chr12 | 94243746 | 94244047 | + | ENST00000332896; ENST00000542893 | TAF |
| 68% | chr7 | 150938296 | 150938250 | − | chr7 | 150937608 | 150937511 | − | ENST00000262188; ENST00000392811; ENST00000356800 | TAF |
| 59% | chr11 | 110329921 | 110329943 | + | chr11 | 110333078 | 110333192 | + | ENST00000260270 | TAF |
| 54% | chr12 | 125263794 | 125263744 | − | chr12 | 125263132 | 125263013; 125263125 | − | ENST00000339570; ENST00000415380 | TAF |
| 54% | chr12 | 125263794 | 125263744 | − | chr12 | 125263132 | 125263013; 125263125 | − | ENST00000339570; ENST00000415380 | TAF |
| 47% | chr4 | 140216524 | 140216458 | − | chr4 | 140216300 | 140216197 | − | ENST00000503997; ENST00000539002; ENST00000544855; ENST00000394228; ENST00000539387; ENST00000265500; ENST00000505036; ENST00000394223 | TAF |
| 43% | chr12 | 102411559 | 102411498 | − | chr12 | 102406970 | 102406886 | − | ENST00000240079; ENST00000545679; ENST00000542923 | TAF |
| 35% | chr9 | 114546431 | 114546079 | − | chr9 | 114543297 | 114543210 | − | ENST00000374283 | TAF |
| 35% | chr14 | 94518197 | 94518094 | − | chr14 | 94517808 | 94517537 | − | ENST00000330836; ENST00000544005; ENST00000555054 | TAF |

TABLE 6-continued

Transcript fusion for Adrenocortical carcinoma Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 33% | chr9 | 111633879 | 111632734 | − | chr9 | 111631462 | 111631395 | − | ENST00000374647; ENST00000537196 | TAF |
| 30% | chr10 | 104637349 | 104637429 | + | chr10 | 104638136 | 104638267 | + | ENST00000369880 | TAF |
| 30% | chr19 | 40330448 | 40330344 | − | chr19 | 40329845 | 40329675; 40329835; 40329714 | − | ENST00000595545; ENST00000221801; ENST00000594443; ENST00000597224; ENST00000601274; ENST00000597634; ENST00000598417; ENST00000594309; ENST00000599134 | TAF |
| 30% | chr19 | 40330448 | 40330344 | − | chr19 | 40329845 | 40329675; 40329835; 40329714 | − | ENST00000595545; ENST00000221801; ENST00000594443; ENST00000597224; ENST00000601274; ENST00000597634; ENST00000598417; ENST00000594309; ENST00000599134 | TAF |
| 30% | chr19 | 40330448 | 40330344 | − | chr19 | 40329845 | 40329675; 40329835; 40329714 | − | ENST00000595545; ENST00000221801; ENST00000594443; ENST00000597224; ENST00000601274; ENST00000597634; ENST00000598417; ENST00000594309; ENST00000599134 | TAF |
| 30% | chr19 | 40330448 | 40330344 | − | chr19 | 40329845 | 40329675; 40329835; 40329714 | − | ENST00000595545; ENST00000221801; ENST00000594443; ENST00000597224; ENST00000601274; ENST00000597634; ENST00000598417; ENST00000594309 ENST00000599134 | TAF |
| 30% | chr19 | 40330448 | 40330344 | − | chr19 | 40329845 | 40329675; 40329835; 40329714 | − | ENST00000595545; ENST00000221801; ENST00000594443; ENST00000597224; ENST00000601274; ENST00000597634; ENST00000598417; ENST00000594309 ENST00000599134 | TAF |
| 30% | chr19 | 40330448 | 40330344 | − | chr19 | 40329845 | 40329675; 40329835; 40329714 | − | ENST00000595545; ENST00000221801; ENST00000594443; ENST00000597224; ENST00000601274; ENST00000597634; ENST00000598417; ENST00000594309 ENST00000599134 | TAF |
| 30% | chr19 | 40330448 | 40330344 | − | chr19 | 40329845 | 40329675; 40329835; 40329714 | − | ENST00000595545; ENST00000221801; ENST00000594443; ENST00000597224; ENST00000601274; ENST00000597634; ENST00000598417; ENST00000594309 ENST00000599134 | TAF |
| 30% | chr19 | 40330448 | 40330344 | − | chr19 | 40329845 | 40329675; 40329835; 40329714 | − | ENST00000595545; ENST00000221801; ENST00000594443; ENST00000597224; ENST00000601274; ENST00000597634; ENST00000598417; ENST00000594309 ENST00000599134 | TAF |
| 30% | chr19 | 40330448 | 40330344 | − | chr19 | 40329845 | 40329675; 40329835; 40329714 | − | ENST00000595545; ENST00000221801; ENST00000594443; ENST00000597224; ENST00000601274; ENST00000597634; ENST00000598417; ENST00000594309 ENST00000599134 | TAF |
| 30% | chr19 | 4454954 | 4454819 | − | chr19 | 4454090 | 4453927 | − | ENST00000591919; ENST00000301281; ENST00000592515 | TSF |
| 30% | chr19 | 4454954 | 4454819 | − | chr19 | 4454090 | 4453927 | − | ENST00000591919; ENST00000301281; ENST00000592515 | TSF |
| 30% | chr19 | 4454954 | 4454819 | − | chr19 | 4454090 | 4453927 | − | ENST00000591919; ENST00000301281; ENST00000592515 | TSF |
| 28% | chr7 | 120447469 | 120447344 | − | chr7 | 120446746 | 120446603 | − | ENST00000222747; ENST00000415871 | TSF |
| 27% | chr4 | 107241932 | 107242850 | + | chr4 | 107246142 | 107246275 | + | ENST00000394701 | TAF |
| 24% | chr9 | 127173550 | 127173482 | − | chr9 | 127167711 | 127167596 | − | ENST00000259457; ENST00000441097 | TAF |
| 24% | chr9 | 127173550 | 127173482 | − | chr9 | 127167711 | 127167596 | − | ENST00000259457; ENST00000441097 | TAF |
| 23% | chr11 | 110317098 | 110317561 | + | chr11 | 110327642 | 110327771 | + | ENST00000260270 | TAF |
| 20% | chr2 | 28200909 | 28201241 | + | chr2 | 28210860 | 28210954 | + | ENST00000436924; ENST00000344773; ENST00000379624; ENST00000342045; ENST00000361704; ENST00000379632; ENST00000379629; ENST00000604932 | TAF |
| 20% | chr2 | 28200909 | 28201241 | + | chr2 | 28210860 | 28210954 | + | ENST00000436924; ENST00000344773; ENST00000379624; ENST00000342045; ENST00000361704; ENST00000379632; ENST00000379629; ENST00000604932 | TAF |

TABLE 6-continued

Transcript fusion for Adrenocortical carcinoma Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 20% | chr2 | 28200909 | 28201241 | + | chr2 | 28210860 | 28210954 | + | ENST00000436924; ENST00000344773; ENST00000379624; ENST00000342045; ENST00000361704; ENST00000379632; ENST00000379629; ENST00000604932 | TAF |
| 20% | chr2 | 28200909 | 28201241 | + | chr2 | 28210860 | 28210954 | + | ENST00000436924; ENST00000344773; ENST00000379624; ENST00000342045; ENST00000361704; ENST00000379632; ENST00000379629; ENST00000604932 | TAF |
| 20% | chr2 | 28200909 | 28201241 | + | chr2 | 28210860 | 28210954 | + | ENST00000436924; ENST00000344773; ENST00000379624; ENST00000342045; ENST00000361704; ENST00000379632; ENST00000379629; ENST00000604932 | TAF |
| 20% | chr2 | 28200909 | 28201241 | + | chr2 | 28210860 | 28210954 | + | ENST00000436924; ENST00000344773; ENST00000379624; ENST00000342045; ENST00000361704; ENST00000379632; ENST00000379629; ENST00000604932 | TAF |
| 20% | chr19 | 48388785 | 48388506 | − | chr19 | 48387042 | 48386834 | − | ENST00000222002 | TAF |
| 19% | chr10 | 104654213 | 104654429 | + | chr10 | 104660350 | 104660457 | + | ENST00000369880 | TAF |
| 19% | chr19 | 49121994 | 49121817 | − | chr19 | 49121134 | 49121048 | − | ENST00000549920; ENST00000547897; ENST00000084795; ENST00000550645; ENST00000549370; ENST00000549273 | TAF |
| 19% | chr19 | 49121994 | 49121817 | − | chr19 | 49121134 | 49121048 | − | ENST00000549920; ENST00000547897; ENST00000084795; ENST00000550645; ENST00000549370; ENST00000549273 | TAF |
| 19% | chr19 | 49121994 | 49121817 | − | chr19 | 49121134 | 49121048 | − | ENST00000549920; ENST00000547897; ENST00000084795; ENST00000550645; ENST00000549370; ENST00000549273 | TAF |
| 19% | chr19 | 49121994 | 49121817 | − | chr19 | 49121134 | 49121048 | − | ENST00000549920; ENST00000547897; ENST00000084795; ENST00000550645; ENST00000549370; ENST00000549273 | TAF |
| 19% | chr19 | 49121994 | 49121817 | − | chr19 | 49121134 | 49121048 | − | ENST00000549920; ENST00000547897; ENST00000084795; ENST00000550645; ENST00000549370; ENST00000549273 | TAF |
| 18% | chr12 | 55223983 | 55224659 | + | chr12 | 55248900 | 55248941 | + | ENST00000546809; ENST00000308796 | TAF |
| 18% | chr20 | 43919547 | 43919514 | − | chr20 | 43882374 | 43882216 | − | ENST00000338380 | TAF |
| 16% | chr17 | 79214190 | 79214239 | + | chr17 | 79214787 | 79214816; 79214953 | + | ENST00000431388; ENST00000576002 | TAF |
| 16% | chr17 | 79214190 | 79214239 | + | chr17 | 79214787 | 79214816; 79214953 | + | ENST00000431388; ENST00000576002 | TAF |
| 16% | chr13 | 76173531 | 76175706 | + | chr13 | 76178905 | 76178963 | + | ENST00000377595; ENST00000419068 | TAF |
| 16% | chr14 | 76123655 | 76123598 | − | chr14 | 76121319 | 76121229 | − | ENST00000256319 | TAF |
| 16% | chr9 | 133953597 | 133953695 | + | chr9 | 133954536 | 133954685 | + | ENST00000361069 | TSF |
| 15% | chr11 | 110301592 | 110301671 | + | chr11 | 110306558 | 110306682 | + | ENST00000260270 | TAF |
| 15% | chr7 | 1014593 | 1014543 | − | chr7 | 1012928 | 1012817 | − | ENST00000457254; ENST00000344111 | TSF |
| 15% | chr7 | 1014593 | 1014543 | − | chr7 | 1012928 | 1012817 | − | ENST00000457254; ENST00000344111 | TSF |
| 14% | chr5 | 147650185 | 147650475 | + | chr5 | 147653910 | 147653947 | + | ENST00000512953; ENST00000398450 | TAF |
| 14% | chr10 | 104634953 | 104634957 | + | chr10 | 104636711 | 104636792 | + | ENST00000369880 | TAF |
| 14% | chr19 | 54631006 | 54631115 | + | chr19 | 54631448 | 54631575 | + | ENST00000321030; ENST00000419967 | TAF |
| 14% | chr19 | 54631006 | 54631115 | + | chr19 | 54631448 | 54631575 | + | ENST00000321030; ENST00000419967 | TAF |
| 14% | chr3 | 122863450 | 122863676 | + | chr3 | 122864369 | 122864384; 122864439 | + | ENST00000489923; ENST00000316218 | TAF |
| 14% | chr3 | 122863450 | 122863676 | + | chr3 | 122864369 | 122864384; 122864439 | + | ENST00000489923; ENST00000316218 | TAF |
| 14% | chr5 | 176950300 | 176950160 | − | chr5 | 176949072 | 176948976 | − | ENST00000514747; ENST00000329540; ENST00000443375; ENST00000524677 | TAF |
| 14% | chr5 | 68663671 | 68663666 | − | chr5 | 68662422 | 68662330 | − | ENST00000380822; ENST00000380818 | TAF |
| 14% | chr3 | 13060700 | 13060650 | − | chr3 | 12983365 | 12983071 | − | ENST00000273221; ENST00000450726; ENST00000429247 | TAF |
| 14% | chr3 | 13060700 | 13060650 | − | chr3 | 12983365 | 12983071 | − | ENST00000273221; ENST00000450726; ENST00000429247 | TAF |
| 14% | chr3 | 13060700 | 13060650 | − | chr3 | 12983365 | 12983071 | − | ENST00000273221; 04ENST000050726; ENST00000429247 | TAF |
| 13% | chr10 | 104637349 | 104637429 | + | chr10 | 104638606 | 104638748 | + | ENST00000369880 | TAF |
| 13% | chr12 | 113808893 | 113809071 | + | chr12 | 113810454 | 113810612; 113810475 | + | ENST00000545182; ENST00000280800; ENST00000548997 | TAF |
| 13% | chr12 | 113808893 | 113809071 | + | chr12 | 113810454 | 113810612; 113810475 | + | ENST00000545182; ENST00000280800; ENST00000548997 | TAF |
| 13% | chr12 | 113808893 | 113809071 | + | chr12 | 113810454 | 113810612; 113810475 | + | ENST00000545182; ENST00000280800; ENST00000548997 | TAF |

TABLE 6-continued

Transcript fusion for Adrenocortical carcinoma Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 13% | chr11 | 110301592 | 110301776 | + | chr11 | 110306558 | 110306682 | + | ENST00000260270 | TAF |
| 13% | chr9 | 130569975 | 130570054 | + | chr9 | 130570513 | 130570590; 130570580 | + | ENST00000373247; ENST00000373245; ENST00000393706; ENST00000373228; ENST00000373225; ENST00000431857; ENST00000423577 | TAF |
| 13% | chr9 | 130569975 | 130570054 | + | chr9 | 130570513 | 130570590; 130570580 | + | ENST00000373247; ENST00000373245; ENST00000393706; ENST00000373228; ENST00000373225; ENST00000431857; ENST00000423577 | TAF |
| 13% | chr9 | 130569975 | 130570054 | + | chr9 | 130570513 | 130570590; 130570580 | + | ENST00000373247; ENST00000373245; ENST00000393706; ENST00000373228; ENST00000373225; ENST00000431857; ENST00000423577 | TAF |
| 13% | chr9 | 130569975 | 130570054 | + | chr9 | 130570513 | 130570590; 130570580 | + | ENST00000373247; ENST00000373245; ENST00000393706; ENST00000373228; ENST00000373225; ENST00000431857; ENST00000423577 | TAF |
| 13% | chr2 | 230409549 | 230409481 | − | chr2 | 230377652 | 230377499 | − | ENST00000341772 | TAF |
| 13% | chr12 | 6602868 | 6602840 | − | chr12 | 6602138 | 6602028 | − | ENST00000229238 | TAF |
| 13% | chrX | 150886281 | 150886376 | + | chrX | 150889867 | 150889973 | + | ENST00000370350 | TSF |
| 13% | chr7 | 100406138 | 100406138 | − | chr7 | 100405202 | 100404987 | − | ENST00000360620; ENST00000358173 | TSF |
| 13% | chr7 | 100406138 | 100406138 | − | chr7 | 100405202 | 100404987 | − | ENST00000360620; ENST00000358173 | TSF |
| 11% | chr14 | 94581487 | 94581557 | + | chr14 | 94582127 | 94582191; 94582279; 94582176 | + | ENST00000554448; ENST00000448882; ENST00000554800; ENST00000556544; ENST00000298902; ENST00000557634; ENST00000555744; ENST00000557035 | TAF |
| 11% | chr14 | 94581487 | 94581557 | + | chr14 | 94582127 | 94582191; 94582279; 94582176 | + | ENST00000554448; ENST00000448882; ENST00000554800; ENST00000556544; ENST00000298902; ENST00000557634; ENST00000555744; ENST00000557035 | TAF |
| 11% | chr14 | 94581487 | 94581557 | + | chr14 | 94582127 | 94582191; 94582279; 94582176 | + | ENST00000554448; ENST00000448882; ENST00000554800; ENST00000556544; ENST00000298902; ENST00000557634; ENST00000555744; ENST00000557035 | TAF |
| 11% | chr14 | 94581487 | 94581557 | + | chr14 | 94582127 | 94582191; 94582279; 94582176 | + | ENST00000554448; ENST00000448882; ENST00000554800; ENST00000556544; ENST00000298902; ENST00000557634; ENST00000555744; ENST00000557035 | TAF |
| 11% | chr14 | 94581487 | 94581557 | + | chr14 | 94582127 | 94582191; 94582279; 94582176 | + | ENST00000554448; ENST00000448882; ENST00000554800; ENST00000556544; ENST00000298902; ENST00000557634; ENST00000555744; ENST00000557035 | TAF |
| 11% | chr11 | 77909738 | 77909764 | + | chr11 | 77910641 | 77910770 | + | ENST00000528910; ENST00000529308 | TAF |
| 11% | chr11 | 77909738 | 77909764 | + | chr11 | 77910641 | 77910770 | + | ENST00000528910; ENST00000529308 | TAF |
| 11% | chr20 | 1453431 | 1453360 | − | chr20 | 1438919 | 1438845; 1438917 | − | ENST00000353088; ENST00000555944; ENST00000476071; ENST00000216879; ENST00000350991; ENST00000381653; ENST00000555568; ENST00000489203 | TAF |
| 11% | chr20 | 1453431 | 1453360 | − | chr20 | 1438919 | 1438845; 1438917 | − | ENST00000353088; ENST00000555944; ENST00000476071; ENST00000216879; ENST00000350991; ENST00000381653; ENST00000555568; ENST00000489203 | TAF |
| 11% | chr20 | 1453431 | 1453360 | − | chr20 | 1438919 | 1438845; 1438917 | − | ENST00000353088; ENST00000555944; ENST00000476071; ENST00000216879; ENST00000350991; ENST00000381653; ENST00000555568; ENST00000489203 | TAF |
| 11% | chr20 | 1453431 | 1453360 | − | chr20 | 1438919 | 1438845; 1438917 | − | ENST00000353088; ENST00000555944; ENST00000476071; ENST00000216879; ENST00000350991; ENST00000381653; ENST00000555568; ENST00000489203 | TAF |
| 11% | chr20 | 1453431 | 1453360 | − | chr20 | 1438919 | 1438845; 1438917 | − | ENST00000353088; ENST00000555944; ENST00000476071; ENST00000216879; ENST00000350991; ENST00000381653; ENST00000555568; ENST00000489203 | TAF |
| 11% | chr20 | 1453431 | 1453360 | − | chr20 | 1438919 | 1438845; 1438917 | − | ENST00000353088; ENST00000555944; ENST00000476071; ENST00000216879; ENST00000350991; ENST00000381653; ENST00000555568; ENST00000489203 | TAF |

TABLE 6-continued

Transcript fusion for Adrenocortical carcinoma Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 11% | chr20 | 1453431 | 1453360 | − | chr20 | 1438919 | 1438845; 1438917 | − | ENST00000353088; ENST00000555944; ENST00000476071; ENST00000216879; ENST00000350991; ENST00000381653; ENST00000555568; ENST00000489203 | TAF |
| 11% | chr12 | 94208725 | 94209257 | + | chr12 | 94243746 | 94244047 | + | ENST00000332896; ENST00000542893 | TSF |
| 10% | chr9 | 133961993 | 133962061 | + | chr9 | 133962863 | 133963009 | + | ENST00000361069; ENST00000355452 | TAF |
| 10% | chr14 | 24105943 | 24105981 | + | chr14 | 24112361 | 24112428 | + | ENST00000432832; ENST00000250383; ENST00000344777; ENST00000557535; ENST00000553600 | TAF |
| 10% | chr14 | 24105943 | 24105981 | + | chr14 | 24112361 | 24112428 | + | ENST00000432832; ENST00000250383; ENST00000344777; ENST00000557535; ENST00000553600 | TAF |
| 10% | chr14 | 24105943 | 24105981 | + | chr14 | 24112361 | 24112428 | + | ENST00000432832; ENST00000250383; ENST00000344777; ENST00000557535; ENST00000553600 | TAF |
| 10% | chr14 | 24105943 | 24105981 | + | chr14 | 24112361 | 24112428 | + | ENST00000432832; ENST00000250383; ENST00000344777; ENST00000557535; ENST00000553600 | TAF |
| 10% | chr14 | 24105943 | 24105981 | + | chr14 | 24112361 | 24112428 | + | ENST00000432832; ENST00000250383; ENST00000344777; ENST00000557535; ENST00000553600 | TAF |
| 10% | chr7 | 73098299 | 73098330 | + | chr7 | 73100966 | 73101061 | + | ENST00000265758; ENST00000432522; ENST00000421744; ENST00000428163; ENST00000423166; ENST00000423497 | TAF |
| 10% | chr7 | 73098299 | 73098330 | + | chr7 | 73100966 | 73101061 | + | ENST00000265758; ENST00000432522; ENST00000421744; ENST00000428163; ENST00000423166; ENST00000423497 | TAF |
| 10% | chr7 | 73098299 | 73098330 | + | chr7 | 73100966 | 73101061 | + | ENST00000265758; ENST00000432522; ENST00000421744; ENST00000428163; ENST00000423166; ENST00000423497 | TAF |
| 10% | chr7 | 73098299 | 73098330 | + | chr7 | 73100966 | 73101061 | + | ENST00000265758; ENST00000432522; ENST00000421744; ENST00000428163; ENST00000423166; ENST00000423497 | TAF |
| 10% | chr7 | 73098299 | 73098330 | + | chr7 | 73100966 | 73101061 | + | ENST00000265758; ENST00000432522; ENST00000421744; ENST00000428163; ENST00000423166; ENST00000423497 | TAF |
| 10% | chr13 | 43628887 | 43629679 | + | chr13 | 43643066 | 43643139 | + | ENST00000379221 | TAF |
| 10% | chr11 | 87906665 | 87906580 | − | chr11 | 87883123 | 87882843 | − | ENST00000243662; ENST00000526372 | TAF |
| 10% | chr19 | 15493496 | 15493406 | − | chr19 | 15491423 | 15491328 | − | ENST00000397410; ENST00000595465 | TAF |
| 10% | chr1 | 40781678 | 40781517 | − | chr1 | 40781336 | 40781262 | − | ENST00000372748; ENST00000417105; ENST00000372736 | TAF |
| 10% | chr1 | 40781678 | 40781517 | − | chr1 | 40781336 | 40781262 | − | ENST00000372748; ENST00000417105; ENST00000372736 | TAF |
| 10% | chr1 | 40781678 | 40781517 | − | chr1 | 40781336 | 40781262 | − | ENST00000372748; ENST00000417105; ENST00000372736 | TAF |
| 10% | chr5 | 173041966 | 173041919 | − | chr5 | 173040258 | 173040134 | − | ENST00000311086; ENST00000285908 | TAF |
| 10% | chr5 | 173041966 | 173041919 | − | chr5 | 173040258 | 173040134 | − | ENST00000311086; ENST00000285908 | TAF |
| 10% | chr1 | 154925216 | 154925088 | − | chr1 | 154924397 | 154924271 | − | ENST00000368463; ENST00000368460; ENST00000490230 | TAF |
| 10% | chr1 | 154925216 | 154925088 | − | chr1 | 154924397 | 154924271 | − | ENST00000368463; ENST00000368460; ENST00000490230 | TAF |
| 10% | chr1 | 154925216 | 154925088 | − | chr1 | 154924397 | 154924271 | − | ENST00000368463; ENST00000368460; ENST00000490230 | TAF |
| 9% | chr2 | 74762302 | 74762039 | − | chr2 | 74761901 | 74761658 | − | ENST00000264094; ENST00000393937; ENST00000409549; ENST00000409986 | TSF |
| 9% | chr2 | 74762302 | 74762039 | − | chr2 | 74761901 | 74761658 | − | ENST00000264094; ENST00000393937; ENST00000409549; ENST00000409986 | TSF |
| 9% | chr10 | 99119563 | 99119361 | − | chr10 | 99118767 | 99118700 | − | ENST00000370992; ENST00000536831; ENST00000315563; ENST00000414986 | TSF |
| 8% | chr12 | 55223983 | 55224659 | + | chr12 | 55250554 | 55250676 | + | ENST00000546809; ENST00000308796 | TSF |
| 8% | chr11 | 1891186 | 1891243 | + | chr11 | 1901317 | 1901454 | + | ENST00000311604; ENST00000381775; ENST00000457279; ENST00000429923; ENST00000418975 | TSF |
| 8% | chr11 | 1891186 | 1891243 | + | chr11 | 1901317 | 1901454 | + | ENST00000311604; ENST00000381775; ENST00000457279; ENST00000429923; ENST00000418975 | TSF |
| 8% | chr11 | 1891186 | 1891243 | + | chr11 | 1901317 | 1901454 | + | ENST00000311604; ENST00000381775; ENST00000457279; ENST00000429923; ENST00000418975 | TSF |
| 8% | chr11 | 1891186 | 1891243 | + | chr11 | 1901317 | 1901454 | + | ENST00000311604; ENST00000381775; ENST00000457279; ENST00000429923; ENST00000418975 | TSF |

TABLE 7

Transcript fusion for Bladder Carcinoma (BLCA) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 44% | chr12 | 71509738 | 71509630 | − | ENST00000549357 | chr12 | 71504233 | 71503634 | − | TAF |
| 27% | chr15 | 58957396 | 58957296 | − | ENST00000260408 | chr15 | 58947615 | 58947395 | − | TAF |
| 25% | chr10 | 47747112 | 47747132 | + | ENST00000340243; ENST00000374277; ENST00000449464; ENST00000538825 | chr10 | 48278725 | 48278896 | + | TAF |
| 23% | chr20 | 35842163 | 35842268 | + | ENST00000237530; ENST00000373622 | chr20 | 35844460 | 35844765 | + | TAF |
| 23% | chr20 | 35842163 | 35842268 | + | ENST00000237530; ENST00000373622 | chr20 | 35844460 | 35844765 | + | TAF |
| 22% | chr3 | 49927493 | 49927357 | − | ENST00000296474; ENST00000344206 | chr3 | 49927248 | 49927204 | − | TAF |
| 22% | chr3 | 49927493 | 49927357 | − | ENST00000296474; ENST00000344206 | chr3 | 49927248 | 49927204 | − | TAF |
| 21% | chr1 | 60370730 | 60370543 | − | ENST00000371204 | chr1 | 60370188 | 60370144 | − | TAF |
| 20% | chr22 | 45689062 | 45689194 | + | ENST00000216211; ENST00000396082 | chr22 | 45691275 | 45691319 | + | TAF |
| 20% | chr22 | 45689062 | 45689194 | + | ENST00000216211; ENST00000396082 | chr22 | 45691275 | 45691319 | + | TAF |
| 20% | chr3 | 118943092 | 118942905 | − | ENST00000483209; ENST00000467604; ENST00000359213; ENST00000393765; ENST00000480814 | chr3 | 1189385122 | 118938188 | − | TAF |
| 17% | chr11 | 64594027 | 64593942 | − | ENST00000342711 | chr11 | 64592957 | 64592752 | − | TAF |
| 16% | chr20 | 43560983 | 43561073 | + | ENST00000255136; ENST00000217073 | chr20 | 43561176 | 43561224 | + | TAF |
| 15% | chr10 | 120905865 | 120905748 | − | ENST00000355697; ENST00000330036 | chr10 | 120901885 | 120901741 | − | TAF |
| 15% | chr10 | 120905865 | 120905748 | − | ENST00000355697; ENST00000330036 | chr10 | 120901885 | 120901741 | − | TAF |
| 15% | chr1 | 32696528 | 32696620 | + | ENST00000373586 | chr1 | 32696861 | 32697110 | + | TAF |
| 14% | chr17 | 40821639; 40821538 | 40821448 | − | ENST00000591022; ENST00000412503; ENST00000293349 | chr17 | 40820920 | 40820864 | − | TAF |
| 14% | chr17 | 40821639; 40821538 | 40821448 | − | ENST00000591022; ENST00000412503; ENST00000293349 | chr17 | 40820920 | 40820864 | − | TAF |
| 14% | chr17 | 40821639; 40821538 | 40821448 | − | ENST00000591022; ENST00000412503; ENST00000293349 | chr17 | 40820920 | 40820864 | − | TAF |
| 14% | chr8 | 54793576 | 54793644 | + | ENST00000276500 | chr8 | 54826057 | 54826421 | + | TAF |
| 14% | chr5 | 82554349 | 82554496 | + | ENST00000282268; ENST00000338635; ENST00000396027; ENST00000511817 | chr5 | 82606608 | 82606935 | + | TAF |
| 13% | chr14 | 24868453 | 24868650 | + | ENST00000382554 | chr14 | 24874817 | 24875031 | + | TAF |
| 13% | chr9 | 15506635 | 15506559 | − | ENST00000380738; ENST00000380733; ENST00000380715; ENST00000380716; ENST00000397519 | chr9 | 15492223 | 15492056 | − | TAF |
| 13% | chr1 | 11115983; 11115877 | 11115838 | − | ENST00000376957; ENST00000490101 | chr1 | 11115464 | 11115178 | − | TSF |
| 13% | chr1 | 11115983; 11115877 | 11115838 | − | ENST00000376957; ENST00000490101 | chr1 | 11115464 | 11115178 | − | TSF |
| 12% | chr5 | 147207691 | 147207585 | − | ENST00000296695; ENST00000510027 | chr5 | 147185494 | 147185375 | − | TAF |
| 12% | chr8 | 101721451 | 101721361 | − | ENST00000318607; ENST00000519004; ENST00000522387; ENST00000523636; ENST00000517403 | chr8 | 101720235 | 101719431 | − | TAF |
| 12% | chr8 | 101721451 | 101721361 | − | ENST00000318607; ENST00000519004; ENST00000522387; ENST00000523636; ENST00000517403 | chr8 | 101720235 | 101719431 | − | TAF |
| 12% | chr8 | 101721451 | 101721361 | − | ENST00000318607; ENST00000519004; ENST00000522387; ENST00000523636; ENST00000517403 | chr8 | 101720235 | 101719431 | − | TAF |
| 12% | chr8 | 101721451 | 101721361 | − | ENST00000318607; ENST00000519004; ENST00000522387; ENST00000523636; ENST00000517403 | chr8 | 101720235 | 101719431 | − | TAF |
| 12% | chr8 | 101721451 | 101721361 | − | ENST00000318607; ENST00000519004; ENST00000522387; ENST00000523636; ENST00000517403 | chr8 | 101720235 | 101719431 | − | TAF |
| 12% | chr5 | 74984990 | 74984837 | − | ENST00000428202; ENST00000514838; ENST00000380475; ENST00000510798; ENST00000446329 | chr5 | 74983153 | 74982863 | − | TAF |
| 12% | chr5 | 74984990 | 74984837 | − | ENST00000428202; ENST00000514838; ENST00000380475; ENST00000510798; ENST00000446329 | chr5 | 74983153 | 74982863 | − | TAF |
| 12% | chr5 | 74984990 | 74984837 | − | ENST00000428202; ENST00000514838; ENST00000380475; ENST00000510798; ENST00000446329 | chr5 | 74983153 | 74982863 | − | TAF |
| 12% | chr5 | 74984990 | 74984837 | − | ENST00000428202; ENST00000514838; ENST00000380475; ENST00000510798; ENST00000446329 | chr5 | 74983153 | 74982863 | − | TAF |
| 11% | chr1 | 153534067 | 153533988 | − | ENST00000368708; ENST00000487430; ENST00000497140; ENST00000368710; ENST00000368709 | chr1 | 153532853 | 153532704 | | TAF |
| 11% | chr1 | 153534067 | 153533988 | − | ENST00000368708; ENST00000487430; ENST00000497140; ENST00000368710; ENST00000368709 | chr1 | 153532853 | 153532704 | | TAF |
| 11% | chr19 | 35612126 | 35612149 | + | ENST00000454903; ENST00000406242; ENST00000604404; ENST00000435734; ENST00000603181; ENST00000604255; ENST00000344013; ENST00000346446; ENST00000603449; ENST00000406988; | chr19 | 35613565 | 35613610 | + | TAF |

TABLE 7-continued

Transcript fusion for Bladder Carcinoma (BLCA) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 11% | chr19 | 35612126 | 35612149 | + | ENST00000605550; ENST00000604804; ENST00000605552; ENST00000535103 ENST00000603524; ENST00000604621; ENST00000605677 ENST00000454903; ENST00000406242; ENST00000604404; ENST00000435734; ENST00000603181; ENST00000604255; ENST00000344013; ENST00000346446; ENST00000603449; ENST00000406988; ENST00000605550; ENST00000604804; ENST00000605552; ENST00000535103 ENST00000603524; ENST00000604621; ENST00000605677 | chr19 | 35613565 | 35613610 | + | TAF |
| 11% | chr3 | 196230044 | 196229744 | − | ENST00000318037; ENST00000437070 | chr3 | 196223342 | 196223041 | − | TAF |
| 11% | chr9 | 125054028 | 125054119 | + | ENST00000297908; ENST00000344641; ENST00000373723; ENST00000373729; ENST00000394315 | chr9 | 125068067 | 125068171 | + | TSF |
| 11% | chr9 | 125054028 | 125054119 | + | ENST00000297908; ENST00000344641; ENST00000373723; ENST00000373729; ENST00000394315 | chr9 | 125068067 | 125068171 | + | TSF |
| 11% | chr9 | 125054028 | 125054119 | + | ENST00000297908; ENST00000344641; ENST00000373723; ENST00000373729; ENST00000394315 | chr9 | 125068067 | 125068171 | + | TSF |
| 11% | chr3 | 118917904 | 118917987 | + | ENST00000497685; ENST00000264234; ENST00000460625 | chr3 | 118922347 | 118922648 | + | TSF |
| 11% | chr3 | 118917904 | 118917987 | + | ENST00000497685; ENST00000264234; ENST00000460625 | chr3 | 118922347 | 118922648 | + | TSF |
| 11% | chr3 | 118917904 | 118917987 | + | ENST00000497685; ENST00000264234; ENST00000460625 | chr3 | 118922347 | 118922648 | + | TSF |
| 10% | chr17 | 61907631; 61907746 | 61907861 | + | ENST00000579708; ENST00000310144; ENST00000581842; ENST00000582130; ENST00000584320; ENST00000585123; ENST00000580864; ENST00000584536; ENST00000375812; ENST00000581882; ENST00000584880 | chr17 | 61908085 | 61908122 | + | TAF |
| 10% | chr17 | 61907631; 61907746 | 61907861 | + | ENST00000579708; ENST00000310144; ENST00000581842; ENST00000582130; ENST00000584320; ENST00000585123; ENST00000580864; ENST00000584536; ENST00000375812; ENST00000581882; ENST00000584880 | chr17 | 61908085 | 61908122 | + | TAF |
| 10% | chr17 | 61907631; 61907746 | 61907861 | + | ENST00000579708; ENST00000310144; ENST00000581842; ENST00000582130; ENST00000584320; ENST00000585123; ENST00000580864; ENST00000584536; ENST00000375812; ENST00000581882; ENST00000584880 | chr17 | 61908085 | 61908122 | + | TAF |
| 10% | chr17 | 61907631; 61907746 | 61907861 | + | ENST00000579708; ENST00000310144; ENST00000581842; ENST00000582130; ENST00000584320; ENST00000585123; ENST00000580864; ENST00000584536; ENST00000375812; ENST00000581882; ENST00000584880 | chr17 | 61908085 | 61908122 | + | TAF |
| 10% | chr17 | 61907631; 61907746 | 61907861 | + | ENST00000579708; ENST00000310144; ENST00000581842; ENST00000582130; ENST00000584320; ENST00000585123; ENST00000580864; ENST00000584536; ENST00000375812; ENST00000581882; ENST00000584880 | chr17 | 61908085 | 61908122 | + | TAF |
| 10% | chr4 | 6695660 | 6695797 | + | ENST00000296370 | chr4 | 6698154 | 6698226 | + | TAF |
| 9% | chr1 | 225156461 | 225156576 | + | ENST00000430092; ENST00000400952; ENST00000366849; ENST00000439375 | chr1 | 225157336 | 225158402 | + | TSF |
| 9% | chr1 | 225156461 | 225156576 | + | ENST00000430092; ENST00000400952; ENST00000366849; ENST00000439375 | chr1 | 225157336 | 225158402 | + | TSF |
| 9% | chr8 | 42924698; 42924750 | 42924802 | + | ENST00000534420; ENST00000302279; ENST00000533998; ENST00000342116; ENST00000531266; ENST00000525699; ENST00000529687; ENST00000533336 | chr8 | 42925245 | 42925476 | + | TSF |
| 9% | chr8 | 42924698; 42924750 | 42924802 | + | ENST00000534420; ENST00000302279; ENST00000533998; ENST00000342116; ENST00000531266; ENST00000525699; ENST00000529687; ENST00000533336 | chr8 | 42925245 | 42925476 | + | TSF |

TABLE 7-continued

Transcript fusion for Bladder Carcinoma (BLCA) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 9% | chr8 | 42924698; 42924750 | 42924802 | + | ENST00000534420; ENST00000302279; ENST00000533998; ENST00000342116; ENST00000531266; ENST00000525699; ENST00000529687; ENST00000533336 | chr8 | 42925245 | 42925476 | + | TSF |
| 9% | chr8 | 42924698; 42924750 | 42924802 | + | ENST00000534420; ENST00000302279; ENST00000533998; ENST00000342116; ENST00000531266; ENST00000525699; ENST00000529687; ENST00000533336 | chr8 | 42925245 | 42925476 | + | TSF |
| 9% | chr8 | 42924698; 42924750 | 42924802 | + | ENST00000534420; ENST00000302279; ENST00000533998; ENST00000342116; ENST00000531266; ENST00000525699; ENST00000529687; ENST00000533336 | chr8 | 42925245 | 42925476 | + | TSF |
| 9% | chr8 | 42924698; 42924750 | 42924802 | + | ENST00000534420; ENST00000302279; ENST00000533998; ENST00000342116; ENST00000531266; ENST00000525699; ENST00000529687; ENST00000533336 | chr8 | 42925245 | 42925476 | + | TSF |
| 8% | chr19 | 53352466; 53352373 | 53352340 | − | ENST00000595646; ENST00000243639; ENST00000597924; ENST00000601847 | chr19 | 53339322 | 53339166 | − | TSF |
| 8% | chr19 | 53352466; 53352373 | 53352340 | − | ENST00000595646; ENST00000243639; ENST00000597924; ENST00000601847 | chr19 | 53339322 | 53339166 | − | TSF |
| 7% | chr17 | 36288631 | 36288740 | + | ENST00000327454; ENST00000378174; ENST00000505415; ENST00000539424 | chr17 | 36289142 | 36289609 | + | TSF |
| 7% | chr17 | 36288631 | 36288740 | + | ENST00000327454; ENST00000378174; ENST00000505415; ENST00000539424 | chr17 | 36289142 | 36289609 | + | TSF |
| 7% | chr3 | 48716169 | 48715997 | − | ENST00000341520; ENST00000416649; ENST00000294129; ENST00000413374 | chr3 | 48702393 | 48702198 | − | TSF |
| 7% | chr3 | 48716169 | 48715997 | − | ENST00000341520; ENST00000416649; ENST00000294129; ENST00000413374 | chr3 | 48702393 | 48702198 | − | TSF |
| 7% | chr3 | 48716169 | 48715997 | − | ENST00000341520; ENST00000416649; ENST00000294129; ENST00000413374 | chr3 | 48702393 | 48702198 | − | TSF |
| 6% | chr17 | 36343995 | 36343886 | − | ENST00000518551; ENST00000354664; ENST00000339023; ENST00000519532; ENST00000537432 | chr17 | 36343484 | 36343017 | − | TSF |
| 6% | chr17 | 36343995 | 36343886 | − | ENST00000518551; ENST00000354664; ENST00000339023; ENST00000519532; ENST00000537432 | chr17 | 36343484 | 36343017 | − | TSF |
| 5% | chr17 | 43475413 | 43475315 | − | ENST00000532038; ENST00000376922; ENST00000528384; ENST00000455881; ENST00000428638; ENST00000442348; ENST00000532891 | chr17 | 43474814 | 43474703 | − | TSF |
| 5% | chr17 | 43475413 | 43475315 | − | ENST00000532038; ENST00000376922; ENST00000528384; ENST00000455881; ENST00000428638; ENST00000442348; ENST00000532891 | chr17 | 43474814 | 43474703 | − | TSF |
| 5% | chr17 | 43475413 | 43475315 | − | ENST00000532038; ENST00000376922; ENST00000528384; ENST00000455881; ENST00000428638; ENST00000442348; ENST00000532891 | chr17 | 43474814 | 43474703 | − | TSF |
| 5% | chr17 | 43475413 | 43475315 | − | ENST00000532038; ENST00000376922; ENST00000528384; ENST00000455881; ENST00000428638; ENST00000442348; ENST00000532891 | chr17 | 43474814 | 43474703 | − | TSF |
| 5% | chr17 | 43475413 | 43475315 | − | ENST00000532038; ENST00000376922; ENST00000528384; ENST00000455881; ENST00000428638; ENST00000442348; ENST00000532891 | chr17 | 43474814 | 43474703 | − | TSF |
| 5% | chr17 | 43475413 | 43475315 | − | ENST00000532038; ENST00000376922; ENST00000528384; ENST00000455881; ENST00000428638; ENST00000442348; ENST00000532891 | chr17 | 43474814 | 43474703 | − | TSF |
| 5% | chr11 | 60701014 | 60701216 | + | ENST00000453848; ENST00000005286; ENST00000536409 | chr11 | 60701443 | 60701575 | + | TSF |
| 5% | chr11 | 60701014 | 60701216 | + | ENST00000453848; ENST00000005286; ENST00000536409 | chr11 | 60701443 | 60701575 | + | TSF |
| 5% | chr11 | 60701014 | 60701216 | + | ENST00000453848; ENST00000005286; ENST00000536409 | chr11 | 60701443 | 60701575 | + | TSF |
| 5% | chr4 | 169086398 | 169086477 | + | ENST00000359299 | chr4 | 169090666 | 169090754 | + | TSF |
| 5% | chr16 | 2825557; 2825626 | 2825452 | − | ENST00000262306; ENST00000409906; ENST00000409477; ENST00000494946 | chr16 | 2823822 | 2823809 | − | TSF |
| 5% | chr16 | 2825557; 2825626 | 2825452 | − | ENST00000262306; ENST00000409906; ENST00000409477; ENST00000494946 | chr16 | 2823822 | 2823809 | − | TSF |
| 5% | chr16 | 2825557; 2825626 | 2825452 | − | ENST00000262306; ENST00000409906; ENST00000409477; ENST00000494946 | chr16 | 2823822 | 2823809 | − | TSF |

TABLE 7-continued

Transcript fusion for Bladder Carcinoma (BLCA) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 5% | chr1 | 40313763; 40313769; 40313673; 40313734 | 40313658 | − | ENST00000441669; ENST00000462797; ENST00000316891; ENST00000372818; ENST00000537223; ENST00000537440; ENST00000545233 | chr1 | 40313419 | 40313374 | − | TSF |
| 5% | chr1 | 40313763; 40313769; 40313673; 40313734 | 40313658 | − | ENST00000441669; ENST00000462797; ENST00000316891; ENST00000372818; ENST00000537223; ENST00000537440; ENST00000545233 | chr1 | 40313419 | 40313374 | − | TSF |
| 5% | chr1 | 40313763; 40313769; 40313673; 40313734 | 40313658 | − | ENST00000441669; ENST00000462797; ENST00000316891; ENST00000372818; ENST00000537223; ENST00000537440; ENST00000545233 | chr1 | 40313419 | 40313374 | − | TSF |
| 5% | chr1 | 40313763; 40313769; 40313673; 40313734 | 40313658 | − | ENST00000441669; ENST00000462797; ENST00000316891; ENST00000372818; ENST00000537223; ENST00000537440; ENST00000545233 | chr1 | 40313419 | 40313374 | − | TSF |
| 5% | chr19 | 45895598 | 45895138 | − | ENST00000360957; ENST00000418234 | chr19 | 45889495 | 45889472 | − | TSF |
| 4% | chr19 | 3114942 | 3115070 | + | ENST00000078429; ENST00000587636 | chr19 | 3115258 | 3115402 | + | TSF |
| 4% | chr19 | 3114942 | 3115070 | + | ENST00000078429; ENST00000587636 | chr19 | 3115258 | 3115402 | + | TSF |
| 4% | chr3 | 12458203 | 12458653 | + | ENST00000397010; ENST00000309576; ENST00000397015; ENST00000397012; ENST00000397026; ENST00000287820 | chr3 | 12493109 | 12493334 | + | TSF |
| 4% | chr3 | 12458203 | 12458653 | + | ENST00000397010; ENST00000309576; ENST00000397015; ENST00000397012; ENST00000397026; ENST00000287820 | chr3 | 12493109 | 12493334 | + | TSF |
| 4% | chr3 | 12458203 | 12458653 | + | ENST00000397010; ENST00000309576; ENST00000397015; ENST00000397012; ENST00000397026; ENST00000287820 | chr3 | 12493109 | 12493334 | + | TSF |
| 4% | chr11 | 71209398; 71209448 | 71209574 | + | ENST00000319023; ENST00000539574; ENST00000530055; ENST00000525593; ENST00000527963 | chr11 | 71216557 | 71216960 | + | TSF |
| 4% | chr11 | 71209398; 71209448 | 71209574 | + | ENST00000319023; ENST00000539574; ENST00000530055; ENST00000525593; ENST00000527963 | chr11 | 71216557 | 71216960 | + | TSF |
| 4% | chr11 | 71209398; 71209448 | 71209574 | + | ENST00000319023; ENST00000539574; ENST00000530055; ENST00000525593; ENST00000527963 | chr11 | 71216557 | 71216960 | + | TSF |
| 4% | chr11 | 71209398; 71209448 | 71209574 | + | ENST00000319023; ENST00000539574; ENST00000530055; ENST00000525593; ENST00000527963 | chr11 | 71216557 | 71216960 | + | TSF |
| 4% | chr11 | 71209398; 71209448 | 71209574 | + | ENST00000319023; ENST00000539574; ENST00000530055; ENST00000525593; ENST00000527963 | chr11 | 71216557 | 71216960 | + | TSF |
| 4% | chr5 | 54993786 | 54993674 | − | ENST00000396865; ENST00000539768; ENST00000318672; ENST00000508124; ENST00000511233; ENST00000503891; ENST00000513993; ENST00000505563; ENST00000506624; ENST00000507109 | chr5 | 54993040 | 54992544 | − | TSF |
| 4% | chr7 | 8198282 | 8198157 | − | ENST00000402384; ENST00000406470; ENST00000265577; ENST00000396675; ENST00000339809; ENST00000401396; ENST00000422063; ENST00000407906; ENST00000317367 | chr7 | 8197727 | 8197714 | − | TSF |
| 4% | chr7 | 8198282 | 8198157 | − | ENST00000402384; ENST00000406470; ENST00000265577; ENST00000396675; ENST00000339809; ENST00000401396; ENST00000422063; ENST00000407906; ENST00000317367 | chr7 | 8197727 | 8197714 | − | TSF |
| 4% | chr7 | 8198282 | 8198157 | − | ENST00000402384; ENST00000406470; ENST00000265577; ENST00000396675; ENST00000339809; ENST00000401396; ENST00000422063; ENST00000407906; ENST00000317367 | chr7 | 8197727 | 8197714 | − | TSF |
| 4% | chr12 | 56742407 | 56742313 | − | ENST00000314128; ENST00000557235 | chr12 | 56740986 | 56740975 | − | TSF |
| 4% | chr12 | 56742407 | 56742313 | − | ENST00000314128; ENST00000557235 | chr12 | 56740986 | 56740975 | − | TSF |
| 3% | chr20 | 29632611 | 29632721 | + | ENST00000278882; ENST00000358464 | chr20 | 29652086 | 29652324 | + | TSF |
| 3% | chr8 | 101620791 | 101620722 | − | ENST00000311812; ENST00000428383 | chr8 | 101619733 | 101619704 | − | TSF |
| 3% | chr8 | 101620791 | 101620722 | − | ENST00000311812; ENST00000428383 | chr8 | 101619733 | 101619704 | − | TSF |
| 3% | chr4 | 57319766 | 57319927 | + | ENST00000514888; ENST00000264221; ENST00000505164; ENST00000399688; ENST00000512576 | chr4 | 57321183 | 57321327 | + | TSF |
| 3% | chr4 | 57319766 | 57319927 | + | ENST00000514888; ENST00000264221; ENST00000505164; ENST00000399688; ENST00000512576 | chr4 | 57321183 | 57321327 | + | TSF |

TABLE 7-continued

Transcript fusion for Bladder Carcinoma (BLCA) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 3% | chr4 | 57319766 | 57319927 | + | ENST00000514888; ENST00000264221; ENST00000505164; ENST00000399688; ENST00000512576 | chr4 | 57321183 | 57321327 | + | TSF |
| 3% | chr22 | 25202408 | 25202451 | + | ENST00000400358; ENST00000400359 | chr22 | 25209976 | 25210040 | + | TSF |
| 3% | chr1 | 24700300 | 24700192 | − | ENST00000374409; ENST00000440416; ENST00000003583; ENST00000337248; ENST00000438866 | chr1 | 24696970 | 24696808 | − | TSF |
| 3% | chr1 | 24700300 | 24700192 | − | ENST00000374409; ENST00000440416; ENST00000003583; ENST00000337248; ENST00000438866 | chr1 | 24696970 | 24696808 | − | TSF |
| 3% | chr1 | 24700300 | 24700192 | − | ENST00000374409; ENST00000440416; ENST00000003583; ENST00000337248; ENST00000438866 | chr1 | 24696970 | 24696808 | − | TSF |
| 3% | chr19 | 54104626 | 54104519 | − | ENST00000600193 | chr19 | 54104407 | 54104303 | − | TSF |
| 3% | chr1 | 110233076 | 110233186 | + | ENST00000309851; ENST00000369823 | chr1 | 110235581 | 110235619 | + | TSF |
| 3% | chr1 | 110233076 | 110233186 | + | ENST00000309851; ENST00000369823 | chr1 | 110235581 | 110235619 | + | TSF |
| 3% | chr17 | 59481967 | 59482130 | + | ENST00000240328 | chr17 | 59482423 | 59482469 | + | TSF |
| 3% | chr12 | 71509738 | 71509686 | − | ENST00000549357 | chr12 | 71504233 | 71503634 | − | TSF |
| 3% | chr7 | 22532348 | 22532184 | − | ENST00000406890; ENST00000404369; ENST00000424363 | chr7 | 22512853 | 22512669 | − | TSF |
| 3% | chr7 | 22532348 | 22532184 | − | ENST00000406890; ENST00000404369; ENST00000424363 | chr7 | 22512853 | 22512669 | − | TSF |
| 3% | chr1 | 32560385 | 32560572 | + | ENST00000336294; ENST00000373634; ENST00000427288 | chr1 | 32561261 | 32561358 | + | TSF |
| 3% | chr1 | 32560385 | 32560572 | + | ENST00000336294; ENST00000373634; ENST00000427288 | chr1 | 32561261 | 32561358 | + | TSF |
| 3% | chr1 | 32560385 | 32560572 | + | ENST00000336294; ENST00000373634; ENST00000427288 | chr1 | 32561261 | 32561358 | + | TSF |
| 3% | chr8 | 71619168 | 71619388 | + | ENST00000408926; ENST00000520030 | chr8 | 71625661 | 71625673 | + | TSF |
| 3% | chr7 | 55270210 | 55270401 | + | ENST00000455089 | chr7 | 55272949 | 55272949 | + | TSF |
| 3% | chr5 | 1802435 | 1802488 | + | ENST00000274137; ENST00000469176 | chr5 | 1811082 | 1811428 | + | TSF |
| 3% | chr19 | 50165585 | 50165205 | − | ENST00000309877; ENST00000600911; ENST00000601291; ENST00000377139; ENST00000597198; ENST00000597636; ENST00000593922; ENST00000599144; ENST00000598808 | chr19 | 50164882 | 50164836 | − | TSF |
| 3% | chr19 | 50165585 | 50165205 | − | ENST00000309877; ENST00000600911; ENST00000601291; ENST00000377139; ENST00000597198; ENST00000597636; ENST00000593922; ENST00000599144; ENST00000598808 | chr19 | 50164882 | 50164836 | − | TSF |
| 2% | chr6 | 44200080 | 44200165 | + | ENST00000393844; ENST00000313248; ENST00000427851; ENST00000371740; ENST00000371755; ENST00000371731; ENST00000393841; ENST00000371713; ENST00000371724; ENST00000371708 | chr6 | 44209921 | 44210213 | + | TSF |
| 2% | chr6 | 44200080 | 44200165 | + | ENST00000393844; ENST00000313248; ENST00000427851; ENST00000371740; ENST00000371755; ENST00000371731; ENST00000393841; ENST00000371713; ENST00000371724; ENST00000371708 | chr6 | 44209921 | 44210213 | + | TSF |
| 2% | chr20 | 58581768 | 58581842 | + | ENST00000244047; ENST00000348616; ENST00000370991; ENST00000244049; ENST00000350849; ENST00000456106 | chr20 | 58600042 | 58600249 | + | TSF |
| 2% | chr20 | 58581768 | 58581842 | + | ENST00000244047; ENST00000348616; ENST00000370991; ENST00000244049; ENST00000350849; ENST00000456106 | chr20 | 58600042 | 58600249 | + | TSF |
| 2% | chr20 | 58581768 | 58581842 | + | ENST00000244047; ENST00000348616; ENST00000370991; ENST00000244049; ENST00000350849; ENST00000456106 | chr20 | 58600042 | 58600249 | + | TSF |
| 2% | chr20 | 58581768 | 58581842 | + | ENST00000244047; ENST00000348616; ENST00000370991; ENST00000244049; ENST00000350849; ENST00000456106 | chr20 | 58600042 | 58600249 | + | TSF |
| 2% | chr20 | 58581768 | 58581842 | + | ENST00000244047; ENST00000348616; ENST00000370991; ENST00000244049; ENST00000350849; ENST00000456106 | chr20 | 58600042 | 58600249 | + | TSF |
| 2% | chr20 | 58581768 | 58581842 | + | ENST00000244047; ENST00000348616; ENST00000370991; ENST00000244049; ENST00000350849; ENST00000456106 | chr20 | 58600042 | 58600249 | + | TSF |
| 2% | chr7 | 76144362 | 76144473 | + | ENST00000334348; ENST00000448265; ENST00000419923; ENST00000443097; ENST00000257632; ENST00000394849 | chr7 | 76648226 | 76648393 | + | TSF |
| 2% | chr7 | 76144362 | 76144473 | + | ENST00000334348; ENST00000448265; ENST00000419923; ENST00000443097; ENST00000257632; ENST00000394849 | chr7 | 76648226 | 76648393 | + | TSF |

TABLE 7-continued

Transcript fusion for Bladder Carcinoma (BLCA) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 2% | chr7 | 76144362 | 76144473 | + | ENST00000334348; ENST00000448265; ENST00000419923; ENST00000443097; ENST00000257632; ENST00000394849 | chr7 | 76648226 | 76648393 | + | TSF |
| 2% | chr11 | 101937216; 101937273 | 101937382 | + | ENST00000434758; ENST00000526781; ENST00000529204 | chr11 | 101937956 | 101938097 | + | TSF |
| 2% | chr11 | 101937216; 101937273 | 101937382 | + | ENST00000434758; ENST00000526781; ENST00000529204 | chr11 | 101937956 | 101938097 | + | TSF |
| 2% | chr1 | 63955889 | 63955754 | − | ENST00000371092; ENST00000271002; ENST00000489099; ENST00000283568 | chr1 | 63952444 | 63951983 | − | TSF |
| 2% | chr1 | 63955889 | 63955754 | − | ENST00000371092; ENST00000271002; ENST00000489099; ENST00000283568 | chr1 | 63952444 | 63951983 | − | TSF |
| 2% | chr9 | 127622543 | 127622462 | − | ENST00000373570; ENST00000493018; ENST00000348462 | chr9 | 127621011 | 127621010 | − | TSF |
| 2% | chr6 | 65098733 | 65098583 | − | ENST00000503581; ENST00000370621; ENST00000370616 | chr6 | 65097495 | 65097442 | − | TSF |
| 2% | chr1 | 6531697 | 6531548 | − | ENST00000400913; ENST00000340850; ENST00000377748; ENST00000377725; ENST00000377728; ENST00000377732; ENST00000400915; ENST00000377740; ENST00000535355; ENST00000377737; ENST00000537245; ENST00000544978 | chr1 | 6531300 | 6531188 | − | TSF |
| 2% | chr1 | 6531697 | 6531548 | − | ENST00000400913; ENST00000340850; ENST00000377748; ENST00000377725; ENST00000377728; ENST00000377732; ENST00000400915; ENST00000377740; ENST00000535355; ENST00000377737; ENST00000537245; ENST00000544978 | chr1 | 6531300 | 6531188 | − | TSF |
| 2% | chr1 | 6531697 | 6531548 | − | ENST00000400913; ENST00000340850; ENST00000377748; ENST00000377725; ENST00000377728; ENST00000377732; ENST00000400915; ENST00000377740; ENST00000535355; ENST00000377737; ENST00000537245; ENST00000544978 | chr1 | 6531300 | 6531188 | − | TSF |
| 2% | chr1 | 6531697 | 6531548 | − | ENST00000400913; ENST00000340850; ENST00000377748; ENST00000377725; ENST00000377728; ENST00000377732; ENST00000400915; ENST00000377740; ENST00000535355; ENST00000377737; ENST00000537245; ENST00000544978 | chr1 | 6531300 | 6531188 | − | TSF |
| 2% | chr1 | 6531697 | 6531548 | − | ENST00000400913; ENST00000340850; ENST00000377748; ENST00000377725; ENST00000377728; ENST00000377732; ENST00000400915; ENST00000377740; ENST00000535355; ENST00000377737; ENST00000537245; ENST00000544978 | chr1 | 6531300 | 6531188 | − | TSF |
| 2% | chr1 | 6531697 | 6531548 | − | ENST00000400913; ENST00000340850; ENST00000377748; ENST00000377725; ENST00000377728; ENST00000377732; ENST00000400915; ENST00000377740; ENST00000535355; ENST00000377737; ENST00000537245; ENST00000544978 | chr1 | 6531300 | 6531188 | − | TSF |
| 2% | chr3 | 98600611; 98600498 | 98600384 | − | ENST00000326840; ENST00000326857; ENST00000449482 | chr3 | 98586282 | 98584565 | − | TSF |
| 2% | chr3 | 98600611; 98600498 | 98600384 | − | ENST00000326840; ENST00000326857; ENST00000449482 | chr3 | 98586282 | 98584565 | − | TSF |
| 2% | chr5 | 1802435 | 1802488 | + | ENST00000274137; ENST00000469176 | chr5 | 1811112 | 1811428 | + | TSF |
| 2% | chr7 | 76144362 | 76144473 | + | ENST00000334348; ENST00000448265; ENST00000419923; ENST00000443097; ENST00000257632; ENST00000394849 | chr7 | 76676146 | 76676313 | + | TSF |
| 2% | chr7 | 76144362 | 76144473 | + | ENST00000334348; ENST00000448265; ENST00000419923; ENST00000443097; ENST00000257632; ENST00000394849 | chr7 | 76676146 | 76676313 | + | TSF |
| 2% | chr7 | 76144362 | 76144473 | + | ENST00000334348; ENST00000448265; ENST00000419923; ENST00000443097; ENST00000257632; ENST00000394849 | chr7 | 76676146 | 76676313 | + | TSF |
| 2% | chr12 | 69656249 | 69656342 | + | ENST00000551516 | chr12 | 69673004 | 69673309 | + | TSF |
| 2% | chr12 | 53862561; 53862564 | 53862616 | + | ENST00000359282; ENST00000437231; ENST00000447282; ENST00000603815; ENST00000549863; ENST00000359462; ENST00000546463; ENST00000552296; ENST00000552819; ENST00000455667; ENST00000439930; ENST00000548933; ENST00000562264; ENST00000553064; ENST00000547859 | chr12 | 53865082 | 53865327 | + | TSF |

TABLE 7-continued

Transcript fusion for Bladder Carcinoma (BLCA) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|----|----|
| 2% | chr12 | 53862561; 53862564 | 53862616 | + | ENST00000359282; ENST00000437231; ENST00000447282; ENST00000603815; ENST00000549863; ENST00000359462; ENST00000546463; ENST00000552296; ENST00000552819; ENST00000455667; ENST00000439930; ENST00000548933; ENST00000562264; ENST00000553064; ENST00000547859 | chr12 | 53865082 | 53865327 | + | TSF |
| 2% | chr12 | 53862561; 53862564 | 53862616 | + | ENST00000359282; ENST00000437231; ENST00000447282; ENST00000603815; ENST00000549863; ENST00000359462; ENST00000546463; ENST00000552296; ENST00000552819; ENST00000455667; ENST00000439930; ENST00000548933; ENST00000562264; ENST00000553064; ENST00000547859 | chr12 | 53865082 | 53865327 | + | TSF |
| 2% | chr12 | 53862561; 53862564 | 53862616 | + | ENST00000359282; ENST00000437231; ENST00000447282; ENST00000603815; ENST00000549863; ENST00000359462; ENST00000546463; ENST00000552296; ENST00000552819; ENST00000455667; ENST00000439930; ENST00000548933; ENST00000562264; ENST00000553064; ENST00000547859 | chr12 | 53865082 | 53865327 | + | TSF |
| 2% | chr12 | 53862561; 53862564 | 53862616 | + | ENST00000359282; ENST00000437231; ENST00000447282; ENST00000603815; ENST00000549863; ENST00000359462; ENST00000546463; ENST00000552296; ENST00000552819; ENST00000455667; ENST00000439930; ENST00000548933; ENST00000562264; ENST00000553064; ENST00000547859 | chr12 | 53865082 | 53865327 | + | TSF |
| 2% | chr12 | 53862561; 53862564 | 53862616 | + | ENST00000359282; ENST00000437231; ENST00000447282; ENST00000603815; ENST00000549863; ENST00000359462; ENST00000546463; ENST00000552296; ENST00000552819; ENST00000455667; ENST00000439930; ENST00000548933; ENST00000562264; ENST00000553064; ENST00000547859 | chr12 | 53865082 | 53865327 | + | TSF |
| 2% | chr12 | 53862561; 53862564 | 53862616 | + | ENST00000359282; ENST00000437231; ENST00000447282; ENST00000603815; ENST00000549863; ENST00000359462; ENST00000546463; ENST00000552296; ENST00000552819; ENST00000455667; ENST00000439930; ENST00000548933; ENST00000562264; ENST00000553064; ENST00000547859 | chr12 | 53865082 | 53865327 | + | TSF |
| 2% | chr12 | 53862561; 53862564 | 53862616 | + | ENST00000359282; ENST00000437231; ENST00000447282; ENST00000603815; ENST00000549863; ENST00000359462; ENST00000546463; ENST00000552296; ENST00000552819; ENST00000455667; ENST00000439930; ENST00000548933; ENST00000562264; ENST00000553064; ENST00000547859 | chr12 | 53865082 | 53865327 | + | TSF |
| 2% | chr12 | 53862561; 53862564 | 53862616 | + | ENST00000359282; ENST00000437231; ENST00000447282; ENST00000603815; ENST00000549863; ENST00000359462; ENST00000546463; ENST00000552296; ENST00000552819; ENST00000455667; ENST00000439930; ENST00000548933; ENST00000562264; ENST00000553064; ENST00000547859 | chr12 | 53865082 | 53865327 | + | TSF |
| 2% | chr12 | 53862561; 53862564 | 53862616 | + | ENST00000359282; ENST00000437231; ENST00000447282; ENST00000603815; ENST00000549863; ENST00000359462; ENST00000546463; ENST00000552296; ENST00000552819; ENST00000455667; ENST00000439930; ENST00000548933; ENST00000562264; ENST00000553064; ENST00000547859 | chr12 | 53865082 | 53865327 | + | TSF |
| 2% | chr12 | 53862561; 53862564 | 53862616 | + | ENST00000359282; ENST00000437231; ENST00000447282; ENST00000603815; ENST00000549863; ENST00000359462; | chr12 | 53865082 | 53865327 | + | TSF |

TABLE 7-continued

Transcript fusion for Bladder Carcinoma (BLCA) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| | | | | | ENST00000546463; ENST00000552296; ENST00000552819; ENST00000455667; ENST00000439930; ENST00000548933; ENST00000562264; ENST00000553064; ENST00000547859 | | | | |
| 2% | chr12 | 53862561; 53862564 | 53862616 | + | ENST00000359282; ENST00000437231; ENST00000447282; ENST00000603815; ENST00000549863; ENST00000359462; ENST00000546463; ENST00000552296; ENST00000552819; ENST00000455667; ENST00000439930; ENST00000548933; ENST00000562264; ENST00000553064; ENST00000547859 | chr12 | 53865082 | 53865327 | + | TSF |
| 2% | chr5 | 70858101 | 70858347 | + | ENST00000358731; ENST00000525844 | chr5 | 70868141 | 70868205 | + | TSF |
| 2% | chr5 | 70858101 | 70858347 | + | ENST00000358731; ENST00000525844 | chr5 | 70868141 | 70868205 | + | TSF |
| 2% | chr18 | 43307367; 43307237 | 43307383 | + | ENST00000502059; ENST00000415427; ENST00000588179; ENST00000436407; ENST00000589891 | chr18 | 43309951 | 43309986 | + | TSF |
| 2% | chr18 | 43307367; 43307237 | 43307383 | + | ENST00000502059; ENST00000415427; ENST00000588179; ENST00000436407; ENST00000589891 | chr18 | 43309951 | 43309986 | + | TSF |
| 2% | chr16 | 4401235; 4401294 | 4401233 | − | ENST00000577031; ENST00000318059; ENST00000571986; ENST00000576217; ENST00000571178 | chr16 | 4398819 | 4398660 | − | TSF |
| 2% | chr16 | 4401235; 4401294 | 4401233 | − | ENST00000577031; ENST00000318059; ENST00000571986; ENST00000576217; ENST00000571178 | chr16 | 4398819 | 4398660 | − | TSF |
| 2% | chrX | 41598709 | 41598637 | − | ENST00000421587; ENST00000318588; ENST00000361962; ENST00000378163; ENST00000378158; ENST00000378166; ENST00000442742; ENST00000378154 | chrX | 41557348 | 41557057 | − | TSF |
| 2% | chr3 | 49928739 | 49928630 | − | ENST00000296474; ENST00000344206; ENST00000434765; ENST00000440292 | chr3 | 49928452 | 49928163 | − | TSF |
| 2% | chr3 | 49928739 | 49928630 | − | ENST00000296474; ENST00000344206; ENST00000434765; ENST00000440292 | chr3 | 49928452 | 49928163 | − | TSF |
| 2% | chr3 | 49928739 | 49928630 | − | ENST00000296474; ENST00000344206; ENST00000434765; ENST00000440292 | chr3 | 49928452 | 49928163 | − | TSF |
| 2% | chr3 | 49928739 | 49928630 | − | ENST00000296474; ENST00000344206; ENST00000434765; ENST00000440292 | chr3 | 49928452 | 49928163 | − | TSF |
| 2% | chr12 | 113440737 | 113440907 | + | ENST00000342315; ENST00000392583 | chr12 | 113442280 | 113442294 | + | TSF |
| 2% | chr4 | 91321187 | 91321280 | + | ENST00000505073; ENST00000509176; ENST00000432775; ENST00000333691 | chr4 | 91325075 | 91325176 | + | TSF |
| 2% | chr1 | 156352539 | 156352660 | + | ENST00000451864; ENST00000255013; ENST00000368246; ENST00000400992; ENST00000368249 | chr1 | 156354082 | 156354192 | + | TSF |
| 2% | chr1 | 156352539 | 156352660 | + | ENST00000451864; ENST00000255013; ENST00000368246; ENST00000400992; ENST00000368249 | chr1 | 156354082 | 156354192 | + | TSF |
| 2% | chr1 | 156352539 | 156352660 | + | ENST00000451864; ENST00000255013; ENST00000368246; ENST00000400992; ENST00000368249 | chr1 | 156354082 | 156354192 | + | TSF |
| 2% | chr1 | 156352539 | 156352660 | + | ENST00000451864; ENST00000255013; ENST00000368246; ENST00000400992; ENST00000368249 | chr1 | 156354082 | 156354192 | + | TSF |
| 2% | chr16 | 16381600 | 16381719 | + | ENST00000399336; ENST00000263012; ENST00000538468 | chr16 | 16382422 | 16382605 | + | TSF |
| 2% | chr16 | 16381600 | 16381719 | + | ENST00000399336; ENST00000263012; ENST00000538468 | chr16 | 16382422 | 16382605 | + | TSF |
| 2% | chr19 | 15289752 | 15289634 | − | ENST00000263388; ENST00000601011 | chr19 | 15289244 | 15289201 | − | TSF |
| 2% | chr19 | 15289752 | 15289634 | − | ENST00000263388; ENST00000601011 | chr19 | 15289244 | 15289201 | − | TSF |
| 2% | chr7 | 73973957 | 73973985 | + | ENST00000265755; ENST00000455841; ENST00000424337; ENST00000476977; ENST00000470715 | chr7 | 73985447 | 73985582 | + | TSF |
| 2% | chr7 | 73973957 | 73973985 | + | ENST00000265755; ENST00000455841; ENST00000424337; ENST00000476977; ENST00000470715 | chr7 | 73985447 | 73985582 | + | TSF |
| 2% | chr7 | 73973957 | 73973985 | + | ENST00000265755; ENST00000455841; ENST00000424337; ENST00000476977; ENST00000470715 | chr7 | 73985447 | 73985582 | + | TSF |
| 2% | chr7 | 73973957 | 73973985 | + | ENST00000265755; ENST00000455841; ENST00000424337; ENST00000476977; ENST00000470715 | chr7 | 73985447 | 73985582 | + | TSF |

TABLE 7-continued

Transcript fusion for Bladder Carcinoma (BLCA) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 2% | chr12 | 102547647 | 102547754 | + | ENST00000327680; ENST00000378128; ENST00000541394; ENST00000358383; ENST00000392911; ENST00000412715; ENST00000417507; ENST00000457614 | chr12 | 102548605 | 102548938 | + | TSF |
| 2% | chr12 | 102547647 | 102547754 | + | ENST00000327680; ENST00000378128; ENST00000541394; ENST00000358383; ENST00000392911; ENST00000412715; ENST00000417507; ENST00000457614 | chr12 | 102548605 | 102548938 | + | TSF |
| 2% | chr12 | 102547647 | 102547754 | + | ENST00000327680; ENST00000378128; ENST00000541394; ENST00000358383; ENST00000392911; ENST00000412715; ENST00000417507; ENST00000457614 | chr12 | 102548605 | 102548938 | + | TSF |
| 2% | chr12 | 102547647 | 102547754 | + | ENST00000327680; ENST00000378128; ENST00000541394; ENST00000358383; ENST00000392911; ENST00000412715; ENST00000417507; ENST00000457614 | chr12 | 102548605 | 102548938 | + | TSF |
| 2% | chr12 | 102547647 | 102547754 | + | ENST00000327680; ENST00000378128; ENST00000541394; ENST00000358383; ENST00000392911; ENST00000412715; ENST00000417507; ENST00000457614 | chr12 | 102548605 | 102548938 | + | TSF |
| 2% | chrX | 71401561; 71401615; 71401644 | 71401678 | + | ENST00000373662; ENST00000218432; ENST00000423432; ENST00000373669; ENST00000496835; ENST00000439980; ENST00000446576 | chrX | 71405250 | 71405452 | + | TSF |
| 2% | chrX | 71401561; 71401615; 71401644 | 71401678 | + | ENST00000373662; ENST00000218432; ENST00000423432; ENST00000373669; ENST00000496835; ENST00000439980; ENST00000446576 | chrX | 71405250 | 71405452 | + | TSF |
| 2% | chrX | 71401561; 71401615; 71401644 | 71401678 | + | ENST00000373662; ENST00000218432; ENST00000423432; ENST00000373669; ENST00000496835; ENST00000439980; ENST00000446576 | chrX | 71405250 | 71405452 | + | TSF |
| 2% | chr18 | 61627392 | 61627509 | + | ENST00000408945 | chr18 | 61628870 | 61629168 | + | TSF |
| 2% | chr4 | 143003338 | 143003184 | − | ENST00000513000; ENST00000262992; ENST00000308502; ENST00000508116; ENST00000509777 | chr4 | 142977129 | 142976903 | − | TSF |
| 2% | chr19 | 53352466; 53352373 | 53352340 | − | ENST00000595646; ENST00000243639; ENST00000597924; ENST00000601847 | chr19 | 53297373 | 53297176 | − | TSF |
| 2% | chr19 | 53352466; 53352373 | 53352340 | − | ENST00000595646; ENST00000243639; ENST00000597924; ENST00000601847 | chr19 | 53297373 | 53297176 | − | TSF |
| 2% | chr19 | 53348549 | 53348432 | − | ENST00000243639 | chr19 | 53339322 | 53339166 | − | TSF |
| 2% | chr16 | 69418613; 69418553; 69418599 | 69418483 | − | ENST00000254942; ENST00000603068; ENST00000566750; ENST00000569542; ENST00000566257; ENST00000567296; ENST00000567841 | chr16 | 69413560 | 69413452 | − | TSF |
| 2% | chr16 | 69418613; 69418553; 69418599 | 69418483 | − | ENST00000254942; ENST00000603068; ENST00000566750; ENST00000569542; ENST00000566257; ENST00000567296; ENST00000567841 | chr16 | 69413560 | 69413452 | − | TSF |
| 2% | chr16 | 69418613; 69418553; 69418599 | 69418483 | − | ENST00000254942; ENST00000603068; ENST00000566750; ENST00000569542; ENST00000566257; ENST00000567296; ENST00000567841 | chr16 | 69413560 | 69413452 | − | TSF |
| 2% | chr16 | 69418613; 69418553; 69418599 | 69418483 | − | ENST00000254942; ENST00000603068; ENST00000566750; ENST00000569542; ENST00000566257; ENST00000567296; ENST00000567841 | chr16 | 69413560 | 69413452 | − | TSF |
| 2% | chr16 | 69418613; 69418553; 69418599 | 69418483 | − | ENST00000254942; ENST00000603068; ENST00000566750; ENST00000569542; ENST00000566257; ENST00000567296; ENST00000567841 | chr16 | 69413560 | 69413452 | − | TSF |
| 2% | chr16 | 69418613; 69418553; 69418599 | 69418483 | − | ENST00000254942; ENST00000603068; ENST00000566750; ENST00000569542; ENST00000566257; ENST00000567296; ENST00000567841 | chr16 | 69413560 | 69413452 | − | TSF |
| 2% | chr1 | 180283857 | 180283827 | − | ENST00000367595 | chr1 | 180281120 | 180281103 | − | TSF |
| 2% | chr7 | 91771800 | 91771777 | − | ENST00000435873 | chr7 | 91767155 | 91766808 | − | TSF |
| 2% | chr3 | 49456584 | 49456404 | − | ENST00000427987; ENST00000395338; ENST00000458307; ENST00000538581; ENST00000273588; ENST00000546031; ENST00000430521 | chr3 | 49455661 | 49455617 | − | TSF |
| 2% | chr3 | 49456584 | 49456404 | − | ENST00000427987; ENST00000395338; ENST00000458307; ENST00000538581; ENST00000273588; ENST00000546031; ENST00000430521 | chr3 | 49455661 | 49455617 | − | TSF |

TABLE 7-continued

Transcript fusion for Bladder Carcinoma (BLCA) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 2% | chr3 | 49456584 | 49456404 | − | ENST00000427987; ENST00000395338; ENST00000458307; ENST00000538581; ENST00000273588; ENST00000546031; ENST00000430521 | chr3 | 49455661 | 49455617 | − | TSF |
| 2% | chr3 | 49456584 | 49456404 | − | ENST00000427987; ENST00000395338; ENST00000458307; ENST00000538581; ENST00000273588; ENST00000546031; ENST00000430521 | chr3 | 49455661 | 49455617 | − | TSF |
| 2% | chr3 | 49456584 | 49456404 | − | ENST00000427987; ENST00000395338; ENST00000458307; ENST00000538581; ENST00000273588; ENST00000546031; ENST00000430521 | chr3 | 49455661 | 49455617 | − | TSF |
| 2% | chr17 | 34802073 | 34802035 | − | ENST00000330458; ENST00000535805; ENST00000535592; ENST00000394453; ENST00000592614; ENST00000341264 | chr17 | 34772854 | 34772787 | − | TSF |
| 2% | chr17 | 34802073 | 34802035 | − | ENST00000330458; ENST00000535805; ENST00000535592; ENST00000394453; ENST00000592614; ENST00000341264 | chr17 | 34772854 | 34772787 | − | TSF |
| 2% | chr17 | 73887428 | 73887358 | − | ENST00000591668; ENST00000592642; ENST00000269383; ENST00000543309 | chr17 | 73885428 | 73885139 | − | TSF |
| 2% | chr17 | 73887428 | 73887358 | − | ENST00000591668; ENST00000592642; ENST00000269383; ENST00000543309 | chr17 | 73885428 | 73885139 | − | TSF |
| 2% | chr17 | 73887428 | 73887358 | − | ENST00000591668; ENST00000592642; ENST00000269383; ENST00000543309 | chr17 | 73885428 | 73885139 | − | TSF |
| 2% | chr17 | 73887428 | 73887358 | − | ENST00000591668; ENST00000592642; ENST00000269383; ENST00000543309 | chr17 | 73885428 | 73885139 | − | TSF |
| 1% | chr19 | 40711028 | 40711203 | + | ENST00000253055; ENST00000593502; ENST00000597986 | chr19 | 40711395 | 40711597 | + | TSF |
| 1% | chr19 | 40711028 | 40711203 | + | ENST00000253055; ENST00000593502; ENST00000597986 | chr19 | 40711395 | 40711597 | + | TSF |
| 1% | chr19 | 40711028 | 40711203 | + | ENST00000253055; ENST00000593502; ENST00000597986 | chr19 | 40711395 | 40711597 | + | TSF |
| 1% | chr19 | 44564902 | 44564994 | + | ENST00000591793; ENST00000434772; ENST00000585552; ENST00000593088; ENST00000591850 | chr19 | 44565998 | 44566256 | + | TSF |
| 1% | chr19 | 44564902 | 44564994 | + | ENST00000591793; ENST00000434772; ENST00000585552; ENST00000593088; ENST00000591850 | chr19 | 44565998 | 44566256 | + | TSF |
| 1% | chr19 | 44564902 | 44564994 | + | ENST00000591793; ENST00000434772; ENST00000585552; ENST00000593088; ENST00000591850 | chr19 | 44565998 | 44566256 | + | TSF |
| 1% | chr19 | 55178148; 55178145 | 55178200 | + | ENST00000391736; ENST00000270452; ENST00000430952; ENST00000391734; ENST00000391733; ENST00000434286 | chr19 | 55178294 | 55178458 | + | TSF |
| 1% | chr19 | 55178148; 55178145 | 55178200 | + | ENST00000391736; ENST00000270452; ENST00000430952; ENST00000391734; ENST00000391733; ENST00000434286 | chr19 | 55178294 | 55178458 | + | TSF |
| 1% | chr19 | 55178148; 55178145 | 55178200 | + | ENST00000391736; ENST00000270452; ENST00000430952; ENST00000391734; ENST00000391733; ENST00000434286 | chr19 | 55178294 | 55178458 | + | TSF |
| 1% | chr19 | 38872757 | 38872868 | + | ENST00000215071; ENST00000602911; ENST00000592561; ENST00000592035 | chr19 | 38873037 | 38873046 | + | TSF |
| 1% | chr19 | 38872757 | 38872868 | + | ENST00000215071; ENST00000602911; ENST00000592561; ENST00000592035 | chr19 | 38873037 | 38873046 | + | TSF |
| 1% | chr19 | 38872757 | 38872868 | + | ENST00000215071; ENST00000602911; ENST00000592561; ENST00000592035 | chr19 | 38873037 | 38873046 | + | TSF |
| 1% | chr19 | 38872757 | 38872868 | + | ENST00000215071; ENST00000602911; ENST00000592561; ENST00000592035 | chr19 | 38873037 | 38873046 | + | TSF |
| 1% | chr7 | 87022264 | 87022383 | + | ENST00000419147; ENST00000331536; ENST00000442291 | chr7 | 87025232 | 87025462 | + | TSF |
| 1% | chr7 | 87022264 | 87022383 | + | ENST00000419147; ENST00000331536; ENST00000442291 | chr7 | 87025232 | 87025462 | + | TSF |
| 1% | chr3 | 137906397 137906427 | 137906441 | + | ENST00000469044; ENST00000461600; ENST00000461822; ENST00000470821; ENST00000471709; ENST00000393058; ENST00000538260; ENST00000463485 | chr3 | 137907243 | 137907252 | + | TSF |
| 1% | chr3 | 137906397 137906427 | 137906441 | + | ENST00000469044; ENST00000461600; ENST00000461822; ENST00000470821; ENST00000471709; ENST00000393058; ENST00000538260; ENST00000463485 | chr3 | 137907243 | 137907252 | + | TSF |
| 1% | chr17 | 75277618 | 75277636 | + | ENST00000427177; ENST00000591833; ENST00000591198 | chr17 | 75313547 | 75313852 | + | TSF |
| 1% | chr12 | 69764668 | 69764755 | + | ENST00000247843; ENST00000548020; ENST00000549685 | chr12 | 69791470 | 69791492 | + | TSF |

TABLE 7-continued

Transcript fusion for Bladder Carcinoma (BLCA) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|----|----|
| 1% | chr12 | 69764668 | 69764755 | + | ENST00000247843; ENST00000548020; ENST00000549685 | chr12 | 69791470 | 69791492 | + | TSF |
| 1% | chr12 | 69764668 | 69764755 | + | ENST00000247843; ENST00000548020; ENST00000549685 | chr12 | 69791470 | 69791492 | + | TSF |
| 1% | chr13 | 114157811 | 114157903 | + | ENST00000434316; ENST00000375391 | chr13 | 114159741 | 114159770 | + | TSF |
| 1% | chr9 | 5689959 | 5690038 | + | ENST00000251879; ENST00000414202; ENST00000381532; ENST00000418622; ENST00000449720; ENST00000545641 | chr9 | 5710416 | 5711239 | + | TSF |
| 1% | chr9 | 5689959 | 5690038 | + | ENST00000251879; ENST00000414202; ENST00000381532; ENST00000418622; ENST00000449720; ENST00000545641 | chr9 | 5710416 | 5711239 | + | TSF |
| 1% | chr9 | 5689959 | 5690038 | + | ENST00000251879; ENST00000414202; ENST00000381532; ENST00000418622; ENST00000449720; ENST00000545641 | chr9 | 5710416 | 5711239 | + | TSF |
| 1% | chr12 | 113623819 | 113623826 | + | ENST00000552495 | chr12 | 113623998 | 113624117 | + | TSF |
| 1% | chr7 | 91509397 | 91509369 | − | ENST00000351870; ENST00000442961 | chr7 | 91430582 | 91429696 | − | TSF |
| 1% | chr7 | 81964567 | 81964451 | − | ENST00000356860; ENST00000356253; ENST00000423588 | chr7 | 81929467 | 81929190 | − | TSF |
| 1% | chr11 | 64599981 | 64599900 | − | ENST00000342711 | chr11 | 64599599 | 64599309 | − | TSF |
| 1% | chr7 | 619014 | 618893 | − | ENST00000544935; ENST00000537384; ENST00000406797; ENST00000403562; ENST00000360274; ENST00000400758; ENST00000430040 | chr7 | 618449 | 618307 | − | TSF |
| 1% | chr7 | 619014 | 618893 | − | ENST00000544935; ENST00000537384; ENST00000406797; ENST00000403562; ENST00000360274; ENST00000400758; ENST00000430040 | chr7 | 618449 | 618307 | − | TSF |
| 1% | chr1 | 156236171 | 156235572 | − | ENST00000361813 | chr1 | 156234234 | 156234174 | − | TSF |
| 1% | chr22 | 22280035 | 22279942 | − | ENST00000263212; ENST00000407142; ENST00000538191; ENST00000397495 | chr22 | 22279401 | 22279262 | − | TSF |
| 1% | chr22 | 22280035 | 22279942 | − | ENST00000263212; ENST00000407142; ENST00000538191; ENST00000397495 | chr22 | 22279401 | 22279262 | − | TSF |
| 1% | chr22 | 22280035 | 22279942 | − | ENST00000263212; ENST00000407142; ENST00000538191; ENST00000397495 | chr22 | 22279401 | 22279262 | − | TSF |
| 1% | chr6 | 33271766 | 33271732 | − | ENST00000434618; ENST00000475304; ENST00000489157; ENST00000426633; ENST00000456592 | chr6 | 33267676 | 33267587 | − | TSF |
| 1% | chr6 | 33271766 | 33271732 | − | ENST00000434618; ENST00000475304; ENST00000489157; ENST00000426633; ENST00000456592 | chr6 | 33267676 | 33267587 | − | TSF |
| 1% | chr6 | 33271766 | 33271732 | − | ENST00000434618; ENST00000475304; ENST00000489157; ENST00000426633; ENST00000456592 | chr6 | 33267676 | 33267587 | − | TSF |

TABLE 8

Transcript fusion for Bladder Carcinoma (BLCA) Coordinates of the fusion sequences for which the donor is the TE.

| 1 | 2' | 3' | 4' | 5' | 6' | 7' | 8' | 9' | 10' | 11' |
|---|----|----|----|----|----|----|----|----|-----|-----|
| 51% | chr14 | 24105943 | 24105981 | + | chr14 | 24112361 | 24112428 | + | ENST00000432832; ENST00000250383; ENST00000344777; ENST00000557535; ENST00000553600 | TAF |
| 51% | chr14 | 24105943 | 24105981 | + | chr14 | 24112361 | 24112428 | + | ENST00000432832; ENST00000250383; ENST00000344777; ENST00000557535; ENST00000553600 | TAF |
| 51% | chr14 | 24105943 | 24105981 | + | chr14 | 24112361 | 24112428 | + | ENST00000432832; ENST00000250383; ENST00000344777; ENST00000557535; ENST00000553600 | TAF |
| 51% | chr14 | 24105943 | 24105981 | + | chr14 | 24112361 | 24112428 | + | ENST00000432832; ENST00000250383; ENST00000344777; ENST00000557535; ENST00000553600 | TAF |
| 51% | chr14 | 24105943 | 24105981 | + | chr14 | 24112361 | 24112428 | + | ENST00000432832; ENST00000250383; ENST00000344777; ENST00000557535; ENST00000553600 | TAF |
| 45% | chr17 | 79214190 | 79214239 | + | chr17 | 79214787 | 79214816; 79214953 | + | ENST00000431388; ENST00000576002 | TAF |
| 45% | chr17 | 79214190 | 79214239 | + | chr17 | 79214787 | 79214816; 79214953 | + | ENST00000431388; ENST00000576002 | TAF |

TABLE 8-continued

Transcript fusion for Bladder Carcinoma (BLCA) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 40% | chr14 | 24113093 | 24113155 | + | chr14 | 24113320 | 24113371 | + | ENST00000432832; ENST00000250383; ENST00000344777; ENST00000557535; ENST00000553600 | TAF |
| 40% | chr14 | 24113093 | 24113155 | + | chr14 | 24113320 | 24113371 | + | ENST00000432832; ENST00000250383; ENST00000344777; ENST00000557535; ENST00000553600 | TAF |
| 40% | chr14 | 24113093 | 24113155 | + | chr14 | 24113320 | 24113371 | + | ENST00000432832; ENST00000250383; ENST00000344777; ENST00000557535; ENST00000553600 | TAF |
| 40% | chr14 | 24113093 | 24113155 | + | chr14 | 24113320 | 24113371 | + | ENST00000432832; ENST00000250383; ENST00000344777; ENST00000557535; ENST00000553600 | TAF |
| 40% | chr14 | 24113093 | 24113155 | + | chr14 | 24113320 | 24113371 | + | ENST00000432832; ENST00000250383; ENST00000344777; ENST00000557535; ENST00000553600 | TAF |
| 33% | chr6 | 34966613 | 34966878 | + | chr6 | 34985250 | 34985836 | + | ENST00000360359 | TAF |
| 33% | chr8 | 104389530 | 1043869551 | + | chr8 | 104390255 | 104390471 | + | ENST00000330295; ENST00000520337 | TAF |
| 29% | chr14 | 24105943 | 24105981 | + | chr14 | 24109003 | 24109104 | + | ENST00000432832; ENST00000250383; ENST00000344777; ENST00000557535; ENST00000553600 | TAF |
| 29% | chr14 | 24105943 | 24105981 | + | chr14 | 24109003 | 24109104 | + | ENST00000432832; ENST00000250383; ENST00000344777; ENST00000557535; ENST00000553600 | TAF |
| 29% | chr14 | 24105943 | 24105981 | + | chr14 | 24109003 | 24109104 | + | ENST00000432832; ENST00000250383; ENST00000344777; ENST00000557535; ENST00000553600 | TAF |
| 29% | chr14 | 24105943 | 24105981 | + | chr14 | 24109003 | 24109104 | + | ENST00000432832; ENST00000250383; ENST00000344777; ENST00000557535; ENST00000553600 | TAF |
| 29% | chr14 | 24105943 | 24105981 | + | chr14 | 24109003 | 24109104 | + | ENST00000432832; ENST00000250383; ENST00000344777; ENST00000557535; ENST00000553600 | TAF |
| 29% | chr11 | 93468219 | 93468129 | − | chr11 | 93467826 | 93467791; 93467814 | − | ENST00000393259; ENST00000527169 | TAF |
| 29% | chr11 | 93468219 | 93468129 | − | chr11 | 93467826 | 93467791; 93467814 | − | ENST00000393259; ENST00000527169 | TAF |
| 26% | chr5 | 147210961 | 147210946 | − | chr5 | 147209193 | 147209162 | − | ENST00000296695; ENST00000510027 | TAF |
| 26% | chr5 | 147210961 | 147210946 | − | chr5 | 147209193 | 147209162 | − | ENST00000296695; ENST00000510027 | TAF |
| 24% | chr10 | 124091515 | 124091773 | + | chr10 | 124091951 | 124092028 | + | ENST00000368994; ENST00000260723 | TAF |
| 23% | chr17 | 80440912 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |
| 23% | chr17 | 80440912 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |
| 23% | chr17 | 80440912 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |
| 23% | chr17 | 80440912 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |
| 22% | chr19 | 49121994 | 49121817 | − | chr19 | 49121134 | 49121048 | − | ENST00000549920; ENST00000547897; ENST00000084795; ENST00000550645; ENST00000549370; ENST00000549273 | TAF |
| 22% | chr19 | 49121994 | 49121817 | − | chr19 | 49121134 | 49121048 | − | ENST00000549920; ENST00000547897; ENST00000084795; ENST00000550645; ENST00000549370; ENST00000549273 | TAF |
| 22% | chr19 | 49121994 | 49121817 | − | chr19 | 49121134 | 49121048 | − | ENST00000549920; ENST00000547897; ENST00000084795; ENST00000550645; ENST00000549370; ENST00000549273 | TAF |
| 22% | chr19 | 49121994 | 49121817 | − | chr19 | 49121134 | 49121048 | − | ENST00000549920; ENST00000547897; ENST00000084795; ENST00000550645; ENST00000549370; ENST00000549273 | TAF |
| 22% | chr19 | 49121994 | 49121817 | − | chr19 | 49121134 | 49121048 | − | ENST00000549920; ENST00000547897; ENST00000084795; ENST00000550645; ENST00000549370; ENST00000549273 | TAF |

TABLE 8-continued

Transcript fusion for Bladder Carcinoma (BLCA) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 20% | chr19 | 54631006 | 5463115 | + | chr19 | 54631448 | 54631575 | + | ENST00000321030; ENST00000419967 | TAF |
| 20% | chr19 | 54631006 | 5463115 | + | chr19 | 54631448 | 54631575 | + | ENST00000321030; ENST00000419967 | TAF |
| 19% | chr19 | 55558521 | 55558473 | − | chr19 | 55556677 | 55556442 | − | ENST00000415061; ENST00000396247 | TAF |
| 18% | chr7 | 116364854 | 116364901 | + | chr7 | 116371722 | 116371913 | + | ENST00000397752; ENST00000318493; ENST00000436117 | TAF |
| 18% | chr7 | 116364854 | 116364901 | + | chr7 | 116371722 | 116371913 | + | ENST00000397752; ENST00000318493; ENST00000436117 | TAF |
| 18% | chr7 | 116364854 | 116364901 | + | chr7 | 116371722 | 116371913 | + | ENST00000397752; ENST00000318493; ENST00000436117 | TAF |
| 18% | chr17 | 74261446 | 74261484 | + | chr17 | 74261988 | 74262050 | + | ENST00000327490 | TAF |
| 17% | chr10 | 100147690 | 100147622 | − | chr10 | 100147064 | 100146958 | − | ENST00000370575 | TAF |
| 17% | chr12 | 6602868 | 6602840 | − | chr12 | 6602138 | 6602028 | − | ENST00000229238 | TAF |
| 16% | chr8 | 143751981 | 143751986 | + | chr8 | 143762745 | 143762852; 143762884 | + | ENST00000301258; ENST00000513264 | TAF |
| 16% | chr8 | 143751981 | 143751986 | + | chr8 | 143762745 | 143762852; 143762884 | + | ENST00000301258; ENST00000513264 | TAF |
| 15% | chr5 | 54528691 | 54528595 | − | chr5 | 54528374 | 54528189 | − | ENST00000282572 | TAF |
| 15% | chr12 | 122430912 | 122431615 | + | chr12 | 122437622 | 122437850 | + | ENST00000288912 | TAF |
| 14% | chr11 | 124618894 | 124618862 | − | chr11 | 124618659 | 124618540 | − | ENST00000326621; ENST00000403470 | TAF |
| 14% | chr11 | 124618894 | 124618540 | − | chr11 | 124618659 | 124618540 | − | ENST00000326621; ENST00000403470 | TAF |
| 14% | chr10 | 120902016 | 120901765 | − | chr10 | 120900831 | 120900754 | − | ENST00000355697; ENST00000330036 | TAF |
| 14% | chr13 | 76173531 | 76175706 | + | chr13 | 76178905 | 76178963 | + | ENST00000377595; ENST00000419068 | TAF |
| 14% | chr1 | 169819657 | 169819707 | + | chr1 | 169820958 | 169821077 | + | ENST00000359326; ENST00000286031 | TSF |
| 14% | chr19 | 54104302 | 54104248 | − | chr19 | 54103688 | 54103573 | − | ENST00000600193 | TSF |
| 13% | chr17 | 40820773 | 40820708 | − | chr17 | 40820321 | 40820145 | − | ENST00000591022; ENST00000412503; ENST00000293349 | TAF |
| 13% | chr4 | 48013268 | 48012811 | | chr4 | 47954720 | 47954600 | − | ENST00000402813 | TAF |
| 12% | chr1 | 6380703 | 6380649 | − | chr1 | 6378638 | 6378552 | − | ENST00000608083; ENST00000377842; ENST00000377845; ENST00000377855; ENST00000377860; ENST00000418124; ENST00000545482; ENST00000361521; ENST00000473466; ENST00000541130 | TAF |
| 12% | chr1 | 6380703 | 6380649 | − | chr1 | 6378638 | 6378552 | − | ENST00000608083; ENST00000377842; ENST00000377845; ENST00000377855; ENST00000377860; ENST00000418124; ENST00000545482; ENST00000361521; ENST00000473466; ENST00000541130 | TAF |
| 12% | chr1 | 6380703 | 6380649 | − | chr1 | 6378638 | 6378552 | − | ENST00000608083; ENST00000377842; ENST00000377845; ENST00000377855; ENST00000377860; ENST00000418124; ENST00000545482; ENST00000361521; ENST00000473466; ENST00000541130 | TAF |
| 12% | chr1 | 6380703 | 6380649 | − | chr1 | 6378638 | 6378552 | − | ENST00000608083; ENST00000377842; ENST00000377845; ENST00000377855; ENST00000377860; ENST00000418124; ENST00000545482; ENST00000361521; ENST00000473466; ENST00000541130 | TAF |
| 12% | chr1 | 6380703 | 6380649 | − | chr1 | 6378638 | 6378552 | − | ENST00000608083; ENST00000377842; ENST00000377845; ENST00000377855; ENST00000377860; ENST00000418124; ENST00000545482; ENST00000361521; ENST00000473466; ENST00000541130 | TAF |
| 12% | chr3 | 12440939 | 12440989 | + | chr3 | 12447381 | 12447580 | + | ENST00000397010; ENST00000309576; ENST00000397015; ENST00000397012; ENST00000397026; ENST00000397000; ENST00000539812; ENST00000287820 | TAF |
| 12% | chr3 | 12440939 | 12440989 | + | chr3 | 12447381 | 12447580 | + | ENST00000397010; ENST00000309576; ENST00000397015; ENST00000397012; ENST00000397026; ENST00000397000; ENST00000539812; ENST00000287820 | TAF |
| 12% | chr4 | 107241932 | 107241850 | + | chr4 | 107246142 | 107246275 | + | ENST00000394701 | TAF |
| 12% | chr5 | 1811001 | 1811176 | + | chr5 | 1814453 | 1814575; 1814785 | + | ENST00000274137; ENST00000469176 | TAF |
| 12% | chr5 | 1811001 | 1811176 | + | chr5 | 1814453 | 1814575; 1814785 | + | ENST00000274137; ENST00000469176 | TAF |
| 11% | chr9 | 130569975 | 13050054 | + | chr9 | 130570513 | 130570590; 130570580 | + | ENST00000373247; ENST00000373245; ENST00000393706; ENST00000373228; ENST00000373225; ENST00000431857; ENST00000423577 | TAF |
| 11% | chr9 | 130569975 | 13050054 | + | chr9 | 130570513 | 130570590; 130570580 | + | ENST00000373247; ENST00000373245; ENST00000393706; ENST00000373228; ENST00000373225; ENST00000431857; ENST00000423577 | TAF |

TABLE 8-continued

Transcript fusion for Bladder Carcinoma (BLCA) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 11% | chr9 | 130569975 | 13050054 | + | chr9 | 130570513 | 130570590; 130570580 | + | ENST00000373247; ENST00000373245; ENST00000393706; ENST00000373228; ENST00000373225; ENST00000431857; ENST00000423577 | TAF |
| 11% | chr9 | 130569975 | 13050054 | + | chr9 | 130570513 | 130570590; 130570580 | + | ENST00000373247; ENST00000373245; ENST00000393706; ENST00000373228; ENST00000373225; ENST00000431857; ENST00000423577 | TAF |
| 11% | chr17 | 48164136 | 48164357 | + | chr17 | 48165108 | 48165233 | + | ENST00000320031; ENST00000007722 | TAF |
| 11% | chr17 | 48164136 | 48164357 | + | chr17 | 48165108 | 48165233 | + | ENST00000320031; ENST00000007722 | TAF |
| 11% | chr1 | 31887686 | 31887779 | + | chr1 | 31896540 | 31896701 | + | ENST00000373710; ENST00000536859; ENST00000373709; ENST00000536384 | TAF |
| 11% | chr1 | 86821476 | 86821330 | − | chr1 | 86820542 | 86820457; 86820538 | − | ENST00000359242; ENST00000460698; ENST00000317336; ENST00000370567; ENST00000394731; ENST00000370566; ENST00000462648; ENST00000294678; ENST00000531412 | TAF |
| 11% | chr1 | 86821476 | 86821330 | − | chr1 | 86820542 | 86820457; 86820538 | − | ENST00000359242; ENST00000460698; ENST00000317336; ENST00000370567; ENST00000394731; ENST00000370566; ENST00000462648; ENST00000294678; ENST00000531412 | TAF |
| 11% | chr1 | 86821476 | 86821330 | − | chr1 | 86820542 | 86820457; 86820538 | − | ENST00000359242; ENST00000460698; ENST00000317336; ENST00000370567; ENST00000394731; ENST00000370566; ENST00000462648; ENST00000294678; ENST00000531412 | TAF |
| 11% | chr1 | 86821476 | 86821330 | − | chr1 | 86820542 | 86820457; 86820538 | − | ENST00000359242; ENST00000460698; ENST00000317336; ENST00000370567; ENST00000394731; ENST00000370566; ENST00000462648; ENST00000294678; ENST00000531412 | TAF |
| 11% | chr11 | 19190423 | 19190515 | + | chr11 | 19191958 | 19192115 | + | ENST00000446113; ENST00000399351 | TAF |
| 11% | chr19 | 1114930 | 1114676 | − | chr19 | 1114421 | 1114230 | − | ENST00000361757; ENST00000587024; ENST00000438103 | TSF |
| 9% | chr7 | 56018506 | 56018522 | + | chr7 | 56020872 | 56021011 | + | ENST00000426595 | TSF |
| 9% | chr17 | 70713894 | 70713885 | − | chr17 | 70645407 | 70645309 | − | ENST00000255559; ENST00000542342; ENST00000582769 | TSF |
| 9% | chr17 | 70713894 | 70713885 | − | chr17 | 70645407 | 70645309 | − | ENST00000255559; ENST00000542342; ENST00000582769 | TSF |
| 8% | chr20 | 110606 | 110697 | + | chr20 | 126056 | 126333 | + | ENST00000382398 | TSF |
| 7% | chr1 | 1422590 | 1422685 | + | chr1 | 1423243 | 1423294 | + | ENST00000308647 | TSF |
| 7% | chr2 | 38983894 | 38983253 | − | chr2 | 38977336 | 38977156 | − | ENST00000313117; ENST00000425778; ENST00000425941; ENST00000446327; ENST00000409276; ENST00000431066; ENST00000443213 | TSF |
| 7% | chr2 | 38983894 | 38983253 | − | chr2 | 38977336 | 38977156 | − | ENST00000313117; ENST00000425778; ENST00000425941; ENST00000446327; ENST00000409276; ENST00000431066; ENST00000443213 | TSF |
| 7% | chr2 | 38983894 | 38983253 | − | chr2 | 38977336 | 38977156 | − | ENST00000313117; ENST00000425778; ENST00000425941; ENST00000446327; ENST00000409276; ENST00000431066; ENST00000443213 | TSF |
| 7% | chr2 | 38983894 | 38983253 | − | chr2 | 38977336 | 38977156 | − | ENST00000313117; ENST00000425778; ENST00000425941; ENST00000446327; ENST00000409276; ENST00000431066; ENST00000443213 | TSF |
| 7% | chr2 | 38983894 | 38983253 | − | chr2 | 38977336 | 38977156 | − | ENST00000313117; ENST00000425778; ENST00000425941; ENST00000446327; ENST00000409276; ENST00000431066; | TSF |
| 7% | chr19 | 54105034 | 54105030 | − | chr19 | 54104626 | 54104519 | − | ENST00000600193 | TSF |
| 7% | chr7 | 136953098 | 136953071 | − | chr7 | 136939714 | 136939606 | − | ENST00000348225; ENST00000393083 | TSF |
| 7% | chr7 | 136953098 | 136953071 | − | chr7 | 136939714 | 136939606 | − | ENST00000348225; ENST00000393083 | TSF |
| 6% | chr18 | 43415105 | 43415246 | + | chr18 | 43416994 | 43417053 | + | ENST00000389474 | TSF |
| 6% | chr2 | 143794737 | 143794842 | + | chr2 | 143797997 | 143798227 | + | ENST00000264170; ENST00000409512 | TSF |
| 6% | chr1 | 41465686 | 41465756 | + | chr1 | 41466701 | 41466789 | + | ENST00000372621; ENST00000541520; ENST00000372616 | TSF |
| 5% | chr10 | 124066312 | 124066425 | + | chr10 | 124066704 | 124066823 | + | ENST00000368994; ENST00000260723 | TSF |
| 5% | chr7 | 1477059 | 1476990 | − | chr7 | 1476492 | 1476378 | − | ENST00000405088; ENST00000297508 | TSF |
| 5% | chr19 | 20737134 | 20737096 | − | chr19 | 20736641 | 20736515; 20736611 | − | ENST00000427401; ENST00000597940; ENST00000596797 | TSF |
| 5% | chr19 | 20737134 | 20737096 | − | chr19 | 20736641 | 20736515; 20736611 | − | ENST00000427401; ENST00000597940; ENST00000596797 | TSF |
| 5% | chr19 | 20737134 | 20737096 | − | chr19 | 20736641 | 20736515; 20736611 | − | ENST00000427401; ENST00000597940; ENST00000596797 | TSF |

TABLE 8-continued

Transcript fusion for Bladder Carcinoma (BLCA) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 5% | chr1 | 15562769 | 15563257 | + | chr1 | 15578267 | 15578373 | + | ENST00000433640 | TSF |
| 5% | chr1 | 167832811 | 167833076 | + | chr1 | 167921038 | 167921099 | + | ENST00000367843; ENST00000470721; ENST00000432587; ENST00000312263; ENST00000367840 | TSF |
| 5% | chr1 | 167832811 | 167833076 | + | chr1 | 167921038 | 167921099 | + | ENST00000367843; ENST00000470721; ENST00000432587; ENST00000312263; ENST00000367840 | TSF |
| 5% | chr1 | 167832811 | 167833076 | + | chr1 | 167921038 | 167921099 | + | ENST00000367843; ENST00000470721; ENST00000432587; ENST00000312263; ENST00000367840 | TSF |
| 5% | chr1 | 167832811 | 167833076 | + | chr1 | 167921038 | 167921099 | + | ENST00000367843; ENST00000470721; ENST00000432587; ENST00000312263; ENST00000367840 | TSF |
| 5% | chr1 | 167832811 | 167833076 | + | chr1 | 167921038 | 167921099 | + | ENST00000367843; ENST00000470721; ENST00000432587; ENST00000312263; ENST00000367840 | TSF |
| 5% | chr17 | 40820773 | 40820676 | − | chr17 | 40820321 | 40820145 | − | ENST00000591022; ENST00000412503; ENST00000293349 | TSF |
| 4% | chr8 | 101647768 | 101647627 | − | chr8 | 101642619 | 101642555 | − | ENST00000311812; ENST00000520352; ENST00000520661 | TSF |
| 4% | chr8 | 101647768 | 101647627 | − | chr8 | 101642619 | 101642555 | − | ENST00000311812; ENST00000520352; ENST00000520661 | TSF |
| 4% | chr8 | 101647768 | 101647627 | − | chr8 | 101642619 | 101642555 | − | ENST00000311812; ENST00000520352; ENST00000520661 | TSF |
| 4% | chr12 | 6602868 | 6602754 | − | chr12 | 6602138 | 6602028 | − | ENST00000229238 | TSF |
| 4% | chr12 | 48058419 | 48058373 | − | chr12 | 48057373 | 48057288 | − | ENST00000005386; ENST00000432584; ENST00000380650 | TSF |
| 4% | chr1 | 84740629 | 84740758 | + | chr1 | 84791320 | 84791431 | + | ENST00000370673; ENST00000370671; ENST00000394834; ENST00000370669; ENST00000370668; ENST00000370670 | TSF |
| 4% | chr22 | 29117574 | 29117506 | − | chr22 | 29115473 | 29115383; 29115458 | − | ENST00000348295; ENST00000382566; ENST00000382578; ENST00000404276; ENST00000328354; ENST00000405598; ENST00000382580; ENST00000433728; ENST00000448511; ENST00000402731; ENST00000403642; ENST00000439200 | TSF |
| 4% | chr22 | 29117574 | 29117506 | − | chr22 | 29115473 | 29115383; 29115458 | − | ENST00000348295; ENST00000382566; ENST00000382578; ENST00000404276; ENST00000328354; ENST00000405598; ENST00000382580; ENST00000433728; ENST00000448511; ENST00000402731; ENST00000403642; ENST00000439200 | TSF |
| 4% | chr22 | 29117574 | 29117506 | − | chr22 | 29115473 | 29115383; 29115458 | − | ENST00000348295; ENST00000382566; ENST00000382578; ENST00000404276; ENST00000328354; ENST00000405598; ENST00000382580; ENST00000433728; ENST00000448511; ENST00000402731; ENST00000403642; ENST00000439200 | TSF |
| 4% | chr22 | 29117574 | 29117506 | − | chr22 | 29115473 | 29115383; 29115458 | − | ENST00000348295; ENST00000382566; ENST00000382578; ENST00000404276; ENST00000328354; ENST00000405598; ENST00000382580; ENST00000433728; ENST00000448511; ENST00000402731; ENST00000403642; ENST00000439200 | TSF |
| 4% | chr22 | 29117574 | 29117506 | − | chr22 | 29115473 | 29115383; 29115458 | − | ENST00000348295; ENST00000382566; ENST00000382578; ENST00000404276; ENST00000328354; ENST00000405598; ENST00000382580; ENST00000433728; ENST00000448511; ENST00000402731; ENST00000403642; ENST00000439200 | TSF |
| 4% | chr11 | 60694460 | 60694542 | + | chr11 | 60694676 | 60694890 | + | ENST00000453848; ENST00000005286 | TSF |
| 4% | chr11 | 60694460 | 60694542 | + | chr11 | 60694676 | 60694890 | + | ENST00000453848; ENST00000005286 | TSF |
| 4% | chr14 | 24104836 | 24105801 | + | chr14 | 24112361 | 24112428 | + | ENST00000432832; ENST00000250383; ENST00000344777; ENST00000557535; ENST00000553600 | TSF |
| 4% | chr14 | 24104836 | 24105801 | + | chr14 | 24112361 | 24112428 | + | ENST00000432832; ENST00000250383; ENST00000344777; ENST00000557535; ENST00000553600 | TSF |
| 4% | chr14 | 24104836 | 24105801 | + | chr14 | 24112361 | 24112428 | + | ENST00000432832; ENST00000250383; ENST00000344777; ENST00000557535; ENST00000553600 | TSF |
| 4% | chr14 | 24104836 | 24105801 | + | chr14 | 24112361 | 24112428 | + | ENST00000432832; ENST00000250383; ENST00000344777; ENST00000557535; ENST00000553600 | TSF |

TABLE 8-continued

Transcript fusion for Bladder Carcinoma (BLCA) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 4% | chr14 | 24104836 | 24105801 | + | chr14 | 24112361 | 24112428 | + | ENST00000432832; ENST00000250383; ENST00000344777; ENST00000557535; ENST00000553600 | |
| 4% | chr20 | 43561150 | 43561175 | + | chr20 | 43561713 | 43561826 | + | ENST00000255136; ENST00000217073 | TSF |
| 4% | chr6 | 161637963 | 161637691 | − | chr6 | 161587449 | 161587280; 161587148 | − | ENST00000320285; ENST00000366908; ENST00000436279; ENST00000366905 | TSF |
| 4% | chr6 | 161637963 | 161637691 | − | chr6 | 161587449 | 161587280; 161587148 | − | ENST00000320285; ENST00000366908; ENST00000436279; ENST00000366905 | TSF |
| 4% | chr6 | 161637963 | 161637691 | − | chr6 | 161587449 | 161587280; 161587148 | − | ENST00000320285; ENST00000366908; ENST00000436279; ENST00000366905 | TSF |
| 3% | chr14 | 24105862 | 24105898 | + | chr14 | 24112361 | 24112428 | + | ENST00000432832; ENST00000250383; ENST00000344777; ENST00000557535; ENST00000553600 | TSF |
| 3% | chr14 | 24105862 | 24105898 | + | chr14 | 24112361 | 24112428 | + | ENST00000432832; ENST00000250383; ENST00000344777; ENST00000557535; ENST00000553600 | TSF |
| 3% | chr14 | 24105862 | 24105898 | + | chr14 | 24112361 | 24112428 | + | ENST00000432832; ENST00000250383; ENST00000344777; ENST00000557535; ENST00000553600 | TSF |
| 3% | chr14 | 24105862 | 24105898 | + | chr14 | 24112361 | 24112428 | + | ENST00000432832; ENST00000250383; ENST00000344777; ENST00000557535; ENST00000553600 | TSF |
| 3% | chr14 | 24105862 | 24105898 | + | chr14 | 24112361 | 24112428 | + | ENST00000432832; ENST00000250383; ENST00000344777; ENST00000557535; ENST00000553600 | TSF |
| 3% | chr12 | 58189709 | 58189746 | + | chr12 | 58189960 | 58190366; 58189980; 58190044 | + | ENST00000454289; ENST00000540550; ENST00000323833; ENST00000350762; ENST00000457189 | TSF |
| 3% | chr12 | 58189709 | 58189746 | + | chr12 | 58189960 | 58190366; 58189980; 58190044 | + | ENST00000454289; ENST00000540550; ENST00000323833; ENST00000350762; ENST00000457189 | TSF |
| 3% | chr12 | 58189709 | 58189746 | + | chr12 | 58189960 | 58190366; 58189980; 58190044 | + | ENST00000454289; ENST00000540550; ENST00000323833; ENST00000350762; ENST00000457189 | TSF |
| 3% | chr8 | 74036014 | 74035742 | − | chr8 | 73993448 | 73993254 | − | ENST00000297354 | TSF |
| 3% | chr2 | 242559097 | 242559034 | − | chr2 | 242545888 | 242545729 | − | ENST00000402136; ENST00000407315; ENST00000402545 | TSF |
| 3% | chr2 | 242559097 | 242559034 | − | chr2 | 242545888 | 242545729 | − | ENST00000402136; ENST00000407315; ENST00000402545 | TSF |
| 3% | chr20 | 45337040 | 45337192 | + | chr20 | 45353680 | 45354963 | + | ENST00000359271 | TSF |
| 3% | chr19 | 45289567 | 45289633 | + | chr19 | 45293261 | 45293348 | + | ENST00000270279; ENST00000341505 | TSF |
| 3% | chr3 | 195593372 | 195593261 | − | chr3 | 195591058 | 195591052 | − | ENST00000416152; ENST00000381916; ENST00000333602; ENST00000428187; ENST00000392400 | TSF |
| 3% | chr7 | 100850556 | 100850506 | − | chr7 | 100850185 | 100850060 | − | ENST00000454310; ENST00000223127 | TSF |
| 3% | chr20 | 410407 | 410425 | + | chr20 | 410994 | 411074 | + | ENST00000356286; ENST00000353660; ENST00000382181 | TSF |
| 3% | chr14 | 24105943 | 24105981 | + | chr14 | 24113618 | 24113752; 24113763; 24113704 | + | ENST00000432832; ENST00000250383; ENST00000344777; ENST00000557535; ENST00000553600 | TSF |
| 3% | chr14 | 24105943 | 24105981 | + | chr14 | 24113618 | 24113752; 24113763; 24113704 | + | ENST00000432832; ENST00000250383; ENST00000344777; ENST00000557535; ENST00000553600 | TSF |
| 3% | chr14 | 24105943 | 24105981 | + | chr14 | 24113618 | 24113752; 24113763; 24113704 | + | ENST00000432832; ENST00000250383; ENST00000344777; ENST00000557535; ENST00000553600 | TSF |
| 3% | chr14 | 24105943 | 24105981 | + | chr14 | 24113618 | 24113752; 24113763; 24113704 | + | ENST00000432832; ENST00000250383; ENST00000344777; ENST00000557535; ENST00000553600 | TSF |
| 3% | chr14 | 24105943 | 24105981 | + | chr14 | 24113618 | 24113752; 24113763; 24113704 | + | ENST00000432832; ENST00000250383; ENST00000344777; ENST00000557535; ENST00000553600 | TSF |
| 3% | chr6 | 5498702 | 5498789 | + | chr6 | 5545413 | 5545573 | + | ENST00000324331; ENST00000274680 | TSF |
| 3% | chr4 | 1745002 | 1745264 | + | chr4 | 1746245 | 1746351 | + | ENST00000313288 | TSF |
| 3% | chr10 | 12277215 | 12277329 | + | chr10 | 12279143 | 12279265; 12279223 | + | ENST00000281141; ENST00000442050; ENST00000440613 | TSF |
| 3% | chr10 | 12277215 | 12277329 | + | chr10 | 12279143 | 12279265; 12279223 | + | ENST00000281141; ENST00000442050; ENST00000440613 | TSF |
| 3% | chr10 | 12277215 | 12277329 | + | chr10 | 12279143 | 12279265; 12279223 | + | ENST00000281141; ENST00000442050; ENST00000440613 | TSF |
| 3% | chr14 | 24105943 | 24105955 | + | chr14 | 24112361 | 24112428 | + | ENST00000432832; ENST00000250383; ENST00000344777; ENST00000557535; ENST00000553600 | TSF |

TABLE 8-continued

Transcript fusion for Bladder Carcinoma (BLCA) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 3% | chr14 | 24105943 | 24105955 | + | chr14 | 24112361 | 24112428 | + | ENST00000432832; ENST00000250383; ENST00000344777; ENST00000557535; ENST00000553600 | TSF |
| 3% | chr14 | 24105943 | 24105955 | + | chr14 | 24112361 | 24112428 | + | ENST00000432832; ENST00000250383; ENST00000344777; ENST00000557535; ENST00000553600 | TSF |
| 3% | chr14 | 24105943 | 24105955 | + | chr14 | 24112361 | 24112428 | + | ENST00000432832; ENST00000250383; ENST00000344777; ENST00000557535; ENST00000553600 | TSF |
| 3% | chr14 | 24105943 | 24105955 | + | chr14 | 24112361 | 24112428 | + | ENST00000432832; ENST00000250383; ENST00000344777; ENST00000557535; ENST00000553600 | TSF |
| 3% | chr1 | 23762222 | 23762216 | − | chr1 | 23761111 | 23761026 | − | ENST00000495646; ENST00000336689; ENST00000437606 | TSF |
| 3% | chr18 | 33076776 | 33076739 | − | chr18 | 33060527 | 33060417 | − | ENST00000592173; ENST00000334598; ENST00000441607; ENST00000591139 | TSF |
| 3% | chr18 | 33076776 | 33076739 | − | chr18 | 33060527 | 33060417 | − | ENST00000592173; ENST00000334598; ENST00000441607; ENST00000591139 | TSF |
| 3% | chr18 | 33076776 | 33076739 | − | chr18 | 33060527 | 33060417 | − | ENST00000592173; ENST00000334598; ENST00000441607; ENST00000591139 | TSF |
| 3% | chr1 | 100177044 | 100176911 | − | chr1 | 100176505 | 100176390; 100176362 | − | ENST00000287474; ENST00000414213 | TSF |
| 3% | chr1 | 100177044 | 100176911 | − | chr1 | 100176505 | 100176390; 100176362 | − | ENST00000287474; ENST00000414213 | TSF |
| 3% | chr11 | 67073292 | 67073338 | + | chr11 | 67074309 | 67074433 | + | ENST00000308127; ENST00000308298; ENST00000376757 | TSF |
| 3% | chr11 | 67073292 | 67073338 | + | chr11 | 67074309 | 67074433 | + | ENST00000308127; ENST00000308298; ENST00000376757 | TSF |
| 3% | chr11 | 67073292 | 67073338 | + | chr11 | 67074309 | 67074433 | + | ENST00000308127; ENST00000308298; ENST00000376757 | TSF |
| 3% | chr14 | 24105943 | 24105981 | + | chr14 | 24108127 | 24108213 | + | ENST00000432832; ENST00000250383; ENST00000344777 | TSF |
| 3% | chr14 | 24105943 | 24105981 | + | chr14 | 24108127 | 24108213 | + | ENST00000432832; ENST00000250383; ENST00000344777 | TSF |
| 3% | chr14 | 24105943 | 24105981 | + | chr14 | 24108127 | 24108213 | + | ENST00000432832; ENST00000250383; ENST00000344777 | TSF |
| 3% | chr1 | 246886599 | 246886803 | + | chr1 | 246890194 | 246890306 | + | ENST00000366510 | TSF |
| 3% | chr5 | 76107394 | 76108135 | + | chr5 | 76128515 | 76129626 | + | ENST00000296677 | TSF |
| 3% | chr19 | 55501071 | 55501120 | + | chr19 | 55501390 | 55501560; 55501464 | + | ENST00000543010; ENST00000391721; ENST00000339757; ENST00000448584; ENST00000537859; ENST00000427260; ENST00000538819; ENST00000263437; ENST00000543277 | TSF |
| 3% | chr19 | 55501071 | 55501120 | + | chr19 | 55501390 | 55501560; 55501464 | + | ENST00000543010; ENST00000391721; ENST00000339757; ENST00000448584; ENST00000537859; ENST00000427260; ENST00000538819; ENST00000263437; ENST00000543277 | TSF |
| 3% | chr17 | 39976225 | 39976301 | + | chr17 | 39976521 | 39976713 | + | ENST00000321562; ENST00000455106; ENST00000544340 | TSF |
| 3% | chr17 | 39974832 | 39974893 | + | chr17 | 39975462 | 39975651 | + | ENST00000321562 | TSF |
| 3% | chr19 | 39347374 | 39346430 | − | chr19 | 39338074 | 39337956 | − | ENST00000221419; ENST00000601449; ENST00000600233; ENST00000601813 | TSF |
| 3% | chr19 | 39347374 | 39346430 | − | chr19 | 39338074 | 39337956 | − | ENST00000221419; ENST00000601449; ENST00000600233; ENST00000601813 | TSF |
| 3% | chr19 | 39347374 | 39346430 | − | chr19 | 39338074 | 39337956 | − | ENST00000221419; ENST00000601449; ENST00000600233; ENST00000601813 | TSF |
| 3% | chr19 | 39347374 | 39346206 | − | chr19 | 39338074 | 39337956 | − | ENST00000221419; ENST00000601449; ENST00000600233; ENST00000601813 | TSF |
| 3% | chr19 | 39347374 | 39346206 | − | chr19 | 39338074 | 39337956 | − | ENST00000221419; ENST00000601449; ENST00000600233; ENST00000601813 | TSF |
| 3% | chr19 | 39347374 | 39346206 | − | chr19 | 39338074 | 39337956 | − | ENST00000221419; ENST00000601449; ENST00000600233; ENST00000601813 | TSF |
| 3% | chr9 | 130929922 | 1309298918 | − | chr9 | 130929443 | 130929374 | − | ENST00000372954; ENST00000393608; ENST00000541172; ENST00000325721; ENST00000357558; ENST00000538431; ENST00000277465; ENST00000372948; ENST00000372938; ENST00000415526 | TSF |
| 3% | chr4 | 142977397 | 142977072 | − | chr4 | 142950067 | 142949935 | − | ENST00000513000; ENST00000262992; ENST00000308502; ENST00000508116 | TSF |
| 3% | chrX | 154534914 | 154534773 | − | chrX | 154528458 | 154528349 | − | ENST00000369449; ENST00000321926 | TSF |
| 3% | chrX | 154534914 | 154534773 | − | chrX | 154528458 | 154528349 | − | ENST00000369449; ENST00000321926 | TSF |
| 2% | chr19 | 56811235 | 56811344 | + | chr19 | 56813337 | 56813464 | + | ENST00000588026 | TSF |
| 2% | chr10 | 72621217 | 72622628 | + | chr10 | 72628102 | 72628190 | + | ENST00000373202 | TSF |
| 2% | chr13 | 43670805 | 43671144 | + | chr13 | 43681314 | 43681384 | + | ENST00000379221 | TSF |

TABLE 8-continued

Transcript fusion for Bladder Carcinoma (BLCA) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 2% | chr1 | 111960622 | 111960373 | − | chr1 | 111959080 | 111958945; 111959068 | − | ENST00000369732; ENST00000540696 | TSF |
| 2% | chr1 | 111960622 | 111960373 | − | chr1 | 111959080 | 111958945; 111959068 59068 | − | ENST00000369732; ENST00000540696 | TSF |
| 2% | chr2 | 230769 | 230547 | − | chr2 | 230044 | 229966; 229922 | − | ENST00000403712; ENST00000415006; ENST00000403657; ENST00000405430; ENST00000356150; ENST00000403658; ENST00000451005; ENST00000431160 | TSF |
| 2% | chr2 | 230769 | 230547 | − | chr2 | 230044 | 229966; 229922 | − | ENST00000403712; ENST00000415006; ENST00000403657; ENST00000405430; ENST00000356150; ENST00000403658; ENST00000451005; ENST00000431160 | TSF |
| 2% | chr2 | 230769 | 230547 | − | chr2 | 230044 | 229966; 229922 | − | ENST00000403712; ENST00000415006; ENST00000403657; ENST00000405430; ENST00000356150; ENST00000403658; ENST00000451005; ENST00000431160 | TSF |
| 2% | chr19 | 46194689 | 46194670 | − | chr19 | 46198241 | 46191645 | − | ENST00000342669; ENST00000588301; ENST00000590212 | TSF |
| 2% | chr19 | 46194689 | 46194670 | − | chr19 | 46198241 | 46191645 | − | ENST00000342669; ENST00000588301; ENST00000590212 | TSF |
| 2% | chr6 | 80022917 | 80022085 | − | chr6 | 79924739 | 79924689 | − | ENST00000275036; ENST00000344726 | TSF |
| 2% | chr6 | 80022917 | 80022085 | − | chr6 | 79924739 | 79924689 | − | ENST00000275036; ENST00000344726 | TSF |
| 2% | chr17 | 34221697 | 34221113 | − | chr17 | 34205643 | 34205532 | − | ENST00000293272; ENST00000366113; ENST00000463941 | TSF |
| 2% | chr17 | 34221697 | 34221113 | − | chr17 | 34205643 | 34205532 | − | ENST00000293272; ENST00000366113; ENST00000463941 | TSF |
| 2% | chrX | 154534914 | 154534817 | − | chrX | 154528458 | 154528349 | − | ENST00000369449; ENST00000321926 | TSF |
| 2% | chrX | 154534914 | 154534817 | − | chrX | 154528458 | 154528349 | − | ENST00000369449; ENST00000321926 | TSF |
| 2% | chr11 | 64599672 | 64599483 | − | chr11 | 64599193 | 64598977 | − | ENST00000342711 | TSF |
| 2% | chr19 | 35613389 | 35613502 | + | chr19 | 35613669 | 35613862; 35613743; 35613858 | + | ENST00000406242; ENST00000604404; ENST00000435734; ENST00000603181; ENST00000604255; ENST00000344013; ENST00000346446; ENST00000406988; ENST00000605550; ENST00000604804; ENST00000535103; ENST00000603524; ENST00000604621; ENST00000605677 | TSF |
| 2% | chr19 | 35613389 | 35613502 | + | chr19 | 35613669 | 35613862; 35613743; 35613858 | + | ENST00000406242; ENST00000604404; ENST00000435734; ENST00000603181; ENST00000604255; ENST00000344013; ENST00000346446; ENST00000406988; ENST00000605550; ENST00000604804; ENST00000535103; ENST00000603524; ENST00000604621; ENST00000605677 | TSF |
| 2% | chr19 | 35613389 | 35613502 | + | chr19 | 35613669 | 35613862; 35613743; 35613858 | + | ENST00000406242; ENST00000604404; ENST00000435734; ENST00000603181; ENST00000604255; ENST00000344013; ENST00000346446; ENST00000406988; ENST00000605550; ENST00000604804; ENST00000535103; ENST00000603524; ENST00000604621; ENST00000605677 | TSF |
| 2% | chr19 | 35613389 | 35613502 | + | chr19 | 35613669 | 35613862; 35613743; 35613858 | + | ENST00000406242; ENST00000604404; ENST00000435734; ENST00000603181; ENST00000604255; ENST00000344013; ENST00000346446; ENST00000406988; ENST00000605550; ENST00000604804; ENST00000535103; ENST00000603524; ENST00000604621; ENST00000605677 | TSF |
| 2% | chr11 | 66048968 | 66049045 | + | chr11 | 66049730 | 66049798 66049824 | + | ENST00000528852; ENST00000311445; ENST00000528063 | TSF |
| 2% | chr11 | 66048968 | 66049045 | + | chr11 | 66049730 | 66049798 66049824 | + | ENST00000528852; ENST00000311445; ENST00000528063 | TSF |
| 2% | chr11 | 66048968 | 66049045 | + | chr11 | 66049730 | 66049798 66049824 | + | ENST00000528852; ENST00000311445; ENST00000528063 | TSF |
| 2% | chr4 | 107241932 | 107242046 | + | chr4 | 107246142 | 107246275 | + | ENST00000394701 | TSF |
| 2% | chr22 | 36652278 | 36652346 | + | chr22 | 36653129 | 36653182 | + | ENST00000397278; ENST00000422706; ENST00000319136; ENST00000422471; ENST00000438034; ENST00000427990; ENST00000397279; ENST00000433768; ENST00000440669; ENST00000431184 | TSF |
| 2% | chr22 | 36652278 | 36652346 | + | chr22 | 36653129 | 36653182 | + | ENST00000397278; ENST00000422706; ENST00000319136; ENST00000422471; ENST00000438034; ENST00000427990; ENST00000397279; ENST00000433768; ENST00000440669; ENST00000431184 | TSF |

TABLE 8-continued

Transcript fusion for Bladder Carcinoma (BLCA) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 2% | chr22 | 36652278 | 36652346 | + | chr22 | 36653129 | 36653182 | + | ENST00000397278; ENST00000422706; ENST00000319136; ENST00000422471; ENST00000438034; ENST00000427990; ENST00000397279; ENST00000433768; ENST00000440669; ENST00000431184 | TSF |
| 2% | chr22 | 36652278 | 36652346 | + | chr22 | 36653129 | 36653182 | + | ENST00000397278; ENST00000422706; ENST00000319136; ENST00000422471; ENST00000438034; ENST00000427990; ENST00000397279; ENST00000433768; ENST00000440669; ENST00000431184 | TSF |
| 2% | chr22 | 36652278 | 36652346 | + | chr22 | 36653129 | 36653182 | + | ENST00000397278; ENST00000422706; ENST00000319136; ENST00000422471; ENST00000438034; ENST00000427990; ENST00000397279; ENST00000433768; ENST00000440669; ENST00000431184 | TSF |
| 2% | chr22 | 36652278 | 36652346 | + | chr22 | 36653129 | 36653182 | + | ENST00000397278; ENST00000422706; ENST00000319136; ENST00000422471; ENST00000438034; ENST00000427990; ENST00000397279; ENST00000433768; ENST00000440669; ENST00000431184 | TSF |
| 2% | chr7 | 99779289 | 99779427 | + | chr7 | 99779713 | 99779815 | + | ENST00000426455; ENST00000394018; ENST00000416412; ENST00000317296; ENST00000422690; ENST00000439782 | TSF |
| 2% | chr7 | 99779289 | 99779427 | + | chr7 | 99779713 | 99779815 | + | ENST00000426455; ENST00000394018; ENST00000416412; ENST00000317296; ENST00000422690; ENST00000439782 | TSF |
| 2% | chr7 | 99779289 | 99779427 | + | chr7 | 99779713 | 99779815 | + | ENST00000426455; ENST00000394018; ENST00000416412; ENST00000317296; ENST00000422690; ENST00000439782 | TSF |
| 2% | chr7 | 99779289 | 99779427 | + | chr7 | 99779713 | 99779815 | + | ENST00000426455; ENST00000394018; ENST00000416412; ENST00000317296; ENST00000422690; ENST00000439782 | TSF |
| 2% | chr7 | 99779289 | 99779427 | + | chr7 | 99779713 | 99779815 | + | ENST00000426455; ENST00000394018; ENST00000416412; ENST00000317296; ENST00000422690; ENST00000439782 | TSF |
| 2% | chr9 | 19419482 | 19419707 | + | chr9 | 19423860 | 19423974 | + | ENST00000340967 | TSF |
| 2% | chr1 | 17603989 | 17604315 | + | chr1 | 17606845 | 17606924 | + | ENST00000375460 | TSF |
| 2% | chr20 | 43561150 | 43561175 | + | chr20 | 43564032 | 43564138 | + | ENST00000255136; ENST00000217073; ENST00000372824; ENST00000372819; ENST00000217075; ENST00000479873; ENST00000372826 | TSF |
| 2% | chr20 | 43561150 | 43561175 | + | chr20 | 43564032 | 43564138 | + | ENST00000255136; ENST00000217073; ENST00000372824; ENST00000372819; ENST00000217075; ENST00000479873; ENST00000372826 | TSF |
| 2% | chr20 | 43561150 | 43561175 | + | chr20 | 43564032 | 43564138 | + | ENST00000255136; ENST00000217073; ENST00000372824; ENST00000372819; ENST00000217075; ENST00000479873; ENST00000372826 | TSF |
| 2% | chr20 | 43561150 | 43561175 | + | chr20 | 43564032 | 43564138 | + | ENST00000255136; ENST00000217073; ENST00000372824; ENST00000372819; ENST00000217075; ENST00000479873; ENST00000372826 | TSF |
| 2% | chr20 | 43561150 | 43561175 | + | chr20 | 43564032 | 43564138 | + | ENST00000255136; ENST00000217073; ENST00000372824; ENST00000372819; ENST00000217075; ENST00000479873; ENST00000372826 | TSF |
| 2% | chr19 | 43980514 | 43980487 | − | chr19 | 43979696 | 43979562 | − | ENST00000292140 | TSF |
| 2% | chr21 | 38273278 | 38272892 | − | chr21 | 38269431 | 38269160 | − | ENST00000336648; ENST00000399120 | TSF |
| 2% | chr10 | 5057417 | 5057095 | − | chr10 | 5043873 | 5043706 | − | ENST00000380753; ENST00000421196; ENST00000407674; ENST00000604507; ENST00000455190 | TSF |
| 2% | chr10 | 5057417 | 5057095 | − | chr10 | 5043873 | 5043706 | − | ENST00000380753; ENST00000421196; ENST00000407674; ENST00000604507; ENST00000455190 | TSF |
| 2% | chr10 | 5057417 | 5057095 | − | chr10 | 5043873 | 5043706 | − | ENST00000380753; ENST00000421196; ENST00000407674; ENST00000604507; ENST00000455190 | TSF |
| 2% | chr10 | 5057417 | 5057095 | − | chr10 | 5043873 | 5043706 | − | ENST00000380753; ENST00000421196; ENST00000407674; ENST00000604507; ENST00000455190 | TSF |
| 2% | chr19 | 48654965 | 48654725 | − | chr19 | 48654596 | 48654489 | − | ENST00000263274; ENST00000601091; ENST00000542460 | TSF |
| 2% | chr19 | 48654965 | 48654725 | − | chr19 | 48654596 | 48654489 | − | ENST00000263274; ENST00000601091; ENST00000542460 | TSF |

TABLE 8-continued

Transcript fusion for Bladder Carcinoma (BLCA) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 2% | chr19 | 48654965 | 48654725 | − | chr19 | 48654596 | 48654489 | − | ENST00000263274; ENST00000601091; ENST00000542460 | TSF |
| 2% | chr1 | 246581335 | 246580598 | − | chr1 | 246518396 | 246518333 | − | ENST00000388985; ENST00000403792 | TSF |
| 2% | chr1 | 246581335 | 246580598 | − | chr1 | 246518396 | 246518333 | − | ENST00000388985; ENST00000403792 | TSF |
| 2% | chr7 | 136953098 | 136952826 | − | chr7 | 136939714 | 136939606 | − | ENST00000348225; ENST00000393083 | TSF |
| 2% | chr7 | 136953098 | 136952826 | − | chr7 | 136939714 | 136939606 | − | ENST00000348225; ENST00000393083 | TSF |
| 2% | chr11 | 60663653 | 60661987 | − | chr11 | 60658735 | 60658638 | − | ENST00000227524; ENST00000535326 | TSF |
| 2% | chr7 | 44158417 | 44158351 | − | chr7 | 44157663 | 44157542 | − | ENST00000406581; ENST00000223361; ENST00000452185; ENST00000433715; ENST00000456038; ENST00000418438 | TSF |
| 2% | chr7 | 44158417 | 44158351 | − | chr7 | 44157663 | 44157542 | − | ENST00000406581; ENST00000223361; ENST00000452185; ENST00000433715; ENST00000456038; ENST00000418438 00000418438 | TSF |
| 2% | chr7 | 44158417 | 44158351 | − | chr7 | 44157663 | 44157542 | − | ENST00000406581; ENST00000223361; ENST00000452185; ENST00000433715; ENST00000456038; ENST00000418438 00000418438 | TSF |
| 2% | chr7 | 44158417 | 44158351 | − | chr7 | 44157663 | 44157542 | − | ENST00000406581; ENST00000223361; ENST00000452185; ENST00000433715; ENST00000456038; ENST00000418438 | TSF |
| 2% | chr7 | 44158417 | 44158351 | − | chr7 | 44157663 | 44157542 | − | ENST00000406581; ENST00000223361; ENST00000452185; ENST00000433715; ENST00000456038; ENST00000418438 00000418438 | TSF |
| 2% | chr1 | 44446234 | 44446286 | + | chr1 | 44446781 | 44447145 | + | ENST00000309519 | TSF |
| 2% | chr15 | 69718867 | 69718995 | + | chr15 | 69721450 | 69721552 | + | ENST00000559279; ENST00000395392; ENST00000352331; ENST00000260363; ENST00000558585; ENST00000559283; ENST00000537891 | TSF |
| 2% | chr15 | 69718867 | 69718995 | + | chr15 | 69721450 | 69721552 | + | ENST00000559279; ENST00000395392; ENST00000352331; ENST00000260363; ENST00000558585; ENST00000559283; ENST00000537891 | TSF |
| 2% | chr15 | 69718867 | 69718995 | + | chr15 | 69721450 | 69721552 | + | ENST00000559279; ENST00000395392; ENST00000352331; ENST00000260363; ENST00000558585; ENST00000559283; ENST00000537891 | TSF |
| 2% | chr15 | 69718867 | 69718995 | + | chr15 | 69721450 | 69721552 | + | ENST00000559279; ENST00000395392; ENST00000352331; ENST00000260363; ENST00000558585; ENST00000559283; ENST00000537891 | TSF |
| 2% | chr14 | 56129674 | 56129713 | + | chr14 | 56130673 | 56130759 | + | ENST00000395309; ENST00000413890; ENST00000395314; ENST00000459737; ENST00000395308; ENST00000395311; ENST00000416613; ENST00000555573 | TSF |
| 2% | chr14 | 56129674 | 56129713 | + | chr14 | 56130673 | 56130759 | + | ENST00000395309; ENST00000413890; ENST00000395314; ENST00000459737; ENST00000395308; ENST00000395311; ENST00000416613; ENST00000555573 | TSF |
| 2% | chr1 | 151017459 | 151017509 | + | chr1 | 151018273 | 151018359 | + | ENST00000368931; ENST00000295294; ENST00000361277 | TSF |
| 2% | chr15 | 83092312 | 83092387 | + | chr15 | 83100556 | 83100675 | + | ENST00000561062; ENST00000358583 | TSF |
| 2% | chr15 | 83092312 | 83092387 | + | chr15 | 83100556 | 83100675 | + | ENST00000561062; ENST00000358583 | TSF |
| 2% | chr12 | 42821122 | 42822199 | + | chr12 | 42835117 | 42835311; 42835231 | + | ENST00000549190; ENST00000395580; ENST00000337898; ENST00000358314; ENST00000395568; ENST00000256678; ENST00000449194; ENST00000552761; ENST00000317560; ENST00000432191 | TSF |
| 2% | chr12 | 42821122 | 42822199 | + | chr12 | 42835117 | 42835311; 42835231 | + | ENST00000549190; ENST00000395580; ENST00000337898; ENST00000358314; ENST00000395568; ENST00000256678; ENST00000449194; ENST00000552761; ENST00000317560; ENST00000432191 | TSF |
| 2% | chr12 | 42821122 | 42822199 | + | chr12 | 42835117 | 42835311; 42835231 | + | ENST00000549190; ENST00000395580; ENST00000337898; ENST00000358314; ENST00000395568; ENST00000256678; ENST00000449194; ENST00000552761; ENST00000317560; ENST00000432191 | TSF |
| 2% | chr12 | 42821122 | 42822199 | + | chr12 | 42835117 | 42835311; 42835231 | + | ENST00000549190; ENST00000395580; ENST00000337898; ENST00000358314; ENST00000395568; ENST00000256678; ENST00000449194; ENST00000552761; ENST00000317560; ENST00000432191 | TSF |

TABLE 8-continued

Transcript fusion for Bladder Carcinoma (BLCA) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 2% | chr12 | 42821122 | 42822199 | + | chr12 | 42835117 | 42835311; 42835231 | + | ENST00000549190; ENST00000395580; ENST00000337898; ENST00000358314; ENST00000395568; ENST00000256678; ENST00000449194; ENST00000552761; ENST00000317560; ENST00000432191 | TSF |
| 2% | chr12 | 42821122 | 42822199 | + | chr12 | 42835117 | 42835311; 42835231 | + | ENST00000549190; ENST00000395580; ENST00000337898; ENST00000358314; ENST00000395568; ENST00000256678; ENST00000449194; ENST00000552761; ENST00000317560; ENST00000432191 | TSF |
| 2% | chr1 | 29648112 | 29648148 | + | chr1 | 29649883 | 29650008 | + | ENST00000345512; ENST00000373779; ENST00000323874; ENST00000356870; ENST00000428026; ENST00000460170 | TSF |
| 2% | chr1 | 29648112 | 29648148 | + | chr1 | 29649883 | 29650008 | + | ENST00000345512; ENST00000373779; ENST00000323874; ENST00000356870; ENST00000428026; ENST00000460170 | TSF |
| 2% | chr15 | 82715787 | 82715862 | + | chr15 | 82724031 | 82724150 | + | ENST00000300515 | TSF |
| 2% | chr1 | 150951160 | 150951226 | + | chr1 | 151018273 | 151018359 | + | ENST00000368931; ENST00000295294; ENST00000361277 | TSF |
| 2% | chr16 | 23360523 | 23360640 | + | chr16 | 23364122 | 23364395 | + | ENST00000343070; ENST00000307331; ENST00000564275; ENST00000568085; ENST00000568923 | TSF |
| 2% | chr16 | 23360523 | 23360640 | + | chr16 | 23364122 | 23364395 | + | ENST00000343070; ENST00000307331; ENST00000564275; ENST00000568085; ENST00000568923 | TSF |
| 2% | chr16 | 23360523 | 23360640 | + | chr16 | 23364122 | 23364395 | + | ENST00000343070; ENST00000307331; ENST00000564275; ENST00000568085; ENST00000568923 | TSF |
| 2% | chr16 | 23360523 | 23360640 | + | chr16 | 23364122 | 23364395 | + | ENST00000343070; ENST00000307331; ENST00000564275; ENST00000568085; ENST00000568923 | TSF |
| 2% | chr7 | 96339660 | 96339504 | − | chr7 | 96324203 | 96324110 | − | ENST00000417009; ENST00000444799; ENST00000449279; ENST00000413065; ENST00000248566 | TSF |
| 2% | chr7 | 96339660 | 96339504 | − | chr7 | 96324203 | 96324110 | − | ENST00000417009; ENST00000444799; ENST00000449279; ENST00000413065; ENST00000248566 | TSF |
| 2% | chr7 | 96339660 | 96339504 | − | chr7 | 96324203 | 96324110 | − | ENST00000417009; ENST00000444799; ENST00000449279; ENST00000413065; ENST00000248566 | TSF |
| 2% | chr7 | 96339660 | 96339504 | − | chr7 | 96324203 | 96324110 | − | ENST00000417009; ENST00000444799; ENST00000449279; ENST00000413065; ENST00000248566 | TSF |
| 2% | chr10 | 5060345 | 5060092 | − | chr10 | 5043777 | 5043706 | − | ENST00000380753; ENST00000421196; ENST00000407674; ENST00000604507; ENST00000455190 | TSF |
| 2% | chr10 | 5060345 | 5060092 | − | chr10 | 5043777 | 5043706 | − | ENST00000380753; ENST00000421196; ENST00000407674; ENST00000604507; ENST00000455190 | TSF |
| 2% | chr10 | 5060345 | 5060092 | − | chr10 | 5043777 | 5043706 | − | ENST00000380753; ENST00000421196; ENST00000407674; ENST00000604507; ENST00000455190 | TSF |
| 2% | chr10 | 5060345 | 5060092 | − | chr10 | 5043777 | 5043706 | − | ENST00000380753; ENST00000421196; ENST00000407674; ENST00000604507; ENST00000455190 | TSF |
| 2% | chr12 | 14670381 | 14670239 | − | chr12 | 14664645 | 14664445 | − | ENST00000240617 | TSF |
| 2% | chr1 | 19672366 | 19672295 | − | chr1 | 19671746 | 19671681 | − | ENST00000401084; ENST00000264203; ENST00000375144; ENST00000375142; ENST00000433834; ENST00000264202; ENST00000413711 | TSF |
| 2% | chr1 | 19672366 | 19672295 | − | chr1 | 19671746 | 19671681 | − | ENST00000401084; ENST00000264203; ENST00000375144; ENST00000375142; ENST00000433834; ENST00000264202; ENST00000413711 | TSF |
| 2% | chr1 | 19672366 | 19672295 | − | chr1 | 19671746 | 19671681 | − | ENST00000401084; ENST00000264203; ENST00000375144; ENST00000375142; ENST00000433834; ENST00000264202; ENST00000413711 | TSF |
| 2% | chr1 | 19672366 | 19672295 | − | chr1 | 19671746 | 19671681 | − | ENST00000401084; ENST00000264203; ENST00000375144; ENST00000375142; ENST00000433834; ENST00000264202; ENST00000413711 | TSF |
| 2% | chr18 | 51273 | 49727 | − | chr18 | 49237 | 49129 | − | ENST00000308911 | TSF |
| 2% | chr5 | 52897435; 52897700 | 52897704 | + | chr5 | 52899282 | 52899360 | + | ENST00000502423; ENST00000296684; ENST00000506974; ENST00000506765 | TSF |

TABLE 8-continued

Transcript fusion for Bladder Carcinoma (BLCA) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 2% | chr5 | 52897435; 52897700 | 52897704 | + | chr5 | 52899282 | 52899360 | + | ENST00000502423; ENST00000296684; ENST00000506974; ENST00000506765 | TSF |
| 2% | chr5 | 52897435; 52897700 | 52897704 | + | chr5 | 52899282 | 52899360 | + | ENST00000502423; ENST00000296684; ENST00000506974; ENST00000506765 | TSF |
| 2% | chr5 | 52897435; 52897700 | 52897704 | + | chr5 | 52899282 | 52899360 | + | ENST00000502423; ENST00000296684; ENST00000506974; ENST00000506765 | TSF |
| 2% | chr5 | 52897435; 52897700 | 52897704 | + | chr5 | 52899282 | 52899360 | + | ENST00000502423; ENST00000296684; ENST00000506974; ENST00000506765 | TSF |
| 2% | chr5 | 52897435; 52897700 | 52897704 | + | chr5 | 52899282 | 52899360 | + | ENST00000502423; ENST00000296684; ENST00000506974; ENST00000506765 | TSF |
| 2% | chr5 | 52897435; 52897700 | 52897704 | + | chr5 | 52899282 | 52899360 | + | ENST00000502423; ENST00000296684; ENST00000506974; ENST00000506765 | TSF |
| 2% | chr5 | 52897435; 52897700 | 52897704 | + | chr5 | 52899282 | 52899360 | + | ENST00000502423; ENST00000296684; ENST00000506974; ENST00000506765 | TSF |
| 2% | chr1 | 150914336 | 150914402 | + | chr1 | 151018273 | 151018359 | + | ENST00000368931; ENST00000295294; ENST00000361277 | TSF |
| 2% | chr13 | 43628887 | 43629679 | + | chr13 | 43681314 | 43681384 | + | ENST00000379221 | TSF |
| 2% | chr1 | 110235391 | 110235454 | + | chr1 | 110235828 | 110235917 | + | ENST00000309851; ENST00000369823; ENST00000349334; ENST00000369819 | TSF |
| 2% | chr19 | 50174724 | 50174836 | + | chr19 | 50176955 | 50177005; 50177034 | + | ENST00000441864; ENST00000246785; ENST00000600947; ENST00000598306 | TSF |
| 2% | chr19 | 50174724 | 50174836 | + | chr19 | 50176955 | 50177005; 50177034 | + | ENST00000441864; ENST00000246785; ENST00000600947; ENST00000598306 | TSF |
| 2% | chr12 | 122387836 | 122388242 | + | chr12 | 122389386 | 122389436 | + | ENST00000288912; ENST00000397454 | TSF |
| 2% | chr12 | 122387836 | 122388242 | + | chr12 | 122389386 | 122389436 | + | ENST00000288912; ENST00000397454 | TSF |
| 2% | chr17 | 59480183 | 59480242 | + | chr17 | 59480422 | 59480568 | + | ENST00000240328 | TSF |
| 2% | chr7 | 26677781 | 26678069 | + | chr7 | 26678815 | 26678963 | + | ENST00000409974 | TSF |
| 2% | chr1 | 168348640 | 168349020 | + | chr1 | 168549301 | 168549415 | + | ENST00000367818 | TSF |
| 2% | chr5 | 1475119 | 1475076 | − | chr5 | 1474800 | 1474675 | − | ENST00000475622; ENST00000283415 | TSF |
| 2% | chr19 | 40327657 | 40327534 | − | chr19 | 40327308 | 40327196 | − | ENST00000595545; ENST00000221801; ENST00000597224; ENST00000601274; ENST00000597634 | TSF |
| 2% | chr19 | 40327657 | 40327534 | − | chr19 | 40327308 | 40327196 | − | ENST00000595545; ENST00000221801; ENST00000597224; ENST00000601274; ENST00000597634 | TSF |
| 2% | chr19 | 40327657 | 40327534 | − | chr19 | 40327308 | 40327196 | − | ENST00000595545; ENST00000221801; ENST00000597224; ENST00000601274; ENST00000597634 | TSF |
| 2% | chr19 | 40327657 | 40327534 | − | chr19 | 40327308 | 40327196 | − | ENST00000595545; ENST00000221801; ENST00000597224; ENST00000601274; ENST00000597634 | TSF |
| 2% | chr19 | 40327657 | 40327534 | − | chr19 | 40327308 | 40327196 | − | ENST00000595545; ENST00000221801; ENST00000597224; ENST00000601274; ENST00000597634 | TSF |
| 2% | chr15 | 40187476 | 40186733 | − | chr15 | 40099459 | 40099207 | − | ENST00000561100; ENST00000543580 | TSF |
| 2% | chr8 | 91107662 | 91105645 | − | chr8 | 91094330 | 91094254 | − | ENST00000265431 | TSF |
| 2% | chr19 | 54106196 | 54106162 | − | chr19 | 54105417 | 54105251 | − | ENST00000600193 | TSF |
| 2% | chr6 | 31114486 | 31114237 | − | chr6 | 31113585 | 31113473 | − | ENST00000396268; ENST00000376266; ENST00000451521 | TSF |
| 2% | chr7 | 48039730 | 48039725 | − | chr7 | 48035743 | 48035628 | − | ENST00000453071; ENST00000297325; ENST00000412371; ENST00000412142; ENST00000395572; ENST00000453192; ENST00000438771 | TSF |
| 2% | chr7 | 48039730 | 48039725 | − | chr7 | 48035743 | 48035628 | − | ENST00000453071; ENST00000297325; ENST00000412371; ENST00000412142; ENST00000395572; ENST00000453192; ENST00000438771 | TSF |
| 2% | chr7 | 48039730 | 48039725 | − | chr7 | 48035743 | 48035628 | − | ENST00000453071; ENST00000297325; ENST00000412371; ENST00000412142; ENST00000395572; ENST00000453192; ENST00000438771 | TSF |
| 1% | chr20 | 110606 | 110697 | + | chr20 | 126220 | 126333 | + | ENST00000382398 | TSF |
| 1% | chr1 | 1562829 | 1562926 | + | chr1 | 1563053 | 1563209 | + | ENST00000520777; ENST00000357210; ENST00000360522; ENST00000378710; ENST00000355826; ENST00000518681; ENST00000505820; ENST00000487053; ENST00000378712; ENST00000504599; ENST00000378708; ENST00000514234 | TSF |
| 1% | chr1 | 1562829 | 1562926 | + | chr1 | 1563053 | 1563209 | + | ENST00000520777; ENST00000357210; ENST00000360522; ENST00000378710; ENST00000355826; ENST00000518681; ENST00000505820; ENST00000487053; ENST00000378712; ENST00000504599; ENST00000378708; ENST00000514234 | TSF |

TABLE 8-continued

Transcript fusion for Bladder Carcinoma (BLCA) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 1% | chr1 | 1562829 | 1562926 | + | chr1 | 1563053 | 1563209 | + | ENST00000520777; ENST00000357210; ENST00000360522; ENST00000378710; ENST00000355826; ENST00000518681; ENST00000505820; ENST00000487053; ENST00000378712; ENST00000504599; ENST00000378708; ENST00000514234 | TSF |
| 1% | chr12 | 122430912 | 122432103 | + | chr12 | 122437622 | 122437850 | + | ENST00000288912 | TSF |
| 1% | chr1 | 27158561 | 27158563 | + | chr1 | 27158938 | 27159098 | + | ENST00000374142 | TSF |
| 1% | chr10 | 124064536 | 124064644 | + | chr10 | 124066704 | 124066823 | + | ENST00000368994; ENST00000260723 | TSF |
| 1% | chr14 | 24105943 | 24105981 | + | chr14 | 24113320 | 24113371 | + | ENST00000432832; ENST00000250383; ENST00000344777; ENST00000557535; ENST00000553600 | TSF |
| 1% | chr14 | 24105943 | 24105981 | + | chr14 | 24113320 | 24113371 | + | ENST00000432832; ENST00000250383; ENST00000344777; ENST00000557535; ENST00000553600 | TSF |
| 1% | chr14 | 24105943 | 24105981 | + | chr14 | 24113320 | 24113371 | + | ENST00000432832; ENST00000250383; ENST00000344777; ENST00000557535; ENST00000553600 | TSF |
| 1% | chr14 | 24105943 | 24105981 | + | chr14 | 24113320 | 24113371 | + | ENST00000432832; ENST00000250383; ENST00000344777; ENST00000557535; ENST00000553600 | TSF |
| 1% | chr14 | 24105943 | 24105981 | + | chr14 | 24113320 | 24113371 | + | ENST00000432832; ENST00000250383; ENST00000344777; ENST00000557535; ENST00000553600 | TSF |
| 1% | chr12 | 122430912 | 122431795 | + | chr12 | 122437622 | 122437850 | + | ENST00000288912 | TSF |
| 1% | chr5 | 66178759 | 66179020 | + | chr5 | 66195779 | 66195810 | + | ENST00000404260; ENST00000403625; ENST00000406374; ENST00000406039; ENST00000452953; ENST00000432817; ENST00000434115; ENST00000411628; ENST00000490016; ENST00000403666; ENST00000450827 | TSF |
| 1% | chr5 | 66178759 | 66179020 | + | chr5 | 66195779 | 66195810 | + | ENST00000404260; ENST00000403625; ENST00000406374; ENST00000406039; ENST00000452953; ENST00000432817; ENST00000434115; ENST00000411628; ENST00000490016; ENST00000403666; ENST00000450827 | TSF |
| 1% | chr5 | 66178759 | 66179020 | + | chr5 | 66195779 | 66195810 | + | ENST00000404260; ENST00000403625; ENST00000406374; ENST00000406039; ENST00000452953; ENST00000432817; ENST00000434115; ENST00000411628; ENST00000490016; ENST00000403666; ENST00000450827 | TSF |
| 1% | chr5 | 66178759 | 66179020 | + | chr5 | 66195779 | 66195810 | + | ENST00000404260; ENST00000403625; ENST00000406374; ENST00000406039; ENST00000452953; ENST00000432817; ENST00000434115; ENST00000411628; ENST00000490016; ENST00000403666; ENST00000450827 | TSF |
| 1% | chr5 | 66178759 | 66179020 | + | chr5 | 66195779 | 66195810 | + | ENST00000404260; ENST00000403625; ENST00000406374; ENST00000406039; ENST00000452953; ENST00000432817; ENST00000434115; ENST00000411628; ENST00000490016; ENST00000403666; ENST00000450827 | TSF |
| 1% | chr5 | 66178759 | 66179020 | + | chr5 | 66195779 | 66195810 | + | ENST00000404260; ENST00000403625; ENST00000406374; ENST00000406039; ENST00000452953; ENST00000432817; ENST00000434115; ENST00000411628; ENST00000490016; ENST00000403666; ENST00000450827 | TSF |
| 1% | chr5 | 66178759 | 66179020 | + | chr5 | 66195779 | 66195810 | + | ENST00000404260; ENST00000403625; ENST00000406374; ENST00000406039; ENST00000452953; ENST00000432817; ENST00000434115; ENST00000411628; ENST00000490016; ENST00000403666; ENST00000450827 | TSF |
| 1% | chr5 | 66178759 | 66179020 | + | chr5 | 66195779 | 66195810 | + | ENST00000404260; ENST00000403625; ENST00000406374; ENST00000406039; | TSF |

TABLE 8-continued

Transcript fusion for Bladder Carcinoma (BLCA) Coordinates of the fusion sequences for which the donor is the TE.

| 1 | 2' | 3' | 4' | 5' | 6' | 7' | 8' | 9' | 10' | 11' |
|---|----|-----|-----|---|----|-----|-----|---|-----|-----|
| 1% | chr5 | 66178759 | 66179020 | + | chr5 | 66195779 | 66195810 | + | ENST00000452953; ENST00000432817; ENST00000434115; ENST00000411628; ENST00000490016; ENST00000403666; ENST00000450827 ENST00000404260; ENST00000403625; ENST00000406374; ENST00000406039; ENST00000452953; ENST00000432817; ENST00000434115; ENST00000411628; ENST00000490016; ENST00000403666; ENST00000450827 | TSF |
| 1% | chr1 | 1562829 | 1562875 | + | chr1 | 1563053 | 1563209 | + | ENST00000520777; ENST00000357210; ENST00000360522; ENST00000378710; ENST00000355826; ENST00000518681; ENST00000505820; ENST00000487053; ENST00000378712; ENST00000504599; ENST00000378708; ENST00000514234 | TSF |
| 1% | chr1 | 1562829 | 1562875 | + | chr1 | 1563053 | 1563209 | + | ENST00000520777; ENST00000357210; ENST00000360522; ENST00000378710; ENST00000355826; ENST00000518681; ENST00000505820; ENST00000487053; ENST00000378712; ENST00000504599; ENST00000378708; ENST00000514234 | TSF |
| 1% | chr1 | 1562829 | 1562875 | + | chr1 | 1563053 | 1563209 | + | ENST00000520777; ENST00000357210; ENST00000360522; ENST00000378710; ENST00000355826; ENST00000518681; ENST00000505820; ENST00000487053; ENST00000378712; ENST00000504599; ENST00000378708; ENST00000514234 | TSF |
| 1% | chr9 | 90301842 | 90301883 | + | chr9 | 90311922 | 90312119 | + | ENST00000358077; ENST00000472284; ENST00000469640; ENST00000408954 | TSF |
| 1% | chr9 | 90301842 | 90301883 | + | chr9 | 90311922 | 90312119 | + | ENST00000358077; ENST00000472284; ENST00000469640; ENST00000408954 0408954 | TSF |
| 1% | chr2 | 150044073 | 150044093 | + | chr2 | 150061767 | 150061918 | + | ENST00000409642; ENST00000409876; ENST00000409029; ENST00000442722; ENST00000280115 | TSF |
| 1% | chr2 | 150044073 | 150044093 | + | chr2 | 150061767 | 150061918 | + | ENST00000409642; ENST00000409876; ENST00000409029; ENST00000442722; ENST00000280115 | TSF |
| 1% | chr8 | 104389530 | 104389536 | + | chr8 | 104390255 | 104390471 | + | ENST00000330295; ENST00000520337 | TSF |
| 1% | chr3 | 184083167 | 184083362 | + | chr3 | 184084505 | 184084588 | + | ENST00000456318; ENST00000438240; ENST00000455712; ENST00000452961; ENST00000296223; ENST00000429568 | TSF |
| 1% | chr3 | 184083167 | 184083362 | + | chr3 | 184084505 | 184084588 | + | ENST00000456318; ENST00000438240; ENST00000455712; ENST00000452961; ENST00000296223; ENST00000429568 | TSF |
| 1% | chr3 | 184083167 | 184083362 | + | chr3 | 184084505 | 184084588 | + | ENST00000456318; ENST00000438240; ENST00000455712; ENST00000452961; ENST00000296223; ENST00000429568 | TSF |
| 1% | chr17 | 49346367 | 49346514 | + | chr17 | 49350723 | 49350811 | + | ENST00000225298 | TSF |
| 1% | chr21 | 45165597 | 45165696 | + | chr21 | 45165960 | 45166006 | + | ENST00000468090; ENST00000291565; ENST00000467908 | TSF |
| 1% | chr19 | 55449720 | 55449717 | − | chr19 | 55449609 | 55449412 | − | ENST00000340844; ENST00000590030; ENST00000446217; ENST00000588756; ENST00000586379; ENST00000592784 | TSF |
| 1% | chr19 | 55449720 | 55449717 | − | chr19 | 55449609 | 55449412 | − | ENST00000340844; ENST00000590030; ENST00000446217; ENST00000588756; ENST00000586379; ENST00000592784 | TSF |
| 1% | chr19 | 55449720 | 55449717 | − | chr19 | 55449609 | 55449412 | − | ENST00000340844; ENST00000590030; ENST00000446217; ENST00000588756; ENST00000586379; ENST00000592784 | TSF |
| 1% | chr20 | 45138455 | 45138244 | − | chr20 | 45133379 | 45133253 | − | ENST00000593880; ENST00000347606 | TSF |
| 1% | chr20 | 45138455 | 45138244 | − | chr20 | 45133379 | 45133253 | − | ENST00000593880; ENST00000347606 | TSF |
| 1% | chr8 | 63949410 | 63948932 | − | chr8 | 63948329 | 63948215 | − | ENST00000260118 | TSF |
| 1% | chr3 | 9823188 | 9823088 | − | chr3 | 9822233 | 9822041 | − | ENST00000301964; ENST00000440161 | TSF |
| 1% | chr12 | 120566093 | 120566088 | − | chr12 | 120565778 | 120565653 | − | ENST00000300648 | TSF |
| 1% | chr12 | 54862718 | 54862609 | − | chr12 | 54858951 | 54858851 | − | ENST00000546931; ENST00000552397; ENST00000305879 | TSF |
| 1% | chr12 | 54862718 | 54862609 | − | chr12 | 54858951 | 54858851 | − | ENST00000546931; ENST00000552397; ENST00000305879 | TSF |
| 1% | chr4 | 873272 | 873014 | − | chr4 | 871597 | 871403 | − | ENST00000314167; ENST00000511163 | TSF |
| 1% | chr2 | 43616365 | 43616285 | − | chr2 | 43571376 | 43571261 | − | ENST00000405975; ENST00000415080; ENST00000407351; ENST00000405006 | TSF |

TABLE 8-continued

Transcript fusion for Bladder Carcinoma (BLCA) Coordinates of the fusion sequences for which the donor is the TE.

| 1  | 2'   | 3'        | 4'        | 5' | 6'   | 7'        | 8'        | 9' | 10'                              | 11' |
|----|------|-----------|-----------|----|------|-----------|-----------|----|----------------------------------|-----|
| 1% | chr9 | 132512208 | 132512163 | –  | chr9 | 132511016 | 132510934 | –  | ENST00000340607                  | TSF |
| 1% | chr1 | 8924664   | 8924519   | –  | chr1 | 8924151   | 8923950   | –  | ENST00000234590                  | TSF |
| 1% | chrX | 76851229  | 76851182  | –  | chrX | 76849319  | 76849166  | –  | ENST00000373344; ENST00000395603 | TSF |

TABLE 9

Transcript fusion for Breast Invasive Carcinoma (BRCA) Coordinates of the fusion sequences for which the donor is the Exon.

| 1   | 2     | 3                    | 4         | 5 | 6                                                                                                       | 7     | 8         | 9         | 10 | 11  |
|-----|-------|----------------------|-----------|---|---------------------------------------------------------------------------------------------------------|-------|-----------|-----------|----|-----|
| 39% | chr10 | 22171368             | 22171211  | – | ENST00000376980                                                                                         | chr10 | 22168812  | 22168560  | –  | TAF |
| 38% | chr6  | 152382126            | 152382259 | + | ENST00000440973; ENST00000338799; ENST00000456483; ENST00000443427; ENST00000206249; ENST00000406599; ENST00000427531 | chr6  | 152399927 | 152404932 | +  | TAF |
| 38% | chr6  | 152382126            | 152382259 | + | ENST00000440973; ENST00000338799; ENST00000456483; ENST00000443427; ENST00000206249; ENST00000406599; ENST00000427531 | chr6  | 152399927 | 152404932 | +  | TAF |
| 38% | chr6  | 152382126            | 152382259 | + | ENST00000440973; ENST00000338799; ENST00000456483; ENST00000443427; ENST00000206249; ENST00000406599; ENST00000427531 | chr6  | 152399927 | 152404932 | +  | TAF |
| 38% | chr6  | 152382126            | 152382259 | + | ENST00000440973; ENST00000338799; ENST00000456483; ENST00000443427; ENST00000206249; ENST00000406599; ENST00000427531 | chr6  | 152399927 | 152404932 | +  | TAF |
| 18% | chr3  | 4927450              | 4927407   | – | ENST00000449914; ENST00000441894                                                                        | chr3  | 4898429   | 4898242   | –  | TSF |
| 16% | chr10 | 37490163             | 37490253  | + | ENST00000361713; ENST00000374660; ENST00000602533                                                       | chr10 | 37494228  | 37494539  | +  | TAF |
| 16% | chr10 | 37490163             | 37490253  | + | ENST00000361713; ENST00000374660; ENST00000602533                                                       | chr10 | 37494228  | 37494539  | +  | TAF |
| 15% | chr10 | 17432619             | 17432530  | – | ENST00000377602                                                                                         | chr10 | 17428932  | 17428606  | –  | TAF |
| 15% | chr17 | 40821538; 40821639   | 40821448  | – | ENST00000412503; ENST00000591022; ENST00000293349                                                       | chr17 | 40820920  | 40820864  | –  | TAF |
| 15% | chr17 | 40821538; 40821639   | 40821448  | – | ENST00000412503; ENST00000591022; ENST00000293349                                                       | chr17 | 40820920  | 40820864  | –  | TAF |
| 15% | chr17 | 40821538; 40821639   | 40821448  | – | ENST00000412503; ENST00000591022; ENST00000293349                                                       | chr17 | 40820920  | 40820864  | –  | TAF |
| 13% | chr1  | 47571800             | 47571933  | + | ENST00000334194                                                                                         | chr1  | 47579327  | 47581130  | +  | TAF |
| 13% | chrX  | 117900807            | 117900939 | + | ENST00000371666                                                                                         | chrX  | 117938895 | 117939267 | +  | TAF |
| 13% | chr1  | 180366740            | 180366651 | – | ENST00000367595                                                                                         | chr1  | 180295697 | 180293314 | –  | TAF |
| 13% | chr2  | 220239744            | 220239577 | – | ENST00000273075; ENST00000373972; ENST00000523282                                                       | chr2  | 220227530 | 220227195 | –  | TAF |
| 13% | chr2  | 220239744            | 220239577 | – | ENST00000273075; ENST00000373972; ENST00000523282                                                       | chr2  | 220227530 | 220227195 | –  | TAF |
| 13% | chr2  | 220239744            | 220239577 | – | ENST00000273075; ENST00000373972; ENST00000523282                                                       | chr2  | 220227530 | 220227195 | –  | TAF |
| 11% | chr14 | 51355542             | 51355621  | + | ENST00000337334; ENST00000353130; ENST00000395752                                                       | chr14 | 51359931  | 51360328  | +  | TAF |
| 11% | chr14 | 51355542             | 51355621  | + | ENST00000337334; ENST00000353130; ENST00000395752                                                       | chr14 | 51359931  | 51360328  | +  | TAF |
| 11% | chr14 | 51355542             | 51355621  | + | ENST00000337334; ENST00000353130; ENST00000395752                                                       | chr14 | 51359931  | 51360328  | +  | TAF |
| 11% | chr6  | 151742456            | 151742380 | – | ENST00000336451; ENST00000367303; ENST00000444024                                                       | chr6  | 151739714 | 151739579 | –  | TSF |
| 11% | chr6  | 151742456            | 151742380 | – | ENST00000336451; ENST00000367303; ENST00000444024                                                       | chr6  | 151739714 | 151739579 | –  | TSF |
| 11% | chr6  | 151742456            | 151742380 | – | ENST00000336451; ENST00000367303; ENST00000444024                                                       | chr6  | 151739714 | 151739579 | –  | TSF |
| 9%  | chr3  | 4872702              | 4872631   | – | ENST00000449914; ENST00000441894                                                                        | chr3  | 4871958   | 4871639   | –  | TSF |
| 7%  | chr1  | 225156461            | 225156576 | + | ENST00000430092; ENST00000400952; ENST00000366849; ENST00000439375                                      | chr1  | 225157336 | 225158402 | +  | TSF |
| 7%  | chr1  | 225156461            | 225156576 | + | ENST00000430092; ENST00000400952; ENST00000366849; ENST00000439375                                      | chr1  | 225157336 | 225158402 | +  | TSF |
| 7%  | chr4  | 57319769             | 57319927  | + | ENST00000514888; ENST00000264221; ENST00000505164; ENST00000399688; ENST00000512576                     | chr4  | 57321183  | 57321327  | +  | TSF |
| 7%  | chr4  | 57319769             | 57319927  | + | ENST00000514888; ENST00000264221; ENST00000505164; ENST00000399688; ENST00000512576                     | chr4  | 57321183  | 57321327  | +  | TSF |

TABLE 9-continued

Transcript fusion for Breast Invasive Carcinoma (BRCA) Coordinates of the fusion sequences for which the donor is the Exon.

| 1 | 2 | 3 | 4 | 5 | 6 | 7 | 8 | 9 | 10 | 11 |
|---|---|---|---|---|---|---|---|---|---|---|
| 7% | chr4 | 57319769 | 57319927 | + | ENST00000514888; ENST00000264221; ENST00000505164; ENST00000399688; ENST00000512576 | chr4 | 57321183 | 57321327 | + | TSF |
| 6% | chr1 | 227842037 | 227843464 | + | ENST00000397097; ENST00000343776 | chr1 | 227864880 | 227866572 | + | TSF |
| 6% | chr1 | 227842037 | 227843464 | + | ENST00000397097; ENST00000343776 | chr1 | 227864880 | 227866572 | + | TSF |
| 6% | chr19 | 58320471 | 58320401 | − | ENST00000391701 | chr19 | 58315432 | 58315298 | − | TSF |
| 5% | chr1 | 180283857 | 180283827 | − | ENST00000367595 | chr1 | 180281457 | 180281103 | − | TSF |
| 5% | chr20 | 41306799 | 41306506 | − | ENST00000356100; ENST00000373184; ENST00000373187; ENST00000373190; ENST00000373193; ENST00000373198; ENST00000373201 | chr20 | 41225908 | 41225560 | − | TSF |
| 5% | chr12 | 113403549; 113403702 | 113403834 | + | ENST00000228928; ENST00000546973 | chr12 | 113404028 | 113404051 | + | TSF |
| 5% | chr12 | 113403549; 113403702 | 113403834 | + | ENST00000228928; ENST00000546973 | chr12 | 113404028 | 113404051 | + | TSF |
| 5% | chr8 | 117950483 | 117950806 | + | ENST00000378279 | chr8 | 117960753 | 117961020 | + | TSF |
| 4% | chr11 | 60701014 | 60701216 | + | ENST00000453848; ENST00000005286; ENST00000536409 | chr11 | 60701443 | 60701575 | + | TSF |
| 4% | chr11 | 60701014 | 60701216 | + | ENST00000453848; ENST00000005286; ENST00000536409 | chr11 | 60701443 | 60701575 | + | TSF |
| 4% | chr11 | 60701014 | 60701216 | + | ENST00000453848; ENST00000005286; ENST00000536409 | chr11 | 60701443 | 60701575 | + | TSF |
| 4% | chr2 | 142238102 | 142237965 | − | ENST00000389484 | chr2 | 142187372 | 142187047 | − | TSF |
| 3% | chr20 | 49458303 | 49458437 | + | ENST00000358791; ENST00000371608; ENST00000609336 | chr20 | 49468479 | 49468517 | + | TSF |
| 3% | chr20 | 49458303 | 49458437 | + | ENST00000358791; ENST00000371608; ENST00000609336 | chr20 | 49468479 | 49468517 | + | TSF |
| 3% | chr7 | 16900207 | 16900124 | − | ENST00000402239; ENST00000310398; ENST00000414935 | chr7 | 16894536 | 16894260 | − | TSF |
| 3% | chr7 | 16900207 | 16900124 | − | ENST00000402239; ENST00000310398; ENST00000414935 | chr7 | 16894536 | 16894260 | − | TSF |
| 3% | chr13 | 111315865 | 111315798 | − | ENST00000257347; ENST00000487253; ENST00000537743 | chr13 | 111312615 | 111311877 | − | TSF |
| 3% | chr13 | 111315865 | 111315798 | − | ENST00000257347; ENST00000487253; ENST00000537743 | chr13 | 111312615 | 111311877 | − | TSF |
| 3% | chr13 | 111315865 | 111315798 | − | ENST00000257347; ENST00000487253; ENST00000537743 | chr13 | 111312615 | 111311877 | − | TSF |
| 3% | chr5 | 70858101 | 70858347 | + | ENST00000358731; ENST00000525844 | chr5 | 70868141 | 70868205 | + | TSF |
| 3% | chr5 | 70858101 | 70858347 | + | ENST00000358731; ENST00000525844 | chr5 | 70868141 | 70868205 | + | TSF |
| 3% | chr8 | 42924698; 42924750 | 42924802 | + | ENST00000534420; ENST00000302279; ENST00000533998; ENST00000342116; ENST00000531266; ENST00000533336; ENST00000525699; ENST00000529687 | chr8 | 42925245 | 42925476 | + | TSF |
| 3% | chr8 | 42924698; 42924750 | 42924802 | + | ENST00000534420; ENST00000302279; ENST00000533998; ENST00000342116; ENST00000531266; ENST00000533336; ENST00000525699; ENST00000529687 | chr8 | 42925245 | 42925476 | + | TSF |
| 3% | chr8 | 42924698; 42924750 | 42924802 | + | ENST00000534420; ENST00000302279; ENST00000533998; ENST00000342116; ENST00000531266; ENST00000533336; ENST00000525699; ENST00000529687 | chr8 | 42925245 | 42925476 | + | TSF |
| 3% | chr8 | 42924698; 42924750 | 42924802 | + | ENST00000534420; ENST00000302279; ENST00000533998; ENST00000342116; ENST00000531266; ENST00000533336; ENST00000525699; ENST00000529687 | chr8 | 42925245 | 42925476 | + | TSF |
| 3% | chr8 | 42924698; 42924750 | 42924802 | + | ENST00000534420; ENST00000302279; ENST00000533998; ENST00000342116; ENST00000531266; ENST00000533336; ENST00000525699; ENST00000529687 | chr8 | 42925245 | 42925476 | + | TSF |
| 3% | chr8 | 42924698; 42924750 | 42924802 | + | ENST00000534420; ENST00000302279; ENST00000533998; ENST00000342116; ENST00000531266; ENST00000533336; ENST00000525699; ENST00000529687 | chr8 | 42925245 | 42925476 | + | TSF |
| 3% | chr6 | 152201790; 152201792 | 152201906 | + | ENST00000440973; ENST00000338799; ENST00000456483; ENST00000443427; ENST00000206249; ENST00000427531; ENST00000415488 | chr6 | 152261821 | 152262024 | + | TSF |

TABLE 9-continued

Transcript fusion for Breast Invasive Carcinoma (BRCA) Coordinates of the fusion sequences for which the donor is the Exon.

| 1 | 2 | 3 | 4 | 5 | 6 | 7 | 8 | 9 | 10 | 11 |
|---|---|---|---|---|---|---|---|---|---|---|
| 3% | chr6 | 152201790; 152201792 | 152201906 | + | ENST00000440973; ENST00000338799; ENST00000456483; ENST00000443427; ENST00000206249; ENST00000427531; ENST00000415488 | chr6 | 152261821 | 152262024 | + | TSF |
| 3% | chr6 | 152201790; 152201792 | 152201906 | + | ENST00000440973; ENST00000338799; ENST00000456483; ENST00000443427; ENST00000206249; ENST00000427531; ENST00000415488 | chr6 | 152261821 | 152262024 | + | TSF |
| 3% | chr10 | 116020945 | 116021054 | + | ENST00000603594; ENST00000392982 | chr10 | 116030863 | 116030985 | + | TSF |
| 3% | chr16 | 16381600 | 16381719 | + | ENST00000399336; ENST00000263012; ENST00000538468 | chr16 | 16382422 | 16382605 | + | TSF |
| 3% | chr16 | 16381600 | 16381719 | + | ENST00000399336; ENST00000263012; ENST00000538468 | chr16 | 16382422 | 16382605 | + | TSF |
| 3% | chr3 | 148563211 | 148563413 | + | ENST00000491148; ENST00000282957 | chr3 | 148570090 | 148570266 | + | TSF |
| 3% | chr1 | 117712793 | 117712729 | − | ENST00000359008; ENST00000328189; ENST00000369458 | chr1 | 117699971 | 117699928 | − | TSF |
| 3% | chr1 | 117712793 | 117712729 | − | ENST00000359008; ENST00000328189; ENST00000369458 | chr1 | 117699971 | 117699928 | − | TSF |
| 3% | chr8 | 126194345 | 126194498 | + | ENST00000523741; ENST00000517532; ENST00000287437; ENST00000522563; ENST00000517315 | chr8 | 126207297 | 126207395 | + | TSF |
| 3% | chr8 | 126194345 | 126194498 | + | ENST00000523741; ENST00000517532; ENST00000287437; ENST00000522563; ENST00000517315 | chr8 | 126207297 | 126207395 | + | TSF |
| 2% | chr20 | 29632611 | 29632721 | + | ENST00000278882; ENST00000358464 | chr20 | 29652086 | 29652324 | + | TSF |
| 2% | chr10 | 19571948 | 19572110 | + | ENST00000377266; ENST00000454679 | chr10 | 19575490 | 19575970 | + | TSF |
| 2% | chr10 | 19571948 | 19572110 | + | ENST00000377266; ENST00000454679 | chr10 | 19575490 | 19575970 | + | TSF |
| 2% | chr12 | 102547647 | 102547754 | + | ENST00000327680; ENST00000378128; ENST00000541394; ENST00000358383; ENST00000392911; ENST00000412715; ENST00000417507; ENST00000457614 | chr12 | 102548605 | 102548938 | + | TSF |
| 2% | chr12 | 102547647 | 102547754 | + | ENST00000327680; ENST00000378128; ENST00000541394; ENST00000358383; ENST00000392911; ENST00000412715; ENST00000417507; ENST00000457614 | chr12 | 102548605 | 102548938 | + | TSF |
| 2% | chr12 | 102547647 | 102547754 | + | ENST00000327680; ENST00000378128; ENST00000541394; ENST00000358383; ENST00000392911; ENST00000412715; ENST00000417507; ENST00000457614 | chr12 | 102548605 | 102548938 | + | TSF |
| 2% | chr12 | 102547647 | 102547754 | + | ENST00000327680; ENST00000378128; ENST00000541394; ENST00000358383; ENST00000392911; ENST00000412715; ENST00000417507; ENST00000457614 | chr12 | 102548605 | 102548938 | + | TSF |
| 2% | chr12 | 102547647 | 102547754 | + | ENST00000327680; ENST00000378128; ENST00000541394; ENST00000358383; ENST00000392911; ENST00000412715; ENST00000417507; ENST00000457614 | chr12 | 102548605 | 102548938 | + | TSF |
| 2% | chr8 | 52287291 | 52287157 | − | ENST00000522628; ENST00000356297; ENST00000543296 | chr8 | 52286772 | 52286772 | − | TSF |
| 2% | chr8 | 52287291 | 52287157 | − | ENST00000522628; ENST00000356297; ENST00000543296 | chr8 | 52286772 | 52286772 | − | TSF |
| 2% | chr10 | 75555297 | 75555421 | + | ENST00000604729; ENST00000603114; ENST00000604524; ENST00000398706; ENST00000605216; ENST00000433366; ENST00000492395; ENST00000603187; ENST00000412198; ENST00000604754 | chr10 | 75556079 | 75556138 | + | TSF |
| 2% | chr10 | 75555297 | 75555421 | + | ENST00000604729; ENST00000603114; ENST00000604524; ENST00000398706; ENST00000605216; ENST00000433366; ENST00000492395; ENST00000603187; ENST00000412198; ENST00000604754 | chr10 | 75556079 | 75556138 | + | TSF |
| 2% | chr10 | 75555297 | 75555421 | + | ENST00000604729; ENST00000603114; ENST00000604524; ENST00000398706; ENST00000605216; ENST00000433366; ENST00000492395; ENST00000603187; ENST00000412198; ENST00000604754 | chr10 | 75556079 | 75556138 | + | TSF |

TABLE 9-continued

Transcript fusion for Breast Invasive Carcinoma (BRCA) Coordinates of the fusion sequences for which the donor is the Exon.

| 1 | 2 | 3 | 4 | 5 | 6 | 7 | 8 | 9 | 10 | 11 |
|---|---|---|---|---|---|---|---|---|---|---|
| 2% | chr10 | 75555297 | 75555421 | + | ENST00000604729; ENST00000603114; ENST00000604524; ENST00000398706; ENST00000605216; ENST00000433366; ENST00000492395; ENST00000603187; ENST00000412198; ENST00000604754 | chr10 | 75556079 | 75556138 | + | TSF |
| 2% | chr10 | 75555297 | 75555421 | + | ENST00000604729; ENST00000603114; ENST00000604524; ENST00000398706; ENST00000605216; ENST00000433366; ENST00000492395; ENST00000603187; ENST00000412198; ENST00000604754 | chr10 | 75556079 | 75556138 | + | TSF |
| 2% | chr10 | 75555297 | 75555421 | + | ENST00000604729; ENST00000603114; ENST00000604524; ENST00000398706; ENST00000605216; ENST00000433366; ENST00000492395; ENST00000603187; ENST00000412198; ENST00000604754 | chr10 | 75556079 | 75556138 | + | TSF |
| 2% | chr10 | 75555297 | 75555421 | + | ENST00000604729; ENST00000603114; ENST00000604524; ENST00000398706; ENST00000605216; ENST00000433366; ENST00000492395; ENST00000603187; ENST00000412198; ENST00000604754 | chr10 | 75556079 | 75556138 | + | TSF |
| 2% | chr10 | 75555297 | 75555421 | + | ENST00000604729; ENST00000603114; ENST00000604524; ENST00000398706; ENST00000605216; ENST00000433366; ENST00000492395; ENST00000603187; ENST00000412198; ENST00000604754 | chr10 | 75556079 | 75556138 | + | TSF |
| 2% | chr7 | 142829210 | 142829304 | + | ENST00000291009 | chr7 | 142856912 | 142857269 | + | TSF |
| 2% | chr9 | 37842086 | 37842283 | + | ENST00000377724; ENST00000242323 | chr9 | 37853047 | 37853165 | + | TSF |
| 2% | chr16 | 30783410 | 30783511 | + | ENST00000324685; ENST00000402121; ENST00000563683; ENST00000357890 | chr16 | 30785136 | 30785155 | + | TSF |
| 2% | chr16 | 30783410 | 30783511 | + | ENST00000324685; ENST00000402121; ENST00000563683; ENST00000357890 | chr16 | 30785136 | 30785155 | + | TSF |
| 2% | chr16 | 30783410 | 30783511 | + | ENST00000324685; ENST00000402121; ENST00000563683; ENST00000357890 | chr16 | 30785136 | 30785155 | + | TSF |
| 2% | chr16 | 30783410 | 30783511 | + | ENST00000324685; ENST00000402121; ENST00000563683; ENST00000357890 | chr16 | 30785136 | 30785155 | + | TSF |
| 2% | chr8 | 42932359 | 42932507 | + | ENST00000302279; ENST00000342116; ENST00000529687; ENST00000533336 | chr8 | 42934165 | 42935743 | + | TSF |
| 2% | chr8 | 42932359 | 42932507 | + | ENST00000302279; ENST00000342116; ENST00000529687; ENST00000533336 | chr8 | 42934165 | 42935743 | + | TSF |
| 2% | chr8 | 42932359 | 42932507 | + | ENST00000302279; ENST00000342116; ENST00000529687; ENST00000533336 | chr8 | 42934165 | 42935743 | + | TSF |
| 2% | chr8 | 42932359 | 42932507 | + | ENST00000302279; ENST00000342116; ENST00000529687; ENST00000533336 | chr8 | 42934165 | 42935743 | + | TSF |
| 2% | chr1 | 180283857 | 180283827 | − | ENST00000367595 | chr1 | 180281120 | 180281103 | − | TSF |
| 2% | chrX | 41598709 | 41598637 | − | ENST00000421587; ENST00000318588; ENST00000361962; ENST00000378163; ENST00000378158; ENST00000378166; ENST00000442742; ENST00000378154 | chrX | 41557348 | 41557057 | − | TSF |
| 2% | chr17 | 70732858 | 70732789 | − | ENST00000255559; ENST00000542342; ENST00000582769; ENST00000581581 | chr17 | 70670711 | 70670228 | − | TSF |
| 2% | chr17 | 70732858 | 70732789 | − | ENST00000255559; ENST00000542342; ENST00000582769; ENST00000581581 | chr17 | 70670711 | 70670228 | − | TSF |
| 2% | chr17 | 70732858 | 70732789 | − | ENST00000255559; ENST00000542342; ENST00000582769; ENST00000581581 | chr17 | 70670711 | 70670228 | − | TSF |
| 2% | chr17 | 70732858 | 70732789 | − | ENST00000255559; ENST00000542342; ENST00000582769; ENST00000581581 | chr17 | 70670711 | 70670228 | − | TSF |
| 2% | chr10 | 43601824 | 43602019 | + | ENST00000355710; ENST00000340058 | chr10 | 43602522 | 43602638 | + | TSF |
| 2% | chr12 | 113623819 | 113623826 | + | ENST00000552495 | chr12 | 113623998 | 113624117 | + | TSF |
| 2% | chrX | 148628285 | 148628463 | + | ENST00000434353; ENST00000514208; ENST00000422892; ENST00000450602; ENST00000441248; ENST00000393985; ENST00000423421; ENST00000423540; ENST00000428236; ENST00000359293 | chrX | 148638635 | 148638790 | + | TSF |

TABLE 9-continued

Transcript fusion for Breast Invasive Carcinoma (BRCA) Coordinates of the fusion sequences for which the donor is the Exon.

| 1 | 2 | 3 | 4 | 5 | 6 | 7 | 8 | 9 | 10 | 11 |
|---|---|---|---|---|---|---|---|---|---|---|
| 2% | chrX | 148628285 | 148628463 | + | ENST00000434353; ENST00000514208; ENST00000422892; ENST00000450602; ENST00000441248; ENST00000393985; ENST00000423421; ENST00000423540; ENST00000428236; ENST00000359293 | chrX | 148638635 | 148638790 | + | TSF |
| 2% | chr22 | 47882528 | 47882479 | − | ENST00000405369 | chr22 | 47880391 | 47879942 | − | TSF |
| 2% | chr2 | 214228800 | 214228869 | + | ENST00000331683; ENST00000272898; ENST00000447990; ENST00000374309; ENST00000413312 | chr2 | 214233538 | 214233723 | + | TSF |
| 2% | chr2 | 214228800 | 214228869 | + | ENST00000331683; ENST00000272898; ENST00000447990; ENST00000374309; ENST00000413312 | chr2 | 214233538 | 214233723 | + | TSF |
| 2% | chr2 | 214228800 | 214228869 | + | ENST00000331683; ENST00000272898; ENST00000447990; ENST00000374309; ENST00000413312 | chr2 | 214233538 | 214233723 | + | TSF |
| 2% | chr9 | 125054028 | 125054119 | + | ENST00000297908; ENST00000344641; ENST00000373723; ENST00000373729; ENST00000394315 | chr9 | 125068067 | 125068171 | + | TSF |
| 2% | chr9 | 125054028 | 125054119 | + | ENST00000297908; ENST00000344641; ENST00000373723; ENST00000373729; ENST00000394315 | chr9 | 125068067 | 125068171 | + | TSF |
| 2% | chr9 | 125054028 | 125054119 | + | ENST00000297908; ENST00000344641; ENST00000373723; ENST00000373729; ENST00000394315 | chr9 | 125068067 | 125068171 | + | TSF |
| 2% | chrX | 149100985 | 149100807 | − | ENST00000370406; ENST00000355203; ENST00000370404; ENST00000370409; ENST00000462691 | chrX | 149090624 | 149090469 | − | TSF |
| 2% | chr3 | 4867546 | 4867430 | − | ENST00000449914 | chr3 | 4841712 | 4841679 | − | TSF |
| 2% | chr11 | 9069109 | 9068903 | − | ENST00000457346; ENST00000309263; ENST00000450649; ENST00000520467 | chr11 | 9062448 | 9062264 | − | TSF |
| 2% | chr11 | 9069109 | 9068903 | − | ENST00000457346; ENST00000309263; ENST00000450649; ENST00000520467 | chr11 | 9062448 | 9062264 | − | TSF |
| 2% | chr11 | 9069109 | 9068903 | − | ENST00000457346; ENST00000309263; ENST00000450649; ENST00000520467 | chr11 | 9062448 | 9062264 | − | TSF |
| 2% | chr8 | 145001050 | 145000952 | − | ENST00000345136; ENST00000357649; ENST00000354589; ENST00000398774; ENST00000322810; ENST00000354958; ENST00000356346; ENST00000436759; ENST00000527096; ENST00000527303 | chr8 | 144977746 | 144977671 | − | TSF |
| 2% | chr8 | 145001050 | 145000952 | − | ENST00000345136; ENST00000357649; ENST00000354589; ENST00000398774; ENST00000322810; ENST00000354958; ENST00000356346; ENST00000436759; ENST00000527096; ENST00000527303 | chr8 | 144977746 | 144977671 | − | TSF |
| 2% | chr8 | 145001050 | 145000952 | − | ENST00000345136; ENST00000357649; ENST00000354589; ENST00000398774; ENST00000322810; ENST00000354958; ENST00000356346; ENST00000436759; ENST00000527096; ENST00000527303 | chr8 | 144977746 | 144977671 | − | TSF |
| 2% | chr8 | 145001050 | 145000952 | − | ENST00000345136; ENST00000357649; ENST00000354589; ENST00000398774; ENST00000322810; ENST00000354958; ENST00000356346; ENST00000436759; ENST00000527096; ENST00000527303 | chr8 | 144977746 | 144977671 | − | TSF |
| 2% | chr8 | 145001050 | 1450010952 | − | ENST00000345136; ENST00000357649; ENST00000354589; ENST00000398774; ENST00000322810; ENST00000354958; ENST00000356346; ENST00000436759; ENST00000527096; ENST00000527303 | chr8 | 144977746 | 144977671 | − | TSF |
| 2% | chr8 | 145001050 | 145000952 | − | ENST00000345136; ENST00000357649; ENST00000354589; ENST00000398774; ENST00000322810; ENST00000354958; ENST00000356346; ENST00000436759; ENST00000527096; ENST00000527303 | chr8 | 144977746 | 144977671 | − | TSF |
| 2% | chr8 | 145001050 | 145000952 | − | ENST00000345136; ENST00000357649; ENST00000354589; ENST00000398774; ENST00000322810; ENST00000354958; ENST00000356346; ENST00000436759; | chr8 | 144977746 | 144977671 | − | TSF |

TABLE 9-continued

Transcript fusion for Breast Invasive Carcinoma (BRCA) Coordinates of the fusion sequences for which the donor is the Exon.

| 1 | 2 | 3 | 4 | 5 | 6 | 7 | 8 | 9 | 10 | 11 |
|---|---|---|---|---|---|---|---|---|---|---|
| 2% | chr8 | 145001050 | 145000952 | − | ENST00000527096; ENST00000527303 ENST00000345136; ENST00000357649; ENST00000354589; ENST00000398774; ENST00000322810; ENST00000354958; ENST00000356346; ENST00000436759; ENST00000527096; ENST00000527303 | chr8 | 144977746 | 144977671 | − | TSF |
| 2% | chr8 | 145001050 | 145000952 | − | ENST00000345136; ENST00000357649; ENST00000354589; ENST00000398774; ENST00000322810; ENST00000354958; ENST00000356346; ENST00000436759; ENST00000527096; ENST00000527303 | chr8 | 144977746 | 144977671 | − | TSF |
| 2% | chr8 | 145001050 | 145000952 | − | ENST00000345136; ENST00000357649; ENST00000354589; ENST00000398774; ENST00000322810; ENST00000354958; ENST00000356346; ENST00000436759; ENST00000527096; ENST00000527303 | chr8 | 144977746 | 144977671 | − | TSF |
| 2% | chr8 | 104778455 | 104778765 | + | ENST00000504942; ENST00000406091 | chr8 | 104821508 | 104821527 | + | TSF |
| 2% | chr12 | 40940937 | 40940984 | + | ENST00000380816 | chr12 | 40941279 | 40941378 | + | TSF |
| 2% | chr1 | 155036300 | 155036412 | + | ENST00000368409; ENST00000359751; ENST00000556931; ENST00000505139; ENST00000427683 | chr1 | 155036918 | 155037085 | + | TSF |
| 2% | chr8 | 109468102 | 109468159 | + | ENST00000220853; ENST00000519642 | chr8 | 109468381 | 109468590 | + | TSF |
| 2% | chr8 | 109468102 | 109468159 | + | ENST00000220853; ENST00000519642 | chr8 | 109468381 | 109468590 | + | TSF |
| 2% | chr10 | 37490163 | 37490253 | + | ENST00000361713; ENST00000374660; ENST00000602533 | chr10 | 37491222 | 37494539 | + | TSF |
| 2% | chr10 | 37490163 | 37490253 | + | ENST00000361713; ENST00000374660; ENST00000602533 | chr10 | 37491222 | 37494539 | + | TSF |
| 2% | chr6 | 610178 | 610098 | − | ENST00000230449 | chr6 | 607066 | 606461 | − | TSF |
| 2% | chr10 | 127483547 | 127483449 | − | ENST00000368797; ENST00000368786 | chr10 | 127473829 | 127473633 | − | TSF |
| 1% | chr7 | 142832287 | 142832392 | + | ENST00000291009 | chr7 | 142856912 | 142857269 | + | TSF |
| 1% | chr5 | 54993786 | 54993674 | − | ENST00000396865; ENST00000539768; ENST00000318672; ENST00000508124; ENST00000511233; ENST00000503891; ENST00000513993; ENST00000505563; ENST00000506624; ENST00000507109 | chr5 | 54993040 | 54992544 | − | TSF |
| 1% | chr1 | 11115877; 11115983 | 11115838 | − | ENST00000490101; ENST00000376957 | chr1 | 11115464 | 11115178 | − | TSF |
| 1% | chr1 | 11115877; 11115983 | 11115838 | − | ENST00000490101; ENST00000376957 | chr1 | 11115464 | 11115178 | − | TSF |
| 1% | chr8 | 71619168 | 71619388 | + | ENST00000408926; ENST00000520030 | chr8 | 71625661 | 71625673 | + | TSF |
| 1% | chr15 | 74219125 | 74220226 | + | ENST00000566011; ENST00000261921 | chr15 | 74234853 | 74234966 | + | TSF |
| 1% | chrX | 117900807 | 117900939 | + | ENST00000371666 | chrX | 117902549 | 117902902 | + | TSF |
| 1% | chr11 | 9069109 | 9068903 | − | ENST00000457346; ENST00000309263; ENST00000450649; ENST00000520467 | chr11 | 9068729 | 9068631 | − | TSF |
| 1% | chr11 | 9069109 | 9068903 | − | ENST00000457346; ENST00000309263; ENST00000450649; ENST00000520467 | chr11 | 9068729 | 9068631 | − | TSF |
| 1% | chr11 | 9069109 | 9068903 | − | ENST00000457346; ENST00000309263; ENST00000450649; ENST00000520467 | chr11 | 9068729 | 9068631 | − | TSF |
| 1% | chr17 | 60107012 | 60106902 | − | ENST00000397786; ENST00000583958 | chr17 | 60101011 | 60100641 | − | TSF |
| 1% | chr17 | 60107012 | 60106902 | − | ENST00000397786; ENST00000583958 | chr17 | 60101011 | 60100641 | − | TSF |
| 1% | chr6 | 151738534 | 151738414 | − | ENST00000336451; ENST00000367303 | chr6 | 151732046 | 151731858 | − | TSF |
| 1% | chr6 | 151738534 | 151738414 | − | ENST00000336451; ENST00000367303 | chr6 | 151732046 | 151731858 | − | TSF |
| 1% | chr20 | 41306799 | 41306506 | − | ENST00000356100; ENST00000373184; ENST00000373187; ENST00000373190; ENST00000373193; ENST00000373198; ENST00000373201 | chr20 | 41171740 | 41171524 | − | TSF |
| 1% | chr14 | 24845500; 24845580 | 24846084 | + | ENST00000555590; ENST00000556279; ENST00000250373; ENST00000553879; ENST00000554344; ENST00000555453; ENST00000556759; ENST00000413692; ENST00000424781; ENST00000539237; ENST00000553708; ENST00000422617; ENST00000557451; ENST00000555167; ENST00000555802; ENST00000555393 | chr14 | 24854777 | 24855120 | + | TSF |
| 1% | chr14 | 24845500; 24845580 | 24846084 | + | ENST00000555590; ENST00000556279; ENST00000250373; ENST00000553879; ENST00000554344; ENST00000555453; ENST00000556759; ENST00000413692; ENST00000424781; ENST00000539237; ENST00000553708; ENST00000422617; | chr14 | 24854777 | 24855120 | + | TSF |

TABLE 9-continued

Transcript fusion for Breast Invasive Carcinoma (BRCA) Coordinates of the fusion sequences for which the donor is the Exon.

| 1 | 2 | 3 | 4 | 5 | 6 | 7 | 8 | 9 | 10 | 11 |
|---|---|---|---|---|---|---|---|---|---|---|
| 1% | chr14 | 24845500; 24845580 | 24846084 | + | ENST00000557451; ENST00000555167; ENST00000555802; ENST00000555393 ENST00000555590; ENST00000556279; ENST00000250373; ENST00000553879; ENST00000554344; ENST00000555453; ENST00000556759; ENST00000413692; ENST00000424781; ENST00000539237; ENST00000553708; ENST00000422617; | chr14 | 24854777 | 24855120 | + | TSF |
| 1% | chr14 | 24845500; 24845580 | 24846084 | + | ENST00000557451; ENST00000555167; ENST00000555802; ENST00000555393 ENST00000555590; ENST00000556279; ENST00000250373; ENST00000553879; ENST00000554344; ENST00000555453; ENST00000556759; ENST00000413692; ENST00000424781; ENST00000539237; ENST00000553708; ENST00000422617; | chr14 | 24854777 | 24855120 | + | TSF |
| 1% | chr14 | 24845500; 24845580 | 24846084 | + | ENST00000557451; ENST00000555167; ENST00000555802; ENST00000555393 ENST00000555590; ENST00000556279; ENST00000250373; ENST00000553879; ENST00000554344; ENST00000555453; ENST00000556759; ENST00000413692; ENST00000424781; ENST00000539237; ENST00000553708; ENST00000422617; | chr14 | 24854777 | 24855120 | + | TSF |
| 1% | chr14 | 24845500; 24845580 | 24846084 | + | ENST00000557451; ENST00000555167; ENST00000555802; ENST00000555393 ENST00000555590; ENST00000556279; ENST00000250373; ENST00000553879; ENST00000554344; ENST00000555453; ENST00000556759; ENST00000413692; ENST00000424781; ENST00000539237; ENST00000553708; ENST00000422617; | chr14 | 24854777 | 24855120 | + | TSF |
| 1% | chr14 | 24845500; 24845580 | 24846084 | + | ENST00000557451; ENST00000555167; ENST00000555802; ENST00000555393 ENST00000555590; ENST00000556279; ENST00000250373; ENST00000553879; ENST00000554344; ENST00000555453; ENST00000556759; ENST00000413692; ENST00000424781; ENST00000539237; ENST00000553708; ENST00000422617; | chr14 | 24854777 | 24855120 | + | TSF |
| 1% | chr14 | 24845500; 24845580 | 24846084 | + | ENST00000557451; ENST00000555167; ENST00000555802; ENST00000555393 ENST00000555590; ENST00000556279; ENST00000250373; ENST00000553879; ENST00000554344; ENST00000555453; ENST00000556759; ENST00000413692; ENST00000424781; ENST00000539237; ENST00000553708; ENST00000422617; | chr14 | 24854777 | 24855120 | + | TSF |
| 1% | chr10 | 37490163 | 37490253 | + | ENST00000361713; ENST00000374660; ENST00000602533 | chr10 | 37501432 | 37501641 | + | TSF |
| 1% | chr10 | 37490163 | 37490253 | + | ENST00000361713; ENST00000374660; ENST00000602533 | chr10 | 37501432 | 37501641 | + | TSF |
| 1% | chr4 | 146617711 | 146617784 | + | ENST00000438731; ENST00000511965 | chr4 | 146620339 | 146620424 | + | TSF |
| 1% | chr4 | 146617711 | 146617784 | + | ENST00000438731; ENST00000511965 | chr4 | 146620339 | 146620424 | + | TSF |
| 1% | chr8 | 17872093 | 17872349 | + | ENST00000325083; ENST00000519253; ENST00000327578; ENST00000522275 | chr8 | 17873210 | 17873221 | + | TSF |
| 1% | chr8 | 17872093 | 17872349 | + | ENST00000325083; ENST00000519253; ENST00000327578; ENST00000522275 | chr8 | 17873210 | 17873221 | + | TSF |
| 1% | chr8 | 17872093 | 17872349 | + | ENST00000325083; ENST00000519253; ENST00000327578; ENST00000522275 | chr8 | 17873210 | 17873221 | + | TSF |
| 1% | chr8 | 17872093 | 17872349 | + | ENST00000325083; ENST00000519253; ENST00000327578; ENST00000522275 | chr8 | 17873210 | 17873221 | + | TSF |
| 1% | chr6 | 152201790; 152201792 | 152201906 | + | ENST00000440973; ENST00000338799; ENST00000456483; ENST00000443427; ENST00000206249; ENST00000427531; ENST00000415488 | chr6 | 152233905 | 152234264 | + | TSF |
| 1% | chr6 | 152201790; 152201792 | 152201906 | + | ENST00000440973; ENST00000338799; ENST00000456483; ENST00000443427; ENST00000206249; ENST00000427531; ENST00000415488 | chr6 | 152233905 | 152234264 | + | TSF |

TABLE 9-continued

Transcript fusion for Breast Invasive Carcinoma (BRCA) Coordinates of the fusion sequences for which the donor is the Exon.

| 1 | 2 | 3 | 4 | 5 | 6 | 7 | 8 | 9 | 10 | 11 |
|---|---|---|---|---|---|---|---|---|---|---|
| 1% | chr6 | 152201790; 152201792 | 152201906 | + | ENST00000440973; ENST00000338799; ENST00000456483; ENST00000443427; ENST00000206249; ENST00000427531; ENST00000415488 | chr6 | 152233905 | 152234264 | + | TSF |
| 1% | chr20 | 41101202 | 41100906 | − | ENST00000356100; ENST00000373184; ENST00000373187; ENST00000373190; ENST00000373193; ENST00000373198; ENST00000373201 | hr20 | 41094843 | 41094411 | − | TSF |
| 1% | chr3 | 188956522 | 188956698 | + | ENST00000433971; ENST00000345063; ENST00000425670 | chr3 | 188963972 | 188964159 | + | TSF |
| 1% | chr3 | 188956522 | 188956698 | + | ENST00000433971; ENST00000345063; ENST00000425670 | chr3 | 188963972 | 188964159 | + | TSF |
| 1% | chr5 | 23976106 | 23976159 | + | ENST00000512559; ENST00000507936 | chr5 | 24177946 | 24178380 | + | TSF |
| 1% | chr7 | 16901071 | 16901008 | − | ENST00000310398; ENST00000402239; ENST00000414935 | chr7 | 16894536 | 16894260 | − | TSF |
| 1% | chr7 | 16901071 | 16901008 | − | ENST00000310398; ENST00000402239; ENST00000414935 | chr7 | 16894536 | 16894260 | − | TSF |
| 1% | chr11 | 100912833 | 100912676 | − | ENST00000325455; ENST00000534013; ENST00000263463 | chr11 | 100911331 | 100910821 | − | TSF |
| 1% | chr11 | 100912833 | 100912676 | − | ENST00000325455; ENST00000534013; ENST00000263463 | chr11 | 100911331 | 100910821 | − | TSF |
| 1% | chr11 | 10092833 | 100912676 | − | ENST00000325455; ENST00000534013; ENST00000263463 | chr11 | 100911331 | 100910821 | − | TSF |
| 1% | chr17 | 34802073 | 34802035 | − | ENST00000330458; ENST00000535805; ENST00000535592; ENST00000394453; ENST00000592614; ENST00000341264 | chr17 | 34772854 | 34772787 | − | TSF |
| 1% | chr17 | 34802073 | 34802035 | − | ENST00000330458; ENST00000535805; ENST00000535592; ENST00000394453; ENST00000592614; ENST00000341264 | chr17 | 34772854 | 34772787 | − | TSF |
| 1% | chr19 | 23556639 | 23556544 | − | ENST00000599743; ENST00000300619 | chr19 | 23491899 | 23491588 | − | TSF |
| 1% | chr17 | 1928159 | 1928147 | − | ENST00000331238 | chr17 | 1917588 | 1917538 | − | TSF |
| 1% | chr13 | 114157811 | 114157903 | + | ENST00000434316; ENST00000375391 | chr13 | 114159741 | 114159770 | + | TSF |
| 1% | chr13 | 98642687; 98642769 | 98642791 | + | ENST00000261574; ENST00000357602; ENST00000490680; ENST00000469360; ENST00000539640 | chr13 | 98643835 | 98643958 | + | TSF |
| 1% | chr13 | 98642687; 98642769 | 98642791 | + | ENST00000261574; ENST00000357602; ENST00000490680; ENST00000469360; ENST00000539640 | chr13 | 98643835 | 98643958 | + | TSF |
| 1% | chr13 | 98642687; 98642769 | 98642791 | + | ENST00000261574; ENST00000357602; ENST00000490680; ENST00000469360; ENST00000539640 | chr13 | 98643835 | 98643958 | + | TSF |
| 1% | chr13 | 98642687; 98642769 | 98642791 | + | ENST00000261574; ENST00000357602; ENST00000490680; ENST00000469360; ENST00000539640 | chr13 | 98643835 | 98643958 | + | TSF |
| 1% | chr4 | 56230241 | 56230438 | + | ENST00000264228 | chr4 | 56252510 | 56252750 | + | TSF |
| 1% | chr1 | 33138392 | 33138502 | + | ENST00000414241; ENST00000373493; ENST00000544435; ENST00000373485; ENST00000458695; ENST00000475321; ENST00000463378; ENST00000460669; ENST00000482190 | chr1 | 33145073 | 33145159 | + | TSF |
| 1% | chr1 | 33138392 | 33138502 | + | ENST00000414241; ENST00000373493; ENST00000544435; ENST00000373485; ENST00000458695; ENST00000475321; ENST00000463378; ENST00000460669; ENST00000482190 | chr1 | 33145073 | 33145159 | + | TSF |
| 1% | chr1 | 33138392 | 33138502 | + | ENST00000414241; ENST00000373493; ENST00000544435; ENST00000373485; ENST00000458695; ENST00000475321; ENST00000463378; ENST00000460669; ENST00000482190 | chr1 | 33145073 | 33145159 | + | TSF |
| 1% | chr1 | 33138392 | 33138502 | + | ENST00000414241; ENST00000373493; ENST00000544435; ENST00000373485; ENST00000458695; ENST00000475321; ENST00000463378; ENST00000460669; ENST00000482190 | chr1 | 33145073 | 33145159 | + | TSF |
| 1% | chr1 | 33138392 | 33138502 | + | ENST00000414241; ENST00000373493; ENST00000544435; ENST00000373485; ENST00000458695; ENST00000475321; ENST00000463378; ENST00000460669; ENST00000482190 | chr1 | 33145073 | 33145159 | + | TSF |

TABLE 9-continued

Transcript fusion for Breast Invasive Carcinoma (BRCA) Coordinates of the fusion sequences for which the donor is the Exon.

| 1 | 2 | 3 | 4 | 5 | 6 | 7 | 8 | 9 | 10 | 11 |
|---|---|---|---|---|---|---|---|---|----|----|
| 1% | chr1 | 33138392 | 33138502 | + | ENST00000414241; ENST00000373493; ENST00000544435; ENST00000373485; ENST00000458695; ENST00000475321; ENST00000463378; ENST00000460669; ENST00000482190 | chr1 | 33145073 | 33145159 | + | TSF |
| 1% | chr1 | 33138392 | 33138502 | + | ENST00000414241; ENST00000373493; ENST00000544435; ENST00000373485; ENST00000458695; ENST00000475321; ENST00000463378; ENST00000460669; ENST00000482190 | chr1 | 33145073 | 33145159 | + | TSF |
| 1% | chr1 | 33138392 | 33138502 | + | ENST00000414241; ENST00000373493; ENST00000544435; ENST00000373485; ENST00000458695; ENST00000475321; ENST00000463378; ENST00000460669; ENST00000482190 | chr1 | 33145073 | 33145159 | + | TSF |
| 1% | chr2 | 143743517 | 143743590 | + | ENST00000264170; ENST00000375773; ENST00000409512 | chr2 | 143745513 | 143745682 | + | TSF |
| 1% | chr1 | 63955889 | 63955754 | − | ENST00000371092; ENST00000271002; ENST00000489099; ENST00000283568 | chr1 | 63952444 | 63951983 | − | TSF |
| 1% | chr1 | 63955889 | 63955754 | − | ENST00000371092; ENST00000271002; ENST00000489099; ENST00000283568 | chr1 | 63952444 | 63951983 | − | TSF |
| 1% | chr8 | 141711121 | 141710990 | − | ENST00000522684; ENST00000519654; ENST00000535192; ENST00000519465; ENST00000517887; ENST00000521059; ENST00000395218; ENST00000523539; ENST00000538769; ENST00000340930; ENST00000519419; ENST00000430260; ENST00000521986 | chr8 | 141701376 | 141701371 | − | TSF |
| 1% | chr8 | 141711121 | 141710990 | − | ENST00000522684; ENST00000519654; ENST00000535192; ENST00000519465; ENST00000517887; ENST00000521059; ENST00000395218; ENST00000523539; ENST00000538769; ENST00000340930; ENST00000519419; ENST00000430260; ENST00000521986 | chr8 | 141701376 | 141701371 | − | TSF |
| 1% | chr8 | 141711121 | 141710990 | − | ENST00000522684; ENST00000519654; ENST00000535192; ENST00000519465; ENST00000517887; ENST00000521059; ENST00000395218; ENST00000523539; ENST00000538769; ENST00000340930; ENST00000519419; ENST00000430260; ENST00000521986 | chr8 | 141701376 | 141701371 | − | TSF |
| 1% | chr8 | 141711121 | 141710990 | − | ENST00000522684; ENST00000519654; ENST00000535192; ENST00000519465; ENST00000517887; ENST00000521059; ENST00000395218; ENST00000523539; ENST00000538769; ENST00000340930; ENST00000519419; ENST00000430260; ENST00000521986 | chr8 | 141701376 | 141701371 | − | TSF |
| 1% | chr8 | 141711121 | 141710990 | − | ENST00000522684; ENST00000519654; ENST00000535192; ENST00000519465; ENST00000517887; ENST00000521059; ENST00000395218; ENST00000523539; ENST00000538769; ENST00000340930; ENST00000519419; ENST00000430260; ENST00000521986 | chr8 | 141701376 | 141701371 | − | TSF |
| 1% | chr8 | 141711121 | 141710990 | − | ENST00000522684; ENST00000519654; ENST00000535192; ENST00000519465; ENST00000517887; ENST00000521059; ENST00000395218; ENST00000523539; ENST00000538769; ENST00000340930; ENST00000519419; ENST00000430260; ENST00000521986 | chr8 | 141701376 | 141701371 | − | TSF |
| 1% | chr8 | 141711121 | 141710990 | − | ENST00000522684; ENST00000519654; ENST00000535192; ENST00000519465; ENST00000517887; ENST00000521059; ENST00000395218; ENST00000523539; ENST00000538769; ENST00000340930; ENST00000519419; ENST00000430260; ENST00000521986 | chr8 | 141701376 | 141701371 | − | TSF |

TABLE 9-continued

Transcript fusion for Breast Invasive Carcinoma (BRCA) Coordinates of the fusion sequences for which the donor is the Exon.

| 1 | 2 | 3 | 4 | 5 | 6 | 7 | 8 | 9 | 10 | 11 |
|---|---|---|---|---|---|---|---|---|---|---|
| 1% | chr8 | 141711121 | 141710990 | − | ENST00000522684; ENST00000519654; ENST00000535192; ENST00000519465; ENST00000517887; ENST00000521059; ENST00000395218; ENST00000523539; ENST00000538769; ENST00000340930; ENST00000519419; ENST00000430260; ENST00000521986 | chr8 | 141701376 | 141701371 | − | TSF |
| 1% | chr8 | 141711121 | 141710990 | − | ENST00000522684; ENST00000519654; ENST00000535192; ENST00000519465; ENST00000517887; ENST00000521059; ENST00000395218; ENST00000523539; ENST00000538769; ENST00000340930; ENST00000519419; ENST00000430260; ENST00000521986 | chr8 | 141701376 | 141701371 | − | TSF |
| 1% | chr12 | 56742407 | 56742313 | − | ENST00000314128; ENST00000557235 | chr12 | 56740986 | 56740975 | − | TSF |
| 1% | chr12 | 56742407 | 56742313 | − | ENST00000314128; ENST00000557235 | chr12 | 56740986 | 56740975 | − | TSF |
| 1% | chr19 | 3869013; 3869015 | 3868963 | − | ENST00000586578; ENST00000262961; ENST00000438164; ENST00000587212; ENST00000439086 | chr19 | 3855694 | 3855445 | − | TSF |
| 1% | chr19 | 3869013; 3869015 | 3868963 | − | ENST00000586578; ENST00000262961; ENST00000438164; ENST00000587212; ENST00000439086 | chr19 | 3855694 | 3855445 | − | TSF |
| 1% | chr3 | 4872702 | 4872631 | − | ENST00000449914; ENST00000441894 | chr3 | 4871474 | 4871202 | − | TSF |
| 1% | chr11 | 86534430 | 86534635 | + | ENST00000532234; ENST00000533902 | chr11 | 86589356 | 86590488 | + | TSF |
| 1% | chr11 | 82698812 | 82698629 | − | ENST00000525117; ENST00000532548; ENST00000524635; ENST00000533486; ENST00000260056; ENST00000533014; ENST00000527633; ENST00000531021; ENST00000534301 | chr11 | 82695638 | 82695143 | − | TSF |
| 1% | chr11 | 82698812 | 82698629 | − | ENST00000525117; ENST00000532548; ENST00000524635; ENST00000533486; ENST00000260056; ENST00000533014; ENST00000527633; ENST00000531021; ENST00000534301 | chr11 | 82695638 | 82695143 | − | TSF |
| 1% | chr11 | 82698812 | 82698629 | − | ENST00000525117; ENST00000532548; ENST00000524635; ENST00000533486; ENST00000260056; ENST00000533014; ENST00000527633; ENST00000531021; ENST00000534301 | chr11 | 82695638 | 82695143 | − | TSF |
| 1% | chr11 | 82698812 | 82698629 | − | ENST00000525117; ENST00000532548; ENST00000524635; ENST00000533486; ENST00000260056; ENST00000533014; ENST00000527633; ENST00000531021; ENST00000534301 | chr11 | 82695638 | 82695143 | − | TSF |
| 1% | chr3 | 48716169 | 48715997 | − | ENST00000413374; ENST00000341520; ENST00000416649; ENST00000294129 | chr3 | 48702393 | 48702198 | − | TSF |
| 1% | chr3 | 48716169 | 48715997 | − | ENST00000413374; ENST00000341520; ENST00000416649; ENST00000294129 | chr3 | 48702393 | 48702198 | − | TSF |
| 1% | chr3 | 48716169 | 48715997 | − | ENST00000413374; ENST00000341520; ENST00000416649; ENST00000294129 | chr3 | 48702393 | 48702198 | − | TSF |
| 1% | chr11 | 9047401 | 9047249 | − | ENST00000519202; ENST00000457346; ENST00000309263; ENST00000450649; ENST00000520467; ENST00000528651 | chr11 | 9045506 | 9045449 | − | TSF |
| 1% | chr11 | 9047401 | 9047249 | − | ENST00000519202; ENST00000457346; ENST00000309263; ENST00000450649; ENST00000520467; ENST00000528651 | chr11 | 9045506 | 9045449 | − | TSF |
| 1% | chr11 | 9047401 | 9047249 | − | ENST00000519202; ENST00000457346; ENST00000309263; ENST00000450649; ENST00000520467; ENST00000528651 | chr11 | 9045506 | 9045449 | − | TSF |
| 1% | chr11 | 9047401 | 9047249 | − | ENST00000519202; ENST00000457346; ENST00000309263; ENST00000450649; ENST00000520467; ENST00000528651 | chr11 | 9045506 | 9045449 | − | TSF |
| 1% | chr11 | 9047401 | 9047249 | − | ENST00000519202; ENST00000457346; ENST00000309263; ENST00000450649; ENST00000520467; ENST00000528651 | chr11 | 9045506 | 9045449 | − | TSF |
| 1% | chr11 | 9047401 | 9047249 | − | ENST00000519202; ENST00000457346; ENST00000309263; ENST00000450649; ENST00000520467; ENST00000528651 | chr11 | 9045506 | 9045449 | − | TSF |

TABLE 10

Transcript fusion for Breast Invasive Carcinoma (BRCA) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 39% | chr8 | 104389530 | 104389551 | + | chr8 | 104390255 | 104390471 | + | ENST00000330295; ENST00000520337 | TAF |
| 31% | chr4 | 95982945 | 95983246 | + | chr4 | 96025559 | 96025718 | + | ENST00000440890 | TAF |
| 25% | chr17 | 75318693 | 75318752 | + | chr17 | 75398141 | 75398484; 75398497; 75398565; 75398785 | + | ENST00000589070; ENST00000591934; ENST00000589140; ENST00000427177; ENST00000591198; ENST00000329047; ENST00000590294; ENST00000423034 | TAF |
| 25% | chr17 | 75318693 | 75318752 | + | chr17 | 75398141 | 75398484; 75398497; 75398565; 75398785 | + | ENST00000589070; ENST00000591934; ENST00000589140; ENST00000427177; ENST00000591198; ENST00000329047; ENST00000590294; ENST00000423034 | TAF |
| 25% | chr17 | 75318693 | 75318752 | + | chr17 | 75398141 | 75398484; 75398497; 75398565; 75398785 | + | ENST00000589070; ENST00000591934; ENST00000589140; ENST00000427177; ENST00000591198; ENST00000329047; ENST00000590294; ENST00000423034 | TAF |
| 25% | chr17 | 75318693 | 75318752 | + | chr17 | 75398141 | 75398484; 75398497; 75398565; 75398785 | + | ENST00000589070; ENST00000591934; ENST00000589140; ENST00000427177; ENST00000591198; ENST00000329047; ENST00000590294; ENST00000423034 | TAF |
| 24% | chr16 | 78085262 | 78085350 | + | chr16 | 78085855 | 78085865 | + | ENST00000567430 | TAF |
| 21% | chr5 | 54528691 | 54528595 | − | chr5 | 54528374 | 54528189 | − | ENST00000282572 | TAF |
| 20% | chr17 | 30771499 | 30771536 | + | chr17 | 30773963 | 30774064 | + | ENST00000261712; ENST00000457654; ENST00000579451 | TAF |
| 20% | chr17 | 30771499 | 30771536 | + | chr17 | 30773963 | 30774064 | + | ENST00000261712; ENST00000457654; ENST00000579451 | TAF |
| 20% | chr10 | 22170801 | 22168673 | − | chr10 | 22095028 | 22094909 | − | ENST00000376980 | TSF |
| 19% | chr16 | 1631056 | 1630957 | − | chr16 | 1630851 | 1630760; 1630836 | − | ENST00000426508; ENST00000397417 | TAF |
| 19% | chr16 | 1631056 | 1630957 | − | chr16 | 1630851 | 1630760; 1630836 | − | ENST00000426508; ENST00000397417 | TAF |
| 18% | chr4 | 141581072 | 141581072 | − | chr4 | 141580859 | 141580742 | − | ENST00000442267 | TAF |
| 18% | chr5 | 70927667 | 70927725 | + | chr5 | 70927948 | 70928012 | + | ENST00000512218; ENST00000340941; ENST00000509358; ENST00000323375; ENST00000509539 | TAF |
| 18% | chr5 | 70927667 | 70927725 | + | chr5 | 70927948 | 70928012 | + | ENST00000512218; ENST00000340941; ENST00000509358; ENST00000323375; ENST00000509539 | TAF |
| 18% | chr5 | 70927667 | 70927725 | + | chr5 | 70927948 | 70928012 | + | ENST00000512218; ENST00000340941; ENST00000509358; ENST00000323375; ENST00000509539 | TAF |
| 18% | chr5 | 70927667 | 70927725 | + | chr5 | 70927948 | 70928012 | + | ENST00000512218; ENST00000340941; ENST00000509358; ENST00000323375; ENST00000509539 | TAF |
| 18% | chr19 | 49121994 | 49121817 | − | chr19 | 49121134 | 49121048 | − | ENST00000549920; ENST00000547897; ENST00000550645; ENST00000549370; ENST00000549273; ENST00000084795 | TAF |
| 18% | chr19 | 49121994 | 49121817 | − | chr19 | 49121134 | 49121048 | − | ENST00000549920; ENST00000547897; ENST00000550645; ENST00000549370; ENST00000549273; ENST00000084795 | TAF |
| 18% | chr19 | 49121994 | 49121817 | − | chr19 | 49121134 | 49121048 | − | ENST00000549920; ENST00000547897; ENST00000550645; ENST00000549370; ENST00000549273; ENST00000084795 | TAF |
| 18% | chr19 | 49121994 | 49121817 | − | chr19 | 49121134 | 49121048 | − | ENST00000549920; ENST00000547897; ENST00000550645; ENST00000549370; ENST00000549273; ENST00000084795 | TAF |
| 18% | chr19 | 49121994 | 49121817 | − | chr19 | 49121134 | 49121048 | − | ENST00000549920; ENST00000547897; ENST00000550645; ENST00000549370; ENST00000549273; ENST00000084795 | TAF |
| 18% | chr10 | 37457109 | 37457331 | + | chr10 | 37458458 | 37458486 | + | ENST00000361713; ENST00000374660 | TAF |
| 18% | chr10 | 37457109 | 37457331 | + | chr10 | 37458458 | 37458486 | + | ENST00000361713; ENST00000374660 | TAF |
| 18% | chr3 | 4858133 | 4857857 | − | chr3 | 4856115 | 4856088 | − | ENST00000449914; ENST00000441894 | TSF |
| 17% | chr10 | 37468901 | 37469123 | + | chr10 | 37470250 | 37470278 | + | ENST00000374660; ENST00000602533 | TAF |
| 17% | chr10 | 37457109 | 37457331 | + | chr10 | 37470250 | 37470278 | + | ENST00000374660; ENST00000602533 | TAF |
| 17% | chr3 | 4859338 | 4859117 | − | chr3 | 4856115 | 4856088 | − | ENST00000449914; ENST00000441894 | TSF |
| 16% | chr14 | 24105943 | 24105981 | + | chr14 | 24112361 | 24112428 | + | ENST00000432832; ENST00000250383; ENST00000344777; ENST00000557535; ENST00000553600 | TAF |
| 16% | chr14 | 24105943 | 24105981 | + | chr14 | 24112361 | 24112428 | + | ENST00000432832; ENST00000250383; ENST00000344777; ENST00000557535; ENST00000553600 | TAF |
| 16% | chr14 | 24105943 | 24105981 | + | chr14 | 24112361 | 24112428 | + | ENST00000432832; ENST00000250383; ENST00000344777; ENST00000557535; ENST00000553600 | TAF |

TABLE 10-continued

Transcript fusion for Breast Invasive Carcinoma (BRCA) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 16% | chr14 | 24105943 | 24105981 | + | chr14 | 24112361 | 24112428 | + | ENST00000432832; ENST00000250383; ENST00000344777; ENST00000557535; ENST00000553600 | TAF |
| 16% | chr14 | 24105943 | 24105981 | + | chr14 | 24112361 | 24112428 | + | ENST00000432832; ENST00000250383; ENST00000344777; ENST00000557535; ENST00000553600 | TAF |
| 15% | chr3 | 4898685 | 4898320 | − | chr3 | 4872702 | 4872631 | − | ENST00000449914; ENST00000441894 | TAF |
| 15% | chr3 | 4898685 | 4898320 | − | chr3 | 4872702 | 4872631 | − | ENST00000449914; ENST00000441894 | TAF |
| 14% | chr7 | 16914458 | 16914438 | − | chr7 | 16913467 | 16913404 | − | ENST00000310398; ENST00000402239; ENST00000414935 | TAF |
| 14% | chr7 | 16914458 | 16914438 | − | chr7 | 16913467 | 16913404 | − | ENST00000310398; ENST00000402239; ENST00000414935 | TAF |
| 14% | chr7 | 16914458 | 16914438 | − | chr7 | 16913467 | 16913404 | − | ENST00000310398; ENST00000402239; ENST00000414935 | TAF |
| 14% | chr6 | 151739722 | 151739668 | − | chr6 | 151738534 | 151738414; 151738471 | − | ENST00000336451; ENST00000367303; ENST00000444024 | TAF |
| 14% | chr6 | 151739722 | 151739668 | − | chr6 | 151738534 | 151738414; 151738471 | − | ENST00000336451; ENST00000367303; ENST00000444024 | TAF |
| 14% | chr1 | 246581335 | 246580598 | − | chr1 | 246518396 | 246518333 | − | ENST00000388985; ENST00000403792 | TSF |
| 14% | chr1 | 246581335 | 246580598 | − | chr1 | 246518396 | 246518333 | − | ENST00000388985; ENST00000403792 | TSF |
| 13% | chr3 | 124560577 | 124560517 | − | chr3 | 124560398 | 124560230; 124560268 | − | ENST00000296181; ENST00000488466; ENST00000496703; ENST00000608657 | TAF |
| 13% | chr3 | 124560577 | 124560517 | − | chr3 | 124560398 | 124560230; 124560268 | − | ENST00000296181; ENST00000488466; ENST00000496703; ENST00000608657 | TAF |
| 13% | chr3 | 124560577 | 124560517 | − | chr3 | 124560398 | 124560230; 124560268 | − | ENST00000296181; ENST00000488466; ENST00000496703; ENST00000608657 | TAF |
| 13% | chr3 | 124560577 | 124560517 | − | chr3 | 124560398 | 124560230; 124560268 | − | ENST00000296181; ENST00000488466; ENST00000496703; ENST00000608657 | TAF |
| 13% | chr7 | 16840326 | 16840006 | − | chr7 | 16839441 | 16839368 | − | ENST00000419304; ENST00000450569; ENST00000419572; ENST00000401412; ENST00000412973 | TAF |
| 13% | chr7 | 16840326 | 16840006 | − | chr7 | 16839441 | 16839368 | − | ENST00000419304; ENST00000450569; ENST00000419572; ENST00000401412; ENST00000412973 | TAF |
| 13% | chr7 | 16840326 | 16840006 | − | chr7 | 16839441 | 16839368 | − | ENST00000419304; ENST00000450569; ENST00000419572; ENST00000401412; ENST00000412973 | TAF |
| 13% | chr7 | 16840326 | 16840006 | − | chr7 | 16839441 | 16839368 | − | ENST00000419304; ENST00000450569; ENST00000419572; ENST00000401412; ENST00000412973 | TAF |
| 12% | chr14 | 24631729 | 24631779 | + | chr14 | 24632175 | 24632191; 24632358 | + | ENST00000561342; ENST00000560852; ENST00000396864; ENST00000559284; ENST00000560275 | TAF |
| 12% | chr14 | 24631729 | 24631779 | + | chr14 | 24632175 | 24632191; 24632358 | + | ENST00000561342; ENST00000560852; ENST00000396864; ENST00000559284; ENST00000560275 | TAF |
| 12% | chr14 | 24631729 | 24631779 | + | chr14 | 24632175 | 24632191; 24632358 | + | ENST00000561342; ENST00000560852; ENST00000396864; ENST00000559284; ENST00000560275 | TAF |
| 12% | chr14 | 24631729 | 24631779 | + | chr14 | 24632175 | 24632191; 24632358 | + | ENST00000561342; ENST00000560852; ENST00000396864; ENST00000559284; ENST00000560275 | TAF |
| 12% | chr17 | 80440912 | 80441180 | + | chr17 | 80441592 | 80441655; 80441659 | + | ENST00000390006; ENST00000309794; ENST00000345415; ENST00000457415; ENST00000577432; ENST00000584513; ENST00000412079 | TAF |
| 12% | chr17 | 80440912 | 80441180 | + | chr17 | 80441592 | 80441655; 80441659 | + | ENST00000390006; ENST00000309794; ENST00000345415; ENST00000457415; ENST00000577432; ENST00000584513; ENST00000412079 | TAF |
| 12% | chr17 | 80440912 | 80441180 | + | chr17 | 80441592 | 80441655; 80441659 | + | ENST00000390006; ENST00000309794; ENST00000345415; ENST00000457415; ENST00000577432; ENST00000584513; ENST00000412079 | TAF |
| 12% | chr17 | 80440912 | 80441180 | + | chr17 | 80441592 | 80441655; 80441659 | + | ENST00000390006; ENST00000309794; ENST00000345415; ENST00000457415; ENST00000577432; ENST00000584513; ENST00000412079 | TAF |
| 12% | chr8 | 126168241 | 126168340 | + | chr8 | 126194345 | 126194498 | + | ENST00000523741; ENST00000517532; ENST00000287437; ENST00000522563; ENST00000517315 | TAF |
| 12% | chr8 | 126168241 | 126168340 | + | chr8 | 126194345 | 126194498 | + | ENST00000523741; ENST00000517532; ENST00000287437; ENST00000522563; ENST00000517315 | TAF |

TABLE 10-continued

Transcript fusion for Breast Invasive Carcinoma (BRCA) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 12% | chr8 | 126168241 | 126168340 | + | chr8 | 126194345 | 126194498 | + | ENST00000523741; ENST00000517532; ENST00000287437; ENST00000522563; ENST00000517315 | TAF |
| 12% | chr19 | 16267516 | 16267566 | + | chr19 | 16268020 | 16268139; 16268205; 16268208; 16268448 | + | ENST00000593031; ENST00000397372; ENST00000253680; ENST00000593154; ENST00000588246 | TAF |
| 12% | chr19 | 16267516 | 16267566 | + | chr19 | 16268020 | 16268139; 16268205; 16268208; 16268448 | + | ENST00000593031; ENST00000397372; ENST00000253680; ENST00000593154; ENST00000588246 | TAF |
| 12% | chr19 | 16267516 | 16267566 | + | chr19 | 16268020 | 16268139; 16268205; 16268208; 16268448 | + | ENST00000593031; ENST00000397372; ENST00000253680; ENST00000593154; ENST00000588246 | TAF |
| 12% | chr19 | 16267516 | 16267566 | + | chr19 | 16268020 | 16268139; 16268205; 16268208; 16268448 | + | ENST00000593031; ENST00000397372; ENST00000253680; ENST00000593154; ENST00000588246 | TAF |
| 11% | chr11 | 93468219 | 93468129 | − | chr11 | 93467826 | 93467791; 93467814 | − | ENST00000393259; ENST00000527169 | TAF |
| 11% | chr11 | 93468219 | 93468129 | − | chr11 | 93467826 | 93467791; 93467814 | − | ENST00000393259; ENST00000527169 | TAF |
| 11% | chr6 | 33673107 | 33673041 | − | chr6 | 33669197 | 33669123 | − | ENST00000374231; ENST00000607484 | TAF |
| 11% | chr18 | 43686699 | 43686799 | + | chr18 | 43698147 | 43698282 | + | ENST00000282058; ENST00000592471 | TAF |
| 11% | chr18 | 43686699 | 43686799 | + | chr18 | 43698147 | 43698282 | + | ENST00000282058; ENST00000592471 | TAF |
| 10% | chr1 | 33142637 | 33142971 | + | chr1 | 33145241 | 33145299; 33145306; 33145415 | + | ENST00000482190; ENST00000414241; ENST00000373493; ENST00000544435; ENST00000458695; ENST00000460669; ENST00000463378 | TAF |
| 10% | chr1 | 33142637 | 33142971 | + | chr1 | 33145241 | 33145299; 33145306; 33145415 | + | ENST00000482190; ENST00000414241; ENST00000373493; ENST00000544435; ENST00000458695; ENST00000460669; ENST00000463378 | TAF |
| 10% | chr1 | 33142637 | 33142971 | + | chr1 | 33145241 | 33145299; 33145306; 33145415 | + | ENST00000482190; ENST00000414241; ENST00000373493; ENST00000544435; ENST00000458695; ENST00000460669; ENST00000463378 | TAF |
| 10% | chr4 | 107241932 | 107242850 | + | chr4 | 107246142 | 107246275 | + | ENST00000394701 | TAF |
| 10% | chrX | 80548900 | 80548905 | + | chrX | 80552694 | 80552726 | + | ENST00000373212 | TAF |
| 9% | chr18 | 33711482 | 33711615 | + | chr18 | 33713201 | 33713279 | + | ENST00000358232; ENST00000351393; ENST00000442325; ENST00000423854; ENST00000539560; ENST00000542430; ENST00000350494; ENST00000542824; ENST00000540799 | TSF |
| 9% | chr18 | 33711482 | 33711615 | + | chr18 | 33713201 | 33713279 | + | ENST00000358232; ENST00000351393; ENST00000442325; ENST00000423854; ENST00000539560; ENST00000542430; ENST00000350494; ENST00000542824; ENST00000540799 | TSF |
| 9% | chr18 | 33711482 | 33711615 | + | chr18 | 33713201 | 33713279 | + | ENST00000358232; ENST00000351393; ENST00000442325; ENST00000423854; ENST00000539560; ENST00000542430; ENST00000350494; ENST00000542824; ENST00000540799 | TSF |
| 9% | chr18 | 33711482 | 33711615 | + | chr18 | 33713201 | 33713279 | + | ENST00000358232; ENST00000351393; ENST00000442325; ENST00000423854; ENST00000539560; ENST00000542430; ENST00000350494; ENST00000542824; ENST00000540799 | TSF |
| 9% | chr18 | 33711482 | 33711615 | + | chr18 | 33713201 | 33713279 | + | ENST00000358232; ENST00000351393; ENST00000442325; ENST00000423854; ENST00000539560; ENST00000542430; ENST00000350494; ENST00000542824; ENST00000540799 | TSF |
| 9% | chr18 | 33711482 | 33711615 | + | chr18 | 33713201 | 33713279 | + | ENST00000358232; ENST00000351393; ENST00000442325; ENST00000423854; ENST00000539560; ENST00000542430; ENST00000350494; ENST00000542824; ENST00000540799 | TSF |
| 9% | chr18 | 33711482 | 33711615 | + | chr18 | 33713201 | 33713279 | + | ENST00000358232; ENST00000351393; ENST00000442325; ENST00000423854; ENST00000539560; ENST00000542430; ENST00000350494; ENST00000542824; ENST00000540799 | TSF |

TABLE 10-continued

Transcript fusion for Breast Invasive Carcinoma (BRCA) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 9% | chr18 | 33711482 | 33711615 | + | chr18 | 33713201 | 33713279 | + | ENST00000358232; ENST00000351393; ENST00000442325; ENST00000423854; ENST00000539560; ENST00000542430; ENST00000350494; ENST00000542824; ENST00000540799 | TSF |
| 9% | chr18 | 33711482 | 33711615 | + | chr18 | 33713201 | 33713279 | + | ENST00000358232; ENST00000351393; ENST00000442325; ENST00000423854; ENST00000539560; ENST00000542430; ENST00000350494; ENST00000542824; ENST00000540799 | TSF |
| 9% | chr7 | 56018506 | 56018522 | + | chr7 | 56020872 | 56021011 | + | ENST00000426595 | TSF |
| 8% | chr1 | 162768504 | 162768725 | + | chr1 | 162769533 | 162769727 | + | ENST00000367917; ENST00000254521 | TSF |
| 8% | chr1 | 162768504 | 162768725 | + | chr1 | 162769533 | 162769727 | + | ENST00000367917; ENST00000254521 | TSF |
| 8% | chr15 | 39896167 | 39896087 | − | chr15 | 39893127 | 39893081 | − | ENST00000350221; ENST00000559547 | TSF |
| 6% | chr11 | 60694460 | 60694542 | + | chr11 | 60694676 | 60694890 | + | ENST00000453848; ENST00000005286 | TSF |
| 6% | chr11 | 60694460 | 60694542 | + | chr11 | 60694676 | 60694890 | + | ENST00000453848; ENST00000005286 | TSF |
| 6% | chr21 | 39513161 | 39513404 | + | chr21 | 39528398 | 39528496 | + | ENST00000357704; ENST00000400477 | TSF |
| 6% | chr8 | 100905650 | 100905547 | − | chr8 | 100899846 | 100899733 | − | ENST00000522934; ENST00000520517; ENST00000520468; ENST00000297564; ENST00000520271; ENST00000517682; ENST00000524245; ENST00000522940; ENST00000518171; ENST00000523016 | TSF |
| 6% | chr8 | 144691011 | 144690934 | − | chr8 | 144690296 | 144690232 | − | ENST00000220966; ENST00000433751 | TSF |
| 6% | chr8 | 144691011 | 144690934 | − | chr8 | 144690296 | 144690232 | − | ENST00000220966; ENST00000433751 | TSF |
| 6% | chr8 | 130855946 | 130855855 | − | chr8 | 130854451 | 130854388 | − | ENST00000519824; ENST00000522746; ENST00000523509; ENST00000401979; ENST00000519110; ENST00000522250; ENST00000517654; ENST00000519540; ENST00000522941 | TSF |
| 5% | chrX | 16671913 | 16671984 | + | chrX | 16672528 | 16672632 | + | ENST00000380200 | TSF |
| 5% | chr10 | 8110441 | 8110501 | + | chr10 | 8111436 | 8111561 | + | ENST00000379328; ENST00000346208 | TSF |
| 5% | chr9 | 95843657 | 95843805 | + | chr9 | 95846819 | 95846949; 95847029 | + | ENST00000465709; ENST00000375472; ENST00000375469; ENST00000471462 | TSF |
| 5% | chr9 | 95843657 | 95843805 | + | chr9 | 95846819 | 95846949; 95847029 | + | ENST00000465709; ENST00000375472; ENST00000375469; ENST00000471462 | TSF |
| 5% | chr12 | 51785233 | 51785272 | + | chr12 | 51834492 | 51834573 | + | ENST00000358657; ENST00000453097 | TSF |
| 5% | chr12 | 51785233 | 51785272 | + | chr12 | 51834492 | 51834573 | + | ENST00000358657; ENST00000453097 | TSF |
| 4% | chr21 | 38273278 | 38272892 | − | chr21 | 38269431 | 38269160 | − | ENST00000336648; ENST00000399120 | TSF |
| 4% | chr19 | 41514770 | 41514950 | + | chr19 | 41515124 | 41515300 | + | ENST00000324071 | TSF |
| 4% | chr15 | 39898214 | 39898131 | − | chr15 | 39893127 | 39893081 | − | ENST00000350221; ENST00000559547 | TSF |
| 4% | chr11 | 66048968 | 66049045 | + | chr11 | 66049730 | 66049798; 66049824 | + | ENST00000528852; ENST00000311445; ENST00000528063 | TSF |
| 4% | chr11 | 66048968 | 66049045 | + | chr11 | 66049730 | 66049798; 66049824 | + | ENST00000528852; ENST00000311445; ENST00000528063 | TSF |
| 4% | chr11 | 66048968 | 66049045 | + | chr11 | 66049730 | 66049798; 66049824 | + | ENST00000528852; ENST00000311445; ENST00000528063 | TSF |
| 4% | chr21 | 39513161 | 39513404 | + | chr21 | 39526527 | 39526623 | + | ENST00000357704; ENST00000400477 | TSF |
| 4% | chr1 | 156305455 | 156305264 | − | chr1 | 156304709 | 156304659 | − | ENST00000295688; ENST00000368258; ENST00000413555; ENST00000496684; ENST00000478640; ENST00000415548 | TSF |
| 4% | chr1 | 156305455 | 156305264 | − | chr1 | 156304709 | 156304659 | − | ENST00000295688; ENST00000368258; ENST00000413555; ENST00000496684; ENST00000478640; ENST00000415548 | TSF |
| 4% | chr1 | 156305455 | 156305264 | − | chr1 | 156304709 | 156304659 | − | ENST00000295688; ENST00000368258; ENST00000413555; ENST00000496684; ENST00000478640; ENST00000415548 | TSF |
| 4% | chr1 | 156305455 | 156305264 | − | chr1 | 156304709 | 156304659 | − | ENST00000295688; ENST00000368258; ENST00000413555; ENST00000496684; ENST00000478640; ENST00000415548 | TSF |
| 4% | chr1 | 156305455 | 156305264 | − | chr1 | 156304709 | 156304659 | − | ENST00000295688; ENST00000368258; ENST00000413555; ENST00000496684; ENST00000478640; ENST00000415548 | TSF |
| 4% | chr1 | 156305455 | 156305264 | − | chr1 | 156304709 | 156304659 | − | ENST00000295688; ENST00000368258; ENST00000413555; ENST00000496684; ENST00000478640; ENST00000415548 | TSF |
| 4% | chr6 | 152261756 | 152261988 | + | chr6 | 152265308 | 152265643 | + | ENST00000440973; ENST00000338799; ENST00000443427; ENST00000206249; ENST00000427531 | TSF |
| 4% | chr6 | 152261756 | 152261988 | + | chr6 | 152265308 | 152265643 | + | ENST00000440973; ENST00000338799; ENST00000443427; ENST00000206249; ENST00000427531 | TSF |
| 4% | chr20 | 45337040 | 45337192 | + | chr20 | 45353680 | 45354963 | + | ENST00000359271 | TSF |
| 4% | chr6 | 151755279 | 151755140 | − | chr6 | 151754365 | 151754290 | − | ENST00000367303; ENST00000444024 | TSF |
| 4% | chr6 | 151755279 | 151755140 | − | chr6 | 151754365 | 151754290 | − | ENST00000367303; ENST00000444024 | TSF |
| 4% | chr6 | 151784315 | 151784765 | + | chr6 | 151785588 | 151785753 | + | ENST00000367294; ENST00000545879 | TSF |

TABLE 10-continued

Transcript fusion for Breast Invasive Carcinoma (BRCA) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 4% | chr9 | 131902050 | 131902148 | + | chr9 | 131904724 | 131904831; 131905179 | + | ENST00000358994; ENST00000393370; ENST00000337738; ENST00000348141; ENST00000452489; ENST00000357197; ENST00000347048; ENST00000355007; ENST00000417728; ENST00000423100; ENST00000436883; ENST00000414510; ENST00000432124; ENST00000419582; ENST00000432651; ENST00000435132; ENST00000434095; ENST00000411917; ENST00000524946; ENST00000435305 | TSF |
| 4% | chr9 | 131902050 | 131902148 | + | chr9 | 131904724 | 131904831; 131905179 | + | ENST00000358994; ENST00000393370; ENST00000337738; ENST00000348141; ENST00000452489; ENST00000357197; ENST00000347048; ENST00000355007; ENST00000417728; ENST00000423100; ENST00000436883; ENST00000414510; ENST00000432124; ENST00000419582; ENST00000432651; ENST00000435132; ENST00000434095; ENST00000411917; ENST00000524946; ENST00000435305 | TSF |
| 4% | chr9 | 131902050 | 131902148 | + | chr9 | 131904724 | 131904831; 131905179 | + | ENST00000358994; ENST00000393370; ENST00000337738; ENST00000348141; ENST00000452489; ENST00000357197; ENST00000347048; ENST00000355007; ENST00000417728; ENST00000423100; ENST00000436883; ENST00000414510; ENST00000432124; ENST00000419582; ENST00000432651; ENST00000435132; ENST00000434095; ENST00000411917; ENST00000524946; ENST00000435305 | TSF |
| 4% | chr9 | 131902050 | 131902148 | + | chr9 | 131904724 | 131904831; 131905179 | + | ENST00000358994; ENST00000393370; ENST00000337738; ENST00000348141; ENST00000452489; ENST00000357197; ENST00000347048; ENST00000355007; ENST00000417728; ENST00000423100; ENST00000436883; ENST00000414510; ENST00000432124; ENST00000419582; ENST00000432651; ENST00000435132; ENST00000434095; ENST00000411917; ENST00000524946; ENST00000435305 | TSF |
| 4% | chr9 | 131902050 | 131902148 | + | chr9 | 131904724 | 131904831; 131905179 | + | ENST00000358994; ENST00000393370; ENST00000337738; ENST00000348141; ENST00000452489; ENST00000357197; ENST00000347048; ENST00000355007; ENST00000417728; ENST00000423100; ENST00000436883; ENST00000414510; ENST00000432124; ENST00000419582; ENST00000432651; ENST00000435132; ENST00000434095; ENST00000411917; ENST00000524946; ENST00000435305 | TSF |
| 4% | chr17 | 40820773 | 40820676 | − | chr17 | 40820321 | 40820145 | − | ENST00000591022; ENST00000412503; ENST00000293349 | TSF |
| 4% | chr22 | 22899971 | 22899965 | − | chr22 | 22893511 | 22893185; 22893189; 22893274; 22893481 | − | ENST00000406503; ENST00000398743; ENST00000398741; ENST00000543184; ENST00000405655; ENST00000402697; ENST00000439106; ENST00000438888; ENST00000420709; ENST00000403441; ENST00000442481 | TSF |
| 4% | chr22 | 22899971 | 22899965 | − | chr22 | 22893511 | 22893185; 22893189; 22893274; 22893481 | − | ENST00000406503; ENST00000398743; ENST00000398741; ENST00000543184; ENST00000405655; ENST00000402697; ENST00000439106; ENST00000438888; ENST00000420709; ENST00000403441; ENST00000442481 | TSF |
| 4% | chr22 | 22899971 | 22899965 | − | chr22 | 22893511 | 22893185; 22893189; 22893274; 22893481 | − | ENST00000406503; ENST00000398743; ENST00000398741; ENST00000543184; ENST00000405655; ENST00000402697; ENST00000439106; ENST00000438888; ENST00000420709; ENST00000403441; ENST00000442481 | TSF |

TABLE 10-continued

Transcript fusion for Breast Invasive Carcinoma (BRCA) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 4% | chr22 | 22899971 | 22899965 | − | chr22 | 22893511 | 22893185; 22893189; 22893274; 22893481 | − | ENST00000406503; ENST00000398743; ENST00000398741; ENST00000543184; ENST00000405655; ENST00000402697; ENST00000439106; ENST00000438888; ENST00000420709; ENST00000403441; ENST00000442481 | TSF |
| 4% | chr22 | 22899971 | 22899965 | − | chr22 | 22893511 | 22893185; 22893189; 22893274; 22893481 | − | ENST00000406503; ENST00000398743; ENST00000398741; ENST00000543184; ENST00000405655; ENST00000402697; ENST00000439106; ENST00000438888; ENST00000420709; ENST00000403441; ENST00000442481 | TSF |
| 4% | chr22 | 22899971 | 22899965 | − | chr22 | 22893511 | 22893185; 22893189; 22893274; 22893481 | − | ENST00000406503; ENST00000398743; ENST00000398741; ENST00000543184; ENST00000405655; ENST00000402697; ENST00000439106; ENST00000438888; ENST00000420709; ENST00000403441; ENST00000442481 | TSF |
| 4% | chr22 | 22899971 | 22899965 | − | chr22 | 22893511 | 22893185; 22893189; 22893274; 22893481 | − | ENST00000406503; ENST00000398743; ENST00000398741; ENST00000543184; ENST00000405655; ENST00000402697; ENST00000439106; ENST00000438888; ENST00000420709; ENST00000403441; ENST00000442481 | TSF |
| 3% | chr9 | 95777456 | 95777506 | + | chr9 | 95778019 | 95778111 | + | ENST00000375482; ENST00000416701; ENST00000337352; ENST00000467786 | TSF |
| 3% | chr9 | 95777456 | 95777506 | + | chr9 | 95778019 | 95778111 | + | ENST00000375482; ENST00000416701; ENST00000337352; ENST00000467786 | TSF |
| 3% | chr9 | 95777456 | 95777506 | + | chr9 | 95778019 | 95778111 | + | ENST00000375482; ENST00000416701; ENST00000337352; ENST00000467786 | TSF |
| 3% | chrX | 16718539 | 16718441 | − | chrX | 16717216 | 16717046 | − | ENST00000443824; ENST00000359276; ENST00000380241 | TSF |
| 3% | chr1 | 116205952 | 116206078 | + | chr1 | 116206282 | 116206889 | + | ENST00000355485; ENST00000369510; ENST00000310260; ENST00000369509 | TSF |
| 3% | chr17 | 64988088 | 64988129 | + | chr17 | 65014305 | 65014388 | + | ENST00000262138 | TSF |
| 3% | chr19 | 41311935 | 41312059 | + | chr19 | 41312460 | 41312579 | + | ENST00000303961; ENST00000406058; ENST00000593726 | TSF |
| 3% | chr16 | 78060352 | 78060356 | + | chr16 | 78062004 | 78062087 | + | ENST00000299642; ENST00000575655 | TSF |
| 3% | chr6 | 80022917 | 80022085 | − | chr6 | 79924739 | 79924689 | − | ENST00000275036; ENST00000344726 | TSF |
| 3% | chr6 | 80022917 | 80022085 | − | chr6 | 79924739 | 79924689 | − | ENST00000275036; ENST00000344726 | TSF |
| 3% | chr8 | 75580849 | 75580998 | + | chr8 | 75614614 | 75614691 | + | ENST00000523442; ENST00000523118 | TSF |
| 3% | chr2 | 171222296 | 171222632 | + | chr2 | 171225732 | 171225887 | + | ENST00000317935; ENST00000408978; ENST00000409044; ENST00000484338; ENST00000334231; ENST00000442690 | TSF |
| 3% | chr2 | 171222296 | 171222632 | + | chr2 | 171225732 | 171225887 | + | ENST00000317935; ENST00000408978; ENST00000409044; ENST00000484338; ENST00000334231; ENST00000442690 | TSF |
| 3% | chr2 | 171222296 | 171222632 | + | chr2 | 171225732 | 171225887 | + | ENST00000317935; ENST00000408978; ENST00000409044; ENST00000484338; ENST00000334231; ENST00000442690 | TSF |
| 3% | chr2 | 171222296 | 171222632 | + | chr2 | 171225732 | 171225887 | + | ENST00000317935; ENST00000408978; ENST00000409044; ENST00000484338; ENST00000334231; ENST00000442690 | TSF |
| 3% | chr2 | 171222296 | 171222632 | + | chr2 | 171225732 | 171225887 | + | ENST00000317935; ENST00000408978; ENST00000409044; ENST00000484338; ENST00000334231; ENST00000442690 | TSF |
| 3% | chr1 | 180281096 | 180280936 | − | chr1 | 180257652 | 180257498 | − | ENST00000367595 | TSF |
| 3% | chr7 | 16920082 | 16920016 | − | chr7 | 16913467 | 16913404 | − | ENST00000310398; ENST00000402239; ENST00000414935 | TSF |
| 3% | chr7 | 16920082 | 16920016 | − | chr7 | 16913467 | 16913404 | − | ENST00000310398; ENST00000402239; ENST00000414935 | TSF |
| 3% | chr7 | 16920082 | 16920016 | − | chr7 | 16913467 | 16913404 | − | ENST00000310398; ENST00000402239; ENST00000414935 | TSF |
| 3% | chr17 | 39976225 | 39976301 | + | chr17 | 39976521 | 39976713 | + | ENST00000321562; ENST00000455106; ENST00000544340 | TSF |
| 3% | chr2 | 132286104 | 132286168 | + | chr2 | 132287220 | 132287264 | + | ENST00000434330; ENST00000295171; ENST00000409856 | TSF |
| 3% | chr2 | 132286104 | 132286168 | + | chr2 | 132287220 | 132287264 | + | ENST00000434330; ENST00000295171; ENST00000409856 | TSF |

TABLE 10-continued

Transcript fusion for Breast Invasive Carcinoma (BRCA) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 3% | chr2 | 132286104 | 132286168 | + | chr2 | 132287220 | 132287264 | + | ENST00000434330; ENST00000295171; ENST00000409856 | TSF |
| 3% | chr20 | 14676179 | 14676510 | + | chr20 | 15210586 | 15210707 | + | ENST00000217246; ENST00000310348 | TSF |
| 3% | chr20 | 14676179 | 14676510 | + | chr20 | 15210586 | 15210707 | + | ENST00000217246; ENST00000310348 | TSF |
| 3% | chr17 | 37886362 | 37886333 | − | chr17 | 37886014 | 37885851; 37885938 | − | ENST00000577810; ENST00000394231 | TSF |
| 3% | chr17 | 37886362 | 37886333 | − | chr17 | 37886014 | 37885851; 37885938 | − | ENST00000577810; ENST00000394231 | TSF |
| 3% | chr10 | 117194803 | 117194993 | + | chr10 | 117221451 | 117221526; 117221545 | + | ENST00000526373; ENST00000355044; ENST00000423111 | TSF |
| 3% | chr10 | 117194803 | 117194993 | + | chr10 | 117221451 | 117221526; 117221545 | + | ENST00000526373; ENST00000355044; ENST00000423111 | TSF |
| 3% | chr1 | 165854440 | 165854616 | + | chr1 | 165859441 | 165859600 | + | ENST00000367879; ENST00000372212 | TSF |
| 3% | chr1 | 165854440 | 165854616 | + | chr1 | 165859441 | 165859600 | + | ENST00000367879; ENST00000372212 | TSF |
| 3% | chr10 | 37480642 | 37480864 | + | chr10 | 37481992 | 37482020 | + | ENST00000361713; ENST00000374660; ENST00000602533 | TSF |
| 3% | chr12 | 116400299 | 116400244 | − | chr12 | 116399203 | 116399071 | − | ENST00000281928 | TSF |
| 3% | chrX | 100655477 | 100654732 | − | chrX | 100653934 | 100653773 | − | ENST00000218516 | TSF |
| 3% | chr8 | 100901915 | 100901910 | − | chr8 | 100899846 | 100899733 | − | ENST00000522934; ENST00000520517; ENST00000520468; ENST00000297564; ENST00000520271; ENST00000517682; ENST00000524245; ENST00000522940; ENST00000518171; ENST00000523016 | TSF |
| 2% | chr1 | 47441646 | 47446228 | + | chr1 | 47581201 | 47581265 | + | ENST00000334194 | TSF |
| 2% | chr22 | 46768579 | 46768553 | − | chr22 | 46765701 | 46765589 | − | ENST00000262738 | TSF |
| 2% | chr11 | 77909738 | 77909743 | + | chr11 | 77910641 | 77910770 | + | ENST00000528910; ENST00000529308 | TSF |
| 2% | chr11 | 77909738 | 77909743 | + | chr11 | 77910641 | 77910770 | + | ENST00000528910; ENST00000529308 | TSF |
| 2% | chr2 | 182766065 | 182766115 | + | chr2 | 182766493 | 182767193 | + | ENST00000431877; ENST00000320370; ENST00000409001; ENST00000428267 | TSF |
| 2% | chr2 | 182766065 | 182766115 | + | chr2 | 182766493 | 182767193 | + | ENST00000431877; ENST00000320370; ENST00000409001; ENST00000428267 | TSF |
| 2% | chr2 | 182766065 | 182766115 | + | chr2 | 182766493 | 182767193 | + | ENST00000431877; ENST00000320370; ENST00000409001; ENST00000428267 | TSF |
| 2% | chr1 | 159928050 | 159927784 | − | chr1 | 182766493 | 159923099 | − | ENST00000368092; ENST00000368093 | TSF |
| 2% | chr1 | 159928050 | 159927784 | − | chr1 | 182766493 | 159923099 | − | ENST00000368092; ENST00000368093 | TSF |
| 2% | chr3 | 11645847 | 11645798 | − | chr3 | 11643496 | 11643307 | − | ENST00000273038; ENST00000430365; ENST00000404339; ENST00000445411; ENST00000418000; ENST00000458499; ENST00000417206; ENST00000419541 | TSF |
| 2% | chr3 | 11645847 | 11645798 | − | chr3 | 11643496 | 11643307 | − | ENST00000273038; ENST00000430365; ENST00000404339; ENST00000445411; ENST00000418000; ENST00000458499; ENST00000417206; ENST00000419541 | TSF |
| 2% | chr3 | 11645847 | 11645798 | − | chr3 | 11643496 | 11643307 | − | ENST00000273038; ENST00000430365; ENST00000404339; ENST00000445411; ENST00000418000; ENST00000458499; ENST00000417206; ENST00000419541 | TSF |
| 2% | chr3 | 11645847 | 11645798 | − | chr3 | 11643496 | 11643307 | − | ENST00000273038; ENST00000430365; ENST00000404339; ENST00000445411; ENST00000418000; ENST00000458499; ENST00000417206; ENST00000419541 | TSF |
| 2% | chr3 | 11645847 | 11645798 | − | chr3 | 11643496 | 11643307 | − | ENST00000273038; ENST00000430365; ENST00000404339; ENST00000445411; ENST00000418000; ENST00000458499; ENST00000417206; ENST00000419541 | TSF |
| 2% | chr3 | 11645847 | 11645798 | − | chr3 | 11643496 | 11643307 | − | ENST00000273038; ENST00000430365; ENST00000404339; ENST00000445411; ENST00000418000; ENST00000458499; ENST00000417206; ENST00000419541 | TSF |
| 2% | chr10 | 117875752 | 117875720 | − | chr10 | 117856275 | 117856166 | − | ENST00000439649; ENST00000369236; ENST00000355422; ENST00000544592; ENST00000369234 | TSF |
| 2% | chr10 | 117875752 | 117875720 | − | chr10 | 117856275 | 117856166 | − | ENST00000439649; ENST00000369236; ENST00000355422; ENST00000544592; ENST00000369234 | TSF |
| 2% | chr19 | 16267516 | 16267584 | + | chr19 | 16268020 | 16268139; 16268205; 16268208; 16268448 | + | ENST00000593031; ENST00000397372; ENST00000253680; ENST00000593154; ENST00000588246 | TSF |
| 2% | chr19 | 16267516 | 16267584 | + | chr19 | 16268020 | 16268139; 16268205; 16268208; 16268448 | + | ENST00000593031; ENST00000397372; ENST00000253680; ENST00000593154; ENST00000588246 | TSF |

TABLE 10-continued

Transcript fusion for Breast Invasive Carcinoma (BRCA) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 2% | chr19 | 16267516 | 16267584 | + | chr19 | 16268020 | 16268139; 16268205; 16268208; 16268448 | + | ENST00000593031; ENST00000397372; ENST00000253680; ENST00000593154; ENST00000588246 | TSF |
| 2% | chr19 | 16267516 | 16267584 | + | chr19 | 16268020 | 16268139; 16268205; 16268208; 16268448 | + | ENST00000593031; ENST00000397372; ENST00000253680; ENST00000593154; ENST00000588246 | TSF |
| 2% | chr19 | 1114930 | 1114676 | − | chr19 | 1114421 | 1114230 | − | ENST00000361757; ENST00000587024; ENST00000438103 | TSF |
| 2% | chr8 | 69544201 | 69545202 | + | chr8 | 69552611 | 69552746 | + | ENST00000539993; ENST00000518698; ENST00000337103; ENST00000325233 | TSF |
| 2% | chr8 | 69544201 | 69545202 | + | chr8 | 69552611 | 69552746 | + | ENST00000539993; ENST00000518698; ENST00000337103; ENST00000325233 | TSF |
| 2% | chr19 | 45571855 | 45571862 | + | chr19 | 45572324 | 45572336; 45572382 | + | ENST00000391952; ENST00000221455; ENST00000391953; ENST00000544944; ENST00000591904 | TSF |
| 2% | chr19 | 45571855 | 45571862 | + | chr19 | 45572324 | 45572336; 45572382 | + | ENST00000391952; ENST00000221455; ENST00000391953; ENST00000544944; ENST00000591904 | TSF |
| 2% | chr19 | 45571855 | 45571862 | + | chr19 | 45572324 | 45572336; 45572382 | + | ENST00000391952; ENST00000221455; ENST00000391953; ENST00000544944; ENST00000591904 | TSF |
| 2% | chr5 | 15934695 | 15934710 | + | chr5 | 15936559 | 15937295 | + | ENST00000504595; ENST00000510662; ENST00000329673 | TSF |
| 2% | chrX | 80474528 | 80474722 | + | chrX | 80532483 | 80532668 | + | ENST00000373212 | TSF |
| 2% | chr15 | 74004214 | 74004264 | + | chr15 | 74005275 | 74005297 | + | ENST00000318443; ENST00000537340; ENST00000318424; ENST00000564751; ENST00000561176; ENST00000559073 | TSF |
| 2% | chr1 | 12002791 | 12002835 | + | chr1 | 12008033 | 12008124 | + | ENST00000449038; ENST00000376369; ENST00000429000; ENST00000196061 | TSF |
| 2% | chr1 | 12002791 | 12002835 | + | chr1 | 12008033 | 12008124 | + | ENST00000449038; ENST00000376369; ENST00000429000; ENST00000196061 | TSF |
| 2% | chr1 | 12002791 | 12002835 | + | chr1 | 12008033 | 12008124 | + | ENST00000449038; ENST00000376369; ENST00000429000; ENST00000196061 | TSF |
| 2% | chr1 | 246547998 | 246547930 | − | chr1 | 246518396 | 246518333 | − | ENST00000388985; ENST00000403792 | TSF |
| 2% | chr1 | 246547998 | 246547930 | − | chr1 | 246518396 | 246518333 | − | ENST00000388985; ENST00000403792 | TSF |
| 2% | chr7 | 94018505 | 94018589 | + | chr7 | 94057748 | 94057789 | + | ENST00000297268 | TSF |
| 2% | chr12 | 58189709 | 58189746 | + | chr12 | 58189960 | 58189980; 58190044; 58190366 | + | ENST00000540550; ENST00000457189; ENST00000454289; ENST00000323833; ENST00000350762 | TSF |
| 2% | chr12 | 58189709 | 58189746 | + | chr12 | 58189960 | 58189980; 58190044; 58190366 | + | ENST00000540550; ENST00000457189; ENST00000454289; ENST00000323833; ENST00000350762 | TSF |
| 2% | chr12 | 58189709 | 58189746 | + | chr12 | 58189960 | 58189980; 58190044; 58190366 | + | ENST00000540550; ENST00000457189; ENST00000454289; ENST00000323833; ENST00000350762 | TSF |
| 2% | chr14 | 100581223 | 100581300 | + | chr14 | 100589876 | 100589907; 100589939 | + | ENST00000555706; ENST00000402714; ENST00000544450; ENST00000392920; ENST00000557153; ENST00000557384 | TSF |
| 2% | chr14 | 100581223 | 100581300 | + | chr14 | 100589876 | 100589907; 100589939 | + | ENST00000555706; ENST00000402714; ENST00000544450; ENST00000392920; ENST00000557153; ENST00000557384 | TSF |
| 2% | chr14 | 100581223 | 100581300 | + | chr14 | 100589876 | 100589907; 100589939 | + | ENST00000555706; ENST00000402714; ENST00000544450; ENST00000392920; ENST00000557153; ENST00000557384 | TSF |
| 2% | chr14 | 100581223 | 100581300 | + | chr14 | 100589876 | 100589907; 100589939 | + | ENST00000555706; ENST00000402714; ENST00000544450; ENST00000392920; ENST00000557153; ENST00000557384 | TSF |
| 2% | chr14 | 100581223 | 100581300 | + | chr14 | 100589876 | 100589907; 100589939 | + | ENST00000555706; ENST00000402714; ENST00000544450; ENST00000392920; ENST00000557153; ENST00000557384 | TSF |
| 2% | chr19 | 50174724 | 50174836 | + | chr19 | 50176955 | 50177005; 50177034 | + | ENST00000441864; ENST00000246785; ENST00000598306; ENST00000600947 | TSF |
| 2% | chr19 | 50174724 | 50174836 | + | chr19 | 50176955 | 50177005; 50177034 | + | ENST00000441864; ENST00000246785; ENST00000598306; ENST00000600947 | TSF |
| 2% | chr1 | 169819657 | 169819707 | + | chr1 | 169820958 | 169821077 | + | ENST00000359326; ENST00000286031 | TSF |
| 2% | chrX | 80467099 | 80467350 | + | chrX | 80532483 | 80532668 | + | ENST00000373212 | TSF |
| 2% | chr11 | 60694460 | 60694539 | + | chr11 | 60694676 | 60694890 | + | ENST00000453848; ENST00000005286 | TSF |
| 2% | chr11 | 60694460 | 60694539 | + | chr11 | 60694676 | 60694890 | + | ENST00000453848; ENST00000005286 | TSF |
| 2% | chr1 | 23762222 | 23762216 | − | chr1 | 23761111 | 23761026 | − | ENST00000495646; ENST00000336689; ENST00000437606 | TSF |

TABLE 10-continued

Transcript fusion for Breast Invasive Carcinoma (BRCA) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 2% | chr1 | 156716197 | 156716133 | − | chr1 | 156715165 | 156715089 | − | ENST00000357325; ENST00000537739; ENST00000368209; ENST00000368206 | TSF |
| 2% | chr17 | 45698288 | 45698367 | + | chr17 | 45699134 | 45699286 | + | ENST00000530173; ENST00000322157; ENST00000544660; ENST00000528565 | TSF |
| 2% | chr4 | 77020173 | 77020223 | + | chr4 | 77021444 | 77021473 | + | ENST00000341029; ENST00000349321; ENST00000355810; ENST00000511188 | TSF |
| 2% | chr4 | 77020173 | 77020223 | + | chr4 | 77021444 | 77021473 | + | ENST00000341029; ENST00000349321; ENST00000355810; ENST00000511188 | TSF |
| 2% | chr4 | 77020173 | 77020223 | + | chr4 | 77021444 | 77021473 | + | ENST00000341029; ENST00000349321; ENST00000355810; ENST00000511188 | TSF |
| 2% | chr4 | 77020173 | 77020223 | + | chr4 | 77021444 | 77021473 | + | ENST00000341029; ENST00000349321; ENST00000355810; ENST00000511188 | TSF |
| 2% | chr17 | 39974832 | 39974893 | + | chr17 | 39975462 | 39975651 | + | ENST00000321562 | TSF |
| 2% | chr8 | 117662244 | 117662067 | − | chr8 | 117661165 | 117661045 | − | ENST00000521861; ENST00000276682; ENST00000518949 | TSF |
| 2% | chr8 | 117662244 | 117662067 | − | chr8 | 117661165 | 117661045 | − | ENST00000521861; ENST00000276682; ENST00000518949 | TSF |
| 2% | chr18 | 20590293 | 20590383 | + | chr18 | 20596791 | 20596887 | + | ENST00000327155; ENST00000399722; ENST00000360790; ENST00000583057 | TSF |
| 2% | chr18 | 20590293 | 20590383 | + | chr18 | 20596791 | 20596887 | + | ENST00000327155; ENST00000399722; ENST00000360790; ENST00000583057 | TSF |
| 2% | chr1 | 155031050 | 155031103 | + | chr1 | 155031186 | 155031263 | + | ENST00000355956; ENST00000356955; ENST00000359280; ENST00000360674; ENST00000368412; ENST00000449910; ENST00000526491; ENST00000529473; ENST00000368410; ENST00000271836; ENST00000368413; ENST00000531455 | TSF |
| 2% | chr1 | 155031050 | 155031103 | + | chr1 | 155031186 | 155031263 | + | ENST00000355956; ENST00000356955; ENST00000359280; ENST00000360674; ENST00000368412; ENST00000449910; ENST00000526491; ENST00000529473; ENST00000368410; ENST00000271836; ENST00000368413; ENST00000531455 | TSF |
| 2% | chr1 | 155031050 | 155031103 | + | chr1 | 155031186 | 155031263 | + | ENST00000355956; ENST00000356955; ENST00000359280; ENST00000360674; ENST00000368412; ENST00000449910; ENST00000526491; ENST00000529473; ENST00000368410; ENST00000271836; ENST00000368413; ENST00000531455 | TSF |
| 2% | chr1 | 155031050 | 155031103 | + | chr1 | 155031186 | 155031263 | + | ENST00000355956; ENST00000356955; ENST00000359280; ENST00000360674; ENST00000368412; ENST00000449910; ENST00000526491; ENST00000529473; ENST00000368410; ENST00000271836; ENST00000368413; ENST00000531455 | TSF |
| 2% | chr1 | 155031050 | 155031103 | + | chr1 | 155031186 | 155031263 | + | ENST00000355956; ENST00000356955; ENST00000359280; ENST00000360674; ENST00000368412; ENST00000449910; ENST00000526491; ENST00000529473; ENST00000368410; ENST00000271836; ENST00000368413; ENST00000531455 | TSF |
| 2% | chr1 | 155031050 | 155031103 | + | chr1 | 155031186 | 155031263 | + | ENST00000355956; ENST00000356955; ENST00000359280; ENST00000360674; ENST00000368412; ENST00000449910; ENST00000526491; ENST00000529473; ENST00000368410; ENST00000271836; ENST00000368413; ENST00000531455 | TSF |
| 2% | chr1 | 155031050 | 155031103 | + | chr1 | 155031186 | 155031263 | + | ENST00000355956; ENST00000356955; ENST00000359280; ENST00000360674; ENST00000368412; ENST00000449910; ENST00000526491; ENST00000529473; ENST00000368410; ENST00000271836; ENST00000368413; ENST00000531455 | TSF |
| 2% | chr1 | 155031050 | 155031103 | + | chr1 | 155031186 | 155031263 | + | ENST00000355956; ENST00000356955; ENST00000359280; ENST00000360674; ENST00000368412; ENST00000449910; ENST00000526491; ENST00000529473; ENST00000368410; ENST00000271836; ENST00000368413; ENST00000531455 | TSF |
| 2% | chr1 | 155031050 | 155031103 | + | chr1 | 155031186 | 155031263 | + | ENST00000355956; ENST00000356955; ENST00000359280; ENST00000360674; ENST00000368412; ENST00000449910; ENST00000526491; ENST00000529473; ENST00000368410; ENST00000271836; ENST00000368413; ENST00000531455 | TSF |

TABLE 10-continued

Transcript fusion for Breast Invasive Carcinoma (BRCA) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 2% | chr8 | 104389530 | 104389536 | + | chr8 | 104390255 | 104390471 | + | ENST00000330295; ENST00000520337 | TSF |
| 2% | chr2 | 171222296 | 171222628 | + | chr2 | 171225732 | 171225887 | + | ENST00000317935; ENST00000408978; ENST00000409044; ENST00000484338; ENST00000334231; ENST00000442690 | TSF |
| 2% | chr2 | 171222296 | 171222628 | + | chr2 | 171225732 | 171225887 | + | ENST00000317935; ENST00000408978; ENST00000409044; ENST00000484338; ENST00000334231; ENST00000442690 | TSF |
| 2% | chr2 | 171222296 | 171222628 | + | chr2 | 171225732 | 171225887 | + | ENST00000317935; ENST00000408978; ENST00000409044; ENST00000484338; ENST00000334231; ENST00000442690 | TSF |
| 2% | chr2 | 171222296 | 171222628 | + | chr2 | 171225732 | 171225887 | + | ENST00000317935; ENST00000408978; ENST00000409044; ENST00000484338; TENST00000334231; ENS00000442690 | TSF |
| 2% | chr2 | 171222296 | 171222628 | + | chr2 | 171225732 | 171225887 | + | ENST00000317935; ENST00000408978; ENST00000409044; ENST00000484338; ENST00000334231; ENST00000442690 | TSF |
| 2% | chr1 | 23397020 | 23397118 | + | chr1 | 23397718 | 23397852 | + | ENST00000356634; ENST00000400181; ENST00000542151 | TSF |
| 2% | chr6 | 123101055 | 123101091 | + | chr6 | 123101436 | 123101608 | + | ENST00000368444; ENST00000356535 | TSF |
| 2% | chr6 | 123101055 | 123101091 | + | chr6 | 123101436 | 123101608 | + | ENST00000368444; ENST00000356535 | TSF |
| 2% | chr12 | 6602868 | 6602754 | − | chr12 | 6602138 | 6602028 | − | ENST00000229238 | TSF |
| 2% | chr8 | 117816470 | 117816753 | + | chr8 | 117861127 | 117861256; 117861276 | + | ENST00000517820; ENST00000520733 | TSF |
| 2% | chr8 | 117816470 | 117816753 | + | chr8 | 117861127 | 117861256; 117861276 | + | ENST00000517820; ENST00000520733 | TSF |
| 2% | chr1 | 47345017 | 47346314 | + | chr1 | 47581201 | 47581265 | + | ENST00000334194 | TSF |
| 2% | chr1 | 31218846 | 31218765 | − | chr1 | 31215396 | 31215303 | − | ENST00000294507 | TSF |
| 2% | chr12 | 15296492 | 15296463 | − | chr12 | 15274053 | 15273997; 15273999 | − | ENST00000256953; ENST00000538313; ENST00000536465; ENST00000545567; TENST00000537647; ENS00000393736 | TSF |
| 2% | chr12 | 15296492 | 15296463 | − | chr12 | 15274053 | 15273997; 15273999 | − | ENST00000256953; ENST00000538313; ENST00000536465; ENST00000545567; ENST00000537647; ENST00000393736 | TSF |
| 2% | chr12 | 15296492 | 15296463 | − | chr12 | 15274053 | 15273997; 15273999 | − | ENST00000256953; ENST00000538313; ENST00000536465; ENST00000545567; ENST00000537647; ENST00000393736 | TSF |
| 2% | chr12 | 15296492 | 15296463 | − | chr12 | 15274053 | 15273997; 15273999 | − | ENST00000256953; ENST00000538313; ENST00000536465; ENST00000545567; ENST00000537647; ENST00000393736 | TSF |
| 2% | chr1 | 246581335 | 246580598 | − | chr1 | 246498776 | 246498669 | − | ENST00000541742; ENST00000490107; ENST00000388985; ENST00000453676; ENST00000403792; ENST00000455277 | TSF |
| 2% | chr1 | 246581335 | 246580598 | − | chr1 | 246498776 | 246498669 | − | ENST00000541742; ENST00000490107; ENST00000388985; ENST00000453676; ENST00000403792; ENST00000455277 | TSF |
| 2% | chr1 | 246581335 | 246580598 | − | chr1 | 246498776 | 246498669 | − | ENST00000541742; ENST00000490107; ENST00000388985; ENST00000453676; ENST00000403792; ENST00000455277 | TSF |
| 2% | chr1 | 246581335 | 246580598 | − | chr1 | 246498776 | 246498669 | − | ENST00000541742; ENST00000490107; ENST00000388985; ENST00000453676; ENST00000403792; ENST00000455277 | TSF |
| 2% | chr3 | 148570083 | 148570155 | + | chr3 | 148575244 | 148575328 | + | ENST00000491148; ENST00000282957 | TSF |
| 2% | chr20 | 18509077 | 18509137 | + | chr20 | 18511324 | 18511447 | + | ENST00000262544; ENST00000336714; ENST00000377475; ENST00000377465 | TSF |
| 2% | chr1 | 59843828 | 59844080 | + | chr1 | 59844421 | 59844509 | + | ENST00000413489; ENST00000371218; ENST00000303721; ENST00000430447; ENST00000371212 | TSF |
| 2% | chr1 | 59843828 | 59844080 | + | chr1 | 59844421 | 59844509 | + | ENST00000413489; ENST00000371218; ENST00000303721; ENST00000430447; ENST00000371212 | TSF |
| 2% | chr1 | 59843828 | 59844080 | + | chr1 | 59844421 | 59844509 | + | ENST00000413489; ENST00000371218; ENST00000303721; ENST00000430447; ENST00000371212 | TSF |
| 2% | chr1 | 59843828 | 59844080 | + | chr1 | 59844421 | 59844509 | + | ENST00000413489; ENST00000371218; ENST00000303721; ENST00000430447; ENST00000371212 | TSF |
| 2% | chr7 | 55464873 | 55464924 | + | chr7 | 55466116 | 55466323 | + | ENST00000254770 | TSF |
| 2% | chr4 | 95982945 | 95983291 | + | chr4 | 96025559 | 96025718 | + | ENST00000440890 | TSF |
| 2% | chr7 | 55985644 | 55985990 | + | chr7 | 55990855 | 55990981 | + | ENST00000426595; ENST00000429591 | TSF |
| 2% | chr7 | 55985644 | 55985990 | + | chr7 | 55990855 | 55990981 | + | ENST00000426595; ENST00000429591 | TSF |
| 2% | chr12 | 50389576 | 50389433 | − | chr12 | 50388292 | 50388197 | − | ENST00000427314; ENST00000312377; ENST00000434422; ENST00000454520; ENST00000551016; ENST00000547905; ENST00000549342 | TSF |

TABLE 10-continued

Transcript fusion for Breast Invasive Carcinoma (BRCA) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 2% | chr12 | 50389576 | 50389433 | − | chr12 | 50388292 | 50388197 | − | ENST00000427314; ENST00000312377; ENST00000434422; ENST00000454520; ENST00000551016; ENST00000547905; ENST00000549342 | TSF |
| 2% | chr8 | 100902036 | 100901972 | − | chr8 | 100899846 | 100899733 | − | ENST00000522934; ENST00000520517; ENST00000520468; ENST00000297564; ENST00000520271; ENST00000517682; ENST00000524245; ENST00000522940; ENST00000518171; ENST00000523016 | TSF |
| 2% | chr1 | 224493544 | 224493476 | − | chr1 | 224492868 | 224492736 | − | ENST00000469968; ENST00000391875; ENST00000281701; ENST00000469075; ENST00000361463; ENST00000467882; ENST00000488718; ENST00000492281; ENST00000436927 | TSF |
| 2% | chr1 | 224493544 | 224493476 | − | chr1 | 224492868 | 224492736 | − | ENST00000469968; ENST00000391875; ENST00000281701; ENST00000469075; ENST00000361463; ENST00000467882; ENST00000488718; ENST00000492281; ENST00000436927 | TSF |
| 2% | chr1 | 224493544 | 224493476 | − | chr1 | 224492868 | 224492736 | − | ENST00000469968; ENST00000391875; ENST00000281701; ENST00000469075; ENST00000361463; ENST00000467882; ENST00000488718; ENST00000492281; ENST00000436927 | TSF |
| 2% | chr1 | 224493544 | 224493476 | − | chr1 | 224492868 | 224492736 | − | ENST00000469968; ENST00000391875; ENST00000281701; ENST00000469075; ENST00000361463; ENST00000467882; ENST00000488718; ENST00000492281; ENST00000436927 | TSF |
| 2% | chr1 | 224493544 | 224493476 | − | chr1 | 224492868 | 224492736 | − | ENST00000469968; ENST00000391875; ENST00000281701; ENST00000469075; ENST00000361463; ENST00000467882; ENST00000488718; ENST00000492281; ENST00000436927 | TSF |
| 2% | chr22 | 29117574 | 29117506 | − | chr22 | 29115473 | 29115383; 29115458 | − | ENST00000348295; ENST00000382566; ENST00000382578; ENST00000404276; ENST00000328354; ENST00000405598; ENST00000382580; ENST00000433728; ENST00000402731; ENST00000403642; ENST00000439200; ENST00000448511 | TSF |
| 2% | chr22 | 29117574 | 29117506 | − | chr22 | 29115473 | 29115383; 29115458 | − | ENST00000348295; ENST00000382566; ENST00000382578; ENST00000404276; ENST00000328354; ENST00000405598; ENST00000382580; ENST00000433728; ENST00000402731; ENST00000403642; ENST00000439200; ENST00000448511 | TSF |
| 2% | chr22 | 29117574 | 29117506 | − | chr22 | 29115473 | 29115383; 29115458 | − | ENST00000348295; ENST00000382566; ENST00000382578; ENST00000404276; ENST00000328354; ENST00000405598; ENST00000382580; ENST00000433728; ENST00000402731; ENST00000403642; ENST00000439200; ENST00000448511 | TSF |
| 2% | chr22 | 29117574 | 29117506 | − | chr22 | 29115473 | 29115383; 29115458 | − | ENST00000348295; ENST00000382566; ENST00000382578; ENST00000404276; ENST00000328354; ENST00000405598; ENST00000382580; ENST00000433728; ENST00000402731; ENST00000403642; ENST00000439200; ENST00000448511 | TSF |
| 2% | chr22 | 29117574 | 29117506 | − | chr22 | 29115473 | 29115383; 29115458 | − | ENST00000348295; ENST00000382566; ENST00000382578; ENST00000404276; ENST00000328354; ENST00000405598; ENST00000382580; ENST00000433728; ENST00000402731; ENST00000403642; ENST00000439200; ENST00000448511 | TSF |
| 2% | chr8 | 133672763 | 133672739 | − | chr8 | 133669153 | 133669076 | − | ENST00000519595; ENST00000518642; ENST00000250173; ENST00000522584 | TSF |
| 2% | chr8 | 133672763 | 133672739 | − | chr8 | 133669153 | 133669076 | − | ENST00000519595; ENST00000518642; ENST00000250173; ENST00000522584 | TSF |
| 2% | chr8 | 133672763 | 133672739 | − | chr8 | 133669153 | 133669076 | − | ENST00000519595; ENST00000518642; ENST00000250173; ENST00000522584 | TSF |
| 1% | chr10 | 27470588 | 27470654 | + | chr10 | 27475308 | 27475465 | + | ENST00000375946; ENST00000375940; ENST00000342386 | TSF |

TABLE 10-continued

Transcript fusion for Breast Invasive Carcinoma (BRCA) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 1% | chr7 | 56018506 | 56018522 | + | chr7 | 56022602 | 56022865; 56022871 | + | ENST00000443449; ENST00000426595; ENST00000285298 | TSF |
| 1% | chr7 | 56018506 | 56018522 | + | chr7 | 56022602 | 56022865; 56022871 | + | ENST00000443449; ENST00000426595; ENST00000285298 | TSF |
| 1% | chr3 | 187087097 | 187087144 | + | chr3 | 187088576 | 187089161 | + | ENST00000259030 | TSF |
| 1% | chr20 | 32404108 | 32404149 | + | chr20 | 32436273 | 32436450 | + | ENST00000217402 | TSF |
| 1% | chr14 | 100606667 | 100606856 | + | chr14 | 100607517 | 100607583 | + | ENST00000402714; ENST00000392920; ENST00000554695 | TSF |
| 1% | chr17 | 72951257 | 72951178 | − | chr17 | 72950460 | 72950233 | − | ENST00000425042 | TSF |
| 1% | chr17 | 39737300 | 39737191 | − | chr17 | 39726472 | 39726390 | − | ENST00000246662 | TSF |
| 1% | chr2 | 163040340 | 163040253 | − | chr2 | 163039978 | 163039924 | − | ENST00000188790; ENST00000443424 | TSF |
| 1% | chr3 | 197640178 | 197640160 | − | chr3 | 197639620 | 197639546 | − | ENST00000265239; ENST00000455191 | TSF |
| 1% | chr19 | 20737134 | 20737096 | − | chr19 | 20736641 | 20736515; 20736611 | − | ENST00000427401; ENST00000596797; ENST00000597940 | TSF |
| 1% | chr19 | 20737134 | 20737096 | − | chr19 | 20736641 | 20736515; 20736611 | − | ENST00000427401; ENST00000596797; ENST00000597940 | TSF |
| 1% | chr19 | 20737134 | 20737096 | − | chr19 | 20736641 | 20736515; 20736611 | − | ENST00000427401; ENST00000596797; ENST00000597940 | TSF |
| 1% | chr15 | 91529041 | 91528993 | − | chr15 | 91528055 | 91527923 | − | ENST00000394249; ENST00000361919; ENST00000361188; ENST00000442656; ENST00000557905; ENST00000559811 | TSF |
| 1% | chr15 | 91529041 | 91528993 | − | chr15 | 91528055 | 91527923 | − | ENST00000394249; ENST00000361919; ENST00000361188; ENST00000442656; ENST00000557905; ENST00000559811 | TSF |
| 1% | chr15 | 91529041 | 91528993 | − | chr15 | 91528055 | 91527923 | − | ENST00000394249; ENST00000361919; ENST00000361188; ENST00000442656; ENST00000557905; ENST00000559811 | TSF |
| 1% | chr15 | 91529041 | 91528993 | − | chr15 | 91528055 | 91527923 | − | ENST00000394249; ENST00000361919; ENST00000361188; ENST00000442656; ENST00000557905; ENST00000559811 | TSF |
| 1% | chr15 | 91529041 | 91528993 | − | chr15 | 91528055 | 91527923 | − | ENST00000394249; ENST00000361919; ENST00000361188; ENST00000442656; ENST00000557905; ENST00000559811 | TSF |
| 1% | chr15 | 91529041 | 91528993 | − | chr15 | 91528055 | 91527923 | − | ENST00000394249; ENST00000361919; ENST00000361188; ENST00000442656; ENST00000557905; ENST00000559811 | TSF |
| 1% | chr2 | 99315948 | 99315517 | − | chr2 | 99294934 | 99294767 | − | ENST00000264968; ENST00000393487; ENST00000409391 | TSF |
| 1% | chr22 | 24967426 | 24967475 | + | chr22 | 24967884 | 24967945 | + | ENST00000215829; ENST00000404603 | TSF |
| 1% | chr10 | 37468901 | 37469123 | + | chr10 | 37481992 | 37482020 | + | ENST00000361713; ENST00000374660; ENST00000602533 | TSF |
| 1% | chr19 | 55501071 | 55501120 | + | chr19 | 55501390 | 55501464; 55501560 | + | ENST00000543277; ENST00000543010; ENST00000391721; ENST00000339757; ENST00000448584; ENST00000537859; ENST00000427260; ENST00000538819; ENST00000263437 | TSF |
| 1% | chr19 | 55501071 | 55501120 | + | chr19 | 55501390 | 55501464; 55501560 | + | ENST00000543277; ENST00000543010; ENST00000391721; ENST00000339757; ENST00000448584; ENST00000537859; ENST00000427260; ENST00000538819; ENST00000263437 | TSF |
| 1% | chr4 | 40352026 | 40352049 | + | chr4 | 40355996 | 40356537 | + | ENST00000310169 | TSF |
| 1% | chr10 | 37457109 | 37457331 | + | chr10 | 37481992 | 37482020 | + | ENST00000361713; ENST00000374660; ENST00000602533 | TSF |
| 1% | chr19 | 58366263 | 58366313 | + | chr19 | 58367475 | 58367491; 58367601 | + | ENST00000316462; ENST00000604231; ENST00000598031; ENST00000339656; ENST00000603271; ENST00000423137 | TSF |
| 1% | chr19 | 58366263 | 58366313 | + | chr19 | 58367475 | 58367491; 58367601 | + | ENST00000316462; ENST00000604231; ENST00000598031; ENST00000339656; ENST00000603271; ENST00000423137 | TSF |
| 1% | chr19 | 58366263 | 58366313 | + | chr19 | 58367475 | 58367491; 58367601 | + | ENST00000316462; ENST00000604231; ENST00000598031; ENST00000339656; ENST00000603271; ENST00000423137 | TSF |
| 1% | chr19 | 58366263 | 58366313 | + | chr19 | 58367475 | 58367491; 58367601 | + | ENST00000316462; ENST00000604231; ENST00000598031; ENST00000339656; ENST00000603271; ENST00000423137 | TSF |
| 1% | chr16 | 89649823 | 89649851 | + | chr16 | 89650105 | 89650179 | + | ENST00000268720; ENST00000319518 | TSF |
| 1% | chr1 | 154581117 | 154581067 | − | chr1 | 154575102 | 154573517 | − | ENST00000292205; ENST00000368474; ENST00000529168 | TSF |
| 1% | chr1 | 154581117 | 154581067 | − | chr1 | 154575102 | 154573517 | − | ENST00000292205; ENST00000368474; ENST00000529168 | TSF |

TABLE 10-continued

Transcript fusion for Breast Invasive Carcinoma (BRCA) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 1% | chr2 | 101024262 | 101024202 | − | chr2 | 101023169 | 101023038 | − | ENST00000542617; ENST00000448989 | TSF |
| 1% | chr2 | 101024262 | 101024202 | − | chr2 | 101023169 | 101023038 | − | ENST00000542617; ENST00000448989 | TSF |
| 1% | chr1 | 17371820 | 17371636 | − | chr1 | 17371383 | 17371256 | − | ENST00000375499 | TSF |
| 1% | chr1 | 84740629 | 84740758 | + | chr1 | 84791320 | 84791431 | + | ENST00000370673; ENST00000370671; ENST00000394834; ENST00000370669; ENST00000370668; ENST00000370670 | TSF |
| 1% | chr1 | 26595323 | 26595855 | + | chr1 | 26595951 | 26596105 | + | ENST00000451429; ENST00000476272; ENST00000252992; ENST00000453146 | TSF |
| 1% | chr1 | 26595323 | 26595855 | + | chr1 | 26595951 | 26596105 | + | ENST00000451429; ENST00000476272; ENST00000252992; ENST00000453146 | TSF |
| 1% | chr2 | 189864980 | 189865248 | + | chr2 | 189866123 | 189866176 | + | ENST00000304636; ENST00000317840 | TSF |
| 1% | chr2 | 189864980 | 189865248 | + | chr2 | 189866123 | 189866176 | + | ENST00000304636; ENST00000317840 | TSF |
| 1% | chr4 | 95985713 | 95986245 | + | chr4 | 96025559 | 96025718 | + | ENST00000440890 | TSF |
| 1% | chr8 | 69544201 | 69545202 | + | chr8 | 69621229 | 69621314 | + | ENST00000539993; ENST00000518698; ENST00000337103; ENST00000325233 | TSF |
| 1% | chr8 | 69544201 | 69545202 | + | chr8 | 69621229 | 69621314 | + | ENST00000539993; ENST00000518698; ENST00000337103; ENST00000325233 | TSF |
| 1% | chr18 | 77906423 | 77906530 | + | chr18 | 77933763 | 77933818 | + | ENST00000589574 | TSF |
| 1% | chr14 | 24105943 | 24105981 | + | chr14 | 24108127 | 24108213 | + | ENST00000432832; ENST00000250383; ENST00000344777 | TSF |
| 1% | chr14 | 24105943 | 24105981 | + | chr14 | 24108127 | 24108213 | + | ENST00000432832; ENST00000250383; 3ENST0000044777 | TSF |
| 1% | chr14 | 24105943 | 24105981 | + | chr14 | 24108127 | 24108213 | + | ENST00000432832; ENST00000250383; ENST00000344777 | TSF |
| 1% | chr8 | 67752911 | 67753611 | + | chr8 | 67753259 | 67753345 | + | ENST00000519289; ENST00000521198; ENST00000522398; ENST00000520976; ENST00000396596; ENST00000345714 | TSF |
| 1% | chr8 | 67752911 | 67753611 | + | chr8 | 67753259 | 67753345 | + | ENST00000519289; ENST00000521198; ENST00000522398; ENST00000520976; ENST00000396596; ENST00000345714 | TSF |
| 1% | chr4 | 76893390 | 76893322 | − | chr4 | 76892611 | 76892510 | − | ENST00000356260; ENST00000395711 | TSF |
| 1% | chr17 | 39696711 | 39696603 | − | chr17 | 39681525 | 39681443 | − | ENST00000361566; ENST00000455635 | TSF |
| 1% | chr17 | 39696711 | 39696603 | − | chr17 | 39681525 | 39681443 | − | ENST00000361566; ENST00000455635 | TSF |
| 1% | chr3 | 195593372 | 195593261 | − | chr3 | 195591058 | 195591052 | − | ENST00000416152; ENST00000381916; ENST00000333602; ENST00000428187; ENST00000392400 | TSF |
| 1% | chr3 | 123694808 | 123694754 | − | chr3 | 123694387 | 123694226; 123694233; 123694273 | − | ENST00000184183; ENST00000405845; ENST00000467907; ENST00000460743 | TSF |
| 1% | chr3 | 123694808 | 123694754 | − | chr3 | 123694387 | 123694226; 123694233; 912364273 | − | ENST00000184183; ENST00000405845; ENST00000467907; ENST00000460743 | TSF |
| 1% | chr3 | 123694808 | 123694754 | − | chr3 | 123694387 | 123694226; 123694233; 123694273 | − | ENST00000184183; ENST00000405845; ENST00000467907; ENST00000460743 | TSF |
| 1% | chr16 | 103424 | 103121 | − | chr16 | 101645 | 101558 | − | ENST00000293860 | TSF |
| 1% | chr3 | 72830506 | 72830456 | − | chr3 | 72799987 | 72799435 | − | ENST00000325599; ENST00000463369 | TSF |
| 1% | chr4 | 56223594 | 56223631 | + | chr4 | 56225513 | 56225655 | + | ENST00000264228; ENST00000505210 | TSF |
| 1% | chr4 | 56223594 | 56223631 | + | chr4 | 56225513 | 56225655 | + | ENST00000264228; ENST00000505210 | TSF |
| 1% | chr17 | 66244121 | 66244199 | + | chr17 | 66244785 | 66244846 | + | ENST00000584837 | TSF |
| 1% | chr8 | 42014292 | 42014390 | + | chr8 | 42015459 | 42015603; 42015630 | + | ENST00000522288; ENST00000518421; ENST00000174653; ENST00000396926; ENST00000530375; ENST00000517922; ENST00000517499 | TSF |
| 1% | chr8 | 42014292 | 42014390 | + | chr8 | 42015459 | 42015603; 42015630 | + | ENST00000522288; ENST00000518421; ENST00000174653; ENST00000396926; ENST00000530375; ENST00000517922; ENST00000517499 | TSF |
| 1% | chr8 | 42014292 | 42014390 | + | chr8 | 42015459 | 42015603; 42015630 | + | ENST00000522288; ENST00000518421; ENST00000174653; ENST00000396926; ENST00000530375; ENST00000517922; ENST00000517499 | TSF |
| 1% | chr8 | 42014292 | 42014390 | + | chr8 | 42015459 | 42015603; 42015630 | + | ENST00000522288; ENST00000518421; ENST00000174653; ENST00000396926; ENST00000530375; ENST00000517922; ENST00000517499 | TSF |
| 1% | chr8 | 42014292 | 42014390 | + | chr8 | 42015459 | 42015603; 42015630 | + | ENST00000522288; ENST00000518421; ENST00000174653; ENST00000396926; ENST00000530375; ENST00000517922; ENST00000517499 | TSF |
| 1% | chr15 | 80450039 | 80450042 | + | chr15 | 80450402 | 80450512 | + | ENST00000558022; ENST00000407106; ENST00000261755; ENST00000561421 | TSF |
| 1% | chr15 | 80450039 | 80450042 | + | chr15 | 80450402 | 80450512 | + | ENST00000558022; ENST00000407106; ENST00000261755; ENST00000561421 | TSF |

TABLE 10-continued

Transcript fusion for Breast Invasive Carcinoma (BRCA) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 1% | chr7 | 99779289 | 99779427 | + | chr7 | 99779713 | 99779815 | + | ENST00000426455; ENST00000394018; ENST00000416412; ENST00000317296; ENST00000422690; ENST00000439782 | TSF |
| 1% | chr7 | 99779289 | 99779427 | + | chr7 | 99779713 | 99779815 | + | ENST00000426455; ENST00000394018; ENST00000416412; ENST00000317296; ENST00000422690; ENST00000439782 | TSF |
| 1% | chr7 | 99779289 | 99779427 | + | chr7 | 99779713 | 99779815 | + | ENST00000426455; ENST00000394018; ENST00000416412; ENST00000317296; ENST00000422690; ENST00000439782 | TSF |
| 1% | chr7 | 99779289 | 99779427 | + | chr7 | 99779713 | 99779815 | + | ENST00000426455; ENST00000394018; ENST00000416412; ENST00000317296; ENST00000422690; ENST00000439782 | TSF |
| 1% | chr7 | 99779289 | 99779427 | + | chr7 | 99779713 | 99779815 | + | ENST00000426455; ENST00000394018; ENST00000416412; ENST00000317296; ENST00000422690; ENST00000439782 | TSF |
| 1% | chr7 | 29523499 | 29523591 | + | chr7 | 29535568 | 29535652 | + | ENST00000539406; ENST00000222792; ENST00000495789; ENST00000539389; ENST00000546235; ENST00000446446; ENST00000409041; ENST00000424025; ENST00000421775; ENST00000439711 | TSF |
| 1% | chr7 | 29523499 | 29523591 | + | chr7 | 29535568 | 29535652 | + | ENST00000539406; ENST00000222792; ENST00000495789; ENST00000539389; ENST00000546235; ENST00000446446; ENST00000409041; ENST00000424025; ENST00000421775; ENST00000439711 | TSF |
| 1% | chr7 | 29523499 | 29523591 | + | chr7 | 29535568 | 29535652 | + | ENST00000539406; ENST00000222792; ENST00000495789; ENST00000539389; ENST00000546235; ENST00000446446; ENST00000409041; ENST00000424025; ENST00000421775; ENST00000439711 | TSF |
| 1% | chr7 | 29523499 | 29523591 | + | chr7 | 29535568 | 29535652 | + | ENST00000539406; ENST00000222792; ENST00000495789; ENST00000539389; ENST00000546235; ENST00000446446; ENST00000409041; ENST00000424025; ENST00000421775; ENST00000439711 | TSF |
| 1% | chr17 | 57720819 | 57720900 | + | chr17 | 57721637 | 57721844; 57721856 | + | ENST00000393043; ENST00000269122; ENST00000579456; ENST00000584313; ENST00000580081 | TSF |
| 1% | chr17 | 57720819 | 57720900 | + | chr17 | 57721637 | 57721844; 57721856 | + | ENST00000393043; ENST00000269122; ENST00000579456; ENST00000584313; ENST00000580081 | TSF |
| 1% | chr17 | 57720819 | 57720900 | + | chr17 | 57721637 | 57721844; 57721856 | + | ENST00000393043; ENST00000269122; ENST00000579456; ENST00000584313; ENST00000580081 | TSF |
| 1% | chr17 | 57720819 | 57720900 | + | chr17 | 57721637 | 57721844; 57721856 | + | ENST00000393043; ENST00000269122; ENST00000579456; ENST00000584313; ENST00000580081 | TSF |
| 1% | chr17 | 57720819 | 57720900 | + | chr17 | 57721637 | 57721844; 57721856 | + | ENST00000393043; ENST00000269122; ENST00000579456; ENST00000584313; ENST00000580081 | TSF |
| 1% | chr7 | 156960055 | 156960055 | + | chr7 | 156961742 | 156961816 | + | ENST00000348165 | TSF |
| 1% | chr4 | 158141838 | 158141877 | + | chr4 | 158142819 | 158142875; 158142959 | + | ENST00000512774; ENST00000509417; ENST00000296526; ENST00000264426 | TSF |
| 1% | chr4 | 158141838 | 158141877 | + | chr4 | 158142819 | 158142875; 158142959 | + | ENST00000512774; ENST00000509417; ENST00000296526; ENST00000264426 | TSF |
| 1% | chr4 | 158141838 | 158141877 | + | chr4 | 158142819 | 158142875; 158142959 | + | ENST00000512774; ENST00000509417; ENST00000296526; ENST00000264426 | TSF |
| 1% | chr4 | 158141838 | 158141877 | + | chr4 | 158142819 | 158142875; 158142959 | + | ENST00000512774; ENST00000509417; ENST00000296526; ENST00000264426 | TSF |
| 1% | chr2 | 132237131 | 132237231 | + | chr2 | 132237642 | 132238322 | + | ENST00000321253 | TSF |
| 1% | chr17 | 75313396 | 75313709 | + | chr17 | 75398141 | 75398484; 75398497; 75398565; 75398785 | + | ENST00000589070; ENST00000591934; ENST00000589140; ENST00000427177; ENST00000591198; ENST00000329047; ENST00000590294; ENST00000423034 | TSF |
| 1% | chr17 | 75313396 | 75313709 | + | chr17 | 75398141 | 75398484; 75398497; 75398565; 75398785 | + | ENST00000589070; ENST00000591934; ENST00000589140; ENST00000427177; ENST00000591198; ENST00000329047; ENST00000590294; ENST00000423034 | TSF |
| 1% | chr17 | 75313396 | 75313709 | + | chr17 | 75398141 | 75398484; 75398497; 75398565; 75398785 | + | ENST00000589070; ENST00000591934; ENST00000589140; ENST00000427177; ENST00000591198; ENST00000329047; ENST00000590294; ENST00000423034 | TSF |

TABLE 10-continued

Transcript fusion for Breast Invasive Carcinoma (BRCA) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 1% | chr17 | 75313396 | 75313709 | + | chr17 | 75398141 | 75398484; 75398497; 75398565; 75398785 | + | ENST00000589070; ENST00000591934; ENST00000589140; ENST00000427177; ENST00000591198; ENST00000329047; ENST00000590294; ENST00000423034 | TSF |
| 1% | chr8 | 74036014 | 74035742 | − | chr8 | 73993448 | 73993254 | − | ENST00000297354 | TSF |
| 1% | chr9 | 117824597 | 117824593 | − | chr9 | 117822281 | 117822009 | − | ENST00000350763; ENST00000341037; ENST00000423613 | TSF |
| 1% | chr9 | 117824597 | 117824593 | − | chr9 | 117822281 | 117822009 | − | ENST00000350763; ENST00000341037; 4ENST0000023613 | TSF |
| 1% | chr9 | 117824597 | 117824593 | − | chr9 | 117822281 | 117822009 | − | ENST00000350763; ENST00000341037; | TSF |
| 1% | chr4 | 185620772 | 185620691 | − | chr4 | 185618957 | 185618801; 185618919 | − | ENST00000281453; ENST00000510146 | TSF |
| 1% | chr4 | 185620772 | 185620691 | − | chr4 | 185618957 | 185618801; 185618919 | − | ENST00000281453; ENST00000510146 | TSF |
| 1% | chrX | 76851229 | 76851182 | − | chrX | 76849319 | 76849166 | − | ENST00000373344; ENST00000395603 | TSF |
| 1% | chr2 | 97561135 | 97560977 | − | chr2 | 97559788 | 97559663 | − | ENST00000327896; ENST00000417561; ENST00000490605 | TSF |
| 1% | chr1 | 32376196 | 32376104 | − | chr1 | 32375713 | 32375639; 32375681 | − | ENST00000602725; ENST00000344035; ENST00000457805; ENST00000470404 | TSF |
| 1% | chr1 | 32376196 | 32376104 | − | chr1 | 32375713 | 32375639; 32375681 | − | ENST00000602725; ENST00000344035; ENST00000457805; ENST00000470404 | TSF |
| 1% | chr16 | 10722002 | 10721934 | − | chr16 | 10721656 | 10721440 | − | ENST0000283025 | TSF |
| 1% | chr4 | 107241932 | 107242046 | + | chr4 | 107246142 | 107246275 | + | ENST00000394701 | TSF |
| 1% | chr8 | 144102603 | 144102637 | + | chr8 | 144102731 | 144102839; 144102850; 144102900 | + | ENST00000517503; ENST00000292494; ENST00000429120; ENST00000521699; ENST00000520466; ENST00000521003; ENST00000522971; ENST00000519611; ENST00000519546; ENST00000523847; ENST00000522024; ENST00000520531 | TSF |
| 1% | chr8 | 144102603 | 144102637 | + | chr8 | 144102731 | 144102839; 144102850; 144102900 | + | ENST00000517503; ENST00000292494; ENST00000429120; ENST00000521699; ENST00000520466; ENST00000521003; ENST00000522971; ENST00000519611; ENST00000519546; ENST00000523847; ENST00000522024; ENST00000520531 | TSF |
| 1% | chr8 | 144102603 | 144102637 | + | chr8 | 144102731 | 144102839; 144102850; 144102900 | + | ENST00000517503; ENST00000292494; ENST00000429120; ENST00000521699; ENST00000520466; ENST00000521003; ENST00000522971; ENST00000519611; ENST00000519546; ENST00000523847; ENST00000522024; ENST00000520531 | TSF |
| 1% | chr8 | 144102603 | 144102637 | + | chr8 | 144102731 | 144102839; 144102850; 144102900 | + | ENST00000517503; ENST00000292494; ENST00000429120; ENST00000521699; ENST00000520466; ENST00000521003; ENST00000522971; ENST00000519611; ENST00000519546; ENST00000523847; ENST00000522024; ENST00000520531 | TSF |
| 1% | chr8 | 144102603 | 144102637 | + | chr8 | 144102731 | 144102839; 144102850; 144102900 | + | ENST00000517503; ENST00000292494; ENST00000429120; ENST00000521699; ENST00000520466; ENST00000521003; ENST00000522971; ENST00000519611; ENST00000519546; ENST00000523847; ENST00000522024; ENST00000520531 | TSF |
| 1% | chr4 | 77000253 | 77000294 | + | chr4 | 77002977 | 77003229; 77003296; 77003431; 77003512; 77003688 | + | ENST00000513353; ENST00000504914; ENST00000510423; ENST00000513122; ENST00000341029; ENST00000349321; ENST00000355810 | TSF |
| 1% | chr4 | 77000253 | 77000294 | + | chr4 | 77002977 | 77003229; 77003296; 77003431; 77003512; 77003688 | + | ENST00000513353; ENST00000504914; ENST00000510423; ENST00000513122; ENST00000341029; ENST00000349321; ENST00000355810 | TSF |
| 1% | chr4 | 77000253 | 77000294 | + | chr4 | 77002977 | 77003229; 77003296; 77003431; 77003512; 77003688 | + | ENST00000513353; ENST00000504914; ENST00000510423; ENST00000513122; ENST00000341029; ENST00000349321; ENST00000355810 | TSF |
| 1% | chr4 | 77000253 | 77000294 | + | chr4 | 77002977 | 77003229; 77003296; 77003431; 77003512; 77003688 | + | ENST00000513353; ENST00000504914; ENST00000510423; ENST00000513122; ENST00000341029; ENST00000349321; ENST00000355810 | TSF |

TABLE 10-continued

Transcript fusion for Breast Invasive Carcinoma (BRCA) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 1% | chr4 | 77000253 | 77000294 | + | chr4 | 77002977 | 77003229; 77003296; 77003431; 77003512; 77003688 | + | ENST00000513353; ENST00000504914; ENST00000510423; ENST00000513122; ENST00000341029; ENST00000349321; ENST00000355810 | TSF |
| 1% | chr4 | 77000253 | 77000294 | + | chr4 | 77002977 | 77003229; 77003296; 77003431; 77003512; 77003688 | + | ENST00000513353; ENST00000504914; ENST00000510423; ENST00000513122; ENST00000341029; ENST00000349321; ENST00000355810 | TSF |
| 1% | chr4 | 77000253 | 77000294 | + | chr4 | 77002977 | 77003229; 77003296; 77003431; 77003512; 77003688 | + | ENST00000513353; ENST00000504914; ENST00000510423; ENST00000513122; ENST00000341029; ENST00000349321; ENST00000355810 | TSF |
| 1% | chr4 | 56227367 | 56227417 | + | chr4 | 56230241 | 56230438 | + | ENST00000264228 | TSF |
| 1% | chr14 | 70466641 | 70466673 | + | chr14 | 70477471 | 70477663 | + | ENST00000361956; ENST00000381280 | TSF |
| 1% | chr14 | 70466641 | 70466673 | + | chr14 | 70477471 | 70477663 | + | ENST00000361956; ENST00000381280 | TSF |
| 1% | chr4 | 125071 | 125178 | + | chr4 | 337571 | 337697 | + | ENST00000512994; ENST00000505939; ENST00000240499 | TSF |
| 1% | chr4 | 125071 | 125178 | + | chr4 | 337571 | 337697 | + | ENST00000512994; ENST00000505939; ENST00000240499 | TSF |
| 1% | chr4 | 125071 | 125178 | + | chr4 | 337571 | 337697 | + | ENST00000512994; ENST00000505939; ENST00000240499 | TSF |
| 1% | chr9 | 70847151 | 70847411 | + | chr9 | 70860129 | 70860215 | + | ENST00000360171; ENST00000377342; ENST00000377344; ENST00000478048 | TSF |
| 1% | chr9 | 70847151 | 70847411 | + | chr9 | 70860129 | 70860215 | + | ENST00000360171; ENST00000377342; ENST00000377344; ENST00000478048 | TSF |
| 1% | chr9 | 70847151 | 70847411 | + | chr9 | 70860129 | 70860215 | + | ENST00000360171; ENST00000377342; ENST00000377344; ENST00000478048 | TSF |
| 1% | chr9 | 70847151 | 70847411 | + | chr9 | 70860129 | 70860215 | + | ENST00000360171; ENST00000377342; ENST00000377344; ENST00000478048 | TSF |
| 1% | chr18 | 33693361 | 33693356 | − | chr18 | 33692544 | 33692464 | − | ENST00000269187; ENST00000590986; ENST00000440549; ENST00000586829 | TSF |
| 1% | chr18 | 33693361 | 33693356 | − | chr18 | 33692544 | 33692464 | − | ENST00000269187; ENST00000590986; ENST00000440549; ENST00000586829 | TSF |
| 1% | chr18 | 33693361 | 33693356 | − | chr18 | 33692544 | 33692464 | − | ENST00000269187; ENST00000590986; ENST00000440549; ENST00000586829 | TSF |
| 1% | chr20 | 16294930 | 16294353 | − | chr20 | 16293063 | 16292980 | − | ENST00000354981; ENST00000355755; ENST00000378003 | TSF |
| 1% | chr7 | 94270259 | 94270209 | − | chr7 | 94268760 | 94268653 | − | ENST00000415788 | TSF |
| 1% | chr7 | 100850556 | 100850506 | − | chr7 | 100850185 | 100850060 | − | ENST00000454310; ENST00000223127 | TSF |
| 1% | chr7 | 94270259 | 94270209 | − | chr7 | 94259153 | 94259031 | − | ENST00000265735; ENST00000445866; ENST00000447873; ENST00000428696; ENST00000415788 | TSF |
| 1% | chr7 | 94270259 | 94270209 | − | chr7 | 94259153 | 94259031 | − | ENST00000265735; ENST00000445866; ENST00000447873; ENST00000428696; ENST00000415788 | TSF |
| 1% | chr7 | 94270259 | 94270209 | − | chr7 | 94259153 | 94259031 | − | ENST00000265735; ENST00000445866; ENST00000447873; ENST00000428696; ENST00000415788 | TSF |
| 1% | chr7 | 94270259 | 94270209 | − | chr7 | 94259153 | 94259031 | − | ENST00000265735; ENST00000445866; ENST00000447873; ENST00000428696; ENST00000415788 | TSF |
| 1% | chr7 | 94270259 | 94270209 | − | chr7 | 94259153 | 94259031 | − | ENST00000265735; ENST00000445866; ENST00000447873; ENST00000428696; ENST00000415788 | TSF |
| 1% | chr6 | 37326936 | 37327118 | + | chr6 | 37328222 | 37328350 | + | ENST00000373479; ENST00000229866; ENST00000394443; ENST00000469316; ENST00000469731 | TSF |
| 1% | chr6 | 37326936 | 37327118 | + | chr6 | 37328222 | 37328350 | + | ENST00000373479; ENST00000229866; ENST00000394443; ENST00000469316; ENST00000469731 | TSF |
| 1% | chr6 | 37326936 | 37327118 | + | chr6 | 37328222 | 37328350 | + | ENST00000373479; ENST00000229866; ENST00000394443; ENST00000469316; ENST00000469731 | TSF |
| 1% | chr6 | 37326936 | 37327118 | + | chr6 | 37328222 | 37328350 | + | ENST00000373479; ENST00000229866; ENST00000394443; ENST00000469316; ENST00000469731 | TSF |
| 1% | chr9 | 127110792 | 127110909 | + | chr9 | 127113116 | 127113226 | + | ENST00000540326; ENST00000373603; ENST00000373600; ENST00000320246; ENST00000545174; ENST00000394199; ENST00000546191; ENST00000539416 | TSF |

TABLE 10-continued

Transcript fusion for Breast Invasive Carcinoma (BRCA) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 1% | chr4 | 74314427 | 74314578 | + | chr4 | 74315052 | 74315184 | + | ENST00000395792; ENST00000226359 | TSF |
| 1% | chr4 | 74314427 | 74314578 | + | chr4 | 74315052 | 74315184 | + | ENST00000395792; ENST00000226359 | TSF |
| 1% | chr8 | 95765825 | 95765986 | + | chr8 | 95768264 | 95768387 | + | ENST00000414645; ENST00000523020 | TSF |
| 1% | chr8 | 95765825 | 95765986 | + | chr8 | 95768264 | 95768387 | + | ENST00000414645; ENST00000523020 | TSF |
| 1% | chr10 | 37430220 | 37430401 | + | chr10 | 37430646 | 37431218 | + | ENST00000361713; ENST00000374660; ENST00000602533 | TSF |
| 1% | chr10 | 37430220 | 37430401 | + | chr10 | 37430646 | 37431218 | + | ENST00000361713; ENST00000374660; ENST00000602533 | TSF |
| 1% | chr4 | 146620427 | 146622789 | + | chr4 | 146648063 | 146648121 | + | ENST00000438731; ENST00000511965 | TSF |
| 1% | chr9 | 37801617 | 37801713 | + | chr9 | 37819285 | 37819398 | + | ENST00000377724; ENST00000242323 | TSF |
| 1% | chr9 | 37801617 | 37801713 | + | chr9 | 37819285 | 37819398 | + | ENST00000377724; ENST00000242323 | TSF |
| 1% | chrX | 80517692 | 80518225 | + | chrX | 80532483 | 80532668 | + | ENST00000373212 | TSF |
| 1% | chr14 | 100572435 | 100572471 | + | chr14 | 100589876 | 100589907; 100589939 | + | ENST00000555706; ENST00000402714; ENST00000544450; ENST00000392920; ENST00000557153; ENST00000557384 | TSF |
| 1% | chr14 | 100572435 | 100572471 | + | chr14 | 100589876 | 100589907; 100589939 | + | ENST00000555706; ENST00000402714; ENST00000544450; ENST00000392920; ENST00000557153; ENST00000557384 | TSF |
| 1% | chr14 | 100572435 | 100572471 | + | chr14 | 100589876 | 100589907; 100589939 | + | ENST00000555706; ENST00000402714; ENST00000544450; ENST00000392920; ENST00000557153; ENST00000557384 | TSF |
| 1% | chr14 | 100572435 | 100572471 | + | chr14 | 100589876 | 100589907; 100589939 | + | ENST00000555706; ENST00000402714; ENST00000544450; ENST00000392920; ENST00000557153; ENST00000557384 | TSF |
| 1% | chr14 | 100572435 | 100572471 | + | chr14 | 100589876 | 100589907; 100589939 | + | ENST00000555706; ENST00000402714; ENST00000544450; ENST00000392920; ENST00000557153; ENST00000557384 | TSF |
| 1% | chr17 | 42149044 | 42149179 | + | chr17 | 42151528 | 42151597; 42151634 | + | ENST00000591696; ENST00000269097 | TSF |
| 1% | chr17 | 42149044 | 42149179 | + | chr17 | 42151528 | 42151597; 42151634 | + | ENST00000591696; ENST00000269097 | TSF |
| 1% | chr1 | 45988716 | 45988450 | − | chr1 | 45981479 | 45981326 | − | ENST00000262746; ENST00000319248; ENST00000447184; ENST00000424390 | TSF |
| 1% | chr1 | 45988716 | 45988450 | − | chr1 | 45981479 | 45981326 | − | ENST00000262746; ENST00000319248; ENST00000447184; ENST00000424390 | TSF |
| 1% | chr4 | 873272 | 873014 | − | chr4 | 871597 | 871403 | − | ENST00000314167; ENST00000511163 | TSF |
| 1% | chr13 | 71011242 | 71010948 | − | chr13 | 70549934 | 70549752 | − | ENST00000377844 | TSF |
| 1% | chr2 | 214079365 | 214079242 | − | chr2 | 214013368 | 214013320 | − | ENST00000342002; ENST00000433134; ENST00000442445 | TSF |
| 1% | chr2 | 214079365 | 214079242 | − | chr2 | 214013368 | 214013320 | − | ENST00000342002; ENST00000433134; ENST00000442445 | TSF |
| 1% | chr2 | 214079365 | 214079242 | − | chr2 | 214013368 | 214013320 | − | ENST00000342002; ENST00000433134; ENST00000442445 | TSF |
| 1% | chr10 | 5473735 | 5473380 | − | chr10 | 5443050 | 5442807 | − | ENST00000380419 | TSF |
| 1% | chr8 | 125535738 | 125535448 | − | chr8 | 125535243 | 125535178 | − | ENST00000276692; ENST00000523214; ENST00000522810; ENST00000519776; ENST00000605953; ENST00000522310; ENST00000519232 | TSF |
| 1% | chr8 | 125535738 | 125535448 | − | chr8 | 125535243 | 125535178 | − | ENST00000276692; ENST00000523214; ENST00000522810; ENST00000519776; ENST00000605953; ENST00000522310; ENST00000519232 | TSF |
| 1% | chr8 | 125535738 | 125535448 | − | chr8 | 125535243 | 125535178 | − | ENST00000276692; ENST00000523214; ENST00000522810; ENST00000519776; ENST00000605953; ENST00000522310; ENST00000519232 | TSF |
| 1% | chr8 | 125535738 | 125535448 | − | chr8 | 125535243 | 125535178 | − | ENST00000276692; ENST00000523214; ENST00000522810; ENST00000519776; ENST00000605953; ENST00000522310; ENST00000519232 | TSF |
| 1% | chr8 | 125535738 | 125535448 | − | chr8 | 125535243 | 125535178 | − | ENST00000276692; ENST00000523214; ENST00000522810; ENST00000519776; ENST00000605953; ENST00000522310; ENST00000519232 | TSF |
| 1% | chr8 | 125535738 | 125535448 | − | chr8 | 125535243 | 125535178 | − | ENST00000276692; ENST00000523214; ENST00000522810; ENST00000519776; ENST00000605953; ENST00000522310; ENST00000519232 | TSF |
| 1% | chr7 | 154755921 | 154755838 | − | chr7 | 154755476 | 154755381 | − | ENST00000404141; ENST00000397192 | TSF |
| 1% | chr21 | 30382014 | 30381948 | − | chr21 | 30380942 | 30380716 | − | ENST00000493196 | TSF |

TABLE 11

Transcript fusion for Cervical squamous cell carcinoma (CESC) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 38% | chr19 | 39077165 | 39077216 | + | ENST00000355481; ENST00000360985; ENST00000359596 | chr19 | 39085644 | 39085967 | + | TAF |
| 38% | chr19 | 39077165 | 39077216 | + | ENST00000355481; ENST00000360985; ENST00000359596 | chr19 | 39085644 | 39085967 | + | TAF |
| 38% | chr19 | 39077165 | 39077216 | + | ENST00000355481; ENST00000360985; ENST00000359596 | chr19 | 39085644 | 39085967 | + | TAF |
| 34% | chr10 | 47747112 | 47747132 | + | ENST00000340243; ENST00000374277; ENST00000449464; ENST00000538825 | chr10 | 48278725 | 48278896 | + | TAF |
| 31% | chr5 | 82554349 | 82554496 | + | ENST00000282268; ENST00000338635; ENST00000396027; ENST00000511817 | chr5 | 82606608 | 82606935 | + | TAF |
| 31% | chr19 | 3869015; 3869013 | 3868963 | − | ENST00000262961; ENST00000438164; ENST00000587212; ENST00000586578; ENST00000439086 | chr19 | 38556948 | 3855445 | − | TSF |
| 31% | chr19 | 3869015; 1386903 | 3868963 | − | ENST00000262961; ENST00000438164; ENST00000587212; ENST00000586578; ENST00000439086 | chr19 | 3855694 | 3855445 | − | TSF |
| 24% | chr3 | 49927493 | 49927357 | − | ENST00000296474; ENST00000344206 | chr3 | 49927248 | 49927204 | − | TAF |
| 24% | chr3 | 49927493 | 49927357 | − | ENST00000296474; ENST00000344206 | chr3 | 49927248 | 49927204 | − | TAF |
| 23% | chr1 | 153534067 | 153533988 | − | ENST00000368708; ENST00000487430; ENST00000497140; ENST00000368710; ENST00000368709 | chr1 | 153532853 | 153532704 | − | TAF |
| 23% | chr1 | 153534067 | 153533988 | − | ENST00000368708; ENST00000487430; ENST00000497140; ENST00000368710; ENST00000368709 | chr1 | 153532853 | 153532704 | − | TAF |
| 19% | chr3 | 118943092 | 118942905 | − | ENST00000483209; ENST00000467604; ENST00000359213; ENST00000393765; ENST00000480814 | chr3 | 118938512 | 118938188 | − | TAF |
| 18% | chr9 | 15506635 | 15506559 | − | ENST00000380738; ENST00000380733; ENST00000380715; ENST00000380716; ENST00000397519 | chr9 | 15492223 | 15492056 | − | TAF |
| 18% | chr18 | 61627392 | 61627509 | + | ENST00000408945 | chr18 | 61628870 | 61629168 | + | TSF |
| 15% | chr4 | 1742553 | 1742713 | + | ENST00000313288 | chr4 | 1745122 | 1745307 | + | TAF |
| 15% | chr3 | 196230044 | 196229744 | − | ENST00000318037; ENST00000437070 | chr3 | 196223342 | 196223041 | − | TAF |
| 15% | chr1 | 225156461 | 225156576 | + | ENST00000430092; ENST00000400952; ENST00000366849; ENST00000439375 | chr1 | 225157336 | 225158402 | + | TSF |
| 15% | chr1 | 225156461 | 225156576 | + | ENST00000430092; ENST00000400952; ENST00000366849; ENST00000439375 | chr1 | 225157336 | 225158402 | + | TSF |
| 14% | chr5 | 54993786 | 54993674 | − | ENST00000396865; ENST00000539768; ENST00000318672; ENST00000508124; ENST00000511233; ENST00000503891; ENST00000513993; ENST00000505563; ENST00000506624; ENST00000507109 | chr5 | 54993040 | 54992544 | − | TSF |
| 13% | chr10 | 4884613 | 4884696 | + | ENST00000474119; ENST00000463345; ENST00000298375; ENST00000532248; ENST00000334019; ENST00000345253 | chr10 | 4915406 | 4915583 | + | TAF |
| 13% | chr10 | 4884613 | 4884696 | + | ENST00000474119; ENST00000463345; ENST00000298375; ENST00000532248; ENST00000334019; ENST00000345253 | chr10 | 4915406 | 4915583 | + | TAF |
| 13% | chr10 | 4884613 | 4884696 | + | ENST00000474119; ENST00000463345; ENST00000298375; ENST00000532248; ENST00000334019; ENST00000345253 | chr10 | 4915406 | 4915583 | + | TAF |
| 13% | chr10 | 4884613 | 4884696 | + | ENST00000474119; ENST00000463345; ENST00000298375; ENST00000532248; ENST00000334019; ENST00000345253 | chr10 | 4915406 | 4915583 | + | TAF |
| 13% | chr20 | 35842163 | 35842268 | + | ENST00000237530; ENST00000373622 | chr20 | 35844460 | 35844765 | + | TAF |
| 13% | chr20 | 35842163 | 35842268 | + | ENST00000237530; ENST00000373622 | chr20 | 35844460 | 35844765 | + | TAF |
| 12% | chr18 | 33767503 | 33767644 | + | ENST00000261326 | chr18 | 33773430 | 33773774 | − | TAF |
| 12% | chr1 | 152006276 | 152006124 | − | ENST00000271638 | chr1 | 152005323 | 152005310 | − | TAF |
| 11% | chr16 | 2818998 | 2819285 | + | ENST00000301740 | chr16 | 2819873 | 2820194 | + | TAF |
| 11% | chr8 | 54793576 | 54793644 | + | ENST00000276500 | chr8 | 54826057 | 54826421 | + | TAF |
| 11% | chr12 | 71509738 | 71509630 | − | ENST00000549357 | chr12 | 71504233 | 71503634 | − | TAF |
| 11% | chr17 | 40821639; 40821538 | 40821448 | − | ENST00000591022; ENST00000412503; ENST00000293349 | chr17 | 40820920 | 40820864 | − | TAF |
| 11% | chr17 | 40821639; 40821538 | 40821448 | − | ENST00000591022; ENST00000412503; ENST00000293349 | chr17 | 40820920 | 40820864 | − | TAF |
| 11% | chr17 | 40821639; 40821538 | 40821448 | − | ENST00000591022; ENST00000412503; ENST00000293349 | chr17 | 40820920 | 40820864 | − | TAF |
| 10% | chr6 | 41606488 | 41606563 | + | ENST00000432027; ENST00000419164; ENST00000373051; ENST00000441667; ENST00000230321; ENST00000373050; ENST00000446650; ENST00000435476 | chr6 | 41607515 | 41607595 | + | TAF |
| 10% | chr1 | 32696528 | 32696620 | + | ENST00000373586 | chr1 | 3269686 | 32697110 | + | TAF |
| 10% | chr22 | 35819207 | 35819334 | + | ENST00000216122; ENST00000382011 | chr22 | 35846150 | 35846200 | + | |
| 10% | chr22 | 35819207 | 35819334 | + | ENST00000216122; ENST00000382011 | chr22 | 35846150 | 35846200 | + | TSF |
| 9% | chr1 | 6531697 | 6531548 | − | ENST00000400913; ENST00000340850 | chr1 | 6531300 | 6531188 | − | TSF |

TABLE 11-continued

Transcript fusion for Cervical squamous cell carcinoma (CESC) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 9% | chr1 | 6531697 | 6531548 | − | ENST00000377748; ENST00000377725; ENST00000377728; ENST00000377732; ENST00000400915; ENST00000377740; ENST00000535355; ENST00000377737; ENST00000537245; ENST00000544978 ENST00000400913; ENST00000340850; | chr1 | 6531300 | 6531188 | − | TSF |
| 9% | chr1 | 6531697 | 6531548 | − | ENST00000377748; ENST00000377725; ENST00000377728; ENST00000377732; ENST00000400915; ENST00000377740; ENST00000535355; ENST00000377737; ENST00000537245; ENST00000544978 ENST00000400913; ENST00000340850; | chr1 | 6531300 | 6531188 | − | TSF |
| 9% | chr1 | 6531697 | 6531548 | − | ENST00000377748; ENST00000377725; ENST00000377728; ENST00000377732; ENST00000400915; ENST00000377740; ENST00000535355; ENST00000377737; ENST00000537245; ENST00000544978 ENST00000400913; ENST00000340850; | chr1 | 6531300 | 6531188 | − | TSF |
| 9% | chr1 | 6531697 | 6531548 | − | ENST00000377748; ENST00000377725; ENST00000377728; ENST00000377732; ENST00000400915; ENST00000377740; ENST00000535355; ENST00000377737; ENST00000537245; ENST00000544978 ENST00000400913; ENST00000340850; | chr1 | 6531300 | 6531188 | − | TSF |
| 9% | chr1 | 6531697 | 6531548 | − | ENST00000377748; ENST00000377725; ENST00000377728; ENST00000377732; ENST00000400915; ENST00000377740; ENST00000535355; ENST00000377737; ENST00000537245; ENST00000544978 | chr1 | 6531300 | 6531188 | − | TSF |
| 8% | chr1 | 63955889 | 63955754 | − | ENST00000371092; ENST00000271002; ENST00000489099; ENST00000283568 | chr1 | 63952444 | 63951983 | − | TSF |
| 8% | chr1 | 63955889 | 63955754 | − | ENST00000371092; ENST00000271002; ENST00000489099; ENST00000283568 | chr1 | 63952441 | 63951983 | − | TSF |
| 7% | chr19 | 3114942 | 3115070 | + | ENST00000078429; ENST00000587636 | chr19 | 3115258 | 3115402 | + | TSF |
| 7% | chr19 | 3114942 | 3115070 | + | ENST00000078429; ENST00000587636 | chr19 | 3115258 | 3115402 | + | TSF |
| 7% | chrX | 41598709 | 41598637− | − | ENST00000421587; ENST00000318588; ENST00000361962; ENST00000378163; ENST00000378158; ENST00000378166; ENST00000442742; ENST00000378154 | chrX | 41557348 | 41557057 | − | TSF |
| 6% | chr1 | 11115983; 11115877 | 11115838 | − | ENST00000376957; ENST00000490101 | chr1 | 11115464 | 11115178 | − | TSF |
| 6% | chr1 | 11115983; 11115877 | 11115838 | − | ENST00000376957; ENST00000490101 | chr1 | 11115464 | 11115178 | − | TSF |
| 6% | chr7 | 22532348 | 22532184 | − | ENST00000406890; ENST00000404369; ENST00000424363 | chr7 | 22512853 | 22512669 | − | TSF |
| 6% | chr7 | 22532348 | 22532184 | − | ENST00000406890; ENST00000404369; ENST00000424363 | chr7 | 22512853 | 22512669 | − | TSF |
| 6% | chr8 | 143867103 | 143867005 | − | ENST00000301263 | chr8 | 143859806 | 143859781 | − | TSF |
| 6% | chr19 | 45895598 | 45895138 | − | ENST00000360957; ENST00000418234 | chr19 | 45889495 | 45889472 | − | TSF |
| 5% | chr9 | 125054028 | 125054119 | + | ENST00000297908; ENST00000344641; ENST00000373723; ENST00000373729; ENST00000394315 | chr9 | 125068067 | 125068171 | + | TSF |
| 5% | chr9 | 125054028 | 125054119 | + | ENST00000373723; ENST00000373729; ENST00000297908; ENST00000344641; ENST00000394315 | chr9 | 125068067 | 125068171 | + | TSF |
| 5% | chr9 | 125054028 | 125054119 | + | ENST00000297908; ENST00000344641; ENST00000373723; ENST00000373729; ENST00000394315 | chr9 | 125068067 | 125068171 | + | TSF |
| 5% | chr22 | 35819207 | 35819334 | + | ENST00000216122; ENST00000382011 | chr22 | 35822985 | 35823438 | + | TSF |
| 5% | chr22 | 35819207 | 35819334 | + | ENST00000216122; ENST00000382011 | chr22 | 35822985 | 35823438 | + | TSF |
| 5% | chr17 | 36288631 | 36288740 | + | ENST00000327454; ENST00000378174; ENST00000505415; ENST00000539424 | chr17 | 36289142 | 36289609 | + | TSF |
| 5% | chr17 | 36288631 | 36288740 | + | ENST00000327454; ENST00000378174; ENST00000505415; ENST00000539424 | chr17 | 36289142 | 36289609 | + | TSF |

TABLE 11-continued

Transcript fusion for Cervical squamous cell carcinoma (CESC) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 5% | chr22 | 35819207 | 35819334 | + | ENST00000216122; ENST00000382011 | chr22 | 35844184 | 35844261 | + | TSF |
| 5% | chr22 | 35819207 | 35819334 | + | ENST00000216122; ENST00000382011 | chr22 | 35844184 | 35844261 | + | TSF |
| 5% | chr8 | 42924698; 42924750 | 42924802 | + | ENST00000534420; ENST00000302279; ENST00000533998; ENST00000342116; ENST00000531266; ENST00000525699; ENST00000529687; ENST00000533336 | chr8 | 42925245 | 42925476 | + | TSF |
| 5% | chr8 | 42924698; 42924750 | 42924802 | + | ENST00000534420; ENST00000302279; ENST00000533998; ENST00000342116; ENST00000531266; ENST00000525699; ENST00000529687; ENST00000533336 | chr8 | 42925245 | 42925476 | + | TSF |
| 5% | chr8 | 42924698; 42924750 | 42924802 | + | ENST00000534420; ENST00000302279; ENST00000533998; ENST00000342116; ENST00000531266; ENST00000525699; ENST00000529687; ENST00000533336 | chr8 | 42925245 | 42925476 | + | TSF |
| 5% | chr8 | 42924698; 42924750 | 42924802 | + | ENST00000534420; ENST00000302279; ENST00000533998; ENST00000342116; ENST00000531266; ENST00000525699; ENST00000529687; ENST00000533336 | chr8 | 42925245 | 42925476 | + | TSF |
| 5% | chr8 | 42924698; 42924750 | 42924802 | + | ENST00000534420; ENST00000302279; ENST00000533998; ENST00000342116; ENST00000531266; ENST00000525699; ENST00000529687; ENST00000533336 | chr8 | 42925245 | 42925476 | + | TSF |
| 5% | chr8 | 42924698; 42924750 | 42924802 | + | ENST00000534420; ENST00000302279; ENST00000533998; ENST00000342116; ENST00000531266; ENST00000525699; ENST00000529687; ENST00000533336 | chr8 | 42925245 | 42925476 | + | TSF |
| 4% | chr16 | 88873689 | 88873890 | + | ENST00000301019 | chr16 | 88875475 | 88875490 | + | TSF |
| 4% | chr4 | 57319769 | 57319927 | + | ENST00000514888; ENST00000264221; ENST00000505164; ENST00000399688; ENST00000512576 | chr4 | 57321183 | 57321327 | + | TSF |
| 4% | chr4 | 57319769 | 57319927 | + | ENST00000514888; ENST00000264221; ENST00000505164; ENST00000399688; ENST00000512576 | chr4 | 57321183 | 57321327 | + | TSF |
| 4% | chr4 | 57319769 | 57319927 | + | ENST00000514888; ENST00000264221; ENST00000505164; ENST00000399688; ENST00000512576 | chr4 | 57321183 | 57321327 | + | TSF |
| 4% | chr10 | 126205749 | 126205840 | + | ENST00000368842 | chr10 | 126251911 | 12625228 | + | TSF |
| 4% | chr16 | 68729680; 68729728 | 68729826 | + | ENST00000264012; ENST00000429102; ENST00000581171; ENST00000568292; ENST00000569080 | chr16 | 68761056 | 68761347 | + | TSF |
| 4% | chr16 | 68729680; 68729728 | 68729826 | + | ENST00000264012; ENST00000429102; ENST00000581171; ENST00000568292; ENST00000569080 | chr16 | 68761056 | 68761347 | + | TSF |
| 4% | chr16 | 68729680; 68729728 | 68729826 | + | ENST00000264012; ENST00000429102; ENST00000581171; ENST00000568292; ENST00000569080 | chr16 | 68761056 | 68761347 | + | TSF |
| 4% | chr16 | 68729680; 68729728 | 68729826 | + | ENST00000264012; ENST00000429102; ENST00000581171; ENST00000568292; ENST00000569080 | chr16 | 68761056 | 68761347 | + | TSF |
| 4% | chr16 | 57115439 | 57115522 | + | ENST00000262510; ENST00000308149; ENST00000539144 | chr16 | 57116257 | 57116272 | + | TSF |
| 4% | chr16 | 57115439 | 57115522 | + | ENST00000262510; ENST00000308149; ENST00000539144 | chr16 | 57116257 | 57116272 | + | TSF |
| 4% | chr7 | 73973957 | 73973985 | + | ENST00000265755; ENST00000455841; ENST00000424337; ENST00000476977; ENST00000470715 | chr7 | 73985447 | 73985582 | + | TSF |
| 4% | chr7 | 73973957 | 73973985 | + | ENST00000265755; ENST00000455841; ENST00000424337; ENST00000476977; ENST00000470715 | chr7 | 73985447 | 73985582 | + | TSF |
| 4% | chr7 | 73973957 | 73973985 | + | ENST00000265755; ENST00000455841; ENST00000424337; ENST00000476977; ENST00000470715 | chr7 | 73985447 | 73985582 | + | TSF |
| 4% | chr7 | 73973957 | 73973985 | + | ENST00000265755; ENST00000455841; ENST00000424337; ENST00000476977; ENST00000470715 | chr7 | 73985447 | 73985582 | + | TSF |
| 4% | chr3 | 48716169 | 48715997 | − | ENST00000341520; ENST00000416649; ENST00000294129; ENST00000413374 | chr3 | 48702393 | 48702198 | − | TSF |
| 4% | chr3 | 48716169 | 48715997 | − | ENST00000341520; ENST00000416649; ENST00000294129; ENST00000413374 | chr3 | 48702393 | 48702198 | − | TSF |
| 4% | chr3 | 48716169 | 48715997 | − | ENST00000341520; ENST00000416649; ENST00000294129; ENST00000413374 | chr3 | 48702393 | 48702198 | − | TSF |
| 4% | chr12 | 56742407 | 56742313 | − | ENST00000314128; ENST00000557235 | chr12 | 56740986 | 56740975 | − | TSF |
| 4% | chr12 | 56742407 | 56742313 | − | ENST00000314128; ENST00000557235 | chr12 | 56740986 | 56740975 | | TSF |
| 4% | chr11 | 60701014 | 60701216 | + | ENST00000453848; ENST00000005286; ENST00000536409 | chr11 | 60701443 | 60701575 | + | TSF |

TABLE 11-continued

Transcript fusion for Cervical squamous cell carcinoma (CESC) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 4% | chr11 | 60701014 | 60701216 | + | ENST00000453848; ENST00000005286; ENST00000536409 | chr11 | 60701443 | 60701575 | + | TSF |
| 4% | chr11 | 60701014 | 60701216 | + | ENST00000453848; ENST00000005286; ENST00000536409 | chr11 | 60701443 | 60701575 | + | TSF |
| 4% | chrX | 119708472 | 119708406 | − | ENST00000404115 | chrX | 119705855 | 119705820 | − | TSF |
| 4% | chr19 | 15289752 | 15289634 | − | ENST00000263388; ENST00000601011 | chr19 | 15289244 | 15289201 | − | TSF |
| 4% | chr19 | 15289752 | 15289634 | − | ENST00000263388; ENST00000601011 | chr19 | 15289244 | 15289201 | − | TSF |
| 3% | chr11 | 101937216; 101937273 | 101937382 | + | ENST00000434758; ENST00000526781; ENST00000529204 | chr11 | 101937956 | 101938097 | + | TSF |
| 3% | chr11 | 101937216; 101937273 | 101937382 | + | ENST00000434758; ENST00000526781; ENST00000529204 | chr11 | 101937956 | 101938097 | + | TSF |
| 3% | chr5 | 1802435 | 1802488 | + | ENST00000274137; ENST00000469176 | chr5 | 1811082 | 1811428 | + | TSF |
| 3% | chr7 | 81964567 | 81964451 | − | ENST00000356860; ENST00000356253; ENST00000423588 | chr7 | 81929467 | 81929190 | − | TSF |
| 3% | chr6 | 29693224; 29693311 | 29693340 | + | ENST00000376861; ENST00000334668; ENST00000259951; ENST00000440587; ENST00000434407; ENST00000429294; ENST00000444621 | chr6 | 29700968 | 29700992 | + | TSF |
| 3% | chr6 | 29693224; 29693311 | 29693340 | + | ENST00000376861; ENST00000334668; ENST00000259951; ENST00000440587; ENST00000434407; ENST00000429294; ENST00000444621 | chr6 | 29700968 | 29700992 | + | TSF |
| 3% | chr6 | 29693224; 29693311 | 29693340 | + | ENST00000376861; ENST00000334668; ENST00000259951; ENST00000440587; ENST00000434407; ENST00000429294; ENST00000444621 | chr6 | 29700968 | 29700992 | + | TSF |
| 3% | chr6 | 29693224; 29693311 | 29693340 | + | ENST00000376861; ENST00000334668; ENST00000259951; ENST00000440587; ENST00000434407; ENST00000429294; ENST00000444621 | chr6 | 29700968 | 29700992 | + | TSF |
| 3% | chr6 | 29693224; 29693311 | 29693340 | + | ENST00000376861; ENST00000334668; ENST00000259951; ENST00000440587; ENST00000434407; ENST00000429294; ENST00000444621 | chr6 | 29700968 | 29700992 | + | TSF |
| 3% | chrX | 153786747; 153786750 | 153786865 | + | ENST00000440286; ENST00000422680; ENST00000369609; ENST00000369607; ENST00000369606; ENST00000413620; ENST00000263518; ENST00000470142; ENST00000393549; ENST00000455588; ENST00000369602; ENST00000424839; ENST00000369601 | chrX | 153788357 | 153788357 | + | TSF |
| 3% | chrX | 153786747; 153786750 | 153786865 | + | ENST00000440286; ENST00000422680; ENST00000369609; ENST00000369607; ENST00000369606; ENST00000413620; ENST00000263518; ENST00000470142; ENST00000393549; ENST00000455588; ENST00000369602; ENST00000424839; ENST00000369601 | chrX | 153788357 | 153788357 | + | TSF |
| 3% | chrX | 153786747; 153786750 | 153786865 | + | ENST00000440286; ENST00000422680; ENST00000369609; ENST00000369607; ENST00000369606; ENST00000413620; ENST00000263518; ENST00000470142; ENST00000393549; ENST00000455588; ENST00000369602; ENST00000424839; ENST00000369601 | chrX | 153788357 | 153788357 | + | TSF |
| 3% | chrX | 153786747; 153786750 | 153786865 | + | ENST00000440286; ENST00000422680; ENST00000369609; ENST00000369607; ENST00000369606; ENST00000413620; ENST00000263518; ENST00000470142; ENST00000393549; ENST00000455588; ENST00000369602; ENST00000424839; ENST00000369601 | chrX | 153788357 | 153788357 | + | TSF |
| 3% | chrX | 153786747; 153786750 | 153786865 | + | ENST00000440286; ENST00000422680; ENST00000369609; ENST00000369607; ENST00000369606; ENST00000413620; ENST00000263518; ENST00000470142; ENST00000393549; ENST00000455588; ENST00000369602; ENST00000424839; ENST00000369601 | chrX | 153788357 | 153788357 | + | TSF |
| 3% | chr17 | 36343995 | 36343886 | − | ENST00000518551; ENST00000354664; ENST00000339023; ENST00000519532; ENST00000537432 | chr17 | 36343484 | 36343017 | − | TSF |
| 3% | chr17 | 36343995 | 36343886 | − | ENST00000518551; ENST00000354664; ENST00000339023; ENST00000519532; ENST00000537432 | chr17 | 36343484 | 36343017 | − | TSF |

TABLE 11-continued

Transcript fusion for Cervical squamous cell carcinoma (CESC) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 3% | chr16 | 2825557; 2825626 | 2825452 | − | ENST00000262306; ENST00000409906; ENST00000409477; ENST00000494946 | chr16 | 2823822 | 2823809 | − | TSF |
| 3% | chr16 | 2825557; 2825626 | 2825452 | − | ENST00000262306; ENST00000409906; ENST00000409477; ENST00000494946 | chr16 | 2823822 | 2823809 | − | TSF |
| 3% | chr16 | 2825557; 2825626 | 2825452 | − | ENST00000262306; ENST00000409906; ENST00000409477; ENST00000494946 | chr16 | 2823822 | 2823809 | − | TSF |
| 3% | chr19 | 3855446 | 3855400 | − | ENST00000592398; ENST00000591712 | chr19 | 3852385 | 3852258 | − | TSF |
| 3% | chr1 | 180283857 | 180283827 | − | ENST00000367595 | chr1 | 180281457 | 180281103 | − | TSF |
| 3% | chr17 | 73887428 | 73887358 | − | ENST00000591668; ENST00000592642; ENST00000269383; ENST00000543309 | chr17 | 73885428 | 73885139 | − | TSF |
| 3% | chr17 | 73887428 | 73887358 | − | ENST00000591668; ENST00000592642; ENST00000269383; ENST00000543309 | chr17 | 73885428 | 73885139 | − | TSF |
| 3% | chr17 | 73887428 | 73887358 | − | ENST00000591668; ENST00000592642; ENST00000269383; ENST00000543309 | chr17 | 73885428 | 73885139 | − | TSF |
| 3% | chr17 | 73887428 | 73887358 | − | ENST00000591668; ENST00000592642; ENST00000269383; ENST00000543309 | chr17 | 73885428 | 73885139 | − | TSF |
| 3% | chr12 | 102547647 | 102547754 | + | ENST00000327680; ENST00000378128; ENST00000541394; ENST00000358383; ENST00000392911; ENST00000412715; ENST00000417507; ENST00000457614 | chr12 | 102548605 | 102548938 | + | TSF |
| 3% | chr12 | 102547647 | 102547754 | + | ENST00000327680; ENST00000378128; ENST00000541394; ENST00000358383; ENST00000392911; ENST00000412715; ENST00000417507; ENST00000457614 | chr12 | 102548605 | 102548938 | + | TSF |
| 3% | chr12 | 102547647 | 102547754 | + | ENST00000327680; ENST00000378128; ENST00000541394; ENST00000358383; ENST00000392911; ENST00000412715; ENST00000417507; ENST00000457614 | chr12 | 102548605 | 102548938 | + | TSF |
| 3% | chr12 | 102547647 | 102547754 | + | ENST00000327680; ENST00000378128; ENST00000541394; ENST00000358383; ENST00000392911; ENST00000412715; ENST00000417507; ENST00000457614 | chr12 | 102548605 | 102548938 | + | TSF |
| 3% | chr12 | 102547647 | 102547754 | + | ENST00000327680; ENST00000378128; ENST00000541394; ENST00000358383; ENST00000392911; ENST00000412715; ENST00000417507; ENST00000457614 | chr12 | 102548605 | 102548938 | + | TSF |
| 3% | chr22 | 38321668; 38321854 | 38322050 | + | ENST00000215957; ENST00000454685 | chr22 | 38322963 | 38322967 | + | TSF |
| 3% | chr22 | 38321668; 38321854 | 38322050 | + | ENST00000215957; ENST00000454685 | chr22 | 38322963 | 38322967 | + | TSF |
| 3% | chr22 | 42154369; 42154464 | 42154537 | + | ENST00000401548; ENST00000540833; ENST00000400107; ENST00000540880 | chr22 | 42155353 | 42155683 | + | TSF |
| 3% | chr22 | 42154369; 42154464 | 42154537 | + | ENST00000401548; ENST00000540833; ENST00000400107; ENST00000540880 | chr22 | 42155353 | 42155683 | + | TSF |
| 3% | chr22 | 42154369; 42154464 | 42154537 | + | ENST00000401548; ENST00000540833; ENST00000400107; ENST00000540880 | chr22 | 42155353 | 42155683 | + | TSF |
| 3% | chr22 | 42154369; 42154464 | 42154537 | + | ENST00000401548; ENST00000540833; ENST00000400107; ENST00000540880 | chr22 | 42155353 | 42155683 | + | TSF |
| 3% | chr3 | 129020793 | 129020985 | + | ENST00000509042; ENST00000383463; ENST00000417226; ENST00000502878; ENST00000389735 | chr3 | 129029005 | 129029042 | + | TSF |
| 3% | chr3 | 129020793 | 129020985 | + | ENST00000509042; ENST00000383463; ENST00000417226; ENST00000502878; ENST00000389735 | chr3 | 129029005 | 129029042 | + | TSF |
| 3% | chr3 | 129020793 | 129020985 | + | ENST00000509042; ENST00000383463; ENST00000417226; ENST00000502878; ENST00000389735 | chr3 | 129029005 | 129029042 | + | TSF |
| 3% | chr22 | 45813490; 45813481 | 45813826 | + | ENST00000342894; ENST00000538017 | chr22 | 45815177 | 45815331 | + | TSF |
| 3% | chr22 | 45813490; 45813481 | 45813826 | + | ENST00000342894; ENST00000538017 | chr22 | 45815177 | 45815331 | + | TSF |
| 3% | chr1 | 180283857 | 180283827 | − | ENST00000367595 | chr1 | 180281120 | 180281103 | − | TSF |
| 2% | chr16 | 3118181 | 3118240 | + | ENST00000325568; ENST00000534507; ENST00000531965; ENST00000396887; ENST00000526464; ENST00000440815; ENST00000529550; ENST00000551122; ENST00000525643; ENST00000548807; ENST00000528163; ENST00000530890; ENST00000444393; ENST00000533097; ENST00000008180; ENST00000396890; ENST00000525228; ENST00000548652; ENST00000525377; ENST00000530538; ENST00000549213; ENST00000552936; | chr16 | 3135449 | 3135770 | + | TSF |

TABLE 11-continued

Transcript fusion for Cervical squamous cell carcinoma (CESC) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|----|----|
|   |   |   |   |   | ENST00000548476; ENST00000552664; ENST00000552356; ENST00000551513; ENST00000382213 |   |   |   |    |    |
| 2% | chr16 | 3118181 | 3118240 | + | ENST00000325568; ENST00000534507; ENST00000531965; ENST00000396887; ENST00000526464; ENST00000440815; ENST00000529550; ENST00000551122; ENST00000525643; ENST00000548807; ENST00000528163; ENST00000530890; ENST00000444393; ENST00000533097; ENST00000008180; ENST00000396890; ENST00000525228; ENST00000548652; ENST00000525377; ENST00000530538; ENST00000549213; ENST00000552936; ENST00000548476; ENST00000552664; ENST00000552356; ENST00000551513; ENST00000382213 | chr16 | 3135449 | 3135770 | + | TSF |
| 2% | chr16 | 3118181 | 3118240 | + | ENST00000325568; ENST00000534507; ENST00000531965; ENST00000396887; ENST00000526464; ENST00000440815; ENST00000529550; ENST00000551122; ENST00000525643; ENST00000548807; ENST00000528163; ENST00000530890; ENST00000444393; ENST00000533097; ENST00000008180; ENST00000396890; ENST00000525228; ENST00000548652; ENST00000525377; ENST00000530538; ENST00000549213; ENST00000552936; ENST00000548476; ENST00000552664; ENST00000552356; ENST00000551513; ENST00000382213 | chr16 | 3135449 | 3135770 | + | TSF |
| 2% | chr16 | 3118181 | 3118240 | + | ENST00000325568; ENST00000534507; ENST00000531965; ENST00000396887; ENST00000526464; ENST00000440815; ENST00000529550; ENST00000551122; ENST00000525643; ENST00000548807; ENST00000528163; ENST00000530890; ENST00000444393; ENST00000533097; ENST00000008180; ENST00000396890; ENST00000525228; ENST00000548652; ENST00000525377; ENST00000530538; ENST00000549213; ENST00000552936; ENST00000548476; ENST00000552664; ENST00000552356; ENST00000551513; ENST00000382213 | chr16 | 3135449 | 3135770 | + | TSF |
| 2% | chr16 | 3118181 | 3118240 | + | ENST00000325568; ENST00000534507; ENST00000531965; ENST00000396887; ENST00000526464; ENST00000440815; ENST00000529550; ENST00000551122; ENST00000525643; ENST00000548807; ENST00000528163; ENST00000530890; ENST00000444393; ENST00000533097; ENST00000008180; ENST00000396890; ENST00000525228; ENST00000548652; ENST00000525377; ENST00000530538; ENST00000549213; ENST00000552936; ENST00000548476; ENST00000552664; ENST00000552356; ENST00000551513; ENST00000382213 | chr16 | 3135449 | 3135770 | + | TSF |
| 2% | chr16 | 3118181 | 3118240 | + | ENST00000325568; ENST00000534507; ENST00000531965; ENST00000396887; ENST00000526464; ENST00000440815; ENST00000529550; ENST00000551122; ENST00000525643; ENST00000548807; ENST00000528163; ENST00000530890; ENST00000444393; ENST00000533097; ENST00000008180; ENST00000396890; ENST00000525228; ENST00000548652; ENST00000525377; ENST00000530538; ENST00000549213; ENST00000552936; ENST00000548476; ENST00000552664; ENST00000552356; ENST00000551513; ENST00000382213 | chr16 | 3135449 | 3135770 | + | TSF |

TABLE 11-continued

Transcript fusion for Cervical squamous cell carcinoma (CESC) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 2% | chr16 | 3118181 | 3118240 | + | ENST00000325568; ENST00000534507; ENST00000531965; ENST00000396887; ENST00000526464; ENST00000440815; ENST00000529550; ENST00000551122; ENST00000525643; ENST00000548807; ENST00000528163; ENST00000530890; ENST00000444393; ENST00000533097; ENST00000008180; ENST00000396890; ENST00000525228; ENST00000548652; ENST00000525377; ENST00000530538; ENST00000549213; ENST00000552936; ENST00000548476; ENST00000552664; ENST00000552356; ENST00000551513; ENST00000382213 | chr16 | 3135449 | 3135770 | + | TSF |
| 2% | chr16 | 3118181 | 3118240 | + | ENST00000325568; ENST00000534507; ENST00000531965; ENST00000396887; ENST00000526464; ENST00000440815; ENST00000529550; ENST00000551122; ENST00000525643; ENST00000548807; ENST00000528163; ENST00000530890; ENST00000444393; ENST00000533097; ENST00000008180; ENST00000396890; ENST00000525228; ENST00000548652; ENST00000525377; ENST00000530538; ENST00000549213; ENST00000552936; ENST00000548476; ENST00000552664; ENST00000552356; ENST00000551513; ENST00000382213 | chr16 | 3135449 | 3135770 | + | TSF |
| 2% | chr14 | 76662221 | 76662315 | + | ENST00000312858; ENST00000261530; ENST00000554799; ENST00000553588 | chr14 | 76666223 | 76666696 | + | TSF |
| 2% | chr14 | 76662221 | 76662315 | + | ENST00000312858; ENST00000261530; ENST00000554799; ENST00000553588 | chr14 | 76666223 | 76666696 | + | TSF |
| 2% | chr14 | 76662221 | 76662315 | + | ENST00000312858; ENST00000261530; ENST00000554799; ENST00000553588 | chr14 | 76666223 | 76666696 | + | TSF |
| 2% | chr19 | 46627413 | 46627143 | − | ENST00000341415 | chr19 | 46623577 | 46622963 | − | TSF |
| 2% | chr11 | 64599981 | 64599900 | − | ENST00000342711 | chr11 | 64599599 | 64599309 | − | TSF |
| 2% | chr19 | 46627413 | 46627143 | − | ENST00000341415 | chr19 | 46623564 | 46622963 | − | TSF |
| 2% | chr4 | 1102192 | 1102131 | − | ENST00000382968; ENST00000433731; ENST00000511620; ENST00000510715; ENST00000333673 | chr4 | 1101132 | 1100845 | − | TSF |
| 2% | chr16 | 30783410 | 30783511 | + | ENST00000324685; ENST00000402121; ENST00000563683; ENST00000357890 | chr16 | 30785136 | 30785155 | + | TSF |
| 2% | chr16 | 30783410 | 30783511 | + | ENST00000324685; ENST00000402121; ENST00000563683; ENST00000357890 | chr16 | 30785136 | 30785155 | + | TSF |
| 2% | chr16 | 30783410 | 30783511 | + | ENST00000324685; ENST00000402121; ENST00000563683; ENST00000357890 | chr16 | 30785136 | 30785155 | + | TSF |
| 2% | chr16 | 30783410 | 30783511 | + | ENST00000324685; ENST00000402121; ENST00000563683; ENST00000357890 | chr16 | 30785136 | 30785155 | + | TSF |
| 2% | chr6 | 84772612 | 84772711 | + | ENST00000257776 | chr6 | 84849189 | 84849246 | + | TSF |
| 2% | chr3 | 137906397; 137906427 | 137906441 | + | ENST00000469044; ENST00000461600; ENST00000461822; ENST00000470821; ENST00000471709; ENST00000393058; ENST00000538260; ENST00000463485 | chr3 | 137907243 | 137907252 | + | TSF |
| 2% | chr3 | 137906397; 137906427 | 137906441 | + | ENST00000469044; ENST00000461600; ENST00000461822; ENST00000470821; ENST00000471709; ENST00000393058; ENST00000538260; ENST00000463485 | chr3 | 137907243 | 137907252 | + | TSF |
| 2% | chr21 | 45222155 | 45222268 | + | ENST00000497547 | chr21 | 45240407 | 45240709 | + | TSF |
| 2% | chr1 | 63944504 | 63944435 | − | ENST00000371092; ENST00000271002; ENST00000489099; ENST00000283568 | chr1 | 63927687 | 63926951 | − | TSF |
| 2% | chr1 | 63944504 | 63944435 | − | ENST00000371092; ENST00000271002; ENST00000489099; ENST00000283568 | chr1 | 63927687 | 63926951 | − | TSF |
| 2% | chr3 | 49928739 | 49928630 | − | ENST00000296474; ENST00000344206; ENST00000434765; ENST00000440292 | chr3 | 49928452 | 49928163 | − | TSF |
| 2% | chr3 | 49928739 | 49928630 | − | ENST00000296474; ENST00000344206; ENST00000434765; ENST00000440292 | chr3 | 49928452 | 49928163 | − | TSF |
| 2% | chr3 | 49928739 | 49928630 | − | ENST00000296474; ENST00000344206; ENST00000434765; ENST00000440292 | chr3 | 49928452 | 49928163 |  | TSF |
| 2% | chr3 | 49928739 | 49928630 | − | ENST00000296474; ENST00000344206; ENST00000434765; ENST00000440292 | chr3 | 49928452 | 49928163 | − | TSF |

TABLE 12

Transcript fusion for Cervical squamous cell carcinoma (CESC) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 61% | chr12 | 122430912 | 122431615 | + | chr12 | 122437622 | 122437850 | + | ENST00000288912 | TAF |
| 30% | chr22 | 45814683 | 45815239 | + | chr22 | 45818170 | 45818288 | + | ENST00000342894; ENST00000538017 | TAF |
| 28% | chr11 | 93468219 | 93468129 |  | chr11 | 93467826 | 93467791; 93467814 |  | ENST00000393259; ENST00000527169 | TAF |
| 28% | chr11 | 93468219 | 93468129 | − | chr11 | 93467826 | 93467791; 93467814 | − | ENST00000393259; ENST00000527169 | TAF |
| 26% | chr2 | 38983894 | 38983253 | − | chr2 | 38977336 | 38977156 | − | ENST00000313117; ENST00000425778; ENST00000425941; ENST00000446327; ENST00000409276; ENST00000431066; ENST00000443213 | TSF |
| 26% | chr2 | 38983894 | 38983253 | − | chr2 | 38977336 | 38977156 | − | ENST00000313117; ENST00000425778; ENST00000425941; ENST00000446327; ENST00000409276; ENST00000431066; ENST00000443213 | TSF |
| 26% | chr2 | 38983894 | 38983253 | − | chr2 | 38977336 | 38977156 | − | ENST00000313117; ENST00000425778; ENST00000425941; ENST00000446327; ENST00000409276; ENST00000431066; ENST00000443213 | TSF |
| 26% | chr2 | 38983894 | 38983253 | − | chr2 | 38977336 | 38977156 | − | ENST00000313117; ENST00000425778; ENST00000425941; ENST00000446327; ENST00000409276; ENST00000431066; ENST00000443213 | TSF |
| 26% | chr2 | 38983894 | 38983253 | − | chr2 | 38977336 | 38977156 | − | ENST00000313117; ENST00000425778; ENST00000425941; ENST00000446327; ENST00000409276; ENST00000431066; ENST00000443213 | TSF |
| 24% | chr19 | 49121994 | 49121817 | − | chr19 | 49121134 | 49121048 | − | ENST00000549920; ENST00000547897; ENST00000084795; ENST00000550645; ENST00000549370; ENST00000549273 | TAF |
| 24% | chr19 | 49121994 | 49121817 | − | chr19 | 49121134 | 49121048 | − | ENST00000549920; ENST00000547897; ENST00000084795; ENST00000550645; ENST00000549370; ENST00000549273 | TAF |
| 24% | chr19 | 49121994 | 49121817 | − | chr19 | 49121134 | 49121048 | − | ENST00000549920; ENST00000547897; ENST00000084795; ENST00000550645; ENST00000549370; ENST00000549273 | TAF |
| 24% | chr19 | 49121994 | 49121817 | − | chr19 | 49121134 | 49121048 | − | ENST00000549920; ENST00000547897; ENST00000084795; ENST00000550645; ENST00000549370; ENST00000549273 | TAF |
| 24% | chr19 | 49121994 | 49121817 | − | chr19 | 49121134 | 49121048 | − | ENST00000549920; ENST00000547897; ENST00000084795; ENST00000550645; ENST00000549370; ENST00000549273 | TAF |
| 23% | chr19 | 54631006 | 54631115 | + | chr19 | 54631448 | 54631575 | + | ENST00000321030; ENST00000419967 | TAF |
| 23% | chr19 | 54631006 | 54631115 | + | chr19 | 54631448 | 54631575 | + | ENST00000321030; ENST00000419967 | TAF |
| 23% | chr1 | 79214190 | 79214239 | + | chr17 | 79214787 | 79214816; 79214953 | + | ENST00000431388; ENST00000576002 | TAF |
| 23% | chr1 | 79214190 | 79214239 | + | chr17 | 79214787 | 79214816; 79214953 | + | ENST00000431388; ENST00000576002 | TAF |
| 23% | chr13 | 76173531 | 76175706 | + | chr13 | 76178905 | 76178963 | + | ENST00000377595; ENST00000419068 | TAF |
| 20% | chr8 | 104389530 | 104389551 | + | chr8 | 104390255 | 104390471 | + | ENST00000330295; ENST00000520337 | TAF |
| 20% | chr6 | 138423138 | 138423021 | − | chr6 | 138417631 | 138417491 | − | ENST00000421351 | TAF |
| 19% | chr8 | 82194688 | 82194727 | + | chr8 | 82195601 | 82195773 | + | ENST00000297258 | TAF |
| 18% | chr12 | 6602868 | 6602840 | − | chr12 | 6602138 | 6602028 | − | ENST00000229238 | TAF |
| 18% | chr1 | 169819657 | 169819707 | + | chr1 | 169820958 | 169821077 | + | ENST00000359326; ENST00000286031 | TSF |
| 17% | chr2 | 38983894 | 38983132 | − | chr2 | 38977336 | 38977156 | − | ENST00000313117; ENST00000425778; ENST00000425941; ENST00000446327; ENST00000409276; ENST00000431066; ENST00000443213 | TAF |
| 17% | chr2 | 38983894 | 38983132 | − | chr2 | 38977336 | 38977156 | − | ENST00000313117; ENST00000425778; ENST00000425941; ENST00000446327; ENST00000409276; ENST00000431066; ENST00000443213 | TAF |
| 17% | chr2 | 38983894 | 38983132 | − | chr2 | 38977336 | 38977156 | − | ENST00000313117; ENST00000425778; ENST00000425941; ENST00000446327; ENST00000409276; ENST00000431066; ENST00000443213 | TAF |
| 17% | chr2 | 38983894 | 38983132 | − | chr2 | 38977336 | 38977156 | − | ENST00000313117; ENST00000425778; ENST00000425941; ENST00000446327; ENST00000409276; ENST00000431066; ENST00000443213 | TAF |
| 17% | chr2 | 38983894 | 38983132 | − | chr2 | 38977336 | 38977156 | − | ENST00000313117; ENST00000425778; ENST00000425941; ENST00000446327; ENST00000409276; ENST00000431066; ENST00000443213 | TAF |
| 17% | chr1 | 86821476 | 86821330 | − | chr1 | 86820542 | 86820457; 86820538 | − | ENST00000359242; ENST00000460698; ENST00000317336; ENST00000370567; | TAF |

TABLE 12-continued

Transcript fusion for Cervical squamous cell carcinoma (CESC) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 17% | chr1 | 86821476 | 86821330 | − | chr1 | 86820542 | 86820457; 86820538 | − | ENST00000394731; ENST00000370566; ENST00000462648; ENST00000294678; ENST00000531412 ENST00000359242; ENST00000460698; ENST00000317336; ENST00000370567; | TAF |
| 17% | chr1 | 86821476 | 86821330 | − | chr1 | 86820542 | 86820457; 86820538 | − | ENST00000394731; ENST00000370566; ENST00000462648; ENST00000294678; ENST00000531412 ENST00000359242; ENST00000460698; ENST00000317336; ENST00000370567; | TAF |
| 17% | chr1 | 86821476 | 86821330 | − | chr1 | 86820542 | 86820457; 86820538 | − | ENST00000394731; ENST00000370566; ENST00000462648; ENST00000294678; ENST00000531412 ENST00000359242; ENST00000460698; ENST00000317336; ENST00000370567; | TAF |
| 15% | chr12 | 86274449 | 86274547 | + | chr12 | 86276001 | 86276153 | + | ENST00000551529; ENST00000256010 | TAF |
| 15% | chr4 | 107241932 | 107242850 | + | chr4 | 107246142 | 107246275 | + | ENST00000394701 | TAF |
| 14% | chr19 | 55558521 | 55558473 | − | chr19 | 55556677 | 55556442 | − | ENST00000415061; ENST00000396247 | TAF |
| 14% | chr17 | 74261446 | 74261484 | + | chr17 | 74261988 | 74262050 | + | ENST00000327490 | TAF |
| 14% | chr17 | 80440912 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |
| 14% | chr17 | 80440912 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |
| 14% | chr17 | 80440912 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |
| 14% | chr17 | 80440912 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |
| 14% | chr19 | 39347374 | 39346430 | − | chr19 | 39338074 | 39337956 | − | ENST00000221419; ENST00000601449; ENST00000600233; ENST00000601813 | TSF |
| 14% | chr19 | 39347374 | 39346430 | − | chr19 | 39338074 | 39337956 | − | ENST00000221419; ENST00000601449; ENST00000600233; ENST00000601813 | TSF |
| 14% | chr19 | 39347374 | 39346430 | − | chr19 | 39338074 | 39337956 | − | ENST00000221419; ENST00000601449; ENST00000600233; ENST00000601813 | TSF |
| 14% | chr19 | 39347374 | 39346430 | − | chr19 | 39338074 | 39337956 | − | ENST00000221419; ENST00000601449; ENST00000600233; ENST00000601813 | TSF |
| 14% | chr19 | 39347374 | 39346430 | − | chr19 | 39338074 | 39337956 | − | ENST00000221419; ENST00000601449; ENST00000600233; ENST00000601813 | TSF |
| 13% | chr15 | 43889497 | 43889601 | + | chr15 | 43890391 | 43890525 | + | ENST00000300283; ENST00000441322 | TAF |
| 12% | chr7 | 116364854 | 116364901 | + | chr7 | 116371722 | 116371913 | + | ENST00000397752; ENST00000318493; ENST00000436117 | TAF |
| 12% | chr7 | 116364854 | 116364901 | + | chr7 | 116371722 | 116371913 | + | ENST00000397752; ENST00000318493; ENST00000436117 | TAF |
| 12% | chr7 | 116364854 | 116364901 | + | chr7 | 116371722 | 116371913 | + | ENST00000397752; ENST00000318493; ENST00000436117 | TAF |
| 12% | chr5 | 54528691 | 54528595 | − | chr5 | 54528374 | 54528189 | − | ENST00000282572 | TAF |
| 11% | chr5 | 1811001 | 1811176 | + | chr5 | 1814453 | 1814575; 1814785 | + | ENST00000274137; ENST00000469176 | TAF |
| 11% | chr5 | 1811001 | 1811176 | + | chr5 | 1814453 | 1814575; 1814785 | + | ENST00000274137; ENST00000469176 | TAF |
| 11% | chr15 | 43989318 | 43989422 | + | chr15 | 43990212 | 43990346 | + | ENST00000434505; ENST00000413453 | TAF |
| 11% | chr17 | 40820773 | 40820708 | − | chr17 | 40820321 | 40820145 | − | ENST00000591022; ENST00000412503; ENST00000293349 | TAF |
| 11% | chr9 | 131002678 | 131002811 | + | chr9 | 131004511 | 131004624 | + | ENST00000475805; ENST00000341179; ENST00000372923; ENST00000393594; ENST00000486160 | TAF |
| 11% | chr9 | 131002678 | 131002811 | + | chr9 | 131004511 | 131004624 | + | ENST00000475805; ENST00000341179; ENST00000372923; ENST00000393594; ENST00000486160 | TAF |
| 11% | chr11 | 19190423 | 19190515 | + | chr11 | 19191958 | 19192115 | + | ENST00000446113; ENST00000399351 | TAF |
| 11% | chr5 | 823586 | 823504 | − | chr5 | 822010 | 821976 | − | ENST00000424784; ENST00000283441 | TAF |
| 11% | chr1 | 165863702 | 165863816 | + | chr1 | 165865427 | 165865569 | + | ENST00000367879 | TAF |
| 11% | chr1 | 6380703 | 6380649 | − | chr1 | 6378638 | 6378552 | − | ENST00000608083; ENST00000377842; | TAF |

TABLE 12-continued

Transcript fusion for Cervical squamous cell carcinoma (CESC) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 11% | chr1 | 6380703 | 6380649 | − | chr1 | 6378638 | 6378552 | − | ENST00000377845; ENST00000377855; ENST00000377860; ENST00000418124; ENST00000545482; ENST00000361521; ENST00000473466; ENST00000541130 ENST00000608083; ENST00000377842; ENST00000377845; ENST00000377855; ENST00000377860; ENST00000418124; ENST00000545482; ENST00000361521; ENST00000473466; ENST00000541130 | TAF |
| 11% | chr1 | 6380703 | 6380649 | − | chr1 | 6378638 | 6378552 | − | ENST00000608083; ENST00000377842; ENST00000377845; ENST00000377855; ENST00000377860; ENST00000418124; ENST00000545482; ENST00000361521; ENST00000473466; ENST00000541130 | TAF |
| 11% | chr1 | 6380703 | 6380649 | − | chr1 | 6378638 | 6378552 | − | ENST00000608083; ENST00000377842; ENST00000377845; ENST00000377855; ENST00000377860; ENST00000418124; ENST00000545482; ENST00000361521; ENST00000473466; ENST00000541130 | TAF |
| 11% | chr1 | 6380703 | 6380649 | − | chr1 | 6378638 | 6378552 | − | ENST00000608083; ENST00000377842; ENST00000377845; ENST00000377855; ENST00000377860; ENST00000418124; ENST00000545482; ENST00000361521; ENST00000473466; ENST00000541130 | TAF |
| 11% | chr19 | 1114930 | 1114676 | − | chr19 | 1114421 | 1114230 | − | ENST00000361757; ENST00000587024; ENST00000438103 | TSF |
| 10% | chr3 | 146238022 | 146237953 | − | chr3 | 146234954 | 146234793; 146234876; 146234936; 146234945 | − | ENST00000342435; ENST00000487389; ENST00000448787; ENST00000483300; ENST00000462666; ENST00000486631; ENST00000472349 | TAF |
| 10% | chr3 | 146238022 | 146237953 | − | chr3 | 146234954 | 146234793; 146234876; 146234936; 146234945 | − | ENST00000342435; ENST00000487389; ENST00000448787; ENST00000483300; ENST00000462666; ENST00000486631; ENST00000472349 | TAF |
| 10% | chr3 | 146238022 | 146237953 | − | chr3 | 146234954 | 146234793; 146234876; 146234936; 146234945 | − | ENST00000342435; ENST00000487389; ENST00000448787; ENST00000483300; ENST00000462666; ENST00000486631; ENST00000472349 | TAF |
| 10% | chr3 | 146238022 | 146237953 | − | chr3 | 146234954 | 146234793; 146234876; 146234936; 146234945 | − | ENST00000342435; ENST00000487389; ENST00000448787; ENST00000483300; ENST00000462666; ENST00000486631; ENST00000472349 | TAF |
| 10% | chr3 | 146238022 | 146237953 | − | chr3 | 146234954 | 146234793; 146234876; 146234936; 146234945 | − | ENST00000342435; ENST00000487389; ENST00000448787; ENST00000483300; ENST00000462666; ENST00000486631; ENST00000472349 | TAF |
| 9% | chr12 | 122387836 | 122388242 | + | chr12 | 122389386 | 122389436 | + | ENST00000288912; ENST00000397454 | TSF |
| 9% | chr12 | 122387836 | 122388242 | + | chr12 | 122389386 | 122389436 | + | ENST00000288912; ENST00000397454 | TSF |
| 9% | chr19 | 48654965 | 48654725 | − | chr19 | 48654596 | 48654489 | − | ENST00000263274; ENST00000601091; ENST00000542460 | TSF |
| 9% | chr19 | 48654965 | 48654725 | − | chr19 | 48654596 | 48654489 | − | ENST00000263274; ENST00000601091; ENST00000542460 | TSF |
| 9% | chr19 | 48654965 | 48654725 | − | chr19 | 48654596 | 48654489 | − | ENST00000263274; ENST00000601091; ENST00000542460 | TSF |
| 8% | chr15 | 69718867 | 69718995 | + | chr15 | 69721450 | 69721552 | + | ENST00000559279; ENST00000395392; ENST00000352331; ENST00000260363; ENST00000558585; ENST00000559283; ENST00000537891 | TSF |
| 8% | chr15 | 69718867 | 69718995 | + | chr15 | 69721450 | 69721552 | + | ENST00000559279; ENST00000395392; ENST00000352331; ENST00000260363; ENST00000558585; ENST00000559283; ENST00000537891 | TSF |
| 8% | chr15 | 69718867 | 69718995 | + | chr15 | 69721450 | 69721552 | + | ENST00000559279; ENST00000395392; ENST00000352331; ENST00000260363; ENST00000558585; ENST00000559283; ENST00000537891 | TSF |
| 8% | chr15 | 69718867 | 69718995 | + | chr15 | 69721450 | 69721552 | + | ENST00000559279; ENST00000395392; ENST00000352331; ENST00000260363; ENST00000558585; ENST00000559283; ENST00000537891 | TSF |
| 7% | chr12 | 122387836 | 122388242 | + | chr12 | 122392026 | 122392240 | + | ENST00000288912; ENST00000397454 | TSF |
| 7% | chr12 | 122387836 | 122388242 | + | chr12 | 122392026 | 122392240 | + | ENST00000288912; ENST00000397454 | TSF |
| 7% | chr22 | 29117574 | 29117506 | − | chr22 | 29115473 | 29115383; 29115458 | − | ENST00000348295; ENST00000382566; ENST00000382578; ENST00000404276; ENST00000328354; ENST00000405598; | TSF |

TABLE 12-continued

Transcript fusion for Cervical squamous cell carcinoma (CESC) Coordinates of the fusion sequences for which the donor is the TE.

| 1 | 2' | 3' | 4' | 5' | 6' | 7' | 8' | 9' | 10' | 11' |
|---|----|----|----|----|----|----|----|----|-----|-----|
| 7% | chr22 | 29117574 | 29117506 | − | chr22 | 29115473 | 29115383; 29115458 | − | ENST00000382580; ENST00000433728; ENST00000448511; ENST00000402731; ENST00000403642; ENST00000439200 ENST00000348295; ENST00000382566; ENST00000382578; ENST00000404276; ENST00000328354; ENST00000405598 | TSF |
| 7% | chr22 | 29117574 | 29117506 | − | chr22 | 29115473 | 29115383; 29115458 | − | ENST00000382580; ENST00000433728; ENST00000448511; ENST00000402731; ENST00000403642; ENST00000439200 ENST00000348295; ENST00000382566; ENST00000382578; ENST00000404276; ENST00000328354; ENST00000405598 | TSF |
| 7% | chr22 | 29117574 | 29117506 | − | chr22 | 29115473 | 29115383; 29115458 | − | ENST00000382580; ENST00000433728; ENST00000448511; ENST00000402731; ENST00000403642; ENST00000439200 ENST00000348295; ENST00000382566; ENST00000382578; ENST00000404276; ENST00000328354; ENST00000405598 | TSF |
| 7% | chr22 | 29117574 | 29117506 | − | chr22 | 29115473 | 29115383; 29115458 | − | ENST00000382580; ENST00000433728; ENST00000448511; ENST00000402731; ENST00000403642; ENST00000439200 ENST00000348295; ENST00000382566; ENST00000382578; ENST00000404276; ENST00000328354; ENST00000405598 | TSF |
| 7% | chr8 | 82194688 | 82194723 | + | chr8 | 82195601 | 82195773 | + | ENST00000297258 | TSF |
| 7% | chr5 | 76107394 | 76108135 | + | chr5 | 76128515 | 76129626 | + | ENST00000296677 | TSF |
| 7% | chr12 | 6602868 | 6602754 | − | chr12 | 6602138 | 6602028 | − | ENST00000229238 | TSF |
| 6% | chr12 | 122430912 | 122432103 | + | chr12 | 122437622 | 122437850 | + | ENST00000288912 | TSF |
| 6% | chr12 | 122430912 | 122431795 | + | chr12 | 122437622 | 122437850 | + | ENST00000288912 | TSF |
| 6% | chr19 | 4412258 | 4412399 | + | chr19 | 4418017 | 4418073 | + | ENST00000301280 | TSF |
| 6% | chr7 | 99801794 | 99801819 | + | chr7 | 99802250 | 99802398 | + | ENST00000426455; ENST00000394018; ENST00000317296 | TSF |
| 6% | chr7 | 56018506 | 56018522 | + | chr7 | 56020872 | 56021011 | + | ENST00000426595 | TSF |
| 6% | chr12 | 58189709 | 58189746 | + | chr12 | 58189960 | 58190366; 58189980; 58190044 | + | ENST00000454289; ENST00000540550; ENST00000323833; ENST00000350762; ENST00000457189 | TSF |
| 6% | chr12 | 58189709 | 58189746 | + | chr12 | 58189960 | 58190366; 58189980; 58190044 | + | ENST00000454289; ENST00000540550; ENST00000323833; ENST00000350762; ENST00000457189 | TSF |
| 6% | chr12 | 58189709 | 58189746 | + | chr12 | 58189960 | 58190366; 58189980; 58190044 | + | ENST00000454289; ENST00000540550; ENST00000323833; ENST00000350762; ENST00000457189 | TSF |
| 6% | chr15 | 83667946 | 83667078 | | chr15 | 83657580 | 83657392 | | ENST00000514272 | TSF |
| 5% | chr2 | 143794737 | 143794842 | + | chr2 | 143797997 | 143798227 | + | ENST00000264170; ENST00000409512 | TSF |
| 5% | chr2 | 17876171 | 17876059 | − | chr2 | 17865030 | 17864905 | − | ENST00000448223; ENST00000351948; ENST00000381272; ENST00000402989 | TSF |
| 5% | chr11 | 64599672 | 64599483 | − | chr11 | 64599193 | 64598977 | − | ENST00000342711 | TSF |
| 5% | chr1 | 1562829 | 1562926 | + | chr1 | 1563053 | 1563209 | + | ENST00000520777; ENST00000357210; ENST00000360522; ENST00000378710; ENST00000355826; ENST00000518681; ENST00000505820; ENST00000487053; ENST00000378712; ENST00000504599; ENST00000378708; ENST00000514234 | TSF |
| 5% | chr1 | 1562829 | 1562926 | + | chr1 | 1563053 | 1563209 | + | ENST00000520777; ENST00000357210; ENST00000360522; ENST00000378710; ENST00000355826; ENST00000518681; ENST00000505820; ENST00000487053; ENST00000378712; ENST00000504599; ENST00000378708; ENST00000514234 | TSF |
| 5% | chr1 | 1562829 | 1562926 | + | chr1 | 1563053 | 1563209 | + | ENST00000520777; ENST00000357210; ENST00000360522; ENST00000378710; ENST00000355826; ENST00000518681; ENST00000505820; ENST00000487053; ENST00000378712; ENST00000504599; ENST00000378708; ENST00000514234 | TSF |
| 5% | chr10 | 27470588 | 27470654 | + | chr10 | 27475308 | 27475465 | + | ENST00000375946; ENST00000375940; ENST00000342386 | TSF |
| 5% | chr1 | 1562829 | 1562875 | + | chr1 | 1563053 | 1563209 | + | ENST00000520777; ENST00000357210; ENST00000360522; ENST00000378710; ENST00000355826; ENST00000518681; | TSF |

TABLE 12-continued

Transcript fusion for Cervical squamous cell carcinoma (CESC) Coordinates of the fusion sequences for which the donor is the TE.

| 1 | 2' | 3' | 4' | 5' | 6' | 7' | 8' | 9' | 10' | 11' |
|---|----|----|----|----|----|----|----|----|-----|-----|
| 5% | chr1 | 1562829 | 1562875 | + | chr1 | 1563053 | 1563209 | + | ENST00000505820; ENST00000487053; ENST00000378712; ENST00000504599; ENST00000378708; ENST00000514234; ENST00000520777; ENST00000357210; ENST00000360522; ENST00000378710; ENST00000355826; ENST00000518681; | TSF |
| 5% | chr1 | 1562829 | 1562875 | + | chr1 | 1563053 | 1563209 | + | ENST00000505820; ENST00000487053; ENST00000378712; ENST00000504599; ENST00000378708; ENST00000514234; ENST00000520777; ENST00000357210; ENST00000360522; ENST00000378710; ENST00000355826; ENST00000518681; ENST00000505820; ENST00000487053; ENST00000378712; ENST00000504599; ENST00000378708; ENST00000514234 | TSF |
| 5% | chr17 | 17816540 | 17815566 | − | chr17 | 17810845 | 17810761 | − | ENST00000581396; ENST00000379504; ENST00000318094; ENST00000395739; ENST00000535933; ENST00000540946; ENST00000542206 | TSF |
| 5% | chr17 | 17816540 | 17815566 | − | chr17 | 17810845 | 17810761 | − | ENST00000581396; ENST00000379504; ENST00000318094; ENST00000395739; ENST00000535933; ENST00000540946; ENST00000542206 | TSF |
| 5% | chr17 | 17816540 | 17815566 | − | chr17 | 17810845 | 17810761 | − | ENST00000581396; ENST00000379504; ENST00000318094; ENST00000395739; ENST00000535933; ENST00000540946; ENST00000542206 | TSF |
| 5% | chr17 | 17816540 | 17815566 | − | chr17 | 17810845 | 17810761 | − | ENST00000581396; ENST00000379504; ENST00000318094; ENST00000395739; ENST00000535933; ENST00000540946; ENST00000542206 | TSF |
| 5% | chr17 | 17816540 | 17815566 | − | chr17 | 17810845 | 17810761 | − | ENST00000581396; ENST00000379504; ENST00000318094; ENST00000395739; ENST00000535933; ENST00000540946; ENST00000542206 | TSF |
| 5% | chr6 | 161637963 | 161637691 | − | chr6 | 161587449 | 161587280; 161587148 | − | ENST00000320285; ENST00000366908; ENST00000436279; ENST00000366905 | TSF |
| 5% | chr6 | 161637963 | 161637691 | − | chr6 | 161587449 | 161587280; 161587148 | − | ENST00000320285; ENST00000366908; ENST00000436279; ENST00000366905 | TSF |
| 5% | chr6 | 161637963 | 161637691 | − | chr6 | 161587449 | 161587280; 161587148 | − | ENST00000320285; ENST00000366908; ENST00000436279; ENST00000366905 | TSF |
| 5% | chr15 | 91529041 | 91528993 | − | chr15 | 91528055 | 91527923 | − | ENST00000394249; ENST00000361919; ENST00000361188; ENST00000442656; ENST00000557905; ENST00000559811 | TSF |
| 5% | chr15 | 91529041 | 91528993 | − | chr15 | 91528055 | 91527923 | − | ENST00000394249; ENST00000361919; ENST00000361188; ENST00000442656; ENST00000557905; ENST00000559811 | TSF |
| 5% | chr15 | 91529041 | 91528993 | − | chr15 | 91528055 | 91527923 | − | ENST00000394249; ENST00000361919; ENST00000361188; ENST00000442656; ENST00000557905; ENST00000559811 | TSF |
| 5% | chr15 | 91529041 | 91528993 | − | chr15 | 91528055 | 91527923 | − | ENST00000394249; ENST00000361919; ENST00000361188; ENST00000442656; ENST00000557905; ENST00000559811 | TSF |
| 5% | chr15 | 91529041 | 91528993 | − | chr15 | 91528055 | 91527923 | − | ENST00000394249; ENST00000361919; ENST00000361188; ENST00000442656; ENST00000557905; ENST00000559811 | TSF |
| 5% | chr15 | 91529041 | 91528993 | − | chr15 | 91528055 | 91527923 | − | ENST00000394249; ENST00000361919; ENST00000361188; ENST00000442656; ENST00000557905; ENST00000559811 | TSF |
| 5% | chr19 | 48627094 | 48627044 | − | chr19 | 48626575 | 48626431 | − | ENST00000263274; ENST00000536218; ENST00000594759; ENST00000427526; ENST00000601091 | TSF |
| 5% | chr19 | 48627094 | 48627044 | − | chr19 | 48626575 | 48626431 | − | ENST00000263274; ENST00000536218; ENST00000594759; ENST00000427526; ENST00000601091 | TSF |
| 4% | chr19 | 56811235 | 56811344 | + | chr19 | 56813337 | 56813464 | + | ENST00000588026 | TSF |
| 4% | chr19 | 50174724 | 50174836 | + | chr19 | 50176955 | 50177005; 50177034 | + | ENST00000441864; ENST00000246785; ENST00000600947; ENST00000598306 | TSF |
| 4% | chr19 | 50174724 | 50174836 | + | chr19 | 50176955 | 50177005; 50177034 | + | ENST00000441864; ENST00000246785; ENST00000600947; ENST00000598306 | TSF |

TABLE 12-continued

Transcript fusion for Cervical squamous cell carcinoma (CESC) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 4% | chr22 | 45814683 | 45815239 | + | chr22 | 45821828 | 45822055 | + | ENST00000342894; ENST00000538017 | TSF |
| 4% | chr6 | 80022917 | 80022085 | − | chr6 | 79924739 | 79924689 | − | ENST00000275036; ENST00000344726 | TSF |
| 4% | chr6 | 80022917 | 80022085 | − | chr6 | 79924739 | 79924689 | − | ENST00000275036; ENST00000344726 | TSF |
| 4% | chr10 | 79700435 | 79700428 | − | chr10 | 79628955 | 79628887 | − | ENST00000372391; ENST00000372388; ENST00000468332 | TSF |
| 4% | chr10 | 79700435 | 79700428 | − | chr10 | 79628955 | 79628887 | − | ENST00000372391; ENST00000372388; ENST00000468332 | TSF |
| 4% | chr10 | 79700435 | 79700428 | − | chr10 | 79628955 | 79628887 | − | ENST00000372391; ENST00000372388; ENST00000468332 | TSF |
| 4% | chr14 | 70466641 | 70466673 | + | chr14 | 70477471 | 70477663 | + | ENST00000361956; ENST00000381280 | TSF |
| 4% | chr14 | 70466641 | 70466673 | + | chr14 | 70477471 | 70477663 | + | ENST00000361956; ENST00000381280 | TSF |
| 4% | chr1 | 1562829 | 1562973 | + | chr1 | 1563053 | 1563209 | + | ENST00000520777; ENST00000357210; ENST00000360522; ENST00000378710; ENST00000355826; ENST00000518681; ENST00000505820; ENST00000487053; ENST00000378712; ENST00000504599; ENST00000378708; ENST00000514234 | TSF |
| 4% | chr1 | 1562829 | 1562973 | + | chr1 | 1563053 | 1563209 | + | ENST00000520777; ENST00000357210; ENST00000360522; ENST00000378710; ENST00000355826; ENST00000518681; ENST00000505820; ENST00000487053; ENST00000378712; ENST00000504599; ENST00000378708; ENST00000514234 | TSF |
| 4% | chr1 | 1562829 | 1562973 | + | chr1 | 1563053 | 1563209 | + | ENST00000520777; ENST00000357210; ENST00000360522; ENST00000378710; ENST00000355826; ENST00000518681; ENST00000505820; ENST00000487053; ENST00000378712; ENST00000504599; ENST00000378708; ENST00000514234 | TSF |
| 4% | chr1 | 1422590 | 1422685 | + | chr1 | 1423243 | 1423294 | + | ENST00000308647 | TSF |
| 4% | chr15 | 40187476 | 40186733 | − | chr15 | 40099459 | 40099207 | − | ENST00000561100; ENST00000543580 | TSF |
| 4% | chr7 | 44158417 | 44158351 | − | chr7 | 44157663 | 44157542 | − | ENST00000406581; ENST00000223361; ENST00000452185; ENST00000433715; ENST00000456038; ENST00000418438 | TSF |
| 4% | chr7 | 44158417 | 44158351 | − | chr7 | 44157663 | 44157542 | − | ENST00000406581; ENST00000223361; ENST00000452185; ENST00000433715; ENST00000456038; ENST00000418438 | TSF |
| 4% | chr7 | 44158417 | 44158351 | − | chr7 | 44157663 | 44157542 | − | ENST00000406581; ENST00000223361; ENST00000452185; ENST00000433715; ENST00000456038; ENST00000418438 | TSF |
| 4% | chr7 | 44158417 | 44158351 | − | chr7 | 44157663 | 44157542 | − | ENST00000406581; ENST00000223361; ENST00000452185; ENST00000433715; ENST00000456038; ENST00000418438 | TSF |
| 4% | chr7 | 44158417 | 44158351 | − | chr7 | 44157663 | 44157542 | − | ENST00000406581; ENST00000223361; ENST00000452185; ENST00000433715; ENST00000456038; ENST00000418438 | TSF |
| 4% | chr1 | 41465686 | 41465756 | + | chr1 | 41466701 | 41466789 | + | ENST00000372621; ENST00000541520; ENST00000372616 | TSF |
| 4% | chr1 | 15562769 | 15563257 | + | chr1 | 15578267 | 15578373 | + | ENST00000433640 | TSF |
| 4% | chr8 | 91107662 | 91105645 | − | chr8 | 91094330 | 91094254 | − | ENST00000265431 | TSF |
| 4% | chr18 | 51273 | 49727 | − | chr18 | 49237 | 49129 | − | ENST00000308911 | TSF |
| 3% | chr12 | 96340433 | 96341255 | + | chr12 | 96346495 | 96346601 | + | ENST00000266736; ENST00000548310 | TSF |
| 3% | chr12 | 96340433 | 96341255 | + | chr12 | 96346495 | 96346601 | + | ENST00000266736; ENST00000548310 | TSF |
| 3% | chr11 | 60694460 | 60694542 | + | chr11 | 60694676 | 60694890 | + | ENST00000453848; ENST00000005286 | TSF |
| 3% | chr11 | 60694460 | 60694542 | + | chr11 | 60694676 | 60694890 | + | ENST00000453848; ENST00000005286 | TSF |
| 3% | chr11 | 102074849 | 102074853 | + | chr11 | 102076624 | 102076805; 210076817 | + | ENST00000526343; ENST00000282441; ENST00000345877; ENST00000537274; ENST00000531439; ENST00000524575; ENST00000529029 | TSF |
| 3% | chr11 | 102074849 | 102074853 | + | chr11 | 102076624 | 102076805; 210076817 | + | ENST00000526343; ENST00000282441; ENST00000345877; ENST00000537274; ENST00000531439; ENST00000524575; ENST00000529029 | TSF |
| 3% | chr11 | 102074849 | 102074853 | + | chr11 | 102076624 | 102076805; 210076817 | + | ENST00000526343; ENST00000282441; ENST00000345877; ENST00000537274; ENST00000531439; ENST00000524575; ENST00000529029 | TSF |
| 3% | chr11 | 102074849 | 102074853 | + | chr11 | 102076624 | 102076805; 210076817 | + | ENST00000526343; ENST00000282441; ENST00000345877; ENST00000537274; ENST00000531439; ENST00000524575; ENST00000529029 | TSF |

TABLE 12-continued

Transcript fusion for Cervical squamous cell carcinoma (CESC) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 3% | chr12 | 122430912 | 122432282 | + | chr12 | 122437622 | 122437850 | + | ENST00000288912 | TSF |
| 3% | chr22 | 22899971 | 22899965 | − | chr22 | 22893511 | 22893189; 22893185; 22893481; 22893274 | − | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |
| 3% | chr22 | 22899971 | 22899965 | − | chr22 | 22893511 | 22893189; 22893185; 22893481; 22893274 | − | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |
| 3% | chr22 | 22899971 | 22899965 | − | chr22 | 22893511 | 22893189; 22893185; 22893481; 22893274 | − | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |
| 3% | chr22 | 22899971 | 22899965 | − | chr22 | 22893511 | 22893189; 22893185; 22893481; 22893274 | − | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |
| 3% | chr22 | 22899971 | 22899965 | − | chr22 | 22893511 | 22893189; 22893185; 22893481; 22893274 | − | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |
| 3% | chr22 | 22899971 | 22899965 | − | chr22 | 22893511 | 22893189; 22893185; 22893481; 22893274 | − | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |
| 3% | chr22 | 22899971 | 22899965 | − | chr22 | 22893511 | 22893189; 22893185; 22893481; 22893274 | − | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |
| 3% | chr7 | 158431231 | 158431181 | − | chr7 | 158424409 | 158424358 | − | ENST00000541468; ENST00000356309; ENST00000409423; ENST00000441982; ENST00000275830 | TSF |
| 3% | chr7 | 56020443 | 56020541 | + | chr7 | 56020872 | 56021011 | + | ENST00000426595 | TSF |
| 3% | chr22 | 36652278 | 36652346 | + | chr22 | 36653129 | 36653182 | + | ENST00000397278; ENST00000422706; ENST00000319136; ENST00000422471; ENST00000438034; ENST00000427990; ENST00000397279; ENST00000433768; ENST00000440669; ENST00000431184 | TSF |
| 3% | chr22 | 36652278 | 36652346 | + | chr22 | 36653129 | 36653182 | + | ENST00000397278; ENST00000422706; ENST00000319136; ENST00000422471; ENST00000438034; ENST00000427990; ENST00000397279; ENST00000433768; ENST00000440669; ENST00000431184 | TSF |
| 3% | chr22 | 36652278 | 36652346 | + | chr22 | 36653129 | 36653182 | + | ENST00000397278; ENST00000422706; ENST00000319136; ENST00000422471; ENST00000438034; ENST00000427990; ENST00000397279; ENST00000433768; ENST00000440669; ENST00000431184 | TSF |
| 3% | chr22 | 36652278 | 36652346 | + | chr22 | 36653129 | 36653182 | + | ENST00000397278; ENST00000422706; ENST00000319136; ENST00000422471; ENST00000438034; ENST00000427990; ENST00000397279; ENST00000433768; ENST00000440669; ENST00000431184 | TSF |
| 3% | chr22 | 36652278 | 36652346 | + | chr22 | 36653129 | 36653182 | + | ENST00000397278; ENST00000422706; ENST00000319136; ENST00000422471; ENST00000438034; ENST00000427990; ENST00000397279; ENST00000433768; ENST00000440669; ENST00000431184 | TSF |
| 3% | chr22 | 36652278 | 36652346 | + | chr22 | 36653129 | 36653182 | + | ENST00000397278; ENST00000422706; ENST00000319136; ENST00000422471; ENST00000438034; ENST00000427990; | TSF |

TABLE 12-continued

Transcript fusion for Cervical squamous cell carcinoma (CESC) Coordinates of the fusion sequences for which the donor is the TE.

| 1 | 2' | 3' | 4' | 5' | 6' | 7' | 8' | 9' | 10' | 11' |
|---|----|----|----|----|----|----|----|----|-----|-----|
| | | | | | | | | | ENST00000397279; ENST00000433768; ENST00000440669; ENST00000431184 | |
| 3% | chr4 | 185620772 | 185620691 | − | chr4 | 185618957 | 185618801; 185618919 | − | ENST00000281453; ENST00000510146 | TSF |
| 3% | chr4 | 185620772 | 185620691 | − | chr4 | 185618957 | 185618801; 185618919 | − | ENST00000281453; ENST00000510146 | TSF |
| 3% | chr1 | 156716197 | 156716133 | − | chr1 | 156715165 | 156715089 | − | ENST00000357325; ENST00000537739; ENST00000368209; ENST00000368206 | TSF |
| 3% | chr14 | 51360331 | 51362440 | + | chr14 | 51368547 | 51368629 | + | ENST00000337334; ENST00000353130; ENST00000395752 | TSF |
| 3% | chr3 | 129019458 | 129019508 | + | chr3 | 129020793 | 129020985; 129020977; 129020857; 129020848 | + | ENST00000509042; ENST00000383463; ENST00000417226; ENST00000510314; ENST00000502878; ENST00000389735; ENST00000509551; ENST00000511665 | TSF |
| 3% | chr3 | 129019458 | 129019508 | + | chr3 | 129020793 | 129020985; 129020977; 129020857; 129020848 | + | ENST00000509042; ENST00000383463; ENST00000417226; ENST00000510314; ENST00000502878; ENST00000389735; ENST00000509551; ENST00000511665 | TSF |
| 3% | chr3 | 129019458 | 129019508 | + | chr3 | 129020793 | 129020985; 129020977; 129020857; 129020848 | + | ENST00000509042; ENST00000383463; ENST00000417226; ENST00000510314; ENST00000502878; ENST00000389735; ENST00000509551; ENST00000511665 | TSF |
| 3% | chr3 | 129019458 | 129019508 | + | chr3 | 129020793 | 129020985; 129020977; 129020857; 129020848 | + | ENST00000509042; ENST00000383463; ENST00000417226; ENST00000510314; ENST00000502878; ENST00000389735; ENST00000509551; ENST00000511665 | TSF |
| 3% | chr3 | 129019458 | 129019508 | + | chr3 | 129020793 | 129020985; 129020977; 129020857; 129020848 | + | ENST00000509042; ENST00000383463; ENST00000417226; ENST00000510314; ENST00000502878; ENST00000389735; ENST00000509551; ENST00000511665 | TSF |
| 3% | chr11 | 66354487 | 66355279 | + | chr11 | 66361113 | 66361185 | + | ENST00000533244; ENST00000530961 | TSF |
| 3% | chr11 | 66354487 | 66355279 | + | chr11 | 66361113 | 66361185 | + | ENST00000533244; ENST00000530961 | TSF |
| 3% | chr7 | 1477059 | 1476990 | − | chr7 | 1476492 | 1476378 | − | ENST00000405088; ENST00000297508 | TSF |
| 3% | chr19 | 55449720 | 55449717 | − | chr19 | 55449609 | 55449412 | − | ENST00000340844; ENST00000590030; ENST00000446217; ENST00000588756; ENST00000586379; ENST00000592784 | TSF |
| 3% | chr19 | 55449720 | 55449717 | − | chr19 | 55449609 | 55449412 | − | ENST00000340844; ENST00000590030; ENST00000446217; ENST00000588756; ENST00000586379; ENST00000592784 | TSF |
| 3% | chr19 | 55449720 | 55449717 | − | chr19 | 55449609 | 55449412 | − | ENST00000340844; ENST00000590030; ENST00000446217; ENST00000588756; ENST00000586379; ENST00000592784 | TSF |
| 3% | chr12 | 14670381 | 14670239 | | chr12 | 14664645 | 14664445 | − | ENST00000240617 | TSF |
| 3% | chr19 | 48654965 | 48654725 | − | chr19 | 48654593 | 48654489 | − | ENST00000263274; ENST00000594759; ENST00000427526; ENST00000601091; ENST00000542460 | TSF |
| 3% | chr19 | 48654965 | 48654725 | − | chr19 | 48654593 | 48654489 | − | ENST00000263274; ENST00000594759; ENST00000427526; ENST00000601091; ENST00000542460 | TSF |
| 3% | chr19 | 48654965 | 48654725 | − | chr19 | 48654593 | 48654489 | − | ENST00000263274; ENST00000594759; ENST00000427526; ENST00000601091; ENST00000542460 | TSF |
| 3% | chr20 | 32693720 | 32693709 | − | chr20 | 32693351 | 32693174 | − | ENST00000374980 | TSF |
| 2% | chr22 | 24967426 | 24967475 | + | chr22 | 24967884 | 24967945 | + | ENST00000215829; ENST00000404603 | TSF |
| 2% | chr19 | 36105129 | 36105133 | + | chr19 | 36105944 | 36106049 | + | ENST00000587439; ENST00000203166; ENST00000379045 | TSF |
| 2% | chr19 | 36105129 | 36105133 | + | chr19 | 36105944 | 36106049 | + | ENST00000587439; ENST00000203166; ENST00000379045 | TSF |
| 2% | chr3 | 126601624 | 126602182 | + | chr3 | 126633523 | 126633593 | + | ENST00000290913; ENST00000508789; ENST00000513253 | TSF |
| 2% | chr3 | 126601624 | 126602182 | + | chr3 | 126633523 | 126633593 | + | ENST00000290913; ENST00000508789; ENST00000513253 | TSF |
| 2% | chr3 | 126601624 | 126602182 | + | chr3 | 126633523 | 126633593 | + | ENST00000290913; ENST00000508789; ENST00000513253 | TSF |
| 2% | chr4 | 1745002 | 1745264 | + | chr4 | 1746245 | 1746351 | + | ENST00000313288 | TSF |
| 2% | chr7 | 134212336 | 134212386 | + | chr7 | 134215479 | 134215562 | | ENST00000359579 | TSF |
| 2% | chr7 | 23290404 | 23290481 | + | chr7 | 23292926 | 23293078 | + | ENST00000258733; ENST00000381990; ENST00000409458; ENST00000453162 | TSF |
| 2% | chr7 | 23290404 | 23290481 | + | chr7 | 23292926 | 23293078 | + | ENST00000258733; ENST00000381990; ENST00000409458; ENST00000453162 | TSF |
| 2% | chr7 | 23290404 | 23290481 | + | chr7 | 23292926 | 23293078 | + | ENST00000258733; ENST00000381990; ENST00000409458; ENST00000453162 | TSF |
| 2% | chr7 | 23290404 | 23290481 | + | chr7 | 23292926 | 23293078 | + | ENST00000258733; ENST00000381990; ENST00000409458; ENST00000453162 | TSF |

TABLE 12-continued

Transcript fusion for Cervical squamous cell carcinoma (CESC) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 2% | chr11 | 85967969 | 85968062 | + | chr11 | 85968557 | 85968638 | + | ENST00000263360; ENST00000528180; ENST00000327320; ENST00000351625 | TSF |
| 2% | chr11 | 85967969 | 85968062 | + | chr11 | 85968557 | 85968638 | + | ENST00000263360; ENST00000528180; ENST00000327320; ENST00000351625 | TSF |
| 2% | chr11 | 85967969 | 85968062 | + | chr11 | 85968557 | 85968638 | + | ENST00000263360; ENST00000528180; ENST00000327320; ENST00000351625 | TSF |
| 2% | chr11 | 85967969 | 85968062 | + | chr11 | 85968557 | 85968638 | + | ENST00000263360; ENST00000528180; ENST00000327320; ENST00000351625 | TSF |
| 2% | chr16 | 48451457 | 48450727 | − | chr16 | 48396341 | 48395491 | − | ENST00000356721 | TSF |
| 2% | chr15 | 83667946 | 83667078 | − | chr15 | 83660798 | 83660684 | − | ENST00000451195 | TSF |
| 2% | chr3 | 139245547 | 139245400 | − | chr3 | 139237364 | 139237263 | − | ENST00000232219 | TSF |
| 2% | chr5 | 76107394 | 76108212 | + | chr5 | 76128515 | 76129626 | + | ENST00000296677 | TSF |
| 2% | chr17 | 45698288 | 45698367 | + | chr17 | 45699134 | 45699286 | + | ENST00000530173; ENST00000322157; ENST00000544660; ENST00000528565 | TSF |
| 2% | chr12 | 122387836 | 122388242 | + | chr12 | 122394980 | 122395174 | + | ENST00000288912; ENST00000397454 | TSF |
| 2% | chr12 | 122387836 | 122388242 | + | chr12 | 122394980 | 122395174 | + | ENST00000288912; ENST00000397454 | TSF |
| 2% | chr3 | 100461913 | 100462018 | + | chr3 | 100463677 | 100463775 | + | ENST00000418917; ENST00000490574; ENST00000240851; ENST00000476228 | TSF |
| 2% | chr10 | 3133726 | 3133857 | + | chr10 | 3141467 | 3141544 | + | ENST00000607886; ENST00000381125; ENST00000381075; ENST00000407806 | TSF |
| 2% | chr10 | 3133726 | 3133857 | + | chr10 | 3141467 | 3141544 | + | ENST00000607886; ENST00000381125; ENST00000381075; ENST00000407806 | TSF |
| 2% | chr10 | 3133726 | 3133857 | + | chr10 | 3141467 | 3141544 | + | ENST00000607886; ENST00000381125; ENST00000381075; ENST00000407806 | TSF |
| 2% | chr10 | 3133726 | 3133857 | + | chr10 | 3141467 | 3141544 | + | ENST00000607886; ENST00000381125; ENST00000381075; ENST00000407806 | TSF |
| 2% | chr3 | 48252382 | 48252880 | + | chr3 | 48265844 | 48265951 | + | ENST00000296435; ENST00000576243 | TSF |
| 2% | chr19 | 4412258 | 4412517 | + | chr19 | 4418017 | 4418073 | + | ENST00000301280 | TSF |
| 2% | chr3 | 184749371 | 184749503 | + | chr3 | 184766267 | 184766347 | + | ENST00000287546; ENST00000437079; ENST00000436792; ENST00000446204 | TSF |
| 2% | chr22 | 45814683 | 45814802 | + | chr22 | 45818170 | 45818288 | + | ENST00000342894; ENST00000538017 | TSF |
| 2% | chr19 | 50391349 | 50391391 | + | chr19 | 50391488 | 50391574 | + | ENST00000221543; ENST00000535102 | TSF |
| 2% | chr2 | 170668914 | 170668783 | − | chr2 | 170668368 | 170668330 | − | ENST00000442181; ENST00000409340; ENST00000260953; ENST00000409965; ENST00000392640; ENST00000308099 | TSF |
| 2% | chr9 | 21974190 | 21974089 | − | chr9 | 21971207 | 21971002; 21970901; 21970975 | − | ENST00000361570; ENST00000304494; ENST00000579755; ENST00000579122; ENST00000530628; ENST00000498124; ENST00000446177 | TSF |
| 2% | chr9 | 21974190 | 21974089 | − | chr9 | 21971207 | 21971002; 21970901; 21970975 | − | ENST00000361570; ENST00000304494; ENST00000579755; ENST00000579122; ENST00000530628; ENST00000498124; ENST00000446177 | TSF |
| 2% | chr9 | 21974190 | 21974089 | − | chr9 | 21971207 | 21971002; 21970901; 21970975 | − | ENST00000361570; ENST00000304494; ENST00000579755; ENST00000579122; ENST00000530628; ENST00000498124; ENST00000446177 | TSF |
| 2% | chr9 | 21974190 | 21974089 | − | chr9 | 21971207 | 21971002; 21970901; 21970975 | − | ENST00000361570; ENST00000304494; ENST00000579755; ENST00000579122; ENST00000530628; ENST00000498124; ENST00000446177 | TSF |
| 2% | chr19 | 47343471 | 47343373 | − | chr19 | 47342835 | 47342722 | − | ENST00000352203; ENST00000601498; ENST00000599990; ENST00000593442; ENST00000263270; ENST00000597020 | TSF |
| 2% | chr3 | 195593372 | 195593261 | − | chr3 | 195591058 | 195591052 | − | ENST00000416152; ENST00000381916; ENST00000333602; ENST00000428187; ENST00000392400 | TSF |
| 2% | chr17 | 39737300 | 39737191 | − | chr17 | 39726472 | 39726390 | − | ENST00000246662 | TSF |
| 2% | chr5 | 58596952 | 58596862 | − | chr5 | 58511794 | 58511603 | − | ENST00000340635; ENST00000360047; ENST00000507116; ENST00000503258; ENST00000405755; ENST00000502484; ENST00000546160; ENST00000309641; ENST00000502575 | TSF |
| 2% | chr5 | 58596952 | 58596862 | − | chr5 | 58511794 | 58511603 | − | ENST00000340635; ENST00000360047; ENST00000507116; ENST00000503258; ENST00000405755; ENST00000502484; ENST00000546160; ENST00000309641; ENST00000502575 | TSF |
| 2% | chr5 | 58596952 | 58596862 | − | chr5 | 58511794 | 58511603 | − | ENST00000340635; ENST00000360047; ENST00000507116; ENST00000503258; ENST00000405755; ENST00000502484; ENST00000546160; ENST00000309641; ENST00000502575 | TSF |

TABLE 13

Transcript fusion for Cholangiocarcinoma (CHOL) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 44% | chr3 | 149205406 | 149205542 | + | ENST00000305354 | chr3 | 149210784 | 149210892 | + | TAF |
| 33% | chr1 | 21926110 | 21925987 | − | ENST00000374761; ENST00000290101; ENST00000374763; ENST00000471600; ENST00000374765; ENST00000542643 | chr1 | 21925313 | 21925206 | − | TAF |
| 33% | chr1 | 21926110 | 21925987 | − | ENST00000374761; ENST00000290101; ENST00000374763; ENST00000471600; ENST00000374765; ENST00000542643 | chr1 | 21925313 | 21925206 | − | TAF |
| 33% | chr1 | 21926110 | 21925987 | − | ENST00000374761; ENST00000290101; ENST00000374763; ENST00000471600; ENST00000374765; ENST00000542643 | chr1 | 21925313 | 21925206 | − | TAF |
| 33% | chr1 | 21926110 | 21925987 | − | ENST00000374761; ENST00000290101; ENST00000374763; ENST00000471600; ENST00000374765; ENST00000542643 | chr1 | 21925313 | 21925206 | − | TAF |
| 33% | chr1 | 21926110 | 21925987 | − | ENST00000374761; ENST00000290101; ENST00000374763; ENST00000471600; ENST00000374765; ENST00000542643 | chr1 | 21925313 | 21925206 | − | TAF |
| 31% | chr20 | 43560983 | 43561073 | + | ENST00000255136; ENST00000217073 | chr20 | 43561176 | 43561224 | + | TAF |
| 28% | chr4 | 88293967 | 88293861 | − | ENST00000358290; ENST00000507286 | chr4 | 88287307 | 88287019 | − | TAF |
| 28% | chr4 | 88293967 | 88293861 | − | ENST00000358290; ENST00000507286 | chr4 | 88287307 | 88287019 | − | TAF |
| 25% | chr19 | 13869914; 13869931; 13869925 | 13870086 | + | ENST00000586600; ENST00000221554; ENST00000586666; ENST00000588809; ENST00000585844 | chr19 | 13872305 | 13872412 | + | TAF |
| 25% | chr19 | 13869914; 13869931; 13869925 | 13870086 | + | ENST00000586600; ENST00000221554; ENST00000586666; ENST00000588809; ENST00000585844 | chr19 | 13872305 | 13872412 | + | TAF |
| 25% | chr19 | 13869914; 13869931; 13869925 | 13870086 | + | ENST00000586600; ENST00000221554; ENST00000586666; ENST00000588809; ENST00000585844 | chr19 | 13872305 | 13872412 | + | TAF |
| 25% | chr19 | 13869914; 13869931; 13869925 | 13870086 | + | ENST00000586600; ENST00000221554; ENST00000586666; ENST00000588809; ENST00000585844 | chr19 | 13872305 | 13872412 | + | TAF |
| 22% | chr5 | 176761404; 176761337 | 176761285 | − | ENST00000303127; ENST00000515209; ENST00000514458 | chr5 | 176744789 | 176744095 | − | TAF |
| 22% | chr5 | 176761404; 176761337 | 176761285 | − | ENST00000303127; ENST00000515209; ENST00000514458 | chr5 | 176744789 | 176744095 | − | TAF |
| 22% | chr1 | 159683928 | 159683793 | − | ENST00000255030; ENST00000368112 | chr1 | 159682370 | 159682050 | − | TAF |
| 22% | chr3 | 49927493 | 49927357 | − | ENST00000296474; ENST00000344206 | chr3 | 49927248 | 49927204 | − | TAF |
| 22% | chr3 | 49927493 | 49927357 | − | ENST00000296474; ENST00000344206 | chr3 | 49927248 | 49927204 | − | TAF |
| 19% | chr9 | 125054028 | 125054119 | + | ENST00000297908; ENST00000344641; ENST00000373723; ENST00000373729; ENST00000394315 | chr9 | 125068067 | 125068171 | + | TSF |
| 19% | chr9 | 125054028 | 125054119 | + | ENST00000297908; ENST00000344641; ENST00000373723; ENST00000373729; ENST00000394315 | chr9 | 125068067 | 125068171 | + | TSF |
| 19% | chr9 | 125054028 | 125054119 | + | ENST00000297908; ENST00000344641; ENST00000373723; ENST00000373729; ENST00000394315 | chr9 | 125068067 | 125068171 | + | TSF |
| 17% | chr20 | 33439171 | 33439034 | − | ENST00000336431 | chr20 | 33438000 | 33437979 | − | TAF |
| 17% | chr10 | 120905865 | 120905748 | − | ENST00000355697; ENST00000330036 | chr10 | 120901885 | 120901741 | − | TAF |
| 17% | chr10 | 120905865 | 120905748 | − | ENST00000355697; ENST00000330036 | chr10 | 120901885 | 120901741 | − | TAF |
| 17% | chr16 | 29913136; 29912293 | 29913241 | + | ENST00000563177; ENST00000483405; ENST00000308748; ENST00000414952; ENST00000566693 | chr16 | 29915825 | 29915953 | + | TSF |
| 17% | chr16 | 29913136; 29912293 | 29913241 | + | ENST00000563177; ENST00000483405; ENST00000308748; ENST00000414952; ENST00000566693 | chr16 | 29915825 | 29915953 | + | TSF |
| 14% | chr10 | 60272904 | 60273093 | + | ENST00000373886 | chr10 | 60299081 | 60299303 | + | TAF |
| 14% | chr9 | 131002264 | 131002275 | + | ENST00000475805; ENST00000341179; ENST00000372923; ENST00000393594; ENST00000486160 | chr9 | 131002706 | 131002973 | + | TAF |
| 14% | chr9 | 131002264 | 131002275 | + | ENST00000475805; ENST00000341179; ENST00000372923; ENST00000393594; ENST00000486160 | chr9 | 131002706 | 131002973 | + | TAF |
| 14% | chr11 | 2940537 | 2940637 | + | ENST00000347936; ENST00000312221; ENST00000449793; ENST00000380574 | chr11 | 2940947 | 2941017 | + | TAF |
| 14% | chr11 | 2940537 | 2940637 | + | ENST00000347936; ENST00000312221; ENST00000449793; ENST00000380574 | chr11 | 2940947 | 2941017 | + | TAF |
| 14% | chr19 | 35514331 | 35514451 | + | ENST00000599564; ENST00000317991; ENST00000504615; ENST00000411896 | chr19 | 35514601 | 35514631 | + | TAF |
| 14% | chr19 | 35514331 | 35514451 | + | ENST00000599564; ENST00000317991; ENST00000504615; ENST00000411896 | chr19 | 35514601 | 35514631 | + | TAF |
| 14% | chr19 | 35514331 | 35514451 | + | ENST00000599564; ENST00000317991; ENST00000504615; ENST00000411896 | chr19 | 35514601 | 35514631 | + | TAF |
| 14% | chr19 | 35514331 | 35514451 | + | ENST00000599564; ENST00000317991; ENST00000504615; ENST00000411896 | chr19 | 35514601 | 35514631 | + | TAF |

TABLE 13-continued

Transcript fusion for Cholangiocarcinoma (CHOL) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 14% | chr5 | 82554349 | 82554496 | + | ENST00000282268; ENST00000338635; ENST00000396027; ENST00000511817 | chr5 | 82606608 | 82606935 | + | TAF |
| 14% | chr10 | 47747112 | 47747132 | + | ENST00000340243; ENST00000374277; ENST00000449464; ENST00000538825 | chr10 | 48278725 | 48278896 | + | TAF |
| 14% | chr16 | 16251666 | 16251520 | − | ENST00000205557 | chr16 | 1624711 | 16249633 | − | TAF |
| 14% | chr19 | 5680497 | 5680469 | − | ENST00000309324; ENST00000587589 | chr19 | 5680194 | 5680187 | − | TAF |
| 14% | chr2 | 132249597 | 132249449 | − | ENST00000427024; ENST00000309451 | chr2 | 132245283 | 132245193 | − | TAF |
| 14% | chr2 | 132249597 | 132249449 | − | ENST00000427024; ENST00000309451 | chr2 | 132245283 | 132245193 | − | TAF |
| 14% | chr1 | 159683928 | 159683797 | − | ENST00000255030; ENST00000368112; ENST00000368111; ENST00000368110; ENST00000343919 | chr1 | 159682370 | 159682050 | − | TAF |
| 11% | chr16 | 2818998 | 2819285 | + | ENST00000301740 | chr16 | 2819676 | 2820194 | + | TAF |
| 11% | chr19 | 50984141 | 50984234 | + | ENST00000334976; ENST00000376918; 8585ENST0000059 | chr19 | 51009025 | 51009080 | + | TAF |
| 11% | chr10 | 15151838 | 15151701 | − | ENST00000378165; ENST00000378150; ENST00000540259; ENST00000535341 | chr10 | 15148697 | 15148684 | − | TAF |
| 11% | chr10 | 15151838 | 15151701 | − | ENST00000378165; ENST00000378150; ENST00000540259; ENST00000535341 | chr10 | 15148697 | 15148684 | − | TAF |
| 11% | chr10 | 15151838 | 15151701 | − | ENST00000378165; ENST00000378150; ENST00000540259; ENST00000535341 | chr10 | 15148697 | 15148684 | − | TAF |
| 11% | chr10 | 15151838 | 15151701 | − | ENST00000378165; ENST00000378150; ENST00000540259; ENST00000535341 | chr10 | 15148697 | 15148684 | − | TAF |
| 11% | chr5 | 147207691 | 147207585 | − | ENST00000296695; ENST00000510027 | chr5 | 147185494 | 147185375 | − | TAF |
| 11% | chr16 | 4409386 | 4409297 | − | ENST00000572467; ENST00000251166; ENST00000539968; ENST00000537233; ENST00000574025; ENST00000576637 | chr16 | 4409070 | 4408945 | − | TAF |
| 11% | chr16 | 4409386 | 4409297 | − | ENST00000572467; ENST00000251166; ENST00000539968; ENST00000537233; ENST00000574025; ENST00000576637 | chr16 | 4409070 | 4408945 | − | TAF |
| 11% | chr16 | 4409386 | 4409297 | − | ENST00000572467; ENST00000251166; ENST00000539968; ENST00000537233; ENST00000574025; ENST00000576637 | chr16 | 4409070 | 4408945 | − | TAF |
| 11% | chr16 | 4409386 | 4409297 | − | ENST00000572467; ENST00000251166; ENST00000539968; ENST00000537233; ENST00000574025; ENST00000576637 | chr16 | 4409070 | 4408945 | − | TAF |
| 11% | chr16 | 4409386 | 4409297 | − | ENST00000572467; ENST00000251166; ENST00000539968; ENST00000537233; ENST00000574025; ENST00000576637 | chr16 | 4409070 | 4408945 | − | TAF |
| 11% | chr19 | 6678034; 6677969 | 6677917 | − | ENST00000245907; ENST00000601008 | chr19 | 6670525 | 6670384 | − | TAF |
| 11% | chr19 | 6678034; 6677969 | 6677917 | − | ENST00000245907; ENST00000601008 | chr19 | 6670525 | 6670384 | − | TAF |
| 11% | chr3 | 124839669; 124839530; 124839525 | 124839443 | − | ENST00000430155; ENST00000393469; ENST00000423114; ENST00000469902; ENST00000314584; ENST00000479826 | chr3 | 124838735 | 124838686 | − | TAF |
| 11% | chr3 | 124839669; 124839530; 124839525 | 124839443 | − | ENST00000430155; ENST00000393469; ENST00000423114; ENST00000469902; ENST00000314584; ENST00000479826 | chr3 | 124838735 | 124838686 | − | TAF |
| 11% | chr3 | 124839669; 124839530; 124839525 | 124839443 | − | ENST00000430155; ENST00000393469; ENST00000423114; ENST00000469902; ENST00000314584; ENST00000479826 | chr3 | 124838735 | 124838686 | − | TAF |
| 11% | chr3 | 124839669; 124839530; 124839525 | 124839443 | − | ENST00000430155; ENST00000393469; ENST00000423114; ENST00000469902; ENST00000314584; ENST00000479826 | chr3 | 124838735 | 124838686 | − | TAF |
| 11% | chr3 | 124839669; 124839530; 124839525 | 124839443 | − | ENST00000430155; ENST00000393469; ENST00000423114; ENST00000469902; ENST00000314584; ENST00000479826 | chr3 | 124838735 | 124838686 | − | TAF |
| 11% | chr17 | 40821639; 40821538 | 40821448 | − | ENST00000591022; ENST00000412503; ENST00000293349 | chr17 | 40820920 | 40820864 | − | TAF |
| 11% | chr17 | 40821639; 40821538 | 40821448 | − | ENST00000591022; ENST00000412503; ENST00000293349 | chr17 | 40820920 | 40820864 | − | TAF |
| 11% | chr17 | 40821639; 40821538 | 40821448 | − | ENST00000591022; ENST00000412503; ENST00000293349 | chr17 | 40820920 | 40820864 | − | TAF |

TABLE 14

Transcript fusion for Cholangiocarcinoma (CHOL) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 64% | chr3 | 182757105 | 182757101 | − | chr3 | 182756923 | 182756814 | − | ENST00000265594; ENST00000492597; ENST00000497959; ENST00000539926; ENST00000476176 | TSF |
| 64% | chr3 | 182757105 | 182757101 | − | chr3 | 182756923 | 182756814 | − | ENST00000265594; ENST00000492597; ENST00000497959; ENST00000539926; ENST00000476176 | TSF |
| 64% | chr3 | 182757105 | 182757101 | − | chr3 | 182756923 | 182756814 | − | ENST00000265594; ENST00000492597; ENST00000497959; ENST00000539926; ENST00000476176 | TSF |
| 64% | chr3 | 182757105 | 182757101 | − | chr3 | 182756923 | 182756814 | − | ENST00000265594; ENST00000492597; ENST00000497959; ENST00000539926; ENST00000476176 | TSF |
| 47% | chr16 | 29915789 | 29915910 | + | chr16 | 29916173 | 29916286 | + | ENST00000563177; ENST00000483405; ENST00000308748; ENST00000414952; ENST00000566693 | TAF |
| 47% | chr16 | 29915789 | 29915910 | + | chr16 | 29916173 | 29916286 | + | ENST00000563177; ENST00000483405; ENST00000308748; ENST00000414952; ENST00000566693 | TAF |
| 44% | chrX | 2178048 | 2177670 | − | chrX | 2161271 | 2161064; 2161103 | − | ENST00000334651; ENST00000412516 | TAF |
| 44% | chrX | 2178048 | 2177670 | − | chrX | 2161271 | 2161064; 2161103 | − | ENST00000334651; ENST00000412516 | TAF |
| 42% | chr10 | 60376682 | 60376727 | + | chr10 | 60380615 | 60380661 | + | ENST00000373886 | TAF |
| 36% | chr7 | 150938296 | 150938250 | − | chr7 | 150937608 | 150937511 | − | ENST00000262188; ENST00000392811; ENST00000356800 | TAF |
| 33% | chr1 | 21925339 | 21925216 | − | chr1 | 21924995 | 21924893 | − | ENST00000374761; ENST00000290101; ENST00000374763; ENST00000374765; ENST00000542643 | TAF |
| 33% | chr1 | 21925339 | 21925216 | − | chr1 | 21924995 | 21924893 | − | ENST00000374761; ENST00000290101; ENST00000374763; ENST00000374765; ENST00000542643 | TAF |
| 33% | chr20 | 10400592 | 10400319 | − | chr20 | 10389451 | 10389276 | − | ENST00000347364; ENST00000399054 | TSF |
| 31% | chr19 | 54631006 | 54631115 | + | chr19 | 54631448 | 54631575 | + | ENST00000321030; ENST00000419967 | TAF |
| 31% | chr19 | 54631006 | 54631115 | + | chr19 | 54631448 | 54631575 | + | ENST00000321030; ENST00000419967 | TAF |
| 28% | chr6 | 24783176 | 24783543 | + | chr6 | 24784315 | 24784397; 24784347 | + | ENST00000356509; ENST00000230056; ENST00000378054; ENST00000378059 | TAF |
| 28% | chr6 | 24783176 | 24783543 | + | chr6 | 24784315 | 24784397; 24784347 | + | ENST00000356509; ENST00000230056; ENST00000378054; ENST00000378059 | TAF |
| 28% | chr6 | 24783176 | 24783543 | + | chr6 | 24784315 | 24784397; 24784347 | + | ENST00000356509; ENST00000230056; ENST00000378054; ENST00000378059 | TAF |
| 28% | chr8 | 104389530 | 104389551 | + | chr8 | 104390255 | 104390471 | + | ENST00000330295; ENST00000520337 | TAF |
| 28% | chr19 | 54930702 | 54930716 | + | chr19 | 54932451 | 54932562 | + | ENST00000423529; ENST00000301194; ENST00000376530; ENST00000445095; ENST00000391739; ENST00000376531 | TAF |
| 28% | chr19 | 54930702 | 54930716 | + | chr19 | 54932451 | 54932562 | + | ENST00000423529; ENST00000301194; ENST00000376530; ENST00000445095; ENST00000391739; ENST00000376531 | TAF |
| 28% | chr19 | 54930702 | 54930716 | + | chr19 | 54932451 | 54932562 | + | ENST00000423529; ENST00000301194; ENST00000376530; ENST00000445095; ENST00000391739; ENST00000376531 | TAF |
| 28% | chr19 | 54930702 | 54930716 | + | chr19 | 54932451 | 54932562 | + | ENST00000423529; ENST00000301194; ENST00000376530; ENST00000445095; ENST00000391739; ENST00000376531 | TAF |
| 28% | chr19 | 54930702 | 54930716 | + | chr19 | 54932451 | 54932562 | + | ENST00000423529; ENST00000301194; ENST00000376530; ENST00000445095; ENST00000391739; ENST00000376531 | TAF |
| 28% | chr19 | 54930702 | 54930716 | + | chr19 | 54932451 | 54932562 | + | ENST00000423529; ENST00000301194; ENST00000376530; ENST00000445095; ENST00000391739; ENST00000376531 | TAF |
| 25% | chr9 | 131002678 | 131002811 | + | chr9 | 131004511 | 131004624 | + | ENST00000475805; ENST00000341179; ENST00000372923; ENST00000393594; ENST00000486160 | TAF |
| 25% | chr9 | 131002678 | 131002811 | + | chr9 | 131004511 | 131004624 | + | ENST00000475805; ENST00000341179; ENST00000372923; ENST00000393594; ENST00000486160 | TAF |
| 25% | chr17 | 79214190 | 79214239 | + | chr17 | 79214787 | 79214816; 79214953 | + | ENST00000431388; ENST00000576002 | TAF |
| 25% | chr17 | 79214190 | 79214239 | + | chr17 | 79214787 | 79214816; 79214953 | + | ENST00000431388; ENST00000576002 | TAF |
| 25% | chr10 | 99548701 | 99548695 | − | chr10 | 99529502 | 99529425 | − | ENST00000266066 | TAF |
| 25% | chr12 | 79992039 | 79991596 | − | chr12 | 79990438 | 79990291 | − | ENST00000328827 | TAF |
| 25% | chr2 | 150044073 | 150044093 | + | chr2 | 150061767 | 150061918 | + | ENST00000409642; ENST00000409876; ENST00000409029; ENST00000442722; ENST00000280115 | TSF |

TABLE 14-continued

Transcript fusion for Cholangiocarcinoma (CHOL) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 25% | chr2 | 150044073 | 150044093 | + | chr2 | 150061767 | 150061918 | + | ENST00000409642; ENST00000409876; ENST00000409029; ENST00000442722; ENST00000280115 | TSF |
| 25% | chr5 | 59983652 | 59983552 | − | chr5 | 59983054 | 59982789 | − | ENST00000265036; ENST00000453022 | TSF |
| 25% | chr5 | 59983652 | 59983552 | − | chr5 | 59983054 | 59982789 | − | ENST00000265036; ENST00000453022 | TSF |
| 25% | chr16 | 57795289 | 57795262 | − | chr16 | 57795083 | 57794954 | − | ENST00000465878; ENST00000379655; ENST00000445690; ENST00000421376; ENST00000541240; ENST00000540079; ENST00000543930; ENST00000562903; ENST00000539578; ENST00000565270 | TSF |
| 25% | chr16 | 57795289 | 57795262 | − | chr16 | 57795083 | 57794954 | − | ENST00000465878; ENST00000379655; ENST00000445690; ENST00000421376; ENST00000541240; ENST00000540079; ENST00000543930; ENST00000562903; ENST00000539578; ENST00000565270 | TSF |
| 25% | chr16 | 57795289 | 57795262 | − | chr16 | 57795083 | 57794954 | − | ENST00000465878; ENST00000379655; ENST00000445690; ENST00000421376; ENST00000541240; ENST00000540079; ENST00000543930; ENST00000562903; ENST00000539578; ENST00000565270 | TSF |
| 22% | chr20 | 30269169 | 30269014 | − | chr20 | 30253889 | 30253752; 30253838 | − | ENST00000376062; ENST00000376055; ENST00000307677; ENST00000420653; ENST00000450273 | TAF |
| 22% | chr20 | 30269169 | 30269014 | − | chr20 | 30253889 | 30253752; 30253838 | − | ENST00000376062; ENST00000376055; ENST00000307677; ENST00000420653; ENST00000450273 | TAF |
| 22% | chr6 | 24306949 | 24306866 | − | chr6 | 24302272 | 24302196 | − | ENST00000378454 | TAF |
| 22% | chr6 | 80022917 | 80022085 | − | chr6 | 79924739 | 79924689 | − | ENST00000275036; ENST00000344726 | TSF |
| 22% | chr6 | 80022917 | 80022085 | − | chr6 | 79924739 | 79924689 | − | ENST00000275036; ENST00000344726 | TSF |
| 19% | chr17 | 48749939 | 48750209 | + | chr17 | 48750332 | 48750499 | + | ENST00000285238; ENST00000505699 | TAF |
| 19% | chr17 | 48749939 | 48750209 | + | chr17 | 48750332 | 48750499 | + | ENST00000285238; ENST00000505699 | TAF |
| 19% | chr19 | 10819783 | 10819829 | + | chr19 | 10822837 | 10822975; 10822931 | + | ENST00000250237; ENST00000591643 | TAF |
| 19% | chr19 | 10819783 | 10819829 | + | chr19 | 10822837 | 10822975; 10822931 | + | ENST00000250237; ENST00000591643 | TAF |
| 19% | chr10 | 98363669 | 98363643 | − | chr10 | 98362155 | 98362037 | − | ENST00000339364; ENST00000371110; ENST00000371109 | TAF |
| 19% | chr10 | 98363669 | 98363666 | − | chr10 | 98362155 | 98362037 | − | ENST00000339364; ENST00000371110; ENST00000371109 | TAF |
| 19% | chr2 | 101649818 | 101649808 | − | chr2 | 101648847 | 101648730 | − | ENST00000376840; ENST00000409318 | TAF |
| 19% | chr16 | 89649823 | 89649851 | + | chr16 | 89650105 | 89650179 | + | ENST00000268720; ENST00000319518 | TSF |
| 19% | chr12 | 117498589 | 117498567 | − | chr12 | 117494691 | 117494611 | − | ENST00000470612; ENST00000335209; ENST00000392545; ENST00000462502 | TSF |
| 19% | chr12 | 117498589 | 117498567 | − | chr12 | 117494691 | 117494611 | − | ENST00000470612; ENST00000335209; ENST00000392545; ENST00000462502 | TSF |
| 19% | chr12 | 117498589 | 117498567 | − | chr12 | 117494691 | 117494611 | − | ENST00000470612; ENST00000335209; ENST00000392545; ENST00000462502 | TSF |
| 17% | chr17 | 80440912 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |
| 17% | chr17 | 80440912 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |
| 17% | chr17 | 80440912 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |
| 17% | chr17 | 80440912 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |
| 17% | chr4 | 107241932 | 107242850 | + | chr4 | 107246142 | 107246275 | + | ENST00000394701 | TAF |
| 17% | chr10 | 71235761 | 71236002 | + | chr10 | 71243447 | 71243632 | + | ENST00000373290 | TAF |
| 17% | chrX | 48793481 | 48793462 | − | chrX | 48792291 | 48792227 | − | ENST00000396743; ENST00000455452; ENST00000156084; ENST00000376488; ENST00000428668 | TAF |
| 17% | chrX | 48793481 | 48793462 | − | chrX | 48792291 | 48792227 | − | ENST00000396743; ENST00000455452; ENST00000156084; ENST00000376488; ENST00000428668 | TAF |
| 17% | chr10 | 34694893 | 34694588 | − | chr10 | 34690845 | 34690754 | − | ENST00000545260; ENST00000545693; ENST00000346874; ENST00000350537; ENST00000374788; ENST00000374789; | TAF |

TABLE 14-continued

Transcript fusion for Cholangiocarcinoma (CHOL) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 17% | chr10 | 34694893 | 34694588 | − | chr10 | 34690845 | 34690754 | − | ENST00000374790; ENST00000374794; ENST00000374776; ENST00000340077; ENST00000374773 ENST00000545260; ENST00000545693; ENST00000346874; ENST00000350537; ENST00000374788; ENST00000374789; ENST00000374790; ENST00000374794; ENST00000374776; ENST00000340077; ENST00000374773 | TAF |
| 17% | chr10 | 34694893 | 34694588 | − | chr10 | 34690845 | 34690754 | − | ENST00000545260; ENST00000545693; ENST00000346874; ENST00000350537; ENST00000374788; ENST00000374789; ENST00000374790; ENST00000374794; ENST00000374776; ENST00000340077; ENST00000374773 | TAF |
| 17% | chr10 | 34694893 | 34694588 | − | chr10 | 34690845 | 34690754 | − | ENST00000545260; ENST00000545693; ENST00000346874; ENST00000350537; ENST00000374788; ENST00000374789; ENST00000374790; ENST00000374794; ENST00000374776; ENST00000340077; ENST00000374773 | TAF |
| 17% | chr10 | 34694893 | 34694588 | − | chr10 | 34690845 | 34690754 | − | ENST00000545260; ENST00000545693; ENST00000346874; ENST00000350537; ENST00000374788; ENST00000374789; ENST00000374790; ENST00000374794; ENST00000374776; ENST00000340077; ENST00000374773 | TAF |
| 17% | chr10 | 34694893 | 34694588 | − | chr10 | 34690845 | 34690754 | − | ENST00000545260; ENST00000545693; ENST00000346874; ENST00000350537; ENST00000374788; ENST00000374789; ENST00000374790; ENST00000374794; ENST00000374776; ENST00000340077; ENST00000374773 | TAF |
| 17% | chr10 | 34694893 | 34694588 | − | chr10 | 34690845 | 34690754 | − | ENST00000545260; ENST00000545693; ENST00000346874; ENST00000350537; ENST00000374788; ENST00000374789; ENST00000374790; ENST00000374794; ENST00000374776; ENST00000340077; ENST00000374773 | TAF |
| 17% | chr10 | 34694893 | 34694588 | − | chr10 | 34690845 | 34690754 | − | ENST00000545260; ENST00000545693; ENST00000346874; ENST00000350537; ENST00000374788; ENST00000374789; ENST00000374790; ENST00000374794; ENST00000374776; ENST00000340077; ENST00000374773 | TAF |
| 17% | chr10 | 34694893 | 34694588 | − | chr10 | 34690845 | 34690754 | − | ENST00000545260; ENST00000545693; ENST00000346874; ENST00000350537; ENST00000374788; ENST00000374789; ENST00000374790; ENST00000374794; ENST00000374776; ENST00000340077; ENST00000374773 | TAF |
| 17% | chr11 | 424193 | 423942 | − | chr11 | 421198 | 421141 | − | ENST00000332826 | TAF |
| 17% | chr19 | 55558521 | 55558473 | − | chr19 | 55556677 | 55556442 | − | ENST00000415061; ENST00000396247 | TAF |
| 17% | chr5 | 176950300 | 176950160 | − | chr5 | 176949072 | 176948976 | − | ENST00000514747; ENST00000329540; ENST00000443375; ENST00000524677 | TAF |
| 17% | chr5 | 823586 | 823504 | − | chr5 | 822010 | 821976 | − | ENST00000424784; ENST00000283441 | TAF |
| 17% | chr19 | 1114930 | 1114676 | − | chr19 | 1114421 | 1114230 | − | ENST00000361757; ENST00000587024; ENST00000438103 | TSF |
| 17 | chr10 | 7735189 | 7733712 | − | chr10 | 7697638 | 7697594 | − | ENST00000256861; ENST00000397146; ENST00000397145 | TSF |
| 17% | chr10 | 7735189 | 7733712 | − | chr10 | 7697638 | 7697594 | − | ENST00000256861; ENST00000397146; ENST00000397145 | TSF |
| 17% | chr10 | 7735189 | 7733712 | − | chr10 | 7697638 | 7697594 | − | ENST00000256861; ENST00000397146; ENST00000397145 | TSF |
| 17% | chr10 | 7735546 | 7735278 | − | chr10 | 7697638 | 7697594 | − | ENST00000256861; ENST00000397146; ENST00000397145 | TSF |
| 17% | chr10 | 7735546 | 7735278 | − | chr10 | 7697638 | 7697594 | − | ENST00000256861; ENST00000397146; ENST00000397145 | TSF |
| 17% | chr10 | 7735546 | 7735278 | − | chr10 | 7697638 | 7697594 | − | ENST00000256861; ENST00000397146; ENST00000397145 | TSF |
| 14% | chr20 | 43581305 | 43581345 | + | chr20 | 43586978 | 43587052 | + | ENST00000372826 | TAF |
| 14% | chr10 | 71851150 | 71851334 | + | chr10 | 71851513 | 71851710 | + | ENST00000373255 | TAF |
| 14% | chr2 | 70052223 | 70052362 | + | chr2 | 70052588 | 70052647 | + | ENST00000409920; ENST00000394295; ENST00000536030 | TAF |

TABLE 14-continued

Transcript fusion for Cholangiocarcinoma (CHOL) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 14% | chr3 | 149210772 | 149210837 | + | chr3 | 149216509 | 149216698 | + | ENST00000305354 | TAF |
| 14% | chr5 | 176950016 | 176949956 | − | chr5 | 176949072 | 176948976 | − | ENST00000514747; ENST00000329540; ENST00000443375; ENST00000524677 | TAF |
| 14% | chr11 | 11334682 | 11334475 | − | chr11 | 11314740 | 11314576 | − | ENST00000227756 | TAF |
| 14% | chr6 | 24710791 | 24710723 | − | chr6 | 24709139 | 24709005 | − | ENST00000378119; ENST00000540769; ENST00000378102 | TAF |
| 14% | chr2 | 26433512 | 26433446 | − | chr2 | 26432758 | 26432649 | − | ENST00000380649 | TAF |
| 14% | chr19 | 6761121 | 6761101 | − | chr19 | 6760998 | 6760649 | − | ENST00000245908; ENST00000597687 | TAF |
| 14% | chr19 | 6761121 | 6761101 | − | chr19 | 6760998 | 6760649 | − | ENST00000245908; ENST00000597687 | TAF |
| 11% | chr10 | 3122429 | 3122494 | + | chr10 | 3124580 | 3124653 | + | ENST00000381125; ENST00000381075 | TAF |
| 11% | chr10 | 3122429 | 3122494 | + | chr10 | 3124580 | 3124653 | + | ENST00000381125; ENST00000381075 | TAF |
| 11% | chr11 | 725232 | 725414 | + | chr11 | 725728 | 725847 | + | ENST00000318562; ENST00000533256; ENST00000530636; ENST00000526198 | TAF |
| 11% | chr1 | 44018824 | 44019043 | + | chr1 | 44019163 | 44019308 | + | ENST00000359947; ENST00000438120; ENST00000372413; ENST00000372414; ENST00000437607 | TAF |
| 11% | chr1 | 44018824 | 44019043 | + | chr1 | 44019163 | 44019308 | + | ENST00000359947; ENST00000438120; ENST00000372413; ENST00000372414; ENST00000437607 | TAF |
| 11% | chr1 | 44018824 | 44019043 | + | chr1 | 44019163 | 44019308 | + | ENST00000359947; ENST00000438120; ENST00000372413; ENST00000372414; ENST00000437607 | TAF |
| 11% | chr1 | 31887686 | 31887779 | + | chr1 | 31896540 | 31896701 | + | ENST00000373710; ENST00000536859; ENST00000373709; ENST00000536384 | TAF |
| 11% | chr8 | 144638103 | 144638200 | + | chr8 | 144640548 | 144640621 | + | ENST00000533063 | TAF |
| 11% | chr22 | 37422073 | 37422119 | + | chr22 | 37425257 | 37425555 | + | ENST00000401419; ENST00000397129; ENST00000404802; ENST00000341116; ENST00000429360; ENST00000397225 | TAF |
| 11% | chr16 | 29845718 | 29845758 | + | chr16 | 29848043 | 29848279; 29848124 | + | ENST00000357402; ENST00000566859; ENST00000452209; ENST00000395353 | TAF |
| 11% | chr16 | 29845718 | 29845758 | + | chr16 | 29848043 | 29848279; 29848124 | + | ENST00000357402; ENST00000566859; ENST00000452209; ENST00000395353 | TAF |
| 11% | chr16 | 29845718 | 29845758 | + | chr16 | 29848043 | 29848279; 29848124 | + | ENST00000357402; ENST00000566859; ENST00000452209; ENST00000395353 | TAF |
| 11% | chr20 | 36998164 | 36998324 | + | chr20 | 36999382 | 36999449 | + | ENST00000217407 | TAF |
| 11% | chr14 | 102691697 | 102691432 | − | chr14 | 102691131 | 102691116 | − | ENST00000559838 | TAF |
| 11% | chr9 | 100872455 | 100872351 | − | chr9 | 100872266 | 100872171 | − | ENST00000375098; ENST00000341469; ENST00000342043 | TAF |
| 11% | chr5 | 54722535 | 54722306 | − | chr5 | 54721867 | 54721691 | − | ENST00000264775; ENST00000307259 | TAF |
| 11% | chr10 | 7612883 | 7612834 | − | chr10 | 7611747 | 7611631 | − | ENST00000256861; ENST00000298441; ENST00000446830 | TAF |
| 11% | chr10 | 7612883 | 7612834 | − | chr10 | 7611747 | 7611631 | − | ENST00000256861; ENST00000298441; ENST00000446830 | TAF |
| 11% | chr19 | 49121994 | 49121817 | − | chr19 | 49121134 | 49121048 | − | ENST00000549920; ENST00000547897; ENST00000084795; ENST00000550645; ENST00000549370; ENST00000549273 | TAF |
| 11% | chr19 | 49121994 | 49121817 | − | chr19 | 49121134 | 49121048 | − | ENST00000549920; ENST00000547897; ENST00000084795; ENST00000550645; ENST00000549370; ENST00000549273 | TAF |
| 11% | chr19 | 49121994 | 49121817 | − | chr19 | 49121134 | 49121048 | − | ENST00000549920; ENST00000547897; ENST00000084795; ENST00000550645; ENST00000549370; ENST00000549273 | TAF |
| 11% | chr19 | 49121994 | 49121817 | − | chr19 | 49121134 | 49121048 | − | ENST00000549920; ENST00000547897; ENST00000084795; ENST00000550645; ENST00000549370; ENST00000549273 | TAF |
| 11% | chr19 | 49121994 | 49121817 | − | chr19 | 49121134 | 49121048 | − | ENST00000549920; ENST00000547897; ENST00000084795; ENST00000550645; ENST00000549370; ENST00000549273 | TAF |
| 11% | chr16 | 57816467 | 57816371 | − | chr16 | 57806200 | 57806135 | − | ENST00000379655; ENST00000445690; ENST00000541240; ENST00000540079; ENST00000539578; ENST00000562503; ENST00000569222; ENST00000566648; ENST00000561524; ENST00000565684 | TAF |
| 11% | chr16 | 57816467 | 57816371 | − | chr16 | 57806200 | 57806135 | − | ENST00000379655; ENST00000445690; ENST00000541240; ENST00000540079; ENST00000539578; ENST00000562503; ENST00000569222; ENST00000566648; ENST00000561524; ENST00000565684 | TAF |
| 11% | chr16 | 57816467 | 57816371 | − | chr16 | 57806200 | 57806135 | − | ENST00000379655; ENST00000445690; ENST00000541240; ENST00000540079; ENST00000539578; ENST00000562503; ENST00000569222; ENST00000566648; ENST00000561524; ENST00000565684 | TAF |
| 11% | chr16 | 57816467 | 57816371 | − | chr16 | 57806200 | 57806135 | − | ENST00000379655; ENST00000445690; ENST00000541240; ENST00000540079; ENST00000539578; ENST00000562503; | TAF |

TABLE 14-continued

Transcript fusion for Cholangiocarcinoma (CHOL) Coordinates of the fusion sequences for which the donor is the TE.

| 1' | 2' | 3' | 4' | 5' | 6' | 7' | 8' | 9' | 10' | 11' |
|---|---|---|---|---|---|---|---|---|---|---|
| 11% | chr16 | 57816467 | 57816371 | – | chr16 | 57806200 | 57806135 | – | ENST00000569222; ENST00000566648; ENST00000561524; ENST00000565684 ENST00000379655; ENST00000445690; ENST00000541240; ENST00000540079; ENST00000539578; ENST00000562503; | TAF |
| 11% | chr16 | 57816467 | 57816371 | – | chr16 | 57806200 | 57806135 | – | ENST00000569222; ENST00000566648; ENST00000561524; ENST00000565684 ENST00000379655; ENST00000445690; ENST00000541240; ENST00000540079; ENST00000539578; ENST00000562503; | TAF |
| 11% | chr16 | 57816467 | 57816371 | – | chr16 | 57806200 | 57806135 | – | ENST00000569222; ENST00000566648; ENST00000561524; ENST00000565684 ENST00000379655; ENST00000445690; ENST00000541240; ENST00000540079; ENST00000539578; ENST00000562503; | TAF |
| 11% | chr19 | 1600051 | 1599987 | – | chr19 | 1599559 | 1599439 | – | ENST00000569222; ENST00000566648; ENST00000561524; ENST00000565684 ENST00000585937; ENST00000591899; ENST00000589880; ENST00000585671 | TAF |

TABLE 15

Transcript fusion for Cholangiocarcinoma (CHOL) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 44% | chr3 | 149205406 | 149205542 | + | ENST00000305354 | chr3 | 149210784 | 149210892 | + | TAF |
| 33% | chr1 | 21926110 | 21925987 | – | ENST00000374761; ENST00000290101; ENST00000374763; ENST00000471600; ENST00000374765; ENST00000542643 | chr1 | 21925313 | 21925206 | – | TAF |
| 33% | chr1 | 21926110 | 21925987 | – | ENST00000374761; ENST00000290101; ENST00000374763; ENST00000471600; ENST00000374765; ENST00000542643 | chr1 | 21925313 | 21925206 | – | TAF |
| 33% | chr1 | 21926110 | 21925987 | – | ENST00000374761; ENST00000290101; ENST00000374763; ENST00000471600; ENST00000374765; ENST00000542643 | chr1 | 21925313 | 21925206 | – | TAF |
| 33% | chr1 | 21926110 | 21925987 | – | ENST00000374761; ENST00000290101; ENST00000374763; ENST00000471600; ENST00000374765; ENST00000542643 | chr1 | 21925313 | 21925206 | – | TAF |
| 33% | chr1 | 21926110 | 21925987 | – | ENST00000374761; ENST00000290101; ENST00000374763; ENST00000471600; ENST00000374765; ENST00000542643 | chr1 | 21925313 | 21925206 | – | TAF |
| 31% | chr20 | 43560983 | 43561073 | + | ENST00000255136; ENST00000217073 | chr20 | 43561176 | 43561224 | + | TAF |
| 28% | chr4 | 88293967 | 88293861 | – | ENST00000358290; ENST00000507286 | chr4 | 88287307 | 88287019 | – | TAF |
| 28% | chr4 | 88293967 | 88293861 | – | ENST00000358290; ENST00000507286 | chr4 | 88287307 | 88287019 | – | TAF |
| 25% | chr19 | 13869914; 13869931; 13869925 | 13870086 | + | ENST00000586600; ENST00000221554; ENST00000586666; ENST00000588809; ENST00000585844 | chr19 | 13872305 | 13872412 | + | TAF |
| 25% | chr19 | 13869914; 13869931; 13869925 | 13870086 | + | ENST00000586600; ENST00000221554; ENST00000586666; ENST00000588809; ENST00000585844 | chr19 | 13872305 | 13872412 | + | TAF |
| 25% | chr19 | 13869914; 13869931; 13869925 | 13870086 | + | ENST00000586600; ENST00000221554; ENST00000586666; ENST00000588809; ENST00000585844 | chr19 | 13872305 | 13872412 | + | TAF |
| 25% | chr19 | 13869914; 13869931; 13869925 | 13870086 | + | ENST00000586600; ENST00000221554; ENST00000586666; ENST00000588809; ENST00000585844 | chr19 | 13872305 | 13872412 | + | TAF |
| 22% | chr5 | 176761404; 176761337 | 176761285 | – | ENST00000303127; ENST00000515209; ENST00000514458 | chr5 | 176744789 | 176744095 | – | TAF |
| 22% | chr5 | 176761404; 176761337 | 176761285 | – | ENST00000303127; ENST00000515209; ENST00000514458 | chr5 | 176744789 | 176744095 | – | TAF |
| 22% | chr1 | 159683928 | 159683793 | – | ENST00000255030; ENST00000368112 | chr1 | 159682370 | 159682050 | – | TAF |
| 22% | chr3 | 49927493 | 49927357 | – | ENST00000296474; ENST00000344206 | chr3 | 49927248 | 49927204 | – | TAF |
| 22% | chr3 | 49927493 | 49927357 | – | ENST00000296474; ENST00000344206 | chr3 | 49927248 | 49927204 | – | TAF |
| 19% | chr9 | 125054028 | 125054119 | + | ENST00000297908; ENST00000344641; ENST00000373723; ENST00000373729; ENST00000394315 | chr9 | 125068067 | 125068171 | + | TSF |
| 19% | chr9 | 125054028 | 125054119 | + | ENST00000297908; ENST00000344641; ENST00000373723; ENST00000373729; ENST00000394315 | chr9 | 125068067 | 125068171 | + | TSF |
| 19% | chr9 | 125054028 | 125054119 | + | ENST00000297908; ENST00000344641; ENST00000373723; ENST00000373729; ENST00000394315 | chr9 | 125068067 | 125068171 | + | TSF |

TABLE 15-continued

Transcript fusion for Cholangiocarcinoma (CHOL) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 17% | chr20 | 33439171 | 33439034 | − | ENST00000336431 | chr20 | 33438000 | 33437979 | − | TAF |
| 17% | chr10 | 120905865 | 120905748 | − | ENST00000355697; ENST00000330036 | chr10 | 120901885 | 120901741 | − | TAF |
| 17% | chr10 | 120905865 | 120905748 | − | ENST00000355697; ENST00000330036 | chr10 | 120901885 | 120901741 | − | TAF |
| 17% | chr16 | 29913136; 29912293 | 29913241 | + | ENST00000563177; ENST00000483405; ENST00000308748; ENST00000414952; ENST00000566693 | chr16 | 29915825 | 29915953 | + | TSF |
| 17% | chr16 | 29913136; 29912293 | 29913241 | + | ENST00000563177; ENST00000483405; ENST00000308748; ENST00000414952; ENST00000566693 | chr16 | 29915825 | 29915953 | + | TSF |
| 14% | chr10 | 60272904 | 60273093 | + | ENST00000373886 | chr10 | 60299081 | 60299303 | + | TAF |
| 14% | chr9 | 131002264 | 131002275 | + | ENST00000475805; ENST00000341179; ENST00000372923; ENST00000393594; ENST00000486160 | chr9 | 131002706 | 131002973 | + | TAF |
| 14% | chr9 | 131002264 | 131002275 | + | ENST00000475805; ENST00000341179; ENST00000372923; ENST00000393594; ENST00000486160 | chr9 | 131002706 | 131002973 | + | TAF |
| 14% | chr11 | 2940537 | 2940637 | + | ENST00000347936; ENST00000312221; ENST00000449793; ENST00000380574 | chr11 | 2940947 | 2941017 | + | TAF |
| 14% | chr11 | 2940537 | 2940637 | + | ENST00000347936; ENST00000312221; ENST00000449793; ENST00000380574 | chr11 | 2940947 | 2941017 | + | TAF |
| 14% | chr19 | 35514331 | 35514451 | + | ENST00000599564; ENST00000317991; ENST00000504615; ENST00000411896 | chr19 | 35514601 | 35514631 | + | TAF |
| 14% | chr19 | 35514331 | 35514451 | + | ENST00000599564; ENST00000317991; ENST00000504615; ENST00000411896 | chr19 | 35514601 | 35514631 | + | TAF |
| 14% | chr19 | 35514331 | 35514451 | + | ENST00000599564; ENST00000317991; ENST00000504615; ENST00000411896 | chr19 | 35514601 | 35514631 | + | TAF |
| 14% | chr19 | 35514331 | 35514451 | + | ENST00000599564; ENST00000317991; ENST00000504615; ENST00000411896 | chr19 | 35514601 | 35514631 | + | TAF |
| 14% | chr5 | 82554349 | 82554496 | + | ENST00000282268; ENST00000338635; ENST00000396027; ENST00000511817 | chr5 | 82606608 | 82606935 | + | TAF |
| 14% | chr10 | 47747112 | 47747132 | + | ENST00000340243; ENST00000374277; ENST00000449464; ENST00000538825 | chr10 | 48278725 | 48278896 | + | TAF |
| 14% | chr16 | 16251666 | 16251520 | − | ENST00000205557 | chr16 | 16249711 | 16249633 | − | TAF |
| 14% | chr19 | 5680497 | 5680469 | − | ENST00000309324; ENST00000587589 | chr19 | 5680194 | 5680187 | − | TAF |
| 14% | chr2 | 132249597 | 132249449 | − | ENST00000427024; ENST00000309451 | chr2 | 132245283 | 132245193 | − | TAF |
| 14% | chr2 | 132249597 | 132249449 | − | ENST00000427024; ENST00000309451 | chr2 | 132245283 | 132245193 | − | TAF |
| 14% | chr1 | 159683928 | 159683797 | − | ENST00000255030; ENST00000368112; ENST00000368111; ENST00000368110; ENST00000343919 | chr1 | 159682370 | 159682050 | − | TAF |
| 11% | chr16 | 2818998 | 2819285 | + | ENST00000301740 | chr16 | 2819676 | 2820194 | + | TAF |
| 11% | chr19 | 50984141 | 50984234 | + | ENST00000334976; ENST00000376918; ENST00000598585 | chr19 | 51009025 | 51009080 | + | TAF |
| 11% | chr10 | 15151838 | 15151701 | − | ENST00000378165; ENST00000378150; ENST00000540259; ENST00000535341 | chr10 | 15148697 | 15148684 | − | TAF |
| 11% | chr10 | 15151838 | 15151701 | − | ENST00000378165; ENST00000378150; ENST00000540259; ENST00000535341 | chr10 | 15148697 | 15148684 | − | TAF |
| 11% | chr10 | 15151838 | 15151701 | − | ENST00000378165; ENST00000378150; ENST00000540259; ENST00000535341 | chr10 | 15148697 | 15148684 | − | TAF |
| 11% | chr10 | 15151838 | 15151701 | − | ENST00000378165; ENST00000378150; ENST00000540259; ENST00000535341 | chr10 | 15148697 | 15148684 | − | TAF |
| 11% | chr5 | 147207691 | 147207585 | − | ENST00000296695; ENST00000510027 | chr5 | 147185494 | 147185375 | − | TAF |
| 11% | chr16 | 4409386 | 4409297 | − | ENST00000572467; ENST00000251166; ENST00000539968; ENST00000537233; ENST00000574025; ENST00000576637 | chr16 | 4409070 | 4408945 | − | TAF |
| 11% | chr16 | 4409386 | 4409297 | − | ENST00000572467; ENST00000251166; ENST00000539968; ENST00000537233; ENST00000574025; ENST00000576637 | chr16 | 4409070 | 4408945 | − | TAF |
| 11% | chr16 | 4409386 | 4409297 | − | ENST00000572467; ENST00000251166; ENST00000539968; ENST00000537233; ENST00000574025; ENST00000576637 | chr16 | 4409070 | 4408945 | − | TAF |
| 11% | chr16 | 4409386 | 4409297 | − | ENST00000572467; ENST00000251166; ENST00000539968; ENST00000537233; ENST00000574025; ENST00000576637 | chr16 | 4409070 | 4408945 | − | TAF |
| 11% | chr16 | 4409386 | 4409297 | − | ENST00000572467; ENST00000251166; ENST00000539968; ENST00000537233; ENST00000574025; ENST00000576637 | chr16 | 4409070 | 4408945 | − | TAF |
| 11% | chr19 | 6678034; 6677969 | 6677917 | − | ENST00000245907; ENST00000601008 | chr19 | 6670525 | 6670384 | − | TAF |
| 11% | chr19 | 6678034; 6677969 | 6677917 | − | ENST00000245907; ENST00000601008 | chr19 | 6670525 | 6670384 | − | TAF |
| 11% | chr3 | 124839669; 124839530; 124839525 | 124839443 | − | ENST00000430155; ENST00000393469; ENST00000423114; ENST00000469902; ENST00000314584; ENST00000479826 | chr3 | 124838735 | 124838686 | − | TAF |
| 11% | chr3 | 124839669; 124839530; 124839525 | 124839443 | − | ENST00000430155; ENST00000393469; ENST00000423114; ENST00000469902; ENST00000314584; ENST00000479826 | chr3 | 124838735 | 124838686 | − | TAF |

TABLE 15-continued

Transcript fusion for Cholangiocarcinoma (CHOL) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 11% | chr3 | 124839669; 124839530; 124839525 | 124839443 | − | ENST00000430155; ENST00000393469; ENST00000423114; ENST00000469902; ENST00000314584; ENST0000479826 | chr3 | 124838735 | 124838686 | − | TAF |
| 11% | chr3 | 124839669; 124839530; 124839525 | 124839443 | − | ENST00000430155; ENST00000393469; ENST00000423114; ENST00000469902; ENST00000314584; ENST0000479826 | chr3 | 124838735 | 124838686 | − | TAF |
| 11% | chr3 | 124839669; 124839530; 124839525 | 124839443 | − | ENST00000430155; ENST00000393469; ENST00000423114; ENST00000469902; ENST00000314584; ENST0000479826 | chr3 | 124838735 | 124838686 | − | TAF |
| 11% | chr17 | 40821639; 40821538 | 40821448 | − | ENST00000591022; ENST00000412503; ENST00000293349 | chr17 | 40820920 | 40820864 | − | TAF |
| 11% | chr17 | 40821639; 40821538 | 40821448 | − | ENST00000591022; ENST00000412503; ENST00000293349 | chr17 | 40820920 | 40820864 | − | TAF |
| 11% | chr17 | 40821639; 40821538 | 40821448 | − | ENST00000591022; ENST00000412503; ENST00000293349 | chr17 | 40820920 | 40820864 | − | TAF |

TABLE 16

Transcript fusion for Colon adenocarcinoma (COAD) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 31% | chr3 | 49927493 | 49927357 | − | ENST00000296474; ENST00000344206 | chr3 | 49927248 | 49927204 | − | TAF |
| 31% | chr3 | 49927493 | 49927357 | − | ENST00000296474; ENST00000344206 | chr3 | 49927248 | 49927204 | − | TAF |
| 27% | chr11 | 428199 | 428088 | − | ENST00000332826 | chr11 | 424187 | 423924 | − | TAF |
| 26% | chr13 | 43659904 | 43659974 | + | ENST00000379221 | chr13 | 43670953 | 43671210 | + | TAF |
| 24% | chr12 | 71928895 | 71928966 | + | ENST00000266674; ENST00000536515; ENST00000540815 | chr12 | 71938771 | 71938901 | + | TSF |
| 23% | chr7 | 75442741 | 75442624 | − | ENST00000222902; ENST00000416943 | chr7 | 75441450 | 75441417 | − | TAF |
| 17% | chr13 | 44433033 | 44432917 | − | ENST00000444614; ENST00000281508 | chr13 | 44413224 | 44412729 | − | TAF |
| 16% | chr1 | 24463799 | 24463621 | − | ENST00000270800 | chr1 | 24461426 | 24461370 | − | TAF |
| 13% | chr6 | 1960205 | 1960101 | − | ENST00000530927; ENST00000380815 | chr6 | 1955184 | 1955013 | − | TAF |
| 13% | chr6 | 1960205 | 1960101 | − | ENST00000530927; ENST00000380815 | chr6 | 1955184 | 1955013 | − | TAF |
| 13% | chr16 | 4409386 | 4409297 | − | ENST00000572467; ENST00000251166; ENST00000539968; ENST00000537233; ENST00000574025; ENST00000576637 | chr16 | 4409070 | 4408945 | − | TAF |
| 13% | chr16 | 4409386 | 4409297 | − | ENST00000572467; ENST00000251166; ENST00000539968; ENST00000537233; ENST00000574025; ENST00000576637 | chr16 | 4409070 | 4408945 | − | TAF |
| 13% | chr16 | 4409386 | 4409297 | − | ENST00000572467; ENST00000251166; ENST00000539968; ENST00000537233; ENST00000574025; ENST00000576637 | chr16 | 4409070 | 4408945 | − | TAF |
| 13% | chr16 | 4409386 | 4409297 | − | ENST00000572467; ENST00000251166; ENST00000539968; ENST00000537233; ENST00000574025; ENST00000576637 | chr16 | 4409070 | 4408945 | − | TAF |
| 13% | chr16 | 4409386 | 4409297 | − | ENST00000572467; ENST00000251166; ENST00000539968; ENST00000537233; ENST00000574025; ENST00000576637 | chr16 | 4409070 | 4408945 | − | TAF |
| 13% | chr20 | 9453926 | 9454012 | + | ENST00000334005; ENST00000378473; ENST00000278655; ENST00000414679; ENST00000378493; ENST00000378501 | chr20 | 9484605 | 9485169 | + | TAF |
| 13% | chr20 | 9453926 | 9454012 | + | ENST00000334005; ENST00000378473; ENST00000278655; ENST00000414679; ENST00000378493; ENST00000378501 | chr20 | 9484605 | 9485169 | + | TAF |
| 12% | chr5 | 147207691 | 147207585 | − | ENST00000296695; ENST00000510027 | chr5 | 147185494 | 147185375 | − | TAF |
| 12% | chr4 | 57319769 | 57319927 | + | ENST00000514888; ENST00000264221; ENST00000505164; ENST00000399688; ENST00000512576 | chr4 | 57321183 | 57321327 | + | TSF |
| 12% | chr4 | 57319769 | 57319927 | + | ENST00000514888; ENST00000264221; ENST00000505164; ENST00000399688; ENST00000512576 | chr4 | 57321183 | 57321327 | + | TSF |
| 12% | chr4 | 57319769 | 57319927 | + | ENST00000514888; ENST00000264221; ENST00000505164; ENST00000399688; ENST00000512576 | chr4 | 57321183 | 57321327 | + | TSF |
| 11% | chr10 | 120905865 | 120905748 | − | ENST00000355697; ENST00000330036 | chr10 | 120901885 | 120901741 | − | TAF |
| 11% | chr10 | 120905865 | 120905748 | − | ENST00000355697; ENST00000330036 | chr10 | 120901885 | 120901741 | − | TAF |
| 11% | chr9 | 125054028 | 125054119 | + | ENST00000297908; ENST00000344641; ENST00000373723; ENST00000373729; ENST00000394315 | chr9 | 125068067 | 125068171 | + | TSF |
| 11% | chr9 | 125054028 | 125054119 | + | ENST00000297908; ENST00000344641; ENST00000373723; ENST00000373729; ENST00000394315 | chr9 | 125068067 | 125068171 | + | TSF |

TABLE 16-continued

Transcript fusion for Colon adenocarcinoma (COAD) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 11% | chr9 | 125054028 | 125054119 | + | ENST00000297908; ENST00000344641; ENST00000373723; ENST00000373729; ENST00000394315 | chr9 | 125068067 | 125068171 | + | TSF |
| 11% | chr20 | 33137782 | 33137833 | + | ENST00000374837 | chr20 | 33138384 | 33138773 | + | TSF |
| 10% | chr6 | 10749855; 10749898 | 10749931 | + | ENST00000379542; ENST00000473166; ENST00000463448; ENST00000460341; ENST00000480294; ENST00000473807; ENST00000461342; ENST00000475942; ENST00000379530; ENST00000463100; ENST00000481240; ENST00000467317; ENST00000478732 | chr6 | 10829240 | 10829256 | + | TAF |
| 10% | chr6 | 10749855; 10749898 | 10749931 | + | ENST00000379542; ENST00000473166; ENST00000463448; ENST00000460341; ENST00000480294; ENST00000473807; ENST00000461342; ENST00000475942; ENST00000379530; ENST00000463100; ENST00000481240; ENST00000467317; ENST00000478732 | chr6 | 10829240 | 10829256 | + | TAF |
| 10% | chr20 | 9382137 | 9382237 | + | ENST00000334005; ENST00000378473; ENST00000278655; ENST00000414679; ENST00000378493; ENST00000378501 | chr20 | 9383648 | 9383757 | + | TSF |
| 9% | chr16 | 50659396 | 50659491 | + | ENST00000268459 | chr16 | 50663933 | 50663990 | + | TSF |
| 8% | chr16 | 50583333 | 50583466 | + | ENST00000268459 | chr16 | 50614862 | 50614981 | + | TSF |
| 8% | chr2 | 241555805 | 241555928 | + | ENST00000270364 | chr2 | 241556208 | 241556489 | + | TSF |
| 7% | chr7 | 34888095 | 34888275 | + | ENST00000360581; ENST00000381542; ENST00000359791; ENST00000531252; ENST00000381539 | chr7 | 34935732 | 34935887 | + | TSF |
| 7% | chr7 | 34888095 | 34888275 | + | ENST00000360581; ENST00000381542; ENST00000359791; ENST00000531252; ENST00000381539 | chr7 | 34935732 | 34935887 | + | TSF |
| 7% | chr7 | 34888095 | 34888275 | + | ENST00000360581; ENST00000381542; ENST00000359791; ENST00000531252; ENST00000381539 | chr7 | 34935732 | 34935887 | + | TSF |
| 7% | chr8 | 42924698; 42924750 | 42924802 | + | ENST00000534420; ENST00000302279; ENST00000533998; ENST00000342116; ENST00000531266; ENST00000525699; ENST00000529687; ENST00000533336 | chr8 | 42925245 | 42925476 | + | TSF |
| 7% | chr8 | 42924698; 42924750 | 42924802 | + | ENST00000534420; ENST00000302279; ENST00000533998; ENST00000342116; ENST00000531266; ENST00000525699; ENST00000529687; ENST00000533336 | chr8 | 42925245 | 42925476 | + | TSF |
| 7% | chr8 | 42924698; 42924750 | 42924802 | + | ENST00000534420; ENST00000302279; ENST00000533998; ENST00000342116; ENST00000531266; ENST00000525699; ENST00000529687; ENST00000533336 | chr8 | 42925245 | 42925476 | + | TSF |
| 7% | chr8 | 42924698; 42924750 | 42924802 | + | ENST00000534420; ENST00000302279; ENST00000533998; ENST00000342116; ENST00000531266; ENST00000525699; ENST00000529687; ENST00000533336 | chr8 | 42925245 | 42925476 | + | TSF |
| 7% | chr8 | 42924698; 42924750 | 42924802 | + | ENST00000534420; ENST00000302279; ENST00000533998; ENST00000342116; ENST00000531266; ENST00000525699; ENST00000529687; ENST00000533336 | chr8 | 42925245 | 42925476 | + | TSF |
| 7% | chr8 | 42924698; 42924750 | 42924802 | + | ENST00000534420; ENST00000302279; ENST00000533998; ENST00000342116; ENST00000531266; ENST00000525699; ENST00000529687; ENST00000533336 | chr8 | 42925245 | 42925476 | + | TSF |
| 5% | chr13 | 98642687; 98642769 | 98642791 | + | ENST00000261574; ENST00000357602; ENST00000490680; ENST00000539640; ENST00000469360 | chr13 | 98643835 | 98643958 | + | TSF |
| 5% | chr13 | 98642687; 98642769 | 98642791 | + | ENST00000261574; ENST00000357602; ENST00000490680; ENST00000539640; ENST00000469360 | chr13 | 98643835 | 98643958 | + | TSF |
| 5% | chr13 | 98642687; 98642769 | 98642791 | + | ENST00000261574; ENST00000357602; ENST00000490680; ENST00000539640; ENST00000469360 | chr13 | 98643835 | 98643958 | + | TSF |
| 5% | chr13 | 98642687; 98642769 | 98642791 | + | ENST00000261574; ENST00000357602; ENST00000490680; ENST00000539640; ENST00000469360 | chr13 | 98643835 | 98643958 | + | TSF |
| 5% | chr16 | 72153988; 72154048 | 72153750 | − | ENST00000537465; ENST00000237353; ENST00000355636 | chr16 | 72150929 | 72150229 | − | TSF |
| 5% | chr16 | 72153988; 72154048 | 72153750 | − | ENST00000537465; ENST00000237353; ENST00000355636 | chr16 | 72150929 | 72150229 | − | TSF |
| 5% | chr16 | 72153988; 72154048 | 72153750 | − | ENST00000537465; ENST00000237353; ENST00000355636 | chr16 | 72150929 | 72150229 | − | TSF |

TABLE 16-continued

Transcript fusion for Colon adenocarcinoma (COAD) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 5% | chr1 | 11115983; 11115877 | 11115838 | − | ENST00000376957; ENST00000490101 | chr1 | 11115464 | 11115178 | − | TSF |
| 5% | chr1 | 11115983; 11115877 | 11115838 | − | ENST00000376957; ENST00000490101 | chr1 | 11115464 | 11115178 | − | TSF |
| 4% | chr8 | 71619168 | 71619388 | + | ENST00000408926; ENST00000520030 | chr8 | 71625661 | 71625673 | + | TSF |
| 4% | chr3 | 49928739 | 49928630 | − | ENST00000296474; ENST00000344206; ENST00000434765; ENST00000440292 | chr3 | 49928452 | 49928163 | − | TSF |
| 4% | chr3 | 49928739 | 49928630 | − | ENST00000296474; ENST00000344206; ENST00000434765; ENST00000440292 | chr3 | 49928452 | 49928163 | − | TSF |
| 4% | chr3 | 49928739 | 49928630 | − | ENST00000296474; ENST00000344206; ENST00000434765; ENST00000440292 | chr3 | 49928452 | 49928163 | − | TSF |
| 4% | chr3 | 49928739 | 49928630 | − | ENST00000296474; ENST00000344206; ENST00000434765; ENST00000440292 | chr3 | 49928452 | 49928163 | − | TSF |
| 4% | chr8 | 109468102 | 109468159 | + | ENST00000220853; ENST00000519642 | chr8 | 109468381 | 109468590 | + | TSF |
| 4% | chr8 | 109468102 | 109468159 | + | ENST00000220853; ENST00000519642 | chr8 | 109468381 | 109468590 | − | TSF |
| 4% | chr12 | 113623819 | 113623826 | + | ENST00000552495 | chr12 | 113623998 | 113624117 | − | TSF |
| 3% | chr17 | 79912179 | 79912132 | − | ENST00000409678 | chr17 | 79911834 | 79911647 | − | TSF |
| 3% | chr7 | 73973957 | 73973985 | + | ENST00000265755; ENST00000455841; ENST00000424337; ENST00000476977; ENST00000470715 | chr7 | 73985447 | 73985582 | + | TSF |
| 3% | chr7 | 73973957 | 73973985 | + | ENST00000265755; ENST00000455841; ENST00000424337; ENST00000476977; ENST00000470715 | chr7 | 73985447 | 73985582 | + | TSF |
| 3% | chr7 | 73973957 | 73973985 | + | ENST00000265755; ENST00000455841; ENST00000424337; ENST00000476977; ENST00000470715 | chr7 | 73985447 | 73985582 | + | TSF |
| 3% | chr7 | 73973957 | 73973985 | + | ENST00000265755; ENST00000455841; ENST00000424337; ENST00000476977; ENST00000470715 | chr7 | 73985447 | 73985582 | + | TSF |
| 3% | chr19 | 42221377; 42221374 | 42221652 | + | ENST00000398599; ENST00000221992; ENST00000405816 | chr19 | 42274707 | 42275202 | + | TSF |
| 3% | chr19 | 42221377; 42221374 | 42221652 | + | ENST00000398599; ENST00000221992; ENST00000405816 | chr19 | 42274707 | 42275202 | + | TSF |
| 3% | chr1 | 225156461 | 225156576 | + | ENST00000430092; ENST00000400952; NEST00000366849; ENST00000439375 | chr1 | 225157336 | 225158402 | + | TSF |
| 3% | chr1 | 225156461 | 225156576 | + | ENST00000430092; ENST00000400952; ENST00000366849; ENST00000439375 | chr1 | 225157336 | 225158402 | + | TSF |
| 3% | chr7 | 150065992 | 150066030 | + | ENST00000466559; ENST00000475514; ENST00000488943; ENST00000467980; ENST00000518514; ENST00000522266 | chr7 | 150067849 | 150067901 | + | TSF |
| 3% | chr20 | 60578330 | 60578216 | − | ENST00000252996; ENST00000488539 | chr20 | 60576919 | 60576839 | − | TSF |
| 3% | chr20 | 60578330 | 60578216 | − | ENST00000252996; ENST00000488539 | chr20 | 60576919 | 60576839 | − | TSF |
| 3% | chr2 | 217366064 | 217366082 | + | ENST00000491306; ENST00000456586 | chr2 | 217393993 | 217394327 | + | TSF |
| 3% | chr2 | 217366064 | 217366082 | + | ENST00000491306; ENST00000456586 | chr2 | 217393993 | 217394327 | + | TSF |
| 3% | chr1 | 23208852 | 23208976 | + | ENST00000544305; ENST00000374630; ENST00000400191; ENST00000374632; ENST00000374627 | chr1 | 23211233 | 23211522 | + | TSF |
| 3% | chr1 | 23208852 | 23208976 | + | ENST00000544305; ENST00000374630; ENST00000400191; ENST00000374632; ENST00000374627 | chr1 | 23211233 | 23211522 | + | TSF |
| 3% | chr16 | 50642205 | 50642271 | + | ENST00000268459 | chr16 | 50651664 | 50651770 | + | TSF |
| 3% | chr16 | 57115439 | 57115522 | + | ENST00000262510; ENST00000308149; ENST00000539144 | chr16 | 57116257 | 57116272 | + | TSF |
| 3% | chr16 | 57115439 | 57115522 | + | ENST00000262510; ENST00000308149; ENST00000539144 | chr16 | 57116257 | 57116272 | + | TSF |
| 3% | chr12 | 4874545 | 4874712 | + | ENST00000252318; ENST00000542998; ENST00000535354 | chr12 | 4884414 | 4884790 | + | TSF |
| 3% | chr12 | 4874545 | 4874712 | + | ENST00000252318; ENST00000542998; ENST00000535354 | chr12 | 4884414 | 4884790 | + | TSF |
| 3% | chr12 | 4874545 | 4874712 | + | ENST00000252318; ENST00000542998; ENST00000535354 | chr12 | 4884414 | 4884790 | + | TSF |
| 3% | chr9 | 130213596 | 130213560 | − | ENST00000361436; ENST00000536368 | chr9 | 130213398 | 130213359 | − | TSF |
| 2% | chr12 | 102547647 | 102547754 | + | ENST00000327680; ENST00000378128; ENST00000541394; ENST00000358383; ENST00000392911; ENST00000412715; ENST00000417507; ENST00000457614 | chr12 | 102548605 | 102548938 | + | TSF |
| 2% | chr12 | 102547647 | 102547754 | + | ENST00000327680; ENST00000378128; ENST00000541394; ENST00000358383; ENST00000392911; ENST00000412715; ENST00000417507; ENST00000457614 | chr12 | 102548605 | 102548938 | + | TSF |
| 2% | chr12 | 102547647 | 102547754 | + | ENST00000327680; ENST00000378128; ENST00000541394; ENST00000358383; ENST00000392911; ENST00000412715; ENST00000417507; ENST00000457614 | chr12 | 102548605 | 102548938 | + | TSF |

TABLE 16-continued

Transcript fusion for Colon adenocarcinoma (COAD) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 2% | chr12 | 102547647 | 102547754 | + | ENST00000327680; ENST00000378128; ENST00000541394; ENST00000358383; ENST00000392911; ENST00000412715; ENST00000417507; ENST00000457614 | chr12 | 102548605 | 102548938 | + | TSF |
| 2% | chr12 | 102547647 | 102547754 | + | ENST00000327680; ENST00000378128; ENST00000541394; ENST00000358383; ENST00000392911; ENST00000412715; ENST00000417507; ENST00000457614 | chr12 | 102548605 | 102548938 | + | TSF |
| 2% | chr13 | 114157811 | 114157903 | + | ENST00000434316; ENST00000375391 | chr13 | 114159741 | 114159770 | + | TSF |
| 2% | chr19 | 42218890 | 42219168 | + | ENST00000398599; ENST00000221992; ENST00000405816; ENST00000595113 | chr19 | 42274707 | 42275202 | + | TSF |
| 2% | chr19 | 42218890 | 42219168 | + | ENST00000398599; ENST00000221992; ENST00000405816; ENST00000595113 | chr19 | 42274707 | 42275202 | + | TSF |
| 2% | chr19 | 42221377; 42221374 | 42221417 | + | ENST00000398599; ENST00000221992; ENST00000405816; ENST00000595113 | chr19 | 42729297 | 42729312 | + | TSF |
| 2% | chr19 | 42221377; 42221374 | 42221417 | + | ENST00000398599; ENST00000221992; ENST00000405816; ENST00000595113 | chr19 | 42729297 | 42729312 | + | TSF |
| 2% | chr19 | 42221377; 42221374 | 42221417 | + | ENST00000398599; ENST00000221992; ENST00000405816; ENST00000595113 | chr19 | 42729297 | 42729312 | + | TSF |
| 2% | chr8 | 624047; 623326; 623657 | 623289 | − | ENST00000522706; ENST00000523415; ENST00000262109; ENST00000522893 | chr8 | 622204 | 621954 | − | TSF |
| 2% | chr8 | 624047; 623326; 623657 | 623289 | − | ENST00000522706; ENST00000523415; ENST00000262109; ENST00000522893 | chr8 | 622204 | 621954 | − | TSF |
| 2% | chr8 | 624047; 623326; 623657 | 623289 | − | ENST00000522706; ENST00000523415; ENST00000262109; ENST00000522893 | chr8 | 622204 | 621954 | − | TSF |
| 2% | chr8 | 624047; 623326; 623657 | 623289 | − | ENST00000522706; ENST00000523415; ENST00000262109; ENST00000522893 | chr8 | 622204 | 621954 | − | TSF |
| 2% | chr6 | 105771643 | 105771540 | − | ENST00000369110; ENST00000448705 | chr6 | 105764464 | 105763345 | − | TSF |
| 2% | chr6 | 105771643 | 105771540 | − | ENST00000369110; ENST00000448705 | chr6 | 105764464 | 105763345 | − | TSF |
| 2% | chr10 | 79796952 | 79797062 | + | ENST00000435275; ENST00000440692; ENST00000372360; ENST00000360830 | chr4 | 176584518 | 176584519 | + | TSF |
| 2% | chr2 | 241555805 | 241555928 | + | ENST00000270364 | chr2 | 241556476 | 241556489 | + | TSF |
| 2% | chr2 | 241555805 | 241555928 | + | ENST00000270364 | chr2 | 241556590 | 241556603 | + | TSF |
| 2% | chr6 | 1930464 | 1930337 | − | ENST00000530927; ENST00000380815 | chr6 | 1888004 | 1887962 | − | TSF |
| 2% | chr6 | 1930464 | 1930337 | − | ENST00000530927; ENST00000380815 | chr6 | 1888004 | 1887962 | − | TSF |
| 2% | chr3 | 108475435 | 108475355 | − | ENST00000295755 | chr3 | 108466866 | 108466812 | − | TSF |

TABLE 17

Transcript fusion for Colon adenocarcinoma (COAD) Coordinates of the fusion sequences for which the donor is the TE.

| 1 | 2 | 3' | 4' | 5' | 6' | 7' | 8' | 9' | 10' | 11' |
|---|---|---|---|---|---|---|---|---|---|---|
| 54% | chr11 | 93468219 | 93468129 | − | chr11 | 93467826 | 93467791; 93467814 | − | ENST00000393259; ENST00000527169 | TAF |
| 54% | chr11 | 93468219 | 93468129 | − | chr11 | 93467826 | 93467791; 93467814 | − | ENST00000393259; ENST00000527169 | TAF |
| 51% | chr9 | 6248332 | 6248555 | + | chr9 | 6250474 | 6250599 | + | ENST00000456383; ENST00000381434 | TAF |
| 51% | chr9 | 6248332 | 6248555 | + | chr9 | 6250474 | 6250599 | + | ENST00000456383; ENST00000381434 | TAF |
| 35% | chr11 | 424193 | 423942 | − | chr11 | 421198 | 421141 | − | ENST00000332826 | TAF |
| 28% | chr8 | 104389530 | 104389551 | + | chr8 | 104390255 | 104390471 | + | ENST00000330295; ENST00000520337 | TAF |
| 26% | chr13 | 43628887 | 43629679 | + | chr13 | 43643066 | 43643139 | + | ENST00000379221 | TAF |
| 23% | chr14 | 51360331 | 51362440 | + | chr14 | 51368547 | 51368629 | + | ENST00000337334; ENST00000353130; ENST00000395752 | TSF |
| 20% | chr19 | 49121994 | 49121817 | − | chr19 | 49121134 | 49121048 | − | ENST00000549920; ENST00000547897; ENST00000084795; ENST00000550645; ENST00000549370; ENST00000549273 | TAF |
| 20% | chr19 | 49121994 | 49121817 | − | chr19 | 49121134 | 49121048 | − | ENST00000549920; ENST00000547897; ENST00000084795; ENST00000550645; ENST00000549370; ENST00000549273 | TAF |
| 20% | chr19 | 49121994 | 49121817 | − | chr19 | 49121134 | 49121048 | − | ENST00000549920; ENST00000547897; ENST00000084795; ENST00000550645; ENST00000549370; ENST00000549273 | TAF |
| 20% | chr19 | 49121994 | 49121817 | − | chr19 | 49121134 | 49121048 | − | ENST00000549920; ENST00000547897; ENST00000084795; ENST00000550645; ENST00000549370; ENST00000549273 | TAF |
| 20% | chr19 | 49121994 | 49121817 | − | chr19 | 49121134 | 49121048 | − | ENST00000549920; ENST00000547897; ENST00000084795; ENST00000550645; ENST00000549370; ENST00000549273 | TAF |

TABLE 17-continued

Transcript fusion for Colon adenocarcinoma (COAD) Coordinates of the fusion sequences for which the donor is the TE.

| 1 | 2 | 3' | 4' | 5' | 6' | 7' | 8' | 9' | 10' | 11' |
|---|---|---|---|---|---|---|---|---|---|---|
| 20% | chr20 | 44420870 | 44421070 | + | chr20 | 44421316 | 44421386 | + | ENST00000372622; ENST00000449078; ENST00000456939 | TAF |
| 20% | chr20 | 44420870 | 44421070 | + | chr20 | 44421316 | 44421386 | + | ENST00000372622; ENST00000449078; ENST00000456939 | TAF |
| 20% | chr20 | 44420870 | 44421070 | + | chr20 | 44421316 | 44421386 | + | ENST00000372622; ENST00000449078; ENST00000456939 | TAF |
| 20% | chr13 | 43628887 | 43629679 | + | chr13 | 43639822 | 43639873 | + | ENST00000379221 | TAF |
| 18% | chr7 | 116364854 | 116364901 | + | chr7 | 116371722 | 116371913 | + | ENST00000397752; ENST00000318493; ENST00000436117 | TAF |
| 18% | chr7 | 116364854 | 116364901 | + | chr7 | 116371722 | 116371913 | + | ENST00000397752; ENST00000318493; ENST00000436117 | TAF |
| 18% | chr7 | 116364854 | 116364901 | + | chr7 | 116371722 | 116371913 | + | ENST00000397752; ENST00000318493; ENST00000436117 | TAF |
| 18% | chr13 | 101090702 | 101090970 | + | chr13 | 101101506 | 101101559 | + | ENST00000376279; ENST00000376286; ENST00000376285; ENST00000458283; ENST00000413170 | TSF |
| 18% | chr13 | 101090702 | 101090970 | + | chr13 | 101101506 | 101101559 | + | ENST00000376279; ENST00000376286; ENST00000376285; ENST00000458283; ENST00000413170 | TSF |
| 18% | chr13 | 101090702 | 101090970 | + | chr13 | 101101506 | 101101559 | + | ENST00000376279; ENST00000376286; ENST00000376285; ENST00000458283; ENST00000413170 | TSF |
| 17% | chr13 | 76173531 | 76175706 | + | chr13 | 76178905 | 76178963 | + | ENST00000377595; ENST00000419068 | TAF |
| 17% | chr14 | 65406849 | 65406835 | − | chr14 | 65406556 | 65406206 | − | ENST00000389614; ENST00000557049 | TAF |
| 17% | chr13 | 28224759 | 28225489 | + | chr13 | 28239823 | 28240090 | + | ENST00000399697 | TAF |
| 17% | chr17 | 79911953 | 79911734 | − | chr17 | 79911143 | 79910837 | − | ENST00000409678 | TAF |
| 17% | chr2 | 85053636 | 85053622 | − | chr2 | 85051328 | 85051077 | − | ENST00000335459; ENST00000409520 | TSF |
| 15% | chr5 | 54528691 | 54528595 | − | chr5 | 54528374 | 54528189 | − | ENST00000282572 | TAF |
| 15% | chr5 | 135398466 | 135398602 | + | chr5 | 135398875 | 135398915; 135398898 | + | ENST00000442011; ENST00000305126; ENST00000514554; ENST00000508076; ENST00000503087 | TAF |
| 15% | chr5 | 135398466 | 135398602 | + | chr5 | 135398875 | 135398915; 135398898 | + | ENST00000442011; ENST00000305126; ENST00000514554; ENST00000508076; ENST00000503087 | TAF |
| 15% | chr1 | 59980221 | 59980497 | + | chr1 | 60019796 | 60019899 | + | ENST00000371218; ENST00000303721; ENST00000430447; ENST00000371212 | TSF |
| 15% | chr1 | 59980221 | 59980497 | + | chr1 | 60019796 | 60019899 | + | ENST00000371218; ENST00000303721; ENST00000430447; ENST00000371212 | TSF |
| 15% | chr1 | 59980221 | 59980497 | + | chr1 | 60019796 | 60019899 | + | ENST00000371218; ENST00000303721; ENST00000430447; ENST00000371212 | TSF |
| 14% | chr20 | 61301271 | 61301405 | + | chr20 | 61303102 | 61303245 | + | ENST00000217159; ENST00000370507; ENST00000451793 | TAF |
| 13% | chr1 | 6380703 | 6380649 | − | chr1 | 6378638 | 6378552 | − | ENST00000608083; ENST00000377842; ENST00000377845; ENST00000377855; ENST00000377860; ENST00000418124; ENST00000545482; ENST00000361521; ENST00000473466; ENST00000541130 | TAF |
| 13% | chr1 | 6380703 | 6380649 | − | chr1 | 6378638 | 6378552 | − | ENST00000608083; ENST00000377842; ENST00000377845; ENST00000377855; ENST00000377860; ENST00000418124; ENST00000545482; ENST00000361521; ENST00000473466; ENST00000541130 | TAF |
| 13% | chr1 | 6380703 | 6380649 | − | chr1 | 6378638 | 6378552 | − | ENST00000608083; ENST00000377842; ENST00000377845; ENST00000377855; ENST00000377860; ENST00000418124; ENST00000545482; ENST00000361521; ENST00000473466; ENST00000541130 | lTAF |
| 13% | chr1 | 6380703 | 6380649 | − | chr1 | 6378638 | 6378552 | − | ENST00000608083; ENST00000377842; ENST00000377845; ENST00000377855; ENST00000377860; ENST00000418124; ENST00000545482; ENST00000361521; ENST00000473466; ENST00000541130 | TAF |
| 13% | chr1 | 6380703 | 6380649 | − | chr1 | 6378638 | 6378552 | − | ENST00000608083; ENST00000377842; ENST00000377845; ENST00000377855; ENST00000377860; ENST00000418124; ENST00000545482; ENST00000361521; ENST00000473466; ENST00000541130 | TAF |
| 12% | chr16 | 718049 | 718154 | + | chr16 | 718353 | 718411 | + | ENST00000315082; ENST00000561983; ENST00000563134; ENST00000563637; ENST00000570280; ENST00000562333; ENST00000561929 | TAF |
| 12% | chr16 | 718049 | 718154 | + | chr16 | 718353 | 718411 | + | ENST00000315082; ENST00000561983; ENST00000563134; ENST00000563637; ENST00000570280; ENST00000562333; ENST00000561929 | TAF |

TABLE 17-continued

Transcript fusion for Colon adenocarcinoma (COAD) Coordinates of the fusion sequences for which the donor is the TE.

| 1 | 2 | 3' | 4' | 5' | 6' | 7' | 8' | 9' | 10' | 11' |
|---|---|---|---|---|---|---|---|---|---|---|
| 12% | chr16 | 718049 | 718154 | + | chr16 | 718353 | 718411 | + | ENST00000315082; ENST00000561983; ENST00000563134; ENST00000563637; ENST00000570280; ENST00000562333; ENST00000561929 | TAF |
| 12% | chr16 | 718049 | 718154 | + | chr16 | 718353 | 718411 | + | ENST00000315082; ENST00000561983; ENST00000563134; ENST00000563637; ENST00000570280; ENST00000562333; ENST00000561929 | TAF |
| 12% | chr16 | 718049 | 718154 | + | chr16 | 718353 | 718411 | + | ENST00000315082; ENST00000561983; ENST00000563134; ENST00000563637; ENST00000570280; ENST00000562333; ENST00000561929 | TAF |
| 12% | chr16 | 718049 | 718154 | + | chr16 | 718353 | 718411 | + | ENST00000315082; ENST00000561983; ENST00000563134; ENST00000563637; ENST00000570280; ENST00000562333; ENST00000561929 | TAF |
| 12% | chr12 | 20780314 | 20780410 | + | chr12 | 20782842 | 20783061 | + | ENST00000359062 | TAF |
| 12% | chr21 | 42597177 | 42597622 | + | chr21 | 42598193 | 42598281 | + | ENST00000328735; ENST00000330333; ENST00000347667 | TAF |
| 12% | chr21 | 42597177 | 42597622 | + | chr21 | 42598193 | 42598281 | + | ENST00000328735; ENST00000330333; ENST00000347667 | TAF |
| 12% | chr21 | 42597177 | 42597622 | + | chr21 | 42598193 | 42598281 | + | ENST00000328735; ENST00000330333; ENST00000347667 | TAF |
| 12% | chr2 | 85059551 | 85059512 | − | chr2 | 85059269 | 85059179 | − | ENST00000335459; ENST00000409520 | TAF |
| 12% | chrX | 100125243 | 100124234 | − | chrX | 100118584 | 100118474 | − | ENST00000372966; ENST00000372964; ENST00000217885 | TAF |
| 12% | chrX | 100125243 | 100124234 | − | chrX | 100118584 | 100118474 | − | ENST00000372966; ENST00000372964; ENST00000217885 | TAF |
| 12% | chrX | 100125243 | 100124234 | − | chrX | 100118584 | 100118474 | − | ENST00000372966; ENST00000372964; ENST00000217885 | TAF |
| 11% | chr16 | 603045 | 603077 | + | chr16 | 603343 | 603516 | + | ENST00000219611 | TAF |
| 11% | chr16 | 603045 | 603138 | + | chr16 | 603343 | 603516 | + | ENST00000219611 | TAF |
| 11% | chr10 | 120901765 | 120900831 | − | chr10 | 120900754 | − | | ENST00000355697; ENST00000330036 | TAF |
| 11% | chr13 | 41835911 | 41835827 | − | chr13 | 41835051 | 41834629 | − | ENST00000430347 | TAF |
| 11% | chr17 | 79214190 | 79214239 | + | chr17 | 79214787 | 79214816; 79214953 | + | ENST00000431388; ENST00000576002 | TAF |
| 11% | chr17 | 79214190 | 79214239 | + | chr17 | 79214787 | 79214816; 79214953 | + | ENST00000431388; ENST00000576002 | TAF |
| 11% | chr17 | 79914312 | 79914232 | − | chr17 | 79913420 | 79913273; 79913391 | − | ENST00000409678; ENST00000477214 | TAF |
| 11% | chr17 | 79914312 | 79914232 | − | chr17 | 79913420 | 79913273; 79913391 | − | ENST00000409678; ENST00000477214 | TAF |
| 10% | chr13 | 98628730 | 98628756 | + | chr13 | 98628947 | 98629040; 98629046 | + | ENST00000460070; ENST00000481455; ENST00000261574; ENST00000493281; ENST00000490369; ENST00000463157; ENST00000489058; ENST00000481689; ENST00000480611; ENST00000485433; ENST00000496368; ENST00000421861 | TAF |
| 10% | chr13 | 98628730 | 98628756 | + | chr13 | 98628947 | 98629040; 98629046 | + | ENST00000460070; ENST00000481455; ENST00000261574; ENST00000493281; ENST00000490369; ENST00000463157; ENST00000489058; ENST00000481689; ENST00000480611; ENST00000485433; ENST00000496368; ENST00000421861 | TAF |
| 10% | chr13 | 98628730 | 98628756 | + | chr13 | 98628947 | 98629040; 98629046 | + | ENST00000460070; ENST00000481455; ENST00000261574; ENST00000493281; ENST00000490369; ENST00000463157; ENST00000489058; ENST00000481689; ENST00000480611; ENST00000485433; ENST00000496368; ENST00000421861 | TAF |
| 10% | chr13 | 98628730 | 98628756 | + | chr13 | 98628947 | 98629040; 98629046 | + | ENST00000460070; ENST00000481455; ENST00000261574; ENST00000493281; ENST00000490369; ENST00000463157; ENST00000489058; ENST00000481689; ENST00000480611; ENST00000485433; ENST00000496368; ENST00000421861 | TAF |
| 10% | chr13 | 98628730 | 98628756 | + | chr13 | 98628947 | 98629040; 98629046 | + | ENST00000460070; ENST00000481455; ENST00000261574; ENST00000493281; ENST00000490369; ENST00000463157; ENST00000489058; ENST00000481689; ENST00000480611; ENST00000485433; ENST00000496368; ENST00000421861 | TAF |
| 10% | chr13 | 98628730 | 98628756 | + | chr13 | 98628947 | 98629040; 98629046 | + | ENST00000460070; ENST00000481455; ENST00000261574; ENST00000493281; ENST00000490369; ENST00000463157; ENST00000489058; ENST00000481689; | TAF |

TABLE 17-continued

Transcript fusion for Colon adenocarcinoma (COAD) Coordinates of the fusion sequences for which the donor is the TE.

| 1 | 2 | 3' | 4' | 5' | 6' | 7' | 8' | 9' | 10' | 11' |
|---|---|---|---|---|---|---|---|---|---|---|
| 10% | chr13 | 98628730 | 98628756 | + | chr13 | 98628947 | 98629040; 98629046 | + | ENST00000480611; ENST00000485433; ENST00000496368; ENST00000421861 ENST00000460070; ENST00000481455; ENST00000261574; ENST00000493281; ENST00000490369; ENST00000463157; ENST00000489058; ENST00000481689; | TAF |
| 10% | chr13 | 98628730 | 98628756 | + | chr13 | 98628947 | 98629040; 98629046 | + | ENST00000480611; ENST00000485433; ENST00000496368; ENST00000421861 ENST00000460070; ENST00000481455; ENST00000261574; ENST00000493281; ENST00000490369; ENST00000463157; ENST00000489058; ENST00000481689; | TAF |
| 10% | chr13 | 98628730 | 98628756 | + | chr13 | 98628947 | 98629040; 98629046 | + | ENST00000480611; ENST00000485433; ENST00000496368; ENST00000421861 ENST00000460070; ENST00000481455; ENST00000261574; ENST00000493281; ENST00000490369; ENST00000463157; ENST00000489058; ENST00000481689; | TAF |
| 10% | chr13 | 98628730 | 98628756 | + | chr13 | 98628947 | 98629040; 98629046 | + | ENST00000480611; ENST00000485433; ENST00000496368; ENST00000421861 ENST00000460070; ENST00000481455; ENST00000261574; ENST00000493281; ENST00000490369; ENST00000463157; ENST00000489058; ENST00000481689; | TAF |
| 10% | chr13 | 98628730 | 98628756 | + | chr13 | 98628947 | 98629040; 98629046 | + | ENST00000480611; ENST00000485433; ENST00000496368; ENST00000421861 ENST00000460070; ENST00000481455; ENST00000261574; ENST00000493281; ENST00000490369; ENST00000463157; ENST00000489058; ENST00000481689; | TAF |
| 10% | chr13 | 98628730 | 98628756 | + | chr13 | 98628947 | 98629040; 98629046 | + | ENST00000480611; ENST00000485433; ENST00000496368; ENST00000421861 ENST00000460070; ENST00000481455; ENST00000261574; ENST00000493281; ENST00000490369; ENST00000463157; ENST00000489058; ENST00000481689; | TAF |
| 9% | chr7 | 100850556 | 100850506 | − | chr7 | 100850185 | 100850060 | − | ENST00000454310; ENST00000223127 | TSF |
| 9% | chr1 | 59843828 | 59844080 | + | chr1 | 59844421 | 59844509 | + | ENST00000413489; ENST00000371218; ENST00000303721; ENST00000430447; ENST00000371212 | TSF |
| 9% | chr1 | 59843828 | 59844080 | + | chr1 | 59844421 | 59844509 | + | ENST00000413489; ENST00000371218; ENST00000303721; ENST00000430447; ENST00000371212 | TSF |
| 9% | chr1 | 59843828 | 59844080 | + | chr1 | 59844421 | 59844509 | + | ENST00000413489; ENST00000371218; ENST00000303721; ENST00000430447; ENST00000371212 | TSF |
| 9% | chr1 | 59843828 | 59844080 | + | chr1 | 59844421 | 59844509 | + | ENST00000413489; ENST00000371218; ENST00000303721; ENST00000430447; ENST00000371212 | TSF |
| 8% | chr20 | 45337040 | 45337192 | + | chr20 | 45353680 | 45354963 | + | ENST00000359271 | TSF |
| 6% | chr19 | 48627094 | 48627044 | − | chr19 | 48626575 | 48626431 | − | ENST00000263274; ENST00000536218; ENST00000594759; ENST00000427526; ENST00000601091 | TSF |
| 6% | chr19 | 48627094 | 48627044 | − | chr19 | 48626575 | 48626431 | − | ENST00000263274; ENST00000536218; ENST00000594759; ENST00000427526; ENST00000601091 | TSF |
| 6% | chr12 | 15701006 | 15701267 | + | chr12 | 15702028 | 15702160 | + | ENST00000281171; ENST00000348962; ENST00000535311 | TSF |
| 6% | chr12 | 15701006 | 15701267 | + | chr12 | 15702028 | 15702160 | + | ENST00000281171; ENST00000348962; ENST00000535311 | TSF |
| 6% | chr12 | 15701006 | 15701267 | + | chr12 | 15702028 | 15702160 | + | ENST00000281171; ENST00000348962; ENST00000535311 | TSF |
| 6% | chr22 | 29117574 | 29117506 | − | chr22 | 29115473 | 29115383; 29115458 | − | ENST00000348295; ENST00000382566; ENST00000382578; ENST00000404276; ENST00000328354; ENST00000405598; ENST00000382580; ENST00000433728; ENST00000448511; ENST00000402731; ENST00000403642; ENST00000439200 | TSF |
| 6% | chr22 | 29117574 | 29117506 | − | chr22 | 29115473 | 29115383; 29115458 | − | ENST00000348295; ENST00000382566; ENST00000382578; ENST00000404276; ENST00000328354; ENST00000405598; ENST00000382580; ENST00000433728; ENST00000448511; ENST00000402731; ENST00000403642; ENST00000439200 | TSF |

TABLE 17-continued

Transcript fusion for Colon adenocarcinoma (COAD) Coordinates of the fusion sequences for which the donor is the TE.

| 1 | 2 | 3' | 4' | 5' | 6' | 7' | 8' | 9' | 10' | 11' |
|---|---|---|---|---|---|---|---|---|---|---|
| 6% | chr22 | 29117574 | 29117506 | − | chr22 | 29115473 | 29115383; 29115458 | − | ENST00000348295; ENST00000382566; ENST00000382578; ENST00000404276; ENST00000328354; ENST00000405598; ENST00000382580; ENST00000433728; ENST00000448511; ENST00000402731; ENST00000403642; ENST00000439200 | TSF |
| 6% | chr22 | 29117574 | 29117506 | − | chr22 | 29115473 | 29115383; 29115458 | − | ENST00000348295; ENST00000382566; ENST00000382578; ENST00000404276; ENST00000328354; ENST00000405598; ENST00000382580; ENST00000433728; ENST00000448511; ENST00000402731; ENST00000403642; ENST00000439200 | TSF |
| 6% | chr22 | 29117574 | 29117506 | − | chr22 | 29115473 | 29115383; 29115458 | − | ENST00000348295; ENST00000382566; ENST00000382578; ENST00000404276; ENST00000328354; ENST00000405598; ENST00000382580; ENST00000433728; ENST00000448511; ENST00000402731; ENST00000403642; ENST00000439200 | TSF |
| 5% | chr21 | 40180090 | 40180187 | + | chr21 | 40181959 | 40182030 | + | ENST00000360214; ENST00000360938; ENST00000432278; ENST00000456966 | TSF |
| 5% | chr21 | 40180090 | 40180187 | + | chr2 1 | 40181959 | 40182030 | + | ENST00000360214; ENST00000360938; ENST00000432278; ENST00000456966 | ITSF |
| 5% | chr21 | 40180090 | 40180187 | + | chr21 | 40181959 | 40182030 | + | ENST00000360214; ENST00000360938; ENST00000432278; ENST00000456966 | TSF |
| 5% | chr12 | 4757939 | 4757967 | + | chr12 | 4763458 | 4763628 | + | ENST00000266544; ENST00000535050 | TSF |
| 5% | chr12 | 4757939 | 4757967 | + | chr12 | 4763458 | 4763628 | + | ENST00000266544; ENST00000535050 | TSF |
| 5% | chr14 | 51360331 | 51360476 | + | chr14 | 51368547 | 51368629 | + | ENST00000337334; ENST00000353130; ENST00000395752 | TSF |
| 5% | chr17 | 1005272 | 1005142 | − | chr17 | 1003975 | 1003877 | − | ENST00000302538; ENST00000544583; ENST00000574437; ENST00000291107; ENST00000574139; ENST00000570525; ENST00000574266 | TSF |
| 5% | chr17 | 1005272 | 1005142 | − | chr17 | 1003975 | 1003877 | − | ENST00000302538; ENST00000544583; ENST00000574437; ENST00000291107; ENST00000574139; ENST00000570525; ENST00000574266 | TSF |
| 5% | chr17 | 1005272 | 1005142 | − | chr17 | 1003975 | 1003877 | − | ENST00000302538; ENST00000544583; ENST00000574437; ENST00000291107; ENST00000574139; ENST00000570525; ENST00000574266 | TSF |
| 5% | chr17 | 1005272 | 1005142 | − | chr17 | 1003975 | 1003877 | − | ENST00000302538; ENST00000544583; ENST00000574437; ENST00000291107; ENST00000574139; ENST00000570525; ENST00000574266 | ITSF |
| 5% | chr7 | 102793255 | 102793520 | + | chr7 | 102939015 | 102939155 | + | ENST00000249269; ENST00000428154; ENST00000456433; ENST00000443722; ENST00000453466 | TSF |
| 5% | chr7 | 102793255 | 102793520 | + | chr7 | 102939015 | 102939155 | + | ENST00000249269; ENST00000428154; ENST00000456433; ENST00000443722; ENST00000453466 | TSF |
| 5% | chr7 | 102793255 | 102793520 | + | chr7 | 102939015 | 102939155 | + | ENST00000249269; ENST00000428154; ENST00000456433; ENST00000443722; ENST00000453466 | TSF |
| 5% | chr7 | 102793255 | 102793520 | + | chr7 | 102939015 | 102939155 | + | ENST00000249269; ENST00000428154; ENST00000456433; ENST00000443722; ENST00000453466 | ITSF |
| 5% | chr7 | 102793255 | 102793520 | + | chr7 | 102939015 | 102939155 | + | ENST00000249269; ENST00000428154; ENST00000456433; ENST00000443722; ENST00000453466 | TSF |
| 5% | chr20 | 9311166 | 9311205 | + | chr20 | 9317773 | 9317853 | + | ENST00000407043; ENST00000441846; ENST00000334005; ENST00000378473; ENST00000437503; ENST00000416836; ENST00000278655; ENST00000414679; ENST00000378493; ENST00000378501 | TSF |
| 5% | chr20 | 9311166 | 9311205 | + | chr20 | 9317773 | 9317853 | + | ENST00000407043; ENST00000441846; ENST00000334005; ENST00000378473; ENST00000437503; ENST00000416836; ENST00000278655; ENST00000414679; ENST00000378493; ENST00000378501 | TSF |
| 5% | chr20 | 9311166 | 9311205 | + | chr20 | 9317773 | 9317853 | + | ENST00000407043; ENST00000441846; ENST00000334005; ENST00000378473; ENST00000437503; ENST00000416836; ENST00000278655; ENST00000414679; ENST00000378493; ENST00000378501 | TSF |

TABLE 17-continued

Transcript fusion for Colon adenocarcinoma (COAD) Coordinates of the fusion sequences for which the donor is the TE.

| 1 | 2 | 3' | 4' | 5' | 6' | 7' | 8' | 9' | 10' | 11' |
|---|---|---|---|---|---|---|---|---|---|---|
| 5% | chr20 | 9311166 | 9311205 | + | chr20 | 9317773 | 9317853 | + | ENST00000407043; ENST00000441846; ENST00000334005; ENST00000378473; ENST00000437503; ENST00000416836; ENST00000278655; ENST00000414679; ENST00000378493; ENST00000378501 | TSF |
| 5% | chr20 | 9311166 | 9311205 | + | chr20 | 9317773 | 9317853 | + | ENST00000407043; ENST00000441846; ENST00000334005; ENST00000378473; ENST00000437503; ENST00000416836; ENST00000278655; ENST00000414679; ENST00000378493; ENST00000378501 | TSF |
| 5% | chr20 | 9311166 | 9311205 | + | chr20 | 9317773 | 9317853 | + | ENST00000407043; ENST00000441846; ENST00000334005; ENST00000378473; ENST00000437503; ENST00000416836; ENST00000278655; ENST00000414679; ENST00000378493; ENST00000378501 | TSF |
| 5% | chr20 | 9311166 | 9311205 | + | chr20 | 9317773 | 9317853 | + | ENST00000407043; ENST00000441846; ENST00000334005; ENST00000378473; ENST00000437503; ENST00000416836; ENST00000278655; ENST00000414679; ENST00000378493; ENST00000378501 | TSF |
| 4% | chr1 | 1562829 | 1562875 | + | chr1 | 1563053 | 1563209 | + | ENST00000520777; ENST00000357210; ENST00000360522; ENST00000378710; ENST00000355826; ENST00000518681; ENST00000505820; ENST00000487053; ENST00000378712; ENST00000504599; ENST00000378708; ENST00000514234 | TSF |
| 4% | chr1 | 1562829 | 1562875 | + | chr1 | 1563053 | 1563209 | + | ENST00000520777; ENST00000357210; ENST00000360522; ENST00000378710; ENST00000355826; ENST00000518681; ENST00000505820; ENST00000487053; ENST00000378712; ENST00000504599; ENST00000378708; ENST00000514234 | TSF |
| 4% | chr1 | 1562829 | 1562875 | + | chr1 | 1563053 | 1563209 | + | ENST00000520777; ENST00000357210; ENST00000360522; ENST00000378710; ENST00000355826; ENST00000518681; ENST00000505820; ENST00000487053; ENST00000378712; ENST00000504599; ENST00000378708; ENST00000514234 | TSF |
| 4% | chr1 | 1562829 | 1562926 | + | chr1 | 1563053 | 1563209 | + | ENST00000520777; ENST00000357210; ENST00000360522; ENST00000378710; ENST00000355826; ENST00000518681; ENST00000505820; ENST00000487053; ENST00000378712; ENST00000504599; ENST00000378708; ENST00000514234 | TSF |
| 4% | chr1 | 1562829 | 1562926 | + | chr1 | 1563053 | 1563209 | + | ENST00000520777; ENST00000357210; ENST00000360522; ENST00000378710; ENST00000355826; ENST00000518681; ENST00000505820; ENST00000487053; ENST00000378712; ENST00000504599; ENST00000378708; ENST00000514234 | TSF |
| 4% | chr1 | 1562829 | 1562926 | + | chr1 | 1563053 | 1563209 | + | ENST00000520777; ENST00000357210; ENST00000360522; ENST00000378710; ENST00000355826; ENST00000518681; ENST00000505820; ENST00000487053; ENST00000378712; ENST00000504599; ENST00000378708; ENST00000514234 | TSF |
| 4% | chr7 | 117315827 | 117316035 | + | chr7 | 117355812 | 117355913 | + | ENST00000600166 | TSF |
| 4% | chr8 | 128749913 | 128749923 | + | chr8 | 128750494 | 128751265 | + | ENST00000377970 | TSF |
| 4% | chr19 | 42246888 | 42246564 | − | chr19 | 42187994 | 42187716 | − | ENST00000006724; ENST00000401731 | TSF |
| 4% | chr1 | 59980221 | 59980497 | + | chr1 | 60073475 | 60073582 | + | ENST00000371218; ENST00000303721; ENST00000430447; ENST00000371212; ENST00000371210 | TSF |
| 4% | chr1 | 59980221 | 59980497 | + | chr1 | 60073475 | 60073582 | + | ENST00000371218; ENST00000303721; ENST00000430447; ENST00000371212; ENST00000371210 | TSF |
| 4% | chr1 | 59980221 | 59980497 | + | chr1 | 60073475 | 60073582 | + | ENST00000371218; ENST00000303721; ENST00000430447; ENST00000371212; ENST00000371210 | TSF |
| 4% | chr20 | 410407 | 410425 | + | chr20 | 410994 | 411074 | + | ENST00000356286; ENST00000353660; ENST00000382181 | TSF |
| 4% | chr19 | 42246888 | 42246564 | − | chr19 | 42181431 | 42181340 | − | ENST00000006724; ENST00000338196; ENST00000401731; ENST00000602225 | TSF |
| 4% | chr19 | 42246888 | 42246564 | − | chr19 | 42191152 | 42190790 | − | ENST00000006724; ENST00000338196; ENST00000401731; ENST00000602225 | TSF |
| 4% | chr19 | 42246888 | 42246564 | − | chr19 | 42191152 | 42190790 | − | ENST00000006724; ENST00000338196; ENST00000401731; ENST00000602225 | TSF |

TABLE 17-continued

Transcript fusion for Colon adenocarcinoma (COAD) Coordinates of the fusion sequences for which the donor is the TE.

| 1 | 2 | 3' | 4' | 5' | 6' | 7' | 8' | 9' | 10' | 11' |
|---|---|---|---|---|---|---|---|---|---|---|
| 4% | chr19 | 50174724 | 50174836 | + | chr19 | 50176955 | 50177005; 50177034 | + | ENST00000441864; ENST00000246785; ENST00000600947; ENST00000598306 | TSF |
| 4% | chr19 | 50174724 | 50174836 | + | chr19 | 50176955 | 50177005; 50177034 | + | ENST00000441864; ENST00000246785; ENST00000600947; ENST00000598306 | TSF |
| 4% | chr7 | 100854761 | 100854711 | − | chr7 | 100853923 | 100853813; 100853876 | − | ENST00000454310; ENST00000223127; ENST00000421736 | ITSF |
| 4% | chr7 | 100854761 | 100854711 | − | chr7 | 100853923 | 100853813; 100853876 | − | ENST00000454310; ENST00000223127; ENST00000421736 | TSF |
| 4% | chr7 | 100854761 | 100854711 | − | chr7 | 100853923 | 100853813; 100853876 | − | ENST00000454310; ENST00000223127; ENST00000421736 | TSF |
| 4% | chr12 | 50285408 | 50285280 | − | chr12 | 50284897 | 50284847; 50284860 | − | ENST00000320634; ENST00000550890; ENST00000550195; ENST00000552669; ENST00000552863; ENST00000550635; ENST00000547871 | TSF |
| 4% | chr12 | 50285408 | 50285280 | − | chr12 | 50284897 | 50284847; 50284860 | − | ENST00000320634; ENST00000550890; ENST00000550195; ENST00000552669; ENST00000552863; ENST00000550635; ENST00000547871 | TSF |
| 4% | chr12 | 50285408 | 50285280 | − | chr12 | 50284897 | 50284847; 50284860 | − | ENST00000320634; ENST00000550890; ENST00000550195; ENST00000552669; ENST00000552863; ENST00000550635; ENST00000547871 | TSF |
| 4% | chr12 | 50285408 | 50285280 | − | chr12 | 50284897 | 50284847; 50284860 | − | ENST00000320634; ENST00000550890; ENST00000550195; ENST00000552669; ENST00000552863; ENST00000550635; ENST00000547871 | TSF |
| 4% | chr12 | 50285408 | 50285280 | − | chr12 | 50284897 | 50284847; 50284860 | − | ENST00000320634; ENST00000550890; ENST00000550195; ENST00000552669; ENST00000552863; ENST00000550635; ENST00000547871 | TSF |
| 4% | chr12 | 50285408 | 50285280 | − | chr12 | 50284897 | 50284847; 50284860 | − | ENST00000320634; ENST00000550890; ENST00000550195; ENST00000552669; ENST00000552863; ENST00000550635; ENST00000547871 | TSF |
| 3% | chr13 | 34394352 | 34394605 | + | chr13 | 34395269 | 34395406 | + | ENST00000380071; ENST00000434425 | TSF |
| 3% | chr13 | 34394352 | 34394605 | + | chr13 | 34395269 | 34395406 | + | ENST00000380071; ENST00000434425 | TSF |
| 3% | chr1 | 1422590 | 1422685 | + | chr1 | 1423243 | 1423294 | + | ENST00000308647 | TSF |
| 3% | chr4 | 873272 | 873014 | − | chr4 | 871597 | 871403 | − | ENST00000314167; ENST00000511163 | TSF |
| 3% | chr8 | 66628514 | 66628604 | + | chr8 | 66631615 | 66631668 | + | ENST00000521247 | TSF |
| 3% | chr7 | 29523499 | 29523591 | + | chr7 | 29535568 | 29535652 | + | ENST00000539406; ENST00000222792; ENST00000495789; ENST00000539389; ENST00000546235; ENST00000446446; ENST00000409041; ENST00000424025; ENST00000421775; ENST00000439711 | TSF |
| 3% | chr7 | 29523499 | 29523591 | + | chr7 | 29535568 | 29535652 | + | ENST00000539406; ENST00000222792; ENST00000495789; ENST00000539389; ENST00000546235; ENST00000446446; ENST00000409041; ENST00000424025; ENST00000421775; ENST00000439711 | TSF |
| 3% | chr7 | 29523499 | 29523591 | + | chr7 | 29535568 | 29535652 | + | ENST00000539406; ENST00000222792; ENST00000495789; ENST00000539389; ENST00000546235; ENST00000446446; ENST00000409041; ENST00000424025; ENST00000421775; ENST00000439711 | TSF |
| 3% | chr7 | 29523499 | 29523591 | + | chr7 | 29535568 | 29535652 | + | ENST00000539406; ENST00000222792; ENST00000495789; ENST00000539389; ENST00000546235; ENST00000446446; ENST00000409041; ENST00000424025; ENST00000421775; ENST00000439711 | TSF |
| 3% | chr13 | 101090702 | 101090974 | + | chr13 | 101167681 | 101167821 | + | ENST00000376286; ENST00000376285; ENST00000428969 | TSF |
| 3% | chr13 | 101090702 | 101090974 | + | chr13 | 101167681 | 101167821 | + | ENST00000376286; ENST00000376285; ENST00000428969 | TSF |
| 3% | chr8 | 71625721 | 71625811 | + | chr8 | 71646031 | 71646659 | + | ENST00000408926; ENST00000520030 | TSF |
| 3% | chr1 | 1562829 | 1562973 | + | chr1 | 1563053 | 1563209 | + | ENST00000520777; ENST00000357210; ENST00000360522; ENST00000378710; ENST00000355826; ENST00000518681; ENST00000505820; ENST00000487053; ENST00000378712; ENST00000504599; ENST00000378708; ENST00000514234 | TSF |
| 3% | chr1 | 1562829 | 1562973 | + | chr1 | 1563053 | 1563209 | + | ENST00000520777; ENST00000357210; ENST00000360522; ENST00000378710; ENST00000355826; ENST00000518681; ENST00000505820; ENST00000487053; ENST00000378712; ENST00000504599; ENST00000378708; ENST00000514234 | TSF |

TABLE 17-continued

Transcript fusion for Colon adenocarcinoma (COAD) Coordinates of the fusion sequences for which the donor is the TE.

| 1 | 2 | 3' | 4' | 5' | 6' | 7' | 8' | 9' | 10' | 11' |
|---|---|---|---|---|---|---|---|---|---|---|
| 3% | chr1 | 1562829 | 1562973 | + | chr1 | 1563053 | 1563209 | + | ENST00000520777; ENST00000357210; ENST00000360522; ENST00000378710; ENST00000355826; ENST00000518681; ENST00000505820; ENST00000487053; ENST00000378712; ENST00000504599; ENST00000378708; ENST00000514234 | TSF |
| 3% | chr16 | 89649823 | 89649851 | + | chr16 | 89650105 | 89650179 | + | ENST00000268720; ENST00000319518 | TSF |
| 3% | chr13 | 95233957 | 95233815 | − | chr13 | 95233443 | 95233345 | − | ENST00000261296 | TSF |
| 2% | chr13 | 43670805 | 43671144 | + | chr13 | 43681314 | 43681384 | + | ENST00000379221 | TSF |
| 2% | chr20 | 60878087 | 60878105 | + | chr20 | 60878775 | 60878837 | + | ENST00000253003 | TSF |
| 2% | chr7 | 56018506 | 56018522 | + | chr7 | 56020872 | 56021011 | + | ENST00000426595 | TSF |
| 2% | chr8 | 63949410 | 63948932 | − | chr8 | 63948329 | 63948215 | − | ENST00000260118 | TSF |
| 2% | chr8 | 144691011 | 144690934 | − | chr8 | 144690296 | 144690232 | − | ENST00000220966; ENST00000433751 | TSF |
| 2% | chr8 | 144691011 | 144690934 | − | chr8 | 144690296 | 144690232 | − | ENST00000220966; ENST00000433751 | TSF |
| 2% | chr17 | 56486405 | 56486202 | − | chr17 | 56448394 | 56448272 | − | ENST00000407977; ENST00000584437; ENST00000577716 | TSF |
| 2% | chr1 | 44446234 | 44446286 | + | chr1 | 44446781 | 44447145 | + | ENST00000309519 | TSF |
| 2% | chr1 | 41465686 | 41465756 | + | chr1 | 41466701 | 41466789 | + | ENST00000372621; ENST00000541520; ENST00000372616 | TSF |
| 2% | chr7 | 139714768 | 139714786 | + | chr7 | 139715523 | 139715660 | + | ENST00000425687; ENST00000263552; ENST00000336425; ENST00000414508; ENST00000416849; ENST00000436047; ENST00000448866; ENST00000458722; ENST00000411653 | TSF |
| 2% | chr7 | 139714768 | 139714786 | + | chr7 | 139715523 | 139715660 | + | ENST00000425687; ENST00000263552; ENST00000336425; ENST00000414508; ENST00000416849; ENST00000436047; ENST00000448866; ENST00000458722; ENST00000411653 | TSF |
| 2% | chrX | 69366031 | 69366077 | + | chrX | 69366483 | 69366678 | + | ENST00000342206; ENST00000356413 | TSF |
| 2% | chr7 | 117326507 | 117326829 | + | chr7 | 117355812 | 117355913 | + | ENST00000600166 | TSF |
| 2% | chr16 | 50663697 | 50663964 | + | chr16 | 50664097 | 50664244 | + | ENST00000268459 | TSF |
| 2% | chr11 | 67035528 | 67035570 | + | chr11 | 67044743 | 67044819 | + | ENST00000308595; ENST00000526285 | TSF |
| 2% | chr11 | 67035528 | 67035570 | + | chr11 | 67044743 | 67044819 | + | ENST00000308595; ENST00000526285 | TSF |
| 2% | chr17 | 39974832 | 39974893 | + | chr17 | 39975462 | 39975651 | + | ENST00000321562 | TSF |
| 2% | chr8 | 91107662 | 91105645 | − | chr8 | 91094330 | 91094254 | − | ENST00000265431 | TSF |
| 2% | chr11 | 65629362 | 65629337 | − | chr11 | 65623713 | 65623406; 65623445 | − | ENST00000525451; ENST00000308162; ENST00000534769; ENST00000532134; ENST00000526975 | TSF |
| 2% | chr11 | 65629362 | 65629337 | − | chr11 | 65623713 | 65623406; 65623445 | − | ENST00000525451; ENST00000308162; ENST00000534769; ENST00000532134; ENST00000526975 | TSF |
| 2% | chr11 | 65629362 | 65629337 | − | chr11 | 65623713 | 65623406; 65623445 | − | ENST00000525451; ENST00000308162; ENST00000534769; ENST00000532134; ENST00000526975 | TSF |
| 2% | chr1 | 156716197 | 156716133 | − | chr1 | 156715165 | 156715089 | − | ENST00000357325; ENST00000537739; ENST00000368209; ENST00000368206 | TSF |
| 2% | chr12 | 14670381 | 14670239 | − | chr12 | 14664645 | 14664445 | − | ENST00000240617 | TSF |

TABLE 19

Transcript fusion for Lymphoid Neoplasm Diffuse Large B-cell Lymphoma (DLBC)
Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 67% | chr16 | 4409386 | 4409297 | − | ENST00000572467; ENST00000251166; ENST00000539968; ENST00000537233; ENST00000574025; ENST00000576637 | chr16 | 4409070 | 4408945 | − | TAF |
| 67% | chr16 | 4409386 | 4409297 | − | ENST00000572467; ENST00000251166; ENST00000539968; ENST00000537233; ENST00000574025; ENST00000576637 | chr16 | 4409070 | 4408945 | − | TAF |
| 67% | chr16 | 4409386 | 4409297 | − | ENST00000572467; ENST00000251166; ENST00000539968; ENST00000537233; ENST00000574025; ENST00000576637 | chr16 | 4409070 | 4408945 | − | TAF |
| 67% | chr16 | 4409386 | 4409297 | − | ENST00000572467; ENST00000251166; ENST00000539968; ENST00000537233; ENST00000574025; ENST00000576637 | chr16 | 4409070 | 4408945 | − | TAF |
| 67% | chr16 | 4409386 | 4409297 | − | ENST00000572467; ENST00000251166; ENST00000539968; ENST00000537233; ENST00000574025; ENST00000576637 | chr16 | 4409070 | 4408945 | − | TAF |
| 62% | chr12 | 9875257; 9875409 | 9875240 | − | ENST00000540988; ENST00000542530; ENST00000327839 | chr12 | 9855036 | 9854406 | − | TAF |

TABLE 19-continued

Transcript fusion for Lymphoid Neoplasm Diffuse Large B-cell Lymphoma (DLBC)
Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 62% | chr12 | 9875257; 9875409 | 9875240 | − | ENST00000540988; ENST00000542530; ENST00000327839 | chr12 | 9855036 | 9854406 | − | TAF |
| 62% | chr12 | 9875257; 9875409 | 9875240 | − | ENST00000540988; ENST00000542530; ENST00000327839 | chr12 | 9855036 | 9854406 | − | TAF |
| 60% | chr5 | 82554349 | 82554496 | + | ENST00000282268; ENST00000338635; ENST00000396027; ENST00000511817 | chr5 | 82606608 | 82606935 | + | TAF |
| 48% | chr5 | 74984990 | 74984837 | − | ENST00000428202; ENST00000514838; ENST00000380475; ENST00000510798; ENST00000446329 | chr5 | 74983153 | 74982863 | − | TAF |
| 48% | chr5 | 74984990 | 74984837 | − | ENST00000428202; ENST00000514838; ENST00000380475; ENST00000510798; ENST00000446329 | chr5 | 74983153 | 74982863 | − | TAF |
| 48% | chr5 | 74984990 | 74984837 | − | ENST00000428202; ENST00000514838; ENST00000380475; ENST00000510798; ENST00000446329 | chr5 | 74983153 | 74982863 | − | TAF |
| 48% | chr5 | 74984990 | 74984837 | − | ENST00000428202; ENST00000514838; ENST00000380475; ENST00000510798; ENST00000446329 | chr5 | 74983153 | 74982863 | − | TAF |
| 46% | chr9 | 101984828 | 101984925 | + | ENST00000223641 | chr9 | 101986374 | 101986588 | + | TAF |
| 44% | chr20 | 49458303 | 49458437 | + | ENST00000358791; ENST00000371608; ENST00000609336 | chr20 | 49468479 | 49468517 | + | TSF |
| 44% | chr20 | 49458303 | 49458437 | + | ENST00000358791; ENST00000371608; ENST00000609336 | chr20 | 49468479 | 49468517 | + | TSF |
| 44% | chr19 | 55178148; 55178145 | 55178200 | + | ENST00000391736; ENST00000270452; ENST00000430952; ENST00000391734; ENST00000391733; ENST00000434286 | chr19 | 55178294 | 55178458 | + | TSF |
| 44% | chr19 | 55178148; 55178145 | 55178200 | + | ENST00000391736; ENST00000270452; ENST00000430952; ENST00000391734; ENST00000391733; ENST00000434286 | chr19 | 55178294 | 55178458 | + | TSF |
| 44% | chr19 | 55178148; 55178145 | 55178200 | + | ENST00000391736; ENST00000270452; ENST00000430952; ENST00000391734; ENST00000391733; ENST00000434286 | chr19 | 55178291 | 55178458 | + | TSF |
| 42% | chr1 | 32696528 | 32696620 | + | ENST00000373586 | chr1 | 32696861 | 32697110 | + | TAF |
| 42% | chr22 | 37868566 | 37868481 | − | ENST00000416983; ENST00000356998 | chr22 | 37865350 | 37865175 | − | TAF |
| 42% | chr22 | 37868566 | 37868481 | − | ENST00000416983; ENST00000356998 | chr22 | 37865350 | 37865175 | − | TAF |
| 40% | chr9 | 15506635 | 15506559 | − | ENST00000380738; ENST00000380733; ENST00000380715; ENST00000380716; ENST00000397519 | chr9 | 15492223 | 15492056 | − | TAF |
| 38% | chr7 | 98991652 | 98991742 | + | ENST00000252725; ENST00000451682 | chr7 | 98994840 | 98994900 | + | TAF |
| 35% | chr9 | 37432005 | 37432135 | + | ENST00000318158; ENST00000607784 | chr9 | 37432530 | 37432695 | + | TAF |
| 35% | chr4 | 1742553 | 1742713 | + | ENST00000313288 | chr4 | 1745122 | 1745307 | + | TAF |
| 35% | chr16 | 28947474 | 28947522 | + | ENST00000538922; ENST00000324662; ENST00000567541 | chr16 | 28947601 | 28947688 | + | TAF |
| 33% | chr19 | 14698426 | 14698503 | + | ENST00000397439; ENST00000547437; ENST00000339847; ENST00000417570; ENST00000551730 | chr19 | 14700687 | 14700982 | + | TAF |
| 33% | chr2 | 99786073 | 99786013 | − | ENST00000422537; ENST00000289359; ENST00000409107 | chr2 | 99784175 | 99783867 | − | TAF |
| 33% | chr2 | 99786073 | 99786013 | − | ENST00000422537; ENST00000289359; ENST00000409107 | chr2 | 99784175 | 99783867 | − | TAF |
| 33% | chr2 | 99786073 | 99786013 | − | ENST00000422537; ENST00000289359; ENST00000409107 | chr2 | 99784175 | 99783867 | − | TAF |
| 33% | chr19 | 14694169 | 14694246 | + | ENST00000397439; ENST00000547437; ENST00000339847; ENST00000417570; ENST00000551730 | chr19 | 14700687 | 14700982 | + | TSF |
| 33% | chr19 | 14694169 | 14694246 | + | ENST00000397439; ENST00000547437; ENST00000339847; ENST00000417570; ENST00000551730 | chr19 | 14696424 | 14696719 | + | TSF |
| 29% | chr14 | 75991427 | 75991531 | + | ENST00000286639 | chr14 | 76001192 | 76001455 | + | TAF |
| 29% | chr19 | 10450290 | 10450215 | − | ENST00000160262; ENST00000585439 | chr19 | 10449921 | 10449718 |  | TAF |
| 27% | chr17 | 28003903 | 28003838 | − | ENST00000269033; ENST00000540801 | chr17 | 28001177 | 28000609 |  | TAF |
| 27% | chr17 | 28003903 | 28003838 | − | ENST00000269033; ENST00000540801 | chr17 | 28001177 | 28000609 |  | TAF |
| 25% | chr3 | 196230044 | 196229744 | − | ENST00000318037; ENST00000437070 | chr3 | 196223342 | 196223041 | − | TAF |
| 25% | chr5 | 150411944 | 150411848 | − | ENST00000520931; ENST00000389378; ENST00000315050; ENST00000523338; ENST00000522226; ENST00000518977; ENST00000521591; ENST00000523200 | chr5 | 150410874 | 150410734 | − | TAF |
| 25% | chr5 | 150411944 | 150411848 | − | ENST00000520931; ENST00000389378; ENST00000315050; ENST00000523338; ENST00000522226; ENST00000518977; ENST00000521591; ENST00000523200 | chr5 | 150410874 | 150410734 | − | TAF |
| 25% | chr5 | 150411944 | 150411848 | − | ENST00000520931; ENST00000389378; ENST00000315050; ENST00000523338; ENST00000522226; ENST00000518977; ENST00000521591; ENST00000523200 | chr5 | 150410874 | 150410734 | − | TAF |

TABLE 19-continued

Transcript fusion for Lymphoid Neoplasm Diffuse Large B-cell Lymphoma (DLBC)
Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 25% | chr22 | 35819207 | 35819334 | + | ENST00000216122; ENST00000382011 | chr22 | 35822985 | 35823438 | + | TSF |
| 25% | chr22 | 35819207 | 35819334 | + | ENST00000216122; ENST00000382011 | chr22 | 35822985 | 35823438 | + | TSF |
| 23% | chr17 | 63173850 | 63173921 | + | ENST00000584234; ENST00000262406 | chr17 | 63176114 | 63176128 | + | TAF |
| 23% | chr6 | 32826141 | 32826282 | + | ENST00000395330; ENST00000453265; ENST00000374859 | chr6 | 32828985 | 32829263 | + | TAF |
| 23% | chr6 | 32826141 | 32826282 | + | ENST00000395330; ENST00000453265; ENST00000374859 | chr6 | 32828985 | 32829263 | + | TAF |
| 23% | chr6 | 32826141 | 32826282 | + | ENST00000395330; ENST00000453265; ENST00000374859 | chr6 | 32828985 | 32829263 | + | TAF |
| 23% | chr1 | 151239649 | 151239815 | + | ENST00000368884; ENST00000368881; ENST00000445776; ENST00000453615 | chr1 | 151251832 | 151251905 | + | TAF |
| 23% | chr1 | 151239649 | 151239815 | + | ENST00000368884; ENST00000368881; ENST00000445776; ENST00000453615 | chr1 | 151251832 | 151251905 | + | TAF |
| 23% | chr1 | 151239649 | 151239815 | + | ENST00000368884; ENST00000368881; ENST00000445776; ENST00000453615 | chr1 | 151251832 | 151251905 | + | TAF |
| 23% | chr1 | 151239649 | 151239815 | + | ENST00000368884; ENST00000368881; ENST00000445776; ENST00000453615 | chr1 | 151251832 | 151251905 | + | TAF |
| 23% | chr10 | 120905865 | 120905748 | − | ENST00000355697; ENST00000330036 | chr10 | 120901885 | 120901741 | − | TAF |
| 23% | chr10 | 120905865 | 120905748 | − | ENST00000355697; ENST00000330036 | chr10 | 120901885 | 120901741 | − | TAF |
| 23% | chr8 | 68536486 | 68536411 | − | ENST00000479862; ENST00000297770; ENST00000518549 | chr8 | 68520294 | 68520139 | − | TAF |
| 23% | chr19 | 50926862 | 50927012 | + | ENST00000599632; ENST00000595883; ENST00000439922 | chr19 | 50927187 | 50927315 | + | TSF |
| 23% | chr19 | 50926862 | 50927012 | + | ENST00000599632; ENST00000595883; ENST00000439922 | chr19 | 50927187 | 50927315 | + | TSF |
| 23% | chr19 | 50926862 | 50927012 | + | ENST00000599632; ENST00000595883; ENST00000439922 | chr19 | 50927187 | 50927315 | + | TSF |
| 21% | chr1 | 209946293 | 209946364 | + | ENST00000400959; ENST00000367025; ENST00000478359; ENST00000367026; ENST00000367024; ENST00000010338 | chr1 | 209948635 | 209948677 | + | TAF |
| 21% | chr1 | 209946293 | 209946364 | + | ENST00000400959; ENST00000367025; ENST00000478359; ENST00000367026; ENST00000367024; ENST00000010338 | chr1 | 209948635 | 209948677 | + | TAF |
| 21% | chr8 | 74939024 | 74939076 | + | ENST00000284818; ENST00000518893 | chr8 | 74944554 | 74944936 | + | TAF |
| 21% | chr8 | 74939024 | 74939076 | + | ENST00000284818; ENST00000518893 | chr8 | 74944554 | 74944936 | + | TAF |
| 21% | chr6 | 139363856 | 139363999 | + | ENST00000367660 | chr6 | 139372258 | 139372516 | + | TAF |
| 21% | chr4 | 57319769 | 57319927 | + | ENST00000514888; ENST00000264221; ENST00000505164; ENST00000399688; ENST00000512576 | chr4 | 57321183 | 57321327 | + | TSF |
| 21% | chr4 | 57319769 | 57319927 | + | ENST00000514888; ENST00000264221; ENST00000505164; ENST00000399688; ENST00000512576 | chr4 | 57321183 | 57321327 | + | TSF |
| 21% | chr4 | 57319769 | 57319927 | + | ENST00000514888; ENST00000264221; ENST00000505164; ENST00000399688; ENST00000512576 | chr4 | 57321183 | 57321327 | + | TSF |
| 17% | chr7 | 86848819 | 86848742 | − | ENST00000257637; ENST00000433078; ENST00000423734 | chr7 | 86836058 | 86835850 | − | TAF |
| 17% | chr5 | 88100618 | 88100415 | − | ENST00000340208; ENST00000424173; ENST00000504921; ENST00000514028; ENST00000437473; ENST00000510942; ENST00000506554; ENST00000508569; ENST00000514015; ENST00000539796; ENST00000513252; ENST00000506716; ENST00000507984; ENST00000502983; ENST00000508610; ENST00000502831; ENST00000503075 | chr5 | 88086672 | 88086593 | − | TAF |
| 15% | chr9 | 130540906 | 130540870 | − | ENST00000314830 | chr9 | 130540563 | 130540257 | − | TAF |
| 15% | chr9 | 132719743 | 132719639 | − | ENST00000446176; ENST00000420781; ENST00000449089; ENST00000355681 | chr9 | 132718439 | 132718336 | − | TAF |
| 15% | chr9 | 132719743 | 132719639 | − | ENST00000446176; ENST00000420781; ENST00000449089; ENST00000355681 | chr9 | 132718439 | 132718336 | − | TAF |
| 15% | chr2 | 87072081 | 87072045 | − | ENST00000393759; ENST00000349455; ENST00000331469; ENST00000390655; ENST00000431506 | chr2 | 87069500 | 87069472 | − | TAF |
| 15% | chr2 | 87072081 | 87072045 | − | ENST00000393759; ENST00000349455; ENST00000331469; ENST00000390655; ENST00000431506 | chr2 | 87069500 | 87069472 | − | TAF |
| 15% | chr2 | 87072081 | 87072045 | − | ENST00000393759; ENST00000349455; ENST00000331469; ENST00000390655; ENST00000431506 | chr2 | 87069500 | 87069472 | − | TAF |
| 15% | chr7 | 102079404 | 102079628 | + | ENST00000495936; ENST00000356387; ENST00000478730; ENST00000468241; ENST00000403646; ENST00000498661; ENST00000473939 | chr7 | 102080251 | 102080534 | + | TSF |

TABLE 19-continued

Transcript fusion for Lymphoid Neoplasm Diffuse Large B-cell Lymphoma (DLBC)
Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 15% | chr3 | 129020793 | 129020985 | + | ENST00000509042; ENST00000383463; ENST00000417226; ENST00000502878; ENST00000389735 | chr3 | 129029005 | 129029042 | + | TSF |
| 15% | chr3 | 129020793 | 129020985 | + | ENST00000509042; ENST00000383463; ENST00000417226; ENST00000502878; ENST00000389735 | chr3 | 129029005 | 129029042 | + | TSF |
| 15% | chr3 | 129020793 | 129020985 | + | ENST00000509042; ENST00000383463; ENST00000417226; ENST00000502878; ENST00000389735 | chr3 | 129029005 | 129029042 | + | TSF |
| 15% | chr9 | 101984828 | 101984925 | + | ENST00000223641 | chr9 | 101986271 | 101986319 | + | TSF |
| 15% | chr11 | 65222908 | 65223052 | + | ENST00000309775 | chr11 | 65224109 | 65224450 | + | TSF |
| 15% | chr19 | 10450290 | 10450215 | − | ENST00000160262; ENST00000585439 | chr19 | 10449848 | 10449718 | − | TSF |
| 15% | chr1 | 154794660; 154794654 | 154794565 | − | ENST00000271915; ENST00000361147; ENST00000358505 | chr1 | 154761737 | 154761457 | − | TSF |
| 15% | chr1 | 154794660; 154794654 | 154794565 | − | ENST00000271915; ENST00000361147; ENST00000358505 | chr1 | 154761737 | 154761457 | − | TSF |
| 15% | chr1 | 154794660; 154794654 | 154794565 | − | ENST00000271915; ENST00000361147; ENST00000358505 | chr1 | 154761737 | 154761457 | − | TSF |
| 15% | chr1 | 157519370 | 157519350 | − | ENST00000361835; ENST00000368190; ENST00000368191; ENST00000368189; ENST00000368188 | chr1 | 157517485 | 157517377 | − | TSF |
| 12% | chr9 | 139872031 | 139872144 | + | ENST00000224167; ENST00000457950; ENST00000371625; ENST00000371623; ENST00000471521 | chr9 | 139873283 | 139873345 | + | TAF |
| 12% | chr10 | 100174892 | 100174766 | − | ENST00000370575 | chr10 | 100174591 | 100174461 | − | TAF |
| 12% | chr7 | 5781275; 5781446 | 5780604 | − | ENST00000425013; ENST00000389902; ENST00000389900 | chr7 | 5779256 | 5779224 | − | TAF |
| 12% | chr7 | 5781275; 5781446 | 5780604 | − | ENST00000425013; ENST00000389902; ENST00000389900 | chr7 | 5779256 | 5779224 | − | TAF |
| 12% | chr1 | 78421014 | 78420940 | − | ENST00000294623; ENST00000370768; ENST00000370767; ENST00000436586 | chr1 | 78417269 | 78417238 | − | TAF |
| 12% | chr1 | 78421014 | 78420940 | − | ENST00000294623; ENST00000370768; ENST00000370767; ENST00000436586 | chr1 | 78417269 | 78417238 | − | TAF |
| 12% | chr1 | 78421014 | 78420940 | − | ENST00000294623; ENST00000370768; ENST00000370767; ENST00000436586 | chr1 | 78417269 | 78417238 | − | TAF |
| 12% | chr12 | 121775196; 121775195 | 121775094 | − | ENST00000539079; ENST00000441917; ENST00000541887; ENST00000261819; ENST00000344395; ENST00000536366; ENST00000544442 | chr12 | 121766988 | 121766947 | − | TAF |
| 12% | chr12 | 121775196; 121775195 | 121775094 | − | ENST00000539079; ENST00000441917; ENST00000541887; ENST00000261819; ENST00000344395; ENST00000536366; ENST00000544442 | chr12 | 121766988 | 121766947 | − | TAF |
| 12% | chr12 | 121775196; 121775195 | 121775094 | − | ENST00000539079; ENST00000441917; ENST00000541887; ENST00000261819; ENST00000344395; ENST00000536366; ENST00000544442 | chr12 | 121766988 | 121766947 | − | TAF |
| 12% | chr12 | 121775196; 121775195 | 121775094 | − | ENST00000539079; ENST00000441917; ENST00000541887; ENST00000261819; ENST00000344395; ENST00000536366; ENST00000544442 | chr12 | 121766988 | 121766947 | − | TAF |
| 12% | chr6 | 110679475 | 110679358 | − | ENST00000338882 | chr2 | 115695277 | 115695018 | − | TAF |
| 12% | chr9 | 126219714 | 126219627 | − | ENST00000373624; ENST00000542603; ENST00000394219; ENST00000373620; ENST00000394215; ENST00000373618 | chr9 | 126219210 | 126219167 | − | TAF |
| 12% | chr9 | 126219714 | 126219627 | − | ENST00000373624; ENST00000542603; ENST00000394219; ENST00000373620; ENST00000394215; ENST00000373618 | chr9 | 126219210 | 126219167 | − | TAF |
| 12% | chr9 | 126219714 | 126219627 | − | ENST00000373624; ENST00000542603; ENST00000394219; ENST00000373620; ENST00000394215; ENST00000373618 | chr9 | 126219210 | 126219167 | − | TAF |
| 12% | chr9 | 126219714 | 126219627 | − | ENST00000373624; ENST00000542603; ENST00000394219; ENST00000373620; ENST00000394215; ENST00000373618 | chr9 | 126219210 | 126219167 | − | TAF |
| 12% | chr9 | 126219714 | 126219627 | − | ENST00000373624; ENST00000542603; ENST00000394219; ENST00000373620; ENST00000394215; ENST00000373618 | chr9 | 126219210 | 126219167 | − | TAF |
| 12% | chr14 | 32020101 | 32020133 | + | ENST00000550005 | chr14 | 32027031 | 32027274 | + | TSF |
| 12% | chr11 | 113857547; 113857240 | 113857768 | + | ENST00000504030; ENST00000355556; ENST00000375498; ENST00000506841; ENST00000535865; ENST00000299961 | chr11 | 113858309 | 113858477 | + | TSF |
| 12% | chr11 | 113857547; 113857240 | 113857768 | + | ENST00000504030; ENST00000355556; ENST00000375498; ENST00000506841; ENST00000535865; ENST00000299961 | chr11 | 113858309 | 113858477 | + | TSF |

TABLE 19-continued

Transcript fusion for Lymphoid Neoplasm Diffuse Large B-cell Lymphoma (DLBC)
Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 12% | chr11 | 113857547; 113857240 | 113857768 | + | ENST00000504030; ENST00000355556; ENST00000375498; ENST00000506841; ENST00000535865; ENST00000299961 | chr11 | 113858309 | 113858477 | + | TSF |
| 12% | chr11 | 113857547; 113857240 | 113857768 | + | ENST00000504030; ENST00000355556; ENST00000375498; ENST00000506841; ENST00000535865; ENST00000299961 | chr11 | 113858309 | 113858477 | + | TSF |
| 12% | chr11 | 113857547; 113857240 | 113857768 | + | ENST00000504030; ENST00000355556; ENST00000375498; ENST00000506841; ENST00000535865; ENST00000299961 | chr11 | 113858309 | 113858477 | + | TSF |
| 12% | chr11 | 113857547; 113857240 | 113857768 | + | ENST00000504030; ENST00000355556; ENST00000375498; ENST00000506841; ENST00000535865; ENST00000299961 | chr11 | 113858309 | 113858477 | + | TSF |
| 12% | chr1 | 11115983; 11115877 | 11115838 | − | ENST00000376957; ENST00000490101 | chr1 | 11115464 | 11115178 | − | TSF |
| 12% | chr1 | 11115983; 11115877 | 11115838 | − | ENST00000376957; ENST00000490101 | chr1 | 11115464 | 11115178 | − | TSF |
| 12% | chr4 | 25759228 | 25759156 | − | ENST00000399878; ENST00000264868; ENST00000502949; ENST00000510448 | chr4 | 25723603 | 25723555 | − | TSF |
| 12% | chr4 | 25759228 | 25759156 | − | ENST00000399878; ENST00000264868; ENST00000502949; ENST00000510448 | chr4 | 25723603 | 25723555 | − | TSF |
| 12% | chr4 | 25759228 | 25759156 | − | ENST00000399878; ENST00000264868; ENST00000502949; ENST00000510448 | chr4 | 25723603 | 25723555 | − | TSF |
| 12% | chr4 | 25759228 | 25759156 | − | ENST00000399878; ENST00000264868; ENST00000502949; ENST00000510448 | chr4 | 25723603 | 25723555 | − | TSF |
| 10% | chr21 | 45379563 | 45379740 | + | ENST00000291572; ENST00000448287; ENST00000398061; ENST00000327505; ENST00000445582; ENST00000398063; ENST00000398058; ENST00000457068; ENST00000422850; ENST00000546158 | chr21 | 45380513 | 45380695 | + | TAF |
| 10% | chr7 | 64254947 | 64254949 | + | ENST00000307355; ENST00000494380; ENST00000440155; ENST00000440598 | chr7 | 64257358 | 64257449 | + | TAF |
| 10% | chr2 | 220239744 | 220239577 | − | ENST00000273075; ENST00000373972; ENST00000523282 | chr2 | 220227530 | 220227195 | − | TAF |
| 10% | chr2 | 220239744 | 220239577 | − | ENST00000273075; ENST00000373972; ENST00000523282 | chr2 | 220227530 | 220227195 | − | TAF |
| 10% | chr2 | 220239744 | 220239577 | − | ENST00000273075; ENST00000373972; ENST00000523282 | chr2 | 220227530 | 220227195 | − | TAF |
| 10% | chr2 | 231065681 | 231065601 | − | ENST00000258381; ENST00000358662; ENST00000392048; ENST00000258382; ENST00000540870; ENST00000338556 | chr2 | 231054571 | 231054311 | − | TAF |
| 10% | chr2 | 231065681 | 231065601 | − | ENST00000258381; ENST00000358662; ENST00000392048; ENST00000258382; ENST00000540870; ENST00000338556 | chr2 | 231054571 | 231054311 | − | TAF |
| 10% | chr2 | 231065681 | 231065601 | − | ENST00000258381; ENST00000358662; ENST00000392048; ENST00000258382; ENST00000540870; ENST00000338556 | chr2 | 231054571 | 231054311 | − | TAF |
| 10% | chr2 | 231065681 | 231065601 | − | ENST00000258381; ENST00000358662; ENST00000392048; ENST00000258382; ENST00000540870; ENST00000338556 | chr2 | 231054571 | 231054311 | − | TAF |

TABLE 20

Transcript fusion for Lymphoid Neoplasm Diffuse Large B-cell Lymphoma (DLBC)
Coordinates of the fusion sequences for which the donor is the TE.

| 1' | 2' | 3' | 4' | 5' | 6' | 7' | 8' | 9' | 10' | 11' |
|---|---|---|---|---|---|---|---|---|---|---|
| 71% | chr17 | 79214190 | 79214239 | + | chr17 | 79214787 | 79214816; 79214953 | + | ENST00000431388; ENST00000576002 | TAF |
| 71% | chr17 | 79214190 | 79214239 | + | chr17 | 79214787 | 79214816; 79214953 | + | ENST00000431388; ENST00000576002 | TAF |
| 71% | chr11 | 44625878 | 44626051 | + | chr11 | 44626608 | 44626732; 44626675 | + | ENST00000526958; ENST00000227155; ENST00000342935; ENST00000532544; ENST00000527737; ENST00000524704; ENST00000525813; ENST00000530601 | TAF |
| 71% | chr11 | 44625878 | 44626051 | + | chr11 | 44626608 | 44626732; 44626675 | + | ENST00000526958; ENST00000227155; ENST00000342935; ENST00000532544; ENST00000527737; ENST00000524704; ENST00000525813; ENST00000530601 | TAF |

TABLE 20-continued

Transcript fusion for Lymphoid Neoplasm Diffuse Large B-cell Lymphoma (DLBC)
Coordinates of the fusion sequences for which the donor is the TE.

| 1' | 2' | 3' | 4' | 5' | 6' | 7' | 8' | 9' | 10' | 11' |
|---|---|---|---|---|---|---|---|---|---|---|
| 71% | chr11 | 44625878 | 44626051 | + | chr11 | 44626608 | 44626732; 44626675 | + | ENST00000526958; ENST00000342935; ENST00000527737; ENST00000525813; ENST00000227155; ENST00000532544; ENST00000524704; ENST00000530601 | TAF |
| 71% | chr11 | 44625878 | 44626051 | + | chr11 | 44626608 | 44626732; 44626675 | + | ENST00000526958; ENST00000342935; ENST00000527737; ENST00000525813; ENST00000227155; ENST00000532544; ENST00000524704; ENST00000530601 | TAF |
| 71% | chr11 | 44625878 | 44626051 | + | chr11 | 44626608 | 44626732; 44626675 | + | ENST00000526958; ENST00000342935; ENST00000527737; ENST00000525813; ENST00000227155; ENST00000532544; ENST00000524704; ENST00000530601 | TAF |
| 71% | chr11 | 44625878 | 44626051 | + | chr11 | 44626608 | 44626732; 44626675 | + | ENST00000526958; ENST00000342935; ENST00000527737; ENST00000525813; ENST00000227155; ENST00000532544; ENST00000524704; ENST00000530601 | TAF |
| 71% | chr11 | 44625878 | 44626051 | + | chr11 | 44626608 | 44626732; 44626675 | + | ENST00000526958; ENST00000342935; ENST00000527737; ENST00000525813; ENST00000227155; ENST00000532544; ENST00000524704; ENST00000530601 | TAF |
| 71% | chr11 | 44625878 | 44626051 | + | chr11 | 44626608 | 44626732; 44626675 | + | ENST00000526958; ENST00000342935; ENST00000527737; ENST00000525813; ENST00000227155; ENST00000532544; ENST00000524704; ENST00000530601 | TAF |
| 65% | chr19 | 16267516 | 16267566 | + | chr19 | 16268020 | 16268208; 16268205; 16268448; 16268139 | + | ENST00000253680; ENST00000593154; ENST00000593031 | ENST00000397372; ENST00000588246; | TAF |
| 65% | chr19 | 16267516 | 16267566 | + | chr19 | 16268020 | 16268208; 16268205; 16268448; 16268139 | + | ENST00000253680; ENST00000593154; ENST00000593031 | ENST00000397372; ENST00000588246; | TAF |
| 65% | chr19 | 16267516 | 16267566 | + | chr19 | 16268020 | 16268208; 16268205; 16268448; 16268139 | + | ENST00000253680; ENST00000593154; ENST00000593031 | ENST00000397372; ENST00000588246; | TAF |
| 65% | chr19 | 16267516 | 16267566 | + | chr19 | 16268020 | 16268208; 16268205; 16268448; 16268139 | + | ENST00000253680; ENST00000593154; ENST00000593031 | ENST00000397372; ENST00000588246; | TAF |
| 60% | chr1 | 111670629 | 111670605 | − | chr1 | 111668916 | 111668849 | − | ENST00000286692; ENST00000496430 | ENST00000539140; | TAF |
| 60% | chr1 | 111670629 | 111670605 | − | chr1 | 111668916 | 111668849 | − | ENST00000286692; ENST00000496430 | ENST00000539140; | TAF |
| 58% | chr20 | 49434330 | 49434474 | + | chr20 | 49434748 | 49434819 | + | ENST00000358791; ENST00000371608; ENST00000445038; ENST00000262591; ENST00000609336; ENST00000463943 | TAF |
| 58% | chr20 | 49434330 | 49434474 | + | chr20 | 49434748 | 49434819 | + | ENST00000358791; ENST00000371608; ENST00000445038; ENST00000262591; ENST00000609336; ENST00000463943 | TAF |
| 58% | chr20 | 49434330 | 49434474 | + | chr20 | 49434748 | 49434819 | + | ENST00000358791; ENST00000371608; ENST00000445038; ENST00000262591; ENST00000609336; ENST00000463943 | TAF |
| 58% | chr20 | 49434330 | 49434474 | + | chr20 | 49434748 | 49434819 | + | ENST00000358791; ENST00000371608; ENST00000445038; ENST00000262591; ENST00000609336; ENST00000463943 | TAF |
| 58% | chr20 | 49434330 | 49434474 | + | chr20 | 49434748 | 49434819 | + | ENST00000358791; ENST00000371608; ENST00000445038; ENST00000262591; ENST00000609336; ENST00000463943 | TAF |
| 48% | chr12 | 6602868 | 6602840 | − | chr12 | 6602138 | 6602028 | − | ENST00000229238 | | TAF |
| 48% | chr9 | 135665394 | 135665131 | − | chr9 | 135602921 | 135602841 | − | ENST00000298545 | | TAF |
| 46% | chr17 | 74261446 | 74261484 | + | chr17 | 74261988 | 74262050 | + | ENST00000327490 | | TAF |
| 44% | chr12 | 55350849 | 55350538 | − | chr12 | 55344174 | 55343992; 55344114 | − | ENST00000528240; ENST00000532757 | | TAF |
| 44% | chr12 | 55350849 | 55350538 | − | chr12 | 55344174 | 55343992; 55344114 | − | ENST00000528240; ENST00000532757 | | TAF |
| 42% | chr19 | 17950014 | 17949989 | − | chr19 | 17949199 | 17949072 | − | ENST00000458235; ENST00000534444 | ENST00000527670; | TAF |
| 42% | chr19 | 17950014 | 17949989 | − | chr19 | 17949199 | 17949072 | − | ENST00000458235; ENST00000534444 | ENST00000527670; | TAF |
| 40% | chr14 | 75983600 | 75983948 | + | chr14 | 75991427 | 75991531; 75991513 | + | ENST00000286639; ENST00000555504 | | TSF |
| 40% | chr14 | 75983600 | 75983948 | + | chr14 | 75991427 | 75991531; 75991513 | + | ENST00000286639; ENST00000555504 | | TSF |

TABLE 20-continued

Transcript fusion for Lymphoid Neoplasm Diffuse Large B-cell Lymphoma (DLBC)
Coordinates of the fusion sequences for which the donor is the TE.

| 1' | 2' | 3' | 4' | 5' | 6' | 7' | 8' | 9' | 10' | 11' |
|---|---|---|---|---|---|---|---|---|---|---|
| 40% | chr9 | 94504684 | 94504366 | − | chr9 | 94499800 | 94499673 | − | ENST00000375715; ENST00000375708 | TSF |
| 40% | chr9 | 94504684 | 94504366 | − | chr9 | 94499800 | 94499673 | − | ENST00000375715; ENST00000375708 | TSF |
| 38% | chr11 | 93468219 | 93468129 | − | chr11 | 93467826 | 93467791; 93467814 | − | ENST00000393259; ENST00000527169 | TAF |
| 38% | chr11 | 93468219 | 93468129 | − | chr11 | 93467826 | 93467791; 93467814 | − | ENST00000393259; ENST00000527169 | TAF |
| 38% | chr19 | 49121994 | 49121817 | − | chr19 | 49121134 | 49121048 | − | ENST00000549920; ENST00000547897; ENST00000084795; ENST00000550645; ENST00000549370; ENST00000549273 | TAF |
| 38% | chr19 | 49121994 | 49121817 | − | chr19 | 49121134 | 49121048 | − | ENST00000549920; ENST00000547897; ENST00000084795; ENST00000550645; ENST00000549370; ENST00000549273 | TAF |
| 38% | chr19 | 49121994 | 49121817 | − | chr19 | 49121134 | 49121048 | − | ENST00000549920; ENST00000547897; ENST00000084795; ENST00000550645; ENST00000549370; ENST00000549273 | TAF |
| 38% | chr19 | 49121994 | 49121817 | − | chr19 | 49121134 | 49121048 | − | ENST00000549920; ENST00000547897; ENST00000084795; ENST00000550645; ENST00000549370; ENST00000549273 | TAF |
| 38% | chr19 | 49121994 | 49121817 | − | chr19 | 49121134 | 49121048 | − | ENST00000549920; ENST00000547897; ENST00000084795; ENST00000550645; ENST00000549370; ENST00000549273 | TAF |
| 38% | chr11 | 64508144 | 64507840 | − | chr11 | 64507635 | 64507485 | − | ENST00000377494; ENST00000394432; ENST00000377497; ENST00000354024; ENST00000431822 | TAF |
| 38% | chr11 | 64508144 | 64507840 | − | chr11 | 64507635 | 64507485 | − | ENST00000377494; ENST00000394432; ENST00000377497; ENST00000354024; ENST00000431822 | TAF |
| 38% | chr11 | 64508144 | 64507840 | − | chr11 | 64507635 | 64507485 | − | ENST00000377494; ENST00000394432; ENST00000377497; ENST00000354024; ENST00000431822 | TAF |
| 35% | chr19 | 42335927 | 42335940 | + | chr19 | 42364892 | 42364915 | + | ENST00000598742; ENST00000601492; ENST00000600467; ENST00000593863; ENST00000598261; ENST00000598399 | TAF |
| 35% | chr19 | 42335927 | 42335940 | + | chr19 | 42364892 | 42364915 | + | ENST00000598742; ENST00000601492; ENST00000600467; ENST00000593863; ENST00000598261; ENST00000598399 | TAF |
| 35% | chr19 | 42335927 | 42335940 | + | chr19 | 42364892 | 42364915 | + | ENST00000598742; ENST00000601492; ENST00000600467; ENST00000593863; ENST00000598261; ENST00000598399 | TAF |
| 35% | chr19 | 42335927 | 42335940 | + | chr19 | 42364892 | 42364915 | + | ENST00000598742; ENST00000601492; ENST00000600467; ENST00000593863; ENST00000598261; ENST00000598399 | TAF |
| 35% | chr19 | 42335927 | 42335940 | + | chr19 | 42364892 | 42364915 | + | ENST00000598742; ENST00000601492; ENST00000600467; ENST00000593863; ENST00000598261; ENST00000598399 | TAF |
| 35% | chr19 | 42335927 | 42335940 | + | chr19 | 42364892 | 42364915 | + | ENST00000598742; ENST00000601492; ENST00000600467; ENST00000593863; ENST00000598261; ENST00000598399 | TSF |
| 35% | chr19 | 42335927 | 42335940 | + | chr19 | 42364892 | 42364915 | + | ENST00000598742; ENST00000601492; ENST00000600467; ENST00000593863; ENST00000598261; ENST00000598399 | TSF |
| 35% | chr19 | 42335927 | 42335940 | + | chr19 | 42364892 | 42364915 | + | ENST00000598742; ENST00000601492; ENST00000600467; ENST00000593863; ENST00000598261; ENST00000598399 | TSF |
| 35% | chr19 | 42335927 | 42335940 | + | chr19 | 42364892 | 42364915 | + | ENST00000598742; ENST00000601492; ENST00000600467; ENST00000593863; ENST00000598261; ENST00000598399 | TSF |
| 35% | chr19 | 42335927 | 42335940 | + | chr19 | 42364892 | 42364915 | + | ENST00000598742; ENST00000601492; ENST00000600467; ENST00000593863; ENST00000598261; ENST00000598399 | TSF |
| 33% | chr12 | 122430912 | 122431615 | + | chr12 | 122437622 | 122437850 | + | ENST00000288912 | TAF |
| 33% | chr2 | 25110247 | 25109962 | − | chr2 | 25095588 | 25095439 | − | ENST00000260600; ENST00000433852 | TAF |
| 33% | chr2 | 25110247 | 25109962 | − | chr2 | 25095588 | 25095439 | − | ENST00000260600; ENST00000433852 | TAF |
| 31% | chr19 | 54631006 | 54631115 | + | chr19 | 54631448 | 54631575 | + | ENST00000321030; ENST00000419967 | TAF |
| 31% | chr19 | 54631006 | 54631115 | + | chr19 | 54631448 | 54631575 | + | ENST00000321030; ENST00000419967 | TAF |
| 31% | chr19 | 1600051 | 1599987 | − | chr19 | 1599559 | 1599439 | − | ENST00000585937; ENST00000591899; ENST00000589880; ENST00000585671 | TAF |
| 29% | chr6 | 26474324 | 26474624 | + | chr6 | 26476389 | 26476396 | + | ENST00000480218 | TAF |
| 29% | chr7 | 98974090 | 98974197 | + | chr7 | 98983325 | 98983401 | + | ENST00000432884 | TAF |
| 27% | chr10 | 120902016 | 120901765 | − | chr10 | 120900831 | 120900754 | − | ENST00000355697; ENST00000330036 | TAF |
| 25% | chr9 | 93647278 | 93648256 | + | chr9 | 93650031 | 93650171 | + | ENST00000375751; ENST00000375754; ENST00000375747; ENST00000375746 | TAF |

TABLE 20-continued

Transcript fusion for Lymphoid Neoplasm Diffuse Large B-cell Lymphoma (DLBC)
Coordinates of the fusion sequences for which the donor is the TE.

| 1' | 2' | 3' | 4' | 5' | 6' | 7' | 8' | 9' | 10' | 11' |
|---|---|---|---|---|---|---|---|---|---|---|
| 23% | chr20 | 30669845 | 30669925 | + | chr20 | 30671697 | 30671846 | + | ENST00000534862; ENST00000538448; ENST00000375862; ENST00000520553; ENST00000518730; ENST00000375852 | TAF |
| 23% | chr17 | 80440912 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |
| 23% | chr17 | 80440912 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |
| 23% | chr17 | 80440912 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |
| 23% | chr17 | 80440912 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |
| 23% | chr4 | 69441933 | 69441669 | − | chr4 | 69431438 | 69431290 | − | ENST00000317746 | TAF |
| 23% | chr12 | 6602868 | 6602754 | − | chr12 | 6602138 | 6602028 | − | ENST00000229238 | TSF |
| 21% | chr16 | 718049 | 718154 | + | chr16 | 718353 | 718411 | + | ENST00000315082; ENST00000561983; ENST00000563134; ENST00000563637; ENST00000570280; ENST00000562333; ENST00000561929 | TAF |
| 21% | chr16 | 718049 | 718154 | + | chr16 | 718353 | 718411 | + | ENST00000315082; ENST00000561983; ENST00000563134; ENST00000563637; ENST00000570280; ENST00000562333; ENST00000561929 | TAF |
| 21% | chr16 | 718049 | 718154 | + | chr16 | 718353 | 718411 | + | ENST00000315082; ENST00000561983; ENST00000563134; ENST00000563637; ENST00000570280; ENST00000562333; ENST00000561929 | TAF |
| 21% | chr16 | 718049 | 718154 | + | chr16 | 718353 | 718411 | + | ENST00000315082; ENST00000561983; ENST00000563134; ENST00000563637; ENST00000570280; ENST00000562333; ENST00000561929 | TAF |
| 21% | chr16 | 718049 | 718154 | + | chr16 | 718353 | 718411 | + | ENST00000315082; ENST00000561983; ENST00000563134; ENST00000563637; ENST00000570280; ENST00000562333; ENST00000561929 | TAF |
| 21% | chr16 | 718049 | 718154 | + | chr16 | 718353 | 718411 | + | ENST00000315082; ENST00000561983; ENST00000563134; ENST00000563637; ENST00000570280; ENST00000562333; ENST00000561929 | TAF |
| 21% | chr2 | 97206254 | 97206414 | + | chr2 | 97213139 | 97213254 | + | ENST00000357485; ENST00000412735 | TAF |
| 21% | chr2 | 97206254 | 97206414 | + | chr2 | 97213139 | 97213254 | + | ENST00000357485; ENST00000412735 | TAF |
| 21% | chr3 | 197680391 | 197680531 | + | chr3 | 197680874 | 197681018; 197680991 | + | ENST00000464167; ENST00000448864; ENST00000442341 | TAF |
| 21% | chr3 | 197680391 | 197680531 | + | chr3 | 197680874 | 197681018; 197680991 | + | ENST00000464167; ENST00000448864; ENST00000442341 | TAF |
| 21% | chr1 | 26442407 | 26442478 | + | chr1 | 26646662 | 26646793 | + | ENST00000374213 | TAF |
| 21% | chrX | 48793481 | 48793462 | − | chrX | 48792291 | 48792227 | − | ENST00000396743; ENST00000455452; ENST00000156084; ENST00000376488; ENST00000428668 | TAF |
| 21% | chrX | 48793481 | 48793462 | − | chrX | 48792291 | 48792227 | − | ENST00000396743; ENST00000455452; ENST00000156084; ENST00000376488; ENST00000428668 | TAF |
| 21% | chr5 | 149925856 | 149925791 | − | chr5 | 149792270 | 149792188 | − | ENST00000377795; ENST00000353334; ENST00000518797; ENST00000524315; ENST00000009530; ENST00000523208; ENST00000522246; ENST00000523813 | TAF |
| 21% | chr5 | 149925856 | 149925791 | − | chr5 | 149792270 | 149792188 | − | ENST00000377795; ENST00000353334; ENST00000518797; ENST00000524315; ENST00000009530; ENST00000523208; ENST00000522246; ENST00000523813 | TAF |
| 21% | chr5 | 149925856 | 149925791 | − | chr5 | 149792270 | 149792188 | − | ENST00000377795; ENST00000353334; ENST00000518797; ENST00000524315; ENST00000009530; ENST00000523208; ENST00000522246; ENST00000523813 | TAF |
| 21% | chr5 | 149925856 | 149925791 | − | chr5 | 149792270 | 149792188 | − | ENST00000377795; ENST00000353334; ENST00000518797; ENST00000524315; ENST00000009530; ENST00000523208; ENST00000522246; ENST00000523813 | TAF |

TABLE 20-continued

Transcript fusion for Lymphoid Neoplasm Diffuse Large B-cell Lymphoma (DLBC)
Coordinates of the fusion sequences for which the donor is the TE.

| 1' | 2' | 3' | 4' | 5' | 6' | 7' | 8' | 9' | 10' | 11' |
|---|---|---|---|---|---|---|---|---|---|---|
| 21% | chr5 | 149925856 | 149925791 | − | chr5 | 149792270 | 149792188 | − | ENST00000377795; ENST00000353334; ENST00000518797; ENST00000524315; ENST00000009530; ENST00000523208; ENST00000522246; ENST00000523813 | TAF |
| 21% | chr5 | 149925856 | 149925791 | − | chr5 | 149792270 | 149792188 | − | ENST00000377795; ENST00000353334; ENST00000518797; ENST00000524315; ENST00000009530; ENST00000523208; ENST00000522246; ENST00000523813 | TAF |
| 21% | chr5 | 149925856 | 149925791 | − | chr5 | 149792270 | 149792188 | − | ENST00000377795; ENST00000353334; ENST00000518797; ENST00000524315; ENST00000009530; ENST00000523208; ENST00000522246; ENST00000523813 | TAF |
| 21% | chr5 | 149925856 | 149925791 | − | chr5 | 149792270 | 149792188 | − | ENST00000377795; ENST00000353334; ENST00000518797; ENST00000524315; ENST00000009530; ENST00000523208; ENST00000522246; ENST00000523813 | TAF |
| 21% | chr1 | 212862111 | 212861469 | − | chr1 | 212860321 | 212860133 | − | ENST00000243440 | TAF |
| 21% | chr8 | 66969394 | 66970244 | + | chr8 | 66988895 | 66989108; 66989064 | + | ENST00000276570; ENST00000522619 | TSF |
| 21% | chr8 | 66969394 | 66970244 | + | chr8 | 66988895 | 66989108; 66989064 | + | ENST00000276570; ENST00000522619 | TSF |
| 19% | chr4 | 107241932 | 107242850 | + | chr4 | 107246142 | 107246275 | + | ENST00000394701 | TAF |
| 19% | chr19 | 49458157 | 49458182 | + | chr19 | 49458944 | 49459090; 49459035 | + | ENST00000539787; ENST00000345358; ENST00000391871; ENST00000515540; ENST00000356483; ENST00000415969; ENST00000293288 | TAF |
| 19% | chr19 | 49458157 | 49458182 | + | chr19 | 49458944 | 49459090; 49459035 | + | ENST00000539787; ENST00000345358; ENST00000391871; ENST00000515540; ENST00000356483; ENST00000415969; ENST00000293288 | TAF |
| 19% | chr19 | 49458157 | 49458182 | + | chr19 | 49458944 | 49459090; 49459035 | + | ENST00000539787; ENST00000345358; ENST00000391871; ENST00000515540; ENST00000356483; ENST00000415969; ENST00000293288 | TAF |
| 19% | chr19 | 49458157 | 49458182 | + | chr19 | 49458944 | 49459090; 49459035 | + | ENST00000539787; ENST00000345358; ENST00000391871; ENST00000515540; ENST00000356483; ENST00000415969; ENST00000293288 | TAF |
| 19% | chr19 | 49458157 | 49458182 | + | chr19 | 49458944 | 49459090; 49459035 | + | ENST00000539787; ENST00000345358; ENST00000391871; ENST00000515540; ENST00000356483; ENST00000415969; ENST00000293288 | TAF |
| 19% | chr21 | 30806412 | 30806689 | + | chr21 | 30969890 | 30970014; 30969979 | + | ENST00000422809; ENST00000468059 | TAF |
| 19% | chr21 | 30806412 | 30806689 | + | chr21 | 30969890 | 30970014; 30969979 | + | ENST00000422809; ENST00000468059 | TAF |
| 19% | chr5 | 171488028 | 171487971 | − | chr5 | 171484477 | 171484353 | − | ENST00000176763; ENST00000520476 | TAF |
| 19% | chr5 | 171488028 | 171487971 | − | chr5 | 171484477 | 171484353 | − | ENST00000176763; ENST00000520476 | TAF |
| 19% | chr3 | 47554781 | 47554681 | − | chr3 | 47552716 | 47552638 | − | ENST00000296149; ENST00000442215 | TAF |
| 19% | chr3 | 47554781 | 47554681 | − | chr3 | 47552716 | 47552638 | − | ENST00000296149; ENST00000442215 | TAF |
| 19% | chr1 | 169819657 | 169819707 | + | chr1 | 169820958 | 169821077 | + | ENST00000359326; ENST00000286031 | TSF |
| 19% | chr19 | 16267516 | 16267584 | + | chr19 | 16268020 | 16268208; 16268205; 16268448; 16268139 | + | ENST00000253680; ENST00000397372; ENST00000593154; ENST00000588246; ENST00000593031 | TSF |
| 19% | chr19 | 16267516 | 16267584 | + | chr19 | 16268020 | 16268208; 16268205; 16268448; 16268139 | + | ENST00000253680; ENST00000397372; ENST00000593154; ENST00000588246; ENST00000593031 | TSF |
| 19% | chr19 | 16267516 | 16267584 | + | chr19 | 16268020 | 16268208; 16268205; 16268448; 16268139 | + | ENST00000253680; ENST00000397372; ENST00000593154; ENST00000588246; ENST00000593031 | TSF |
| 19% | chr19 | 16267516 | 16267584 | + | chr19 | 16268020 | 16268208; 16268205; 16268448; 16268139 | + | ENST00000253680; ENST00000397372; ENST00000593154; ENST00000588246; ENST00000593031 | TSF |
| 19% | chr2 | 68983124 | 68984862 | + | chr2 | 69002353 | 69002552; 69002488 | + | ENST00000295381; ENST00000409202; ENST00000467265; ENST00000488795; ENST00000409030; ENST00000409220; ENST00000473986; ENST00000497079 | TSF |
| 19% | chr2 | 68983124 | 68984862 | + | chr2 | 69002353 | 69002552; 69002488 | + | ENST00000295381; ENST00000409202; ENST00000467265; ENST00000488795; ENST00000409030; ENST00000409220; ENST00000473986; ENST00000497079 | TSF |

TABLE 20-continued

Transcript fusion for Lymphoid Neoplasm Diffuse Large B-cell Lymphoma (DLBC)
Coordinates of the fusion sequences for which the donor is the TE.

| 1' | 2' | 3' | 4' | 5' | 6' | 7' | 8' | 9' | 10' | 11' |
|---|---|---|---|---|---|---|---|---|---|---|
| 19% | chr2 | 68983124 | 68984862 | + | chr2 | 69002353 | 69002552; 69002488 | + | ENST00000295381; ENST00000409202; ENST00000467265; ENST00000488795; ENST00000409030; ENST00000409220; ENST00000473986; ENST00000497079 | TSF |
| 19% | chr2 | 68983124 | 68984862 | + | chr2 | 69002353 | 69002552; 69002488 | + | ENST00000295381; ENST00000409202; ENST00000467265; ENST00000488795; ENST00000409030; ENST00000409220; ENST00000473986; ENST00000497079 | TSF |
| 19% | chr2 | 68983124 | 68984862 | + | chr2 | 69002353 | 69002552; 69002488 | + | ENST00000295381; ENST00000409202; ENST00000467265; ENST00000488795; ENST00000409030; ENST00000409220; ENST00000473986; ENST00000497079 | TSF |
| 19% | chr2 | 68983124 | 68984862 | + | chr2 | 69002353 | 69002552; 69002488 | + | ENST00000295381; ENST00000409202; ENST00000467265; ENST00000488795; ENST00000409030; ENST00000409220; ENST00000473986; ENST00000497079 | TSF |
| 19% | chr19 | 39347374 | 39346206 | − | chr19 | 39338074 | 39337956 | − | ENST00000221419; ENST00000601449; ENST00000600233; ENST00000601813 | TSF |
| 19% | chr19 | 39347374 | 39346206 | − | chr19 | 39338074 | 39337956 | − | ENST00000221419; ENST00000601449; ENST00000600233; ENST00000601813 | TSF |
| 19% | chr19 | 39347374 | 39346206 | − | chr19 | 39338074 | 39337956 | − | ENST00000221419; ENST00000601449; ENST00000600233; ENST00000601813 | TSF |
| 19% | chr19 | 39347374 | 39346206 | − | chr19 | 39338074 | 39337956 | − | ENST00000221419; ENST00000601449; ENST00000600233; ENST00000601813 | TSF |
| 19% | chr19 | 39347374 | 39346206 | − | chr19 | 39338074 | 39337956 | − | ENST00000221419; ENST00000601449; ENST00000600233; ENST00000601813 | TSF |
| 19% | chr19 | 39347374 | 39346206 | − | chr19 | 39338074 | 39337956 | − | ENST00000221419; ENST00000601449; ENST00000600233; ENST00000601813 | TSF |
| 17% | chr4 | 154533967 | 154534548 | + | chr4 | 154541908 | 154542032 | + | ENST00000440693; ENST00000409663; ENST00000409959; ENST00000240487 | TAF |
| 17% | chr8 | 104389530 | 104389551 | + | chr8 | 104390255 | 104390471 | + | ENST00000330295; ENST00000520337 | TAF |
| 17% | chr2 | 62362210 | 62362285 | + | chr2 | 62362966 | 62363076 | + | ENST00000311832; ENST00000458337; ENST00000427417 | TAF |
| 17% | chr2 | 99797199 | 99797170 | − | chr2 | 99790479 | 99790378 | + | ENST00000422537; ENST00000289359; ENST00000409107 | TAF |
| 17% | chr2 | 99797199 | 99797170 | − | chr2 | 99790479 | 99790378 | + | ENST00000422537; ENST00000289359; ENST00000409107 | TAF |
| 17% | chr11 | 61129218 | 61129205 | − | chr11 | 61121464 | 61121256; 61121303 | − | ENST00000294072; ENST00000426130; ENST00000447532; ENST00000536915; ENST00000542361; ENST00000537364; ENST00000539128 | TAF |
| 17% | chr11 | 61129218 | 61129205 | − | chr11 | 61121464 | 61121256; 61121303 | − | ENST00000294072; ENST00000426130; ENST00000447532; ENST00000536915; ENST00000542361; ENST00000537364; ENST00000539128 | TAF |
| 17% | chr11 | 61129218 | 61129205 | − | chr11 | 61121464 | 61121256; 61121303 | − | ENST00000294072; ENST00000426130; ENST00000447532; ENST00000536915; ENST00000542361; ENST00000537364; ENST00000539128 | TAF |
| 17% | chr11 | 61129218 | 61129205 | − | chr11 | 61121464 | 61121256; 61121303 | − | ENST00000294072; ENST00000426130; ENST00000447532; ENST00000536915; ENST00000542361; ENST00000537364; ENST00000539128 | TAF |
| 17% | chr11 | 61129218 | 61129205 | − | chr11 | 61121464 | 61121256; 61121303 | − | ENST00000294072; ENST00000426130; ENST00000447532; ENST00000536915; ENST00000542361; ENST00000537364; ENST00000539128 | TAF |
| 17% | chr10 | 102260069 | 102259867 | − | chr10 | 102259355 | 102259281 | − | ENST00000370345 | TAF |
| 17% | chr2 | 3624644 | 3624710 | + | chr2 | 3625300 | 3625364 | + | ENST00000304921; ENST00000407445; ENST00000403564; ENST00000406376 | TSF |
| 17% | chr2 | 3624644 | 3624710 | + | chr2 | 3625300 | 3625364 | + | ENST00000304921; ENST00000407445; ENST00000403564; ENST00000406376 | TSF |
| 17% | chr2 | 3624644 | 3624710 | + | chr2 | 3625300 | 3625364 | + | ENST00000304921; ENST00000407445; ENST00000403564; ENST00000406376 | TSF |
| 17% | chr2 | 3624644 | 3624710 | + | chr2 | 3625300 | 3625364 | + | ENST00000304921; ENST00000407445; ENST00000403564; ENST00000406376 | TSF |
| 17% | chr1 | 17371820 | 17371636 | | chr1 | 17371383 | 17371256 | | ENST00000375499 | TSF |
| 15% | chr7 | 21979898 | 21979880 | − | chr7 | 21956512 | 21956372 | − | ENST00000406877; ENST00000373934 | TAF |
| 15% | chr7 | 21979898 | 21979880 | − | chr7 | 21956512 | 21956372 | − | ENST00000406877; ENST00000373934 | TAF |
| 15% | chr12 | 9809754 | 9809756 | + | chr12 | 9833519 | 9833629; 9833560 | + | ENST00000261340; ENST00000290855; ENST00000325960; ENST00000492359; ENST00000444971; ENST00000479877; ENST00000543300 | TSF |

TABLE 20-continued

Transcript fusion for Lymphoid Neoplasm Diffuse Large B-cell Lymphoma (DLBC)
Coordinates of the fusion sequences for which the donor is the TE.

| 1' | 2' | 3' | 4' | 5' | 6' | 7' | 8' | 9' | 10' | 11' |
|---|---|---|---|---|---|---|---|---|---|---|
| 15% | chr12 | 9809754 | 9809756 | + | chr12 | 9833519 | 9833629; 9833560 | + | ENST00000261340; ENST00000290855; ENST00000325960; ENST00000492359; ENST00000444971; ENST00000479877; ENST00000543300 | TSF |
| 15% | chr12 | 9809754 | 9809756 | + | chr12 | 9833519 | 9833629; 9833560 | + | ENST00000261340; ENST00000290855; ENST00000325960; ENST00000492359; ENST00000444971; ENST00000479877; ENST00000543300 | TSF |
| 15% | chr12 | 9809754 | 9809756 | + | chr12 | 9833519 | 9833629; 9833560 | + | ENST00000261340; ENST00000290855; ENST00000325960; ENST00000492359; ENST00000444971; ENST00000479877; ENST00000543300 | TSF |
| 15% | chr12 | 9809754 | 9809756 | + | chr12 | 9833519 | 9833629; 9833560 | + | ENST00000261340; ENST00000290855; ENST00000325960; ENST00000492359; ENST00000444971; ENST00000479877; ENST00000543300 | TSF |
| 15% | chr12 | 9809754 | 9809756 | + | chr12 | 9833519 | 9833629; 9833560 | + | ENST00000261340; ENST00000290855; ENST00000325960; ENST00000492359; ENST00000444971; ENST00000479877; ENST00000543300 | TSF |
| 15% | chr19 | 49831887 | 49832338 | + | chr19 | 49838971 | 49839043; 49839039 | + | ENST00000391859; ENST00000595725; ENST00000323906; ENST00000535669; ENST00000595660 | TSF |
| 15% | chr19 | 49831887 | 49832338 | + | chr19 | 49838971 | 49839043; 49839039 | + | ENST00000391859; ENST00000595725; ENST00000323906; ENST00000535669; ENST00000595660 | TSF |
| 15% | chr19 | 49831887 | 49832338 | + | chr19 | 49838971 | 49839043; 49839039 | + | ENST00000391859; ENST00000595725; ENST00000323906; ENST00000535669; ENST00000595660 | TSF |
| 15% | chr19 | 49831887 | 49832338 | + | chr19 | 49838971 | 49839043; 49839039 | + | ENST00000391859; ENST00000595725; ENST00000323906; ENST00000535669; ENST00000595660 | TSF |
| 15% | chr19 | 49831887 | 49832338 | + | chr19 | 49838971 | 49839043; 49839039 | + | ENST00000391859; ENST00000595725; ENST00000323906; ENST00000535669; ENST00000595660 | TSF |
| 15% | chr16 | 14699964 | 14699912 | − | chr16 | 14698083 | 14698003; 14698068 | − | ENST00000437198; ENST00000420015; ENST00000341484; ENST00000539279; ENST00000538472 | TSF |
| 15% | chr16 | 14699964 | 14699912 | − | chr16 | 14698083 | 14698003; 14698068 | − | ENST00000437198; ENST00000420015; ENST00000341484; ENST00000539279; ENST00000538472 | TSF |
| 15% | chr8 | 620733 | 620243 | − | chr8 | 618782 | 618598; 618491 | − | ENST00000522706; ENST00000523415; ENST00000262109; ENST00000522893 | TSF |
| 15% | chr8 | 620733 | 620243 | − | chr8 | 618782 | 618598; 618491 | − | ENST00000522706; ENST00000523415; ENST00000262109; ENST00000522893 | TSF |
| 15% | chr8 | 620733 | 620243 | − | chr8 | 618782 | 618598; 618491 | − | ENST00000522706; ENST00000523415; ENST00000262109; ENST00000522893 | TSF |
| 15% | chr8 | 620733 | 620243 | − | chr8 | 618782 | 618598; 618491 | − | ENST00000522706; ENST00000523415; ENST00000262109; ENST00000522893 | TSF |
| 15% | chr2 | 25310179 | 25309890 | − | chr2 | 25095588 | 25095439 | − | ENST00000260600; ENST00000433852 | TSF |
| 15% | chr2 | 25310179 | 25309890 | − | chr2 | 25095588 | 25095439 | − | ENST00000260600; ENST00000433852 | TSF |
| 12% | chr5 | 149532994 | 149533002 | + | chr5 | 149562331 | 149562476 | + | ENST00000231656 | TAF |
| 12% | chr8 | 126168241 | 126168340 | + | chr8 | 126194345 | 126194498 | + | ENST00000523741; ENST00000517532; ENST00000287437; ENST00000522563; ENST00000517315 | TAF |
| 12% | chr8 | 126168241 | 126168340 | + | chr8 | 126194345 | 126194498 | + | ENST00000523741; ENST00000517532; ENST00000287437; ENST00000522563; ENST00000517315 | TAF |
| 12% | chr8 | 126168241 | 126168340 | + | chr8 | 126194345 | 126194498 | + | ENST00000523741; ENST00000517532; ENST00000287437; ENST00000522563; ENST00000517315 | TAF |
| 12% | chr2 | 202003725 | 202004053 | + | chr2 | 202005080 | 202005162; 202005198 | + | ENST00000309955; ENST00000443227; ENST00000341222; ENST00000340870; ENST00000355558; ENST00000341582; ENST00000342795; ENST00000423241; ENST00000439154; ENST00000440180; ENST00000457277; ENST00000494258; ENST00000470178; ENST00000462763; ENST00000479953 | TAF |
| 12% | chr2 | 202003725 | 202004053 | + | chr2 | 202005080 | 202005162; 202005198 | + | ENST00000309955; ENST00000443227; ENST00000341222; ENST00000340870; ENST00000355558; ENST00000341582; ENST00000342795; ENST00000423241; ENST00000439154; ENST00000440180; ENST00000457277; ENST00000494258; | TAF |

TABLE 20-continued

Transcript fusion for Lymphoid Neoplasm Diffuse Large B-cell Lymphoma (DLBC)
Coordinates of the fusion sequences for which the donor is the TE.

| 1' | 2' | 3' | 4' | 5' | 6' | 7' | 8' | 9' | 10' | 11' |
|---|---|---|---|---|---|---|---|---|---|---|
| 12% | chr2 | 202003725 | 202004053 | + | chr2 | 202005080 | 202005162; 202005198 | + | ENST00000309955; ENST00000443227; ENST00000341222; ENST00000340870; ENST00000355558; ENST00000341582; ENST00000342795; ENST00000423241; ENST00000439154; ENST00000440180; ENST00000457277; ENST00000494258; ENST00000470178; ENST00000462763; ENST00000479953 | TAF |
| 12% | chr2 | 202003725 | 202004053 | + | chr2 | 202005080 | 202005162; 202005198 | + | ENST00000309955; ENST00000443227; ENST00000341222; ENST00000340870; ENST00000355558; ENST00000341582; ENST00000342795; ENST00000423241; ENST00000439154; ENST00000440180; ENST00000457277; ENST00000494258; ENST00000470178; ENST00000462763; ENST00000479953 | TAF |
| 12% | chr2 | 202003725 | 202004053 | + | chr2 | 202005080 | 202005162; 202005198 | + | ENST00000309955; ENST00000443227; ENST00000341222; ENST00000340870; ENST00000355558; ENST00000341582; ENST00000342795; ENST00000423241; ENST00000439154; ENST00000440180; ENST00000457277; ENST00000494258; ENST00000470178; ENST00000462763; ENST00000479953 | TAF |
| 12% | chr2 | 202003725 | 202004053 | + | chr2 | 202005080 | 202005162; 202005198 | + | ENST00000309955; ENST00000443227; ENST00000341222; ENST00000340870; ENST00000355558; ENST00000341582; ENST00000342795; ENST00000423241; ENST00000439154; ENST00000440180; ENST00000457277; ENST00000494258; ENST00000470178; ENST00000462763; ENST00000479953 | TAF |
| 12% | chr2 | 202003725 | 202004053 | + | chr2 | 202005080 | 202005162; 202005198 | + | ENST00000309955; ENST00000443227; ENST00000341222; ENST00000340870; ENST00000355558; ENST00000341582; ENST00000342795; ENST00000423241; ENST00000439154; ENST00000440180; ENST00000457277; ENST00000494258; ENST00000470178; ENST00000462763; ENST00000479953 | TAF |
| 12% | chr2 | 202003725 | 202004053 | + | chr2 | 202005080 | 202005162; 202005198 | + | ENST00000309955; ENST00000443227; ENST00000341222; ENST00000340870; ENST00000355558; ENST00000341582; ENST00000342795; ENST00000423241; ENST00000439154; ENST00000440180; ENST00000457277; ENST00000494258; ENST00000470178; ENST00000462763; ENST00000479953 | TAF |
| 12% | chr2 | 202003725 | 202004053 | + | chr2 | 202005080 | 202005162; 202005198 | + | ENST00000309955; ENST00000443227; ENST00000341222; ENST00000340870; ENST00000355558; ENST00000341582; ENST00000342795; ENST00000423241; ENST00000439154; ENST00000440180; ENST00000457277; ENST00000494258; ENST00000470178; ENST00000462763; ENST00000479953 | TAF |
| 12% | chr2 | 202003725 | 202004053 | + | chr2 | 202005080 | 202005162; 202005198 | + | ENST00000309955; ENST00000443227; ENST00000341222; ENST00000340870; ENST00000355558; ENST00000341582; ENST00000342795; ENST00000423241; ENST00000439154; ENST00000440180; ENST00000457277; ENST00000494258; ENST00000470178; ENST00000462763; ENST00000479953 | TAF |
| 12% | chr7 | 99747312 | 99747315 | + | chr7 | 99751023 | 99751140; 99751352 | + | ENST00000341942; ENST00000441173 | TAF |
| 12% | chr7 | 99747312 | 99747315 | + | chr7 | 99751023 | 99751140; 99751352 | + | ENST00000341942; ENST00000441173 | TAF |
| 12% | chr6 | 43026913 | 43026822 | − | chr6 | 43025971 | 43025803; 43025889; 43025777 | − | ENST00000388752; ENST00000230413; ENST00000489623; ENST00000487429; ENST00000468957 | TAF |

TABLE 20-continued

Transcript fusion for Lymphoid Neoplasm Diffuse Large B-cell Lymphoma (DLBC)
Coordinates of the fusion sequences for which the donor is the TE.

| 1' | 2' | 3' | 4' | 5' | 6' | 7' | 8' | 9' | 10' | 11' |
|---|---|---|---|---|---|---|---|---|---|---|
| 12% | chr6 | 43026913 | 43026822 | – | chr6 | 43025971 | 43025803; 43025889; 43025777 | – | ENST00000388752; ENST00000489623; ENST00000468957 | ENST00000230413; ENST00000487429; TAF |
| 12% | chr6 | 43026913 | 43026822 | – | chr6 | 43025971 | 43025803; 43025889; 43025777 | – | ENST00000388752; ENST00000489623; ENST00000468957 | ENST00000230413; ENST00000487429; TAF |
| 12% | chr6 | 43026913 | 43026822 | – | chr6 | 43025971 | 43025803; 43025889; 43025777 | – | ENST00000388752; ENST00000489623; ENST00000468957 | ENST00000230413; ENST00000487429; TAF |
| 12% | chr6 | 43026913 | 43026822 | – | chr6 | 43025971 | 43025803; 43025889; 43025777 | – | ENST00000388752; ENST00000489623; ENST00000468957 | ENST00000230413; ENST00000487429; TAF |
| 12% | chr9 | 69229480 | 69229475 | – | chr9 | 69218561 | 69218510 | – | ENST00000416428; ENST00000377449; ENST00000382399 | ENST00000377457; TAF |
| 12% | chr9 | 69229480 | 69229475 | – | chr9 | 69218561 | 69218510 | – | ENST00000416428; ENST00000377449; ENST00000382399 | ENST00000377457; TAF |
| 12% | chr6 | 24710791 | 24710723 | | chr6 | 24709139 | 24709005 | – | ENST00000378119; ENST00000378102 | ENST00000540769; TAF |
| 12% | chr10 | 98363669 | 98363666 | – | chr10 | 98362155 | 98362037 | – | ENST00000339364; ENST00000371109 | ENST00000371110; TAF |
| 12% | chr1 | 6380703 | 6380649 | – | chr1 | 6378638 | 6378552 | – | ENST00000608083; ENST00000377845; ENST00000377860; ENST00000545482; ENST00000473466; ENST00000541130 | ENST00000377842; TAF ENST00000377855; ENST00000418124; ENST00000361521; |
| 12% | chr1 | 6380703 | 6380649 | – | chr1 | 6378638 | 6378552 | – | ENST00000608083; ENST00000377845; ENST00000377860; ENST00000545482; ENST00000473466; ENST00000541130 | ENST00000377842; TAF ENST00000377855; ENST00000418124; ENST00000361521; |
| 12% | chr1 | 6380703 | 6380649 | – | chr1 | 6378638 | 6378552 | – | ENST00000608083; ENST00000377845; ENST00000377860; ENST00000545482; ENST00000473466; ENST00000541130 | ENST00000377842; TAF ENST00000377855; ENST00000418124; ENST00000361521; |
| 12% | chr1 | 6380703 | 6380649 | – | chr1 | 6378638 | 6378552 | – | ENST00000608083; ENST00000377845; ENST00000377860; ENST00000545482; ENST00000473466; ENST00000541130 | ENST00000377842; TAF ENST00000377855; ENST00000418124; ENST00000361521; |
| 12% | chr1 | 6380703 | 6380649 | – | chr1 | 6378638 | 6378552 | – | ENST00000608083; ENST00000377845; ENST00000377860; ENST00000545482; ENST00000473466; ENST00000541130 | ENST00000377842; TAF ENST00000377855; ENST00000418124; ENST00000361521; |
| 12% | chr12 | 102411559 | 102411498 | – | chr12 | 102406970 | 102406886 | – | ENST00000240079; ENST00000542923 | ENST00000545679; TAF |
| 12% | chr15 | 101833626 | 101833498 | – | chr15 | 101833377 | 101833230 | – | ENST00000254193; ENST00000559309 TAF | |
| 12% | chr15 | 101833626 | 101833498 | – | chr15 | 101833377 | 101833230 | – | ENST00000254193; ENST00000559309;TAF | |
| 12% | chr1 | 9128508 | 9128439 | – | chr1 | 9118309 | 9118211 | – | ENST00000377424; ENST00000484798; ENST00000479813; ENST00000487835; ENST00000473209 | ENST00000377414;TAF ENST00000474145; ENST00000486632; ENST00000464985; |
| 12% | chr1 | 9128508 | 9128439 | – | chr1 | 9118309 | 9118211 | – | ENST00000377424; ENST00000484798; ENST00000479813; ENST00000487835; ENST00000473209 | ENST00000377414;TAF ENST00000474145; ENST00000486632; ENST00000464985; |
| 12% | chr1 | 9128508 | 9128439 | – | chr1 | 9118309 | 9118211 | – | ENST00000377424; ENST00000484798; ENST00000479813; ENST00000487835; ENST00000473209 | ENST00000377414;TAF ENST00000474145; ENST00000486632; ENST00000464985; |
| 12% | chr1 | 9128508 | 9128439 | – | chr1 | 9118309 | 9118211 | – | ENST00000377424; ENST00000484798; ENST00000479813; ENST00000487835; ENST00000473209 | ENST00000377414;TAF ENST00000474145; ENST00000486632; ENST00000464985; |
| 12% | chr1 | 9128508 | 9128439 | – | chr1 | 9118309 | 9118211 | – | ENST00000377424; ENST00000484798; ENST00000479813; ENST00000487835; ENST00000473209 | ENST00000377414;TAF ENST00000474145; ENST00000486632; ENST00000464985; |

TABLE 20-continued

Transcript fusion for Lymphoid Neoplasm Diffuse Large B-cell Lymphoma (DLBC)
Coordinates of the fusion sequences for which the donor is the TE.

| 1' | 2' | 3' | 4' | 5' | 6' | 7' | 8' | 9' | 10' | 11' |
|---|---|---|---|---|---|---|---|---|---|---|
| 12% | chr1 | 9128508 | 9128439 | − | chr1 | 9118309 | 9118211 | − | ENST00000377424; ENST00000377414; ENST00000484798; ENST00000474145; ENST00000479813; ENST00000486632; ENST00000487835; ENST00000464985; ENST0000473209 | TAF |
| 12% | chr1 | 53107333 | 53107382 | + | chr1 | 53108535 | 53108674 | + | ENST00000517870 | TSF |
| 12% | chr16 | 57073351 | 57073401 | + | chr16 | 57073693 | 57073761 | + | ENST00000262510; ENST00000308149; ENST00000436936; ENST00000539144; ENST00000538805; ENST00000545081; ENST00000538110; ENST00000543030; ENST00000538453 | TSF |
| 12% | chr16 | 57073351 | 57073401 | + | chr16 | 57073693 | 57073761 | + | ENST00000262510; ENST00000308149; ENST00000436936; ENST00000539144; ENST00000538805; ENST00000545081; ENST00000538110; ENST00000543030; ENST00000538453 | TSF |
| 12% | chr16 | 57073351 | 57073401 | + | chr16 | 57073693 | 57073761 | + | ENST00000262510; ENST00000308149; ENST00000436936; ENST00000539144; ENST00000538805; ENST00000545081; ENST00000538110; ENST00000543030; ENST00000538453 | TSF |
| 12% | chr16 | 57073351 | 57073401 | + | chr16 | 57073693 | 57073761 | + | ENST00000262510; ENST00000308149; ENST00000436936; ENST00000539144; ENST00000538805; ENST00000545081; ENST00000538110; ENST00000543030; ENST00000538453 | TSF |
| 12% | chr16 | 57073351 | 57073401 | + | chr16 | 57073693 | 57073761 | + | ENST00000262510; ENST00000308149; ENST00000436936; ENST00000539144; ENST00000538805; ENST00000545081; ENST00000538110; ENST00000543030; ENST00000538453 | TSF |
| 12% | chr16 | 57073351 | 57073401 | + | chr16 | 57073693 | 57073761 | + | ENST00000262510; ENST00000308149; ENST00000436936; ENST00000539144; ENST00000538805; ENST00000545081; ENST00000538110; ENST00000543030; ENST00000538453 | TSF |
| 12% | chr16 | 57073351 | 57073401 | + | chr16 | 57073693 | 57073761 | + | ENST00000262510; ENST00000308149; ENST00000436936; ENST00000539144; ENST00000538805; ENST00000545081; ENST00000538110; ENST00000543030; ENST00000538453 | TSF |
| 12% | chr4 | 154546282 | 154546350 | + | chr4 | 154547299 | 154547377 | + | ENST00000440693; ENST00000409663; ENST00000409959; ENST00000240487 | TSF |
| 12% | chr9 | 140632674 | 140633231 | + | chr9 | 140637823 | 140637980 | + | ENST00000462484; ENST00000334856; ENST00000460843 | TSF |
| 12% | chr9 | 140632674 | 140633231 | + | chr9 | 140637823 | 140637980 | + | ENST00000462484; ENST00000334856; ENST00000460843 | TSF |
| 12% | chr9 | 140632674 | 140633231 | + | chr9 | 140637823 | 140637980 | + | ENST00000462484; ENST00000334856; ENST00000460843 | TSF |
| 12% | chr19 | 49831887 | 49832338 | + | chr19 | 49840166 | 49840290 | + | ENST00000391859; ENST00000595725; ENST00000323906; ENST00000535669; ENST00000595660 | TSF |
| 12% | chr19 | 49831887 | 49832338 | + | chr19 | 49840166 | 49840290 | + | ENST00000391859; ENST00000595725; ENST00000323906; ENST00000535669; ENST00000595660 | TSF |
| 12% | chr19 | 49831887 | 49832338 | + | chr19 | 49840166 | 49840290 | + | ENST00000391859; ENST00000595725; ENST00000323906; ENST00000535669; ENST00000595660 | TSF |
| 12% | chr19 | 49831887 | 49832338 | + | chr19 | 49840166 | 49840290 | + | ENST00000391859; ENST00000595725; ENST00000323906; ENST00000535669; ENST00000595660 | TSF |
| 12% | chr19 | 49831887 | 49832338 | + | chr19 | 49840166 | 49840290 | + | ENST00000391859; ENST00000595725; ENST00000323906; ENST00000535669; ENST00000595660 | TSF |
| 12% | chr3 | 15096823 | 15096427 | − | chr3 | 15094974 | 15094887; 15094883 | − | ENST00000253686; ENST00000449354; ENST00000420267; ENST00000447299 | TSF |
| 12% | chr3 | 15096823 | 15096427 | − | chr3 | 15094974 | 15094887; 15094883 | − | ENST00000253686; ENST00000449354; ENST00000420267; ENST00000447299 | TSF |
| 12% | chr3 | 15096823 | 15096427 | − | chr3 | 15094974 | 15094887; 15094883 | − | ENST00000253686; ENST00000449354; ENST00000420267; ENST00000447299 | TSF |
| 12% | chr14 | 94936503 | 94936425 | − | chr14 | 94935803 | 94935550; 94935708 | − | ENST00000448305; ENST00000337425; ENST00000380365; ENST00000538527; ENST00000546329 | TSF |

TABLE 20-continued

Transcript fusion for Lymphoid Neoplasm Diffuse Large B-cell Lymphoma (DLBC)
Coordinates of the fusion sequences for which the donor is the TE.

| 1' | 2' | 3' | 4' | 5' | 6' | 7' | 8' | 9' | 10' | 11' |
|---|---|---|---|---|---|---|---|---|---|---|
| 12% | chr14 | 94936503 | 94936425 | − | chr14 | 94935803 | 94935550; 94935708 | − | ENST00000448305; ENST00000337425; ENST00000380365; ENST00000538527; ENST00000546329 | TSF |
| 12% | chr14 | 94936503 | 94936425 | − | chr14 | 94935803 | 94935550; 94935708 | − | ENST00000448305; ENST00000337425; ENST00000380365; ENST00000538527; ENST00000546329 | TSF |
| 10% | chr7 | 2289080 | 2289115 | + | chr7 | 2289492 | 2289637 | + | ENST00000356714; ENST00000397049; ENST00000397046; ENST00000397048; ENST00000339737; ENST00000343985 | TAF |
| 10% | chr8 | 144638103 | 144638200 | + | chr8 | 144640548 | 144640621 | + | ENST00000533063 | TAF |
| 10% | chr7 | 2289080 | 2289194 | + | chr7 | 2289492 | 2289637 | + | ENST00000356714; ENST00000397049; ENST00000397046; ENST00000397048; ENST0000033937; ENST00000343985 | TAF |
| 10% | chr1 | 33097909 | 33097809 | − | chr1 | 33097480 | 33097428 | − | ENST00000468695 | TAF |
| 10% | chr16 | 18795209 | 18795124 | − | chr16 | 18794424 | 18794331; 18794411 | − | ENST00000322989; ENST00000572008; ENST00000563390; ENST00000565420; ENST00000563579 | TAF |
| 10% | chr16 | 18795209 | 18795124 | − | chr16 | 18794424 | 18794331; 18794411 | − | ENST00000322989; ENST00000572008; ENST00000563390; ENST00000565420; ENST00000563579 | TAF |
| 10% | chr11 | 424193 | 423942 | − | chr11 | 421198 | 421141 | − | ENST00000332826 | TAF |
| 10% | chr11 | 58330466 | 58330321 | − | chr11 | 58322413 | 58322314 | − | ENST00000530561; ENST00000395074; ENST00000528954; ENST00000528489 | TAF |
| 10% | chr11 | 58330466 | 58330321 | − | chr11 | 58322413 | 58322314 | − | ENST00000530561; ENST00000395074; ENST00000528954; ENST00000528489 | TAF |
| 10% | chr19 | 39347374 | 39346635 | − | chr19 | 39338074 | 39337956 | − | ENST00000221419; ENST00000601449; ENST00000600233; ENST00000601813 | TAF |
| 10% | chr19 | 39347374 | 39346635 | − | chr19 | 39338074 | 39337956 | − | ENST00000221419; ENST00000601449; ENST00000600233; ENST00000601813 | TAF |
| 10% | chr19 | 39347374 | 39346635 | − | chr19 | 39338074 | 39337956 | − | ENST00000221419; ENST00000601449; ENST00000600233; ENST00000601813 | TAF |
| 10% | chr6 | 33039547 | 33039397 | − | chr6 | 33037663 | 33037418 | − | ENST00000419277; ENST00000428995; ENST00000453337 | TAF |
| 10% | chr6 | 33039547 | 33039397 | − | chr6 | 33037663 | 33037418 | − | ENST00000419277; ENST00000428995; ENST00000453337 | TAF |
| 10% | chr10 | 5826921 | 5825287 | − | chr10 | 5815904 | 5815805 | − | ENST00000380191; ENST00000447751; ENST00000380132; ENST00000380181; ENST00000456041 | TAF |
| 10% | chr10 | 5826921 | 5825287 | − | chr10 | 5815904 | 5815805 | − | ENST00000380191; ENST00000447751; ENST00000380132; ENST00000380181; ENST00000456041 | TAF |
| 10% | chr10 | 5826921 | 5825287 | − | chr10 | 5815904 | 5815805 | − | ENST00000380191; ENST00000447751; ENST00000380132; ENST00000380181; ENST00000456041 | TAF |

TABLE 21

Transcript fusion for Esophageal Carcinoma (ESCA) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 69% | chr1 | 32696528 | 32696620 | + | ENST00000373586 | chr1 | 32696861 | 32697110 | + | TAF |
| 64% | chr20 | 47768284 | 47768119 | − | ENST00000371828; ENST00000340954; ENST00000347458; ENST00000360426; ENST00000371792; ENST00000371802; ENST00000371856; ENST00000437404; ENST00000456866 | chr20 | 47761186 | 47760181 | − | TAF |
| 64% | chr20 | 47768284 | 47768119 | − | ENST00000371828; ENST00000340954; ENST00000347458; ENST00000360426; ENST00000371792; ENST00000371802; ENST00000371856; ENST00000437404; ENST00000456866 | chr20 | 47761186 | 47760181 | − | TAF |
| 64% | chr20 | 47768284 | 47768119 | − | ENST00000371828; ENST00000340954; ENST00000347458; ENST00000360426; ENST00000371792; ENST00000371802; ENST00000371856; ENST00000437404; ENST00000456866 | chr20 | 47761186 | 47760181 | − | TAF |
| 54% | chr10 | 47747112 | 47747132 | + | ENST00000340243; ENST00000374277; ENST00000449464; ENST00000538825 | chr10 | 48278725 | 48278896 | + | TAF |
| 42% | chr12 | 71509738 | 71509630 | − | ENST00000549357 | chr12 | 71504233 | 71503634 | − | TAF |
| 41% | chr12 | 52909024 | 52908899 | − | ENST00000252242 | chr12 | 52908920 | 52908992 | + | TSF |
| 32% | chr19 | 15289752 | 15289634 | − | ENST00000263388; ENST00000601011 | chr19 | 15289244 | 15289201 | − | TSF |

TABLE 21-continued

Transcript fusion for Esophageal Carcinoma (ESCA) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 32% | chr19 | 15289752 | 15289634 | − | ENST00000263388; ENST00000601011 | chr19 | 15289244 | 15289201 | − | TSF |
| 28% | chr5 | 54993786 | 54993674 | − | ENST00000396865; ENST00000539768; ENST00000318672; ENST00000508124; ENST00000511233; ENST00000503891; ENST00000513993; ENST00000505563; ENST00000506624; ENST00000507109 | chr5 | 54993040 | 54992544 | − | TSF |
| 27% | chr1 | 24463799 | 24463621 | − | ENST00000270800 | chr1 | 24461426 | 24461370 | − | TAF |
| 27% | chr15 | 83102759 | 83103078 | + | ENST00000561062; ENST00000358583 | chr15 | 83193141 | 83193227 | + | TSF |
| 27% | chr11 | 118888255 | 118888078 | − | ENST00000527673 | chr11 | 118861152 | 118861045 | − | TSF |
| 26% | chr15 | 82726234 | 82726553 | + | ENST00000300515 | chr15 | 82808796 | 82808882 | + | TAF |
| 26% | chr18 | 33767503 | 33767644 | + | ENST00000261326 | chr18 | 33773430 | 33773774 | + | TAF |
| 26% | chr19 | 16204346; 16204382 | 16204408 | − | ENST00000344824; ENST00000538887; ENST00000300933; ENST00000588032; ENST00000592822 | chr19 | 16213047 | 16213167 | + | TSF |
| 26% | chr19 | 16204346; 16204382 | 16204408 | + | ENST00000344824; ENST00000538887; ENST00000300933; ENST00000588032; ENST00000592822 | chr19 | 16213047 | 16213167 | + | TSF |
| 26% | chr19 | 16204346; 16204382 | 16204408 | + | ENST00000344824; ENST00000538887; ENST00000300933; ENST00000588032; ENST00000592822 | chr19 | 16213047 | 16213167 | + | TSF |
| 26% | chr19 | 16204346; 16204382 | 16204408 | + | ENST00000344824; ENST00000538887; ENST00000300933; ENST00000588032; ENST00000592822 | chr19 | 16213047 | 16213167 | + | TSF |
| 24% | chr17 | 73733619 | 73733725 | + | ENST00000579662; ENST00000339591; ENST00000200181; ENST00000450894; ENST00000449880 | chr17 | 73735417 | 73735563 | + | TAF |
| 24% | chr12 | 57060050 | 57059988 | − | ENST00000262033; ENST00000414274; ENST00000436399; ENST00000456859 | chr12 | 57059571 | 57059432 | − | TAF |
| 24% | chr12 | 57060050 | 57059988 | − | ENST00000262033; ENST00000414274; ENST00000436399; ENST00000456859 | chr12 | 57059571 | 57059432 | − | TAF |
| 24% | chr12 | 57060050 | 57059988 | − | ENST00000262033; ENST00000414274; ENST00000436399; ENST00000456859 | chr12 | 57059571 | 57059432 | − | TAF |
| 24% | chr12 | 57060050 | 57059988 | − | ENST00000262033; ENST00000414274; ENST00000436399; ENST00000456859 | chr12 | 57059571 | 57059432 | − | TAF |
| 24% | chr19 | 42222047 | 42222099 | + | ENST00000398599; ENST00000221992; ENST00000405816 | chr19 | 42234250 | 42234353 | + | TSF |
| 24% | chr19 | 42222047 | 42222099 | + | ENST00000398599; ENST00000221992; ENST00000405816 | chr19 | 42234250 | 42234353 | + | TSF |
| 24% | chr12 | 52909024 | 52908918 | − | ENST00000252242 | chr12 | 52908901 | 52908992 | + | TSF |
| 23% | chr20 | 35842163 | 35842268 | + | ENST00000237530; ENST00000373622 | chr20 | 35844460 | 35844765 | + | TAF |
| 23% | chr20 | 35842163 | 35842268 | + | ENST00000237530; ENST00000373622 | chr20 | 35844460 | 35844765 | + | TAF |
| 23% | chr1 | 6531697 | 6531548 | − | ENST00000400913; ENST00000340850; ENST00000377748; ENST00000377725; ENST00000377728; ENST00000377732; ENST00000400915; ENST00000377740; ENST00000535355; ENST00000377737; ENST00000537245; ENST00000544978 | chr1 | 6531300 | 6531188 | − | TSF |
| 23% | chr1 | 6531697 | 6531548 | − | ENST00000400913; ENST00000340850; ENST00000377748; ENST00000377725; ENST00000377728; ENST00000377732; ENST00000400915; ENST00000377740; ENST00000535355; ENST00000377737; ENST00000537245; ENST00000544978 | chr1 | 6531300 | 6531188 | − | TSF |
| 23% | chr1 | 6531697 | 6531548 | − | ENST00000400913; ENST00000340850; ENST00000377748; ENST00000377725; ENST00000377728; ENST00000377732; ENST00000400915; ENST00000377740; ENST00000535355; ENST00000377737; ENST00000537245; ENST00000544978 | chr1 | 6531300 | 6531188 | − | TSF |
| 23% | chr1 | 6531697 | 6531548 | − | ENST00000400913; ENST00000340850; ENST00000377748; ENST00000377725; ENST00000377728; ENST00000377732; ENST00000400915; ENST00000377740; ENST00000535355; ENST00000377737; ENST00000537245; ENST00000544978 | chr1 | 6531300 | 6531188 | − | TSF |
| 23% | chr1 | 6531697 | 6531548 | − | ENST00000400913; ENST00000340850; ENST00000377748; ENST00000377725; ENST00000377728; ENST00000377732; ENST00000400915; ENST00000377740; ENST00000535355; ENST00000377737; ENST00000537245; ENST00000544978 | chr1 | 6531300 | 6531188 | − | TSF |

TABLE 21-continued

Transcript fusion for Esophageal Carcinoma (ESCA) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 23% | chr1 | 6531697 | 6531548 | − | ENST00000400913; ENST00000340850; ENST00000377748; ENST00000377725; ENST00000377728; ENST00000377732; ENST00000400915; ENST00000377740; ENST00000535355; ENST00000377737; ENST00000537245; ENST00000544978 | chr1 | 6531300 | 6531188 | − | TSF |
| 21% | chr16 | 68849418 | 68849662 | + | ENST00000261769; ENST00000566612; ENST00000422392 | chr16 | 68851395 | 68851859 | + | TAF |
| 21% | chr16 | 68849418 | 68849662 | + | ENST00000261769; ENST00000566612; ENST00000422392 | chr16 | 68851395 | 68851859 | + | TAF |
| 19% | chr19 | 42222047 | 42222099 | + | ENST00000398599; ENST00000221992; ENST00000405816 | chr19 | 42234246 | 42234353 | + | TSF |
| 19% | chr19 | 42222047 | 42222099 | + | ENST00000398599; ENST00000221992; ENST00000405816 | chr19 | 42234246 | 42234353 | + | TSF |
| 18% | chr6 | 41606488 | 41606563 | + | ENST00000432027; ENST00000419164; ENST00000373051; ENST00000441667; ENST00000230321; ENST00000373050; ENST00000446650; ENST00000435476 | chr6 | 41607515 | 41607595 | + | TAF |
| 18% | chr6 | 74228333 | 74228077 | − | ENST00000316292; ENST00000309268; ENST00000331523 | chr6 | 74195910 | 74195882 | | TSF |
| 18% | chr3 | 185414451 | 185414400 | − | ENST00000382199; ENST00000421047; ENST00000457616; ENST00000346192 | chr3 | 185411016 | 185410789 | − | TSF |
| 18% | chr3 | 185414451 | 185414400 | − | ENST00000382199; ENST00000421047; ENST00000457616; ENST00000346192 | chr3 | 185411016 | 185410789 | − | TSF |
| 17% | chr8 | 134274410; 134274372 | 134274290 | − | ENST00000323851; ENST00000517599; ENST00000537882; ENST00000414097; ENST00000522476; ENST00000522377; ENST00000520230; ENST00000518480; ENST00000519228; ENST00000519580; ENST00000522890; ENST00000520943; ENST00000521544; ENST00000522738; ENST00000523892 | chr8 | 134272213 | 134272102 | − | TAF |
| 17% | chr8 | 134274410; 134274372 | 134274290 | − | ENST00000323851; ENST00000517599; ENST00000537882; ENST00000414097; ENST00000522476; ENST00000522377; ENST00000520230; ENST00000518480; ENST00000519228; ENST00000519580; ENST00000522890; ENST00000520943; ENST00000521544; ENST00000522738; ENST00000523892 | chr8 | 134272213 | 134272102 | − | TAF |
| 17% | chr8 | 134274410; 134274372 | 134274290 | − | ENST00000323851; ENST00000517599; ENST00000537882; ENST00000414097; ENST00000522476; ENST00000522377; ENST00000520230; ENST00000518480; ENST00000519228; ENST00000519580; ENST00000522890; ENST00000520943; ENST00000521544; ENST00000522738; ENST00000523892 | chr8 | 134272213 | 134272102 | − | TAF |
| 17% | chr8 | 134274410; 134274372 | 134274290 | − | ENST00000323851; ENST00000517599; ENST00000537882; ENST00000414097; ENST00000522476; ENST00000522377; ENST00000520230; ENST00000518480; ENST00000519228; ENST00000519580; ENST00000522890; ENST00000520943; ENST00000521544; ENST00000522738; ENST00000523892 | chr8 | 134272213 | 134272102 | − | TAF |
| 17% | chr8 | 134274410; 134274372 | 134274290 | − | ENST00000323851; ENST00000517599; ENST00000537882; ENST00000414097; ENST00000522476; ENST00000522377; ENST00000520230; ENST00000518480; ENST00000519228; ENST00000519580; ENST00000522890; ENST00000520943; ENST00000521544; ENST00000522738; ENST00000523892 | chr8 | 134272213 | 134272102 | − | TAF |
| 17% | chr8 | 134274410; 134274372 | 134274290 | − | ENST00000323851; ENST00000517599; ENST00000537882; ENST00000414097; ENST00000522476; ENST00000522377; ENST00000520230; ENST00000518480; ENST00000519228; ENST00000519580; ENST00000522890; ENST00000520943; ENST00000521544; ENST00000522738; ENST00000523892 | chr8 | 134272213 | 134272102 | − | TAF |
| 17% | chr8 | 134274410; 134274372 | 134274290 | − | ENST00000323851; ENST00000517599; ENST00000537882; ENST00000414097; ENST00000522476; ENST00000522377; ENST00000520230; ENST00000518480; | | | | | |

TABLE 21-continued

Transcript fusion for Esophageal Carcinoma (ESCA) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 17% | chr8 | 134274410; 134274372 | 134274290 | − | ENST00000519228; ENST00000519580; ENST00000522890; ENST00000520943; ENST00000521544; ENST00000522738; ENST00000523892 ENST00000323851; ENST00000517599; ENST00000537882; ENST00000414097; ENST00000522476; ENST00000522377; ENST00000520230; ENST00000518480; ENST00000519228; ENST00000519580; ENST00000522890; ENST00000520943; ENST00000521544; ENST00000522738; ENST00000523892 | chr8 | 134272213 | 134272102 | − | TAF |
| 17% | chr1 | 153534067 | 153533988 | − | ENST00000368708; ENST00000487430; ENST00000497140; ENST00000368710; ENST00000368709 | chr1 | 153532853 | 153532704 | − | TAF |
| 17% | chr1 | 153534067 | 153533988 | − | ENST00000368708; ENST00000487430; ENST00000497140; ENST00000368710; ENST00000368709 | chr1 | 153532853 | 153532704 | − | TAF |
| 17% | chr3 | 49927493 | 49927357 | − | ENST00000296474; ENST00000344206 | chr3 | 49927248 | 49927204 | − | TAF |
| 17% | chr3 | 49927493 | 49927357 | − | ENST00000296474; ENST00000344206 | chr3 | 49927248 | 49927204 | − | TAF |
| 16% | chr11 | 11394176 | 11394062 | − | ENST00000227756 | chr11 | 11386990 | 11386568 | − | TAF |
| 16% | chr7 | 55270210 | 55270401 | + | ENST00000455089 | chr7 | 55272949 | 55272949 | + | TSF |
| 15% | chr7 | 27582719 | 27582586 | − | ENST00000265395; ENST00000425715 | chr7 | 27581374 | 27579272 | − | TAF |
| 15% | chr7 | 27582719 | 27582586 | − | ENST00000265395; ENST00000425715 | chr7 | 27581374 | 27579272 | − | TAF |
| 14% | chr3 | 141640819 | 141640905 | + | ENST00000286371 | chr3 | 141642262 | 141642420 | + | TAF |
| 14% | chr8 | 144102731 | 144102850 | + | ENST00000292494; ENST00000429120; ENST00000521699; ENST00000520531; ENST00000520466; ENST00000521003; ENST00000522971; ENST00000519611; ENST00000519546; ENST00000523847; ENST00000522024 | chr8 | 144113283 | 144113885 | + | TAF |
| 14% | chr5 | 1802435 | 1802488 | + | ENST00000274137; ENST00000469176 | chr5 | 1811023 | 1811428 | + | TAF |
| 14% | chr20 | 3844903 | 3845435 | + | ENST00000416600; ENST00000428216 | chr20 | 3854441 | 3854475 | + | TAF |
| 14% | chr20 | 3844903 | 3845435 | + | ENST00000416600; ENST00000428216 | chr20 | 3854441 | 3854475 | + | TAF |
| 14% | chr1 | 33272212 | 33272083 | − | ENST00000373477 | chr1 | 33270534 | 33269340 | − | TAF |
| 14% | chr1 | 147438786 | 147438895 | + | ENST00000314163 | chr1 | 147440564 | 147440653 | + | TAF |
| 14% | chr10 | 22171368 | 22171211 | − | ENST00000376980 | chr10 | 22168812 | 22168560 | − | TAF |
| 14% | chr10 | 48255429 | 48255449 | + | ENST00000357718; ENST00000344416; ENST00000535874; ENST00000456111 | chr10 | 48278725 | 48278896 | + | TSF |
| 13% | chr3 | 57678745 | 57678509 | − | ENST00000311128 | chr3 | 57665452 | 57665436 | − | TAF |
| 12% | chr11 | 102033187 | 102033302 | + | ENST00000526343; ENST00000282441; ENST00000345877; ENST00000537274; ENST00000531439; ENST00000524575 | chr11 | 102045049 | 102045326 | + | TAF |
| 12% | chr11 | 102033187 | 102033302 | + | ENST00000526343; ENST00000282441; ENST00000345877; ENST00000537274; ENST00000531439; ENST00000524575 | chr11 | 102045049 | 102045326 | + | TAF |
| 12% | chr1 | 224544627 | 224544695 | + | ENST00000465271; ENST00000366858; ENST00000366857; ENST00000366856 | chr1 | 224551811 | 224551931 | + | TAF |
| 12% | chr21 | 45379563 | 45379740 | + | ENST00000291572; ENST00000448287; ENST00000398061; ENST00000327505; ENST00000445582; ENST00000398063; ENST00000398058; ENST00000457068; ENST00000422850; ENST00000546158 | chr21 | 45380513 | 45380695 | + | TAF |
| 12% | chr7 | 4026818 | 4026954 | + | ENST00000404826; ENST00000389531 | chr7 | 4027977 | 4028157 | + | TAF |
| 12% | chr10 | 75555297 | 75555421 | + | ENST00000604729; ENST00000603114; ENST00000604524; ENST00000398706; ENST00000605216; ENST00000433366; ENST00000492395; ENST00000603187; ENST00000412198; ENST00000604754 | chr10 | 75556079 | 75556138 | + | TSF |
| 12% | chr10 | 75555297 | 75555421 | + | ENST00000604729; ENST00000603114; ENST00000604524; ENST00000398706; ENST00000605216; ENST00000433366; ENST00000492395; ENST00000603187; ENST00000412198; ENST00000604754 | chr10 | 75556079 | 75556138 | + | TSF |
| 12% | chr10 | 75555297 | 75555421 | + | ENST00000604729; ENST00000603114; ENST00000604524; ENST00000398706; ENST00000605216; ENST00000433366; ENST00000492395; ENST00000603187; ENST00000412198; ENST00000604754 | chr10 | 75556079 | 75556138 | + | TSF |
| 12% | chr10 | 75555297 | 75555421 | + | ENST00000604729; ENST00000603114; ENST00000604524; ENST00000398706; ENST00000605216; ENST00000433366; ENST00000492395; ENST00000603187; ENST00000412198; ENST00000604754 | chr10 | 75556079 | 75556138 | + | TSF |

TABLE 21-continued

Transcript fusion for Esophageal Carcinoma (ESCA) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 12% | chr10 | 75555297 | 75555421 | + | ENST00000604729; ENST00000603114; ENST00000604524; ENST00000398706; ENST00000605216; ENST00000433366; ENST00000492395; ENST00000603187; ENST00000412198; ENST00000604754 | chr10 | 75556079 | 75556138 | + | TSF |
| 12% | chr10 | 75555297 | 75555421 | + | ENST00000604729; ENST00000603114; ENST00000604524; ENST00000398706; ENST00000605216; ENST00000433366; ENST00000492395; ENST00000603187; ENST00000412198; ENST00000604754 | chr10 | 75556079 | 75556138 | + | TSF |
| 12% | chr10 | 75555297 | 75555421 | + | ENST00000604729; ENST00000603114; ENST00000604524; ENST00000398706; ENST00000605216; ENST00000433366; ENST00000492395; ENST00000603187; ENST00000412198; ENST00000604754 | chr10 | 75556079 | 75556138 | + | TSF |
| 12% | chr10 | 75555297 | 75555421 | + | ENST00000604729; ENST00000603114; ENST00000604524; ENST00000398706; ENST00000605216; ENST00000433366; ENST00000492395; ENST00000603187; ENST00000412198; ENST00000604754 | chr10 | 75556079 | 75556138 | + | TSF |
| 11% | chr13 | 44433033 | 44432917 | − | ENST00000444614; ENST00000281508 | chr13 | 44413224 | 44412729 | − | TAF |
| 11% | chr14 | 31922550 | 31922481 | − | ENST00000549185; ENST00000547378; ENST00000310850; ENST00000356180 | chr14 | 31907346 | 31905965 | − | TSF |
| 10% | chr7 | 5781275; 5781446 | 5780604 | − | ENST00000425013; ENST00000389902; ENST00000389900 | chr7 | 5779256 | 5779224 | − | TAF |
| 10% | chr7 | 5781275; 5781446 | 5780604 | − | ENST00000425013; ENST00000389902; ENST00000389900 | chr7 | 5779256 | 5779224 | − | TAF |
| 10% | chr6 | 27114577 | 27114201 | − | ENST00000396891; ENST00000356950 | chr6 | 27106460 | 27106003 | − | TAF |
| 10% | chr1 | 987108 | 987195 | + | ENST00000379370; ENST00000419249 | chr1 | 992542 | 992691 | + | TSF |
| 10% | chr1 | 987108 | 987195 | + | ENST00000379370; ENST00000419249 | chr1 | 992542 | 992691 | + | TSF |
| 10% | chr1 | 183441756 | 183441784 | + | ENST00000440812; ENST00000444547; ENST00000347615; ENST00000507469; ENST00000515829 | chr1 | 183470266 | 183470283 | + | TSF |
| 10% | chr12 | 52912944; 52912901 | 52912801 | − | ENST00000252242; ENST00000551188; ENST00000549420 | chr12 | 52901143 | 52899664 | − | TSF |
| 10% | chr12 | 52912944; 52912901 | 52912801 | − | ENST00000252242; ENST00000551188; ENST00000549420 | chr12 | 52901143 | 52899664 | − | TSF |
| 10% | chr12 | 52912944; 52912901 | 52912801 | − | ENST00000252242; ENST00000551188; ENST00000549420 | chr12 | 52901143 | 52899664 | − | TSF |
| 10% | chr12 | 113403549; 113403702 | 113403834 | + | ENST00000228928; ENST00000546973 | chr12 | 113404028 | 113404051 | + | TSF |
| 10% | chr12 | 113403549; 113403702 | 113403834 | + | ENST00000228928; ENST00000546973 | chr12 | 113404028 | 113404051 | + | TSF |
| 10% | chr7 | 81964567 | 81964451 | − | ENST00000356860; ENST00000356253; ENST00000423588 | chr7 | 81929467 | 81929190 | − | TSF |
| 9% | chr6 | 34210489 | 34210572 | + | ENST00000447654; ENST00000311487; ENST00000347617; ENST00000401473; ENST00000374116 | chr6 | 34212756 | 34212817 | + | TSF |
| 9% | chr6 | 34210489 | 34210572 | + | ENST00000447654; ENST00000311487; ENST00000347617; ENST00000401473; ENST00000374116 | chr6 | 34212756 | 34212817 | + | TSF |
| 9% | chr1 | 209792 | 20979114 | − | ENST00000602624; ENST00000375048; ENST00000415136 | chr1 | 20978611 | 20978295 | − | TSF |
| 9% | chr1 | 20979220 | 20979114 | − | ENST00000602624; ENST00000375048; ENST00000415136 | chr1 | 20978611 | 20978295 | − | TSF |
| 9% | chr1 | 20979220 | 20979114 | − | ENST00000602624; ENST00000375048; ENST00000415136 | chr1 | 20978611 | 20978295 | − | TSF |
| 9% | chr4 | 25759228 | 25759156 | − | ENST00000399878; ENST00000264868; ENST00000502949; ENST00000510448 | chr4 | 25723603 | 25723555 | − | TSF |
| 9% | chr4 | 25759228 | 25759156 | − | ENST00000399878; ENST00000264868; ENST00000502949; ENST00000510448 | chr4 | 25723603 | 25723555 | − | TSF |
| 9% | chr4 | 25759228 | 25759156 | − | ENST00000399878; ENST00000264868; ENST00000502949; ENST00000510448 | chr4 | 25723603 | 25723555 | − | TSF |
| 9% | chr4 | 25759228 | 25759156 | − | ENST00000399878; ENST00000264868; ENST00000502949; ENST00000510448 | chr4 | 25723603 | 25723555 | − | TSF |
| 9% | chr3 | 137906397; 137906427 | 137906441 | + | ENST00000469044; ENST00000461600; ENST00000461822; ENST00000470821; ENST00000471709; ENST00000393058; ENST00000538260; ENST00000463485 | chr3 | 137907243 | 137907252 | + | TSF |
| 9% | chr3 | 137906397; 137906427 | 137906441 | + | ENST00000469044; ENST00000461600; ENST00000461822; ENST00000470821; ENST00000471709; ENST00000393058; ENST00000538260; ENST00000463485 | chr3 | 137907243 | 137907252 | + | TSF |

TABLE 21-continued

Transcript fusion for Esophageal Carcinoma (ESCA) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 9% | chr10 | 47173918 | 47173898 | − | ENST00000358140; ENST00000359178; ENST00000545298; ENST00000414655 | chr10 | 47139994 | 47138925 | − | TSF |
| 8% | chr4 | 146617711 | 146617784 | + | ENST00000438731; ENST00000511965 | chr4 | 146620339 | 146620424 | + | TSF |
| 8% | chr4 | 146617711 | 146617784 | + | ENST00000438731; ENST00000511965 | chr4 | 146620339 | 146620424 | + | TSF |
| 8% | chr19 | 15289752 | 15289634 | − | ENST00000263388; ENST00000601011 | chr19 | 15289358 | 15289201 | − | TSF |
| 8% | chr19 | 15289752 | 15289634 | − | ENST00000263388; ENST00000601011 | chr19 | 15289358 | 15289201 | − | TSF |
| 8% | chr8 | 71619168 | 71619388 | + | ENST00000408926; ENST00000520030 | chr8 | 71625661 | 71625673 | + | TSF |
| 8% | chrX | 24091208 | 24091333 | + | ENST00000253039 | chrX | 24091714 | 24091817 | + | TSF |
| 8% | chr2 | 176860312; 176860292 | 176860286 | − | ENST00000272748; ENST00000544803; ENST00000392540; ENST00000445472 | chr2 | 176859008 | 176858934 | − | TSF |
| 8% | chr2 | 176860312; 176860292 | 176860286 | − | ENST00000272748; ENST00000544803; ENST00000392540; ENST00000445472 | chr2 | 176859008 | 176858934 | | TSF |
| 8% | chr8 | 145001050 | 145000952 | − | ENST00000345136; ENST00000357649; ENST00000354589; ENST00000398774; ENST00000322810; ENST00000354958; ENST00000356346; ENST00000436759; ENST00000527096; ENST00000527303 | chr8 | 144977746 | 144977671 | | TSF |
| 8% | chr8 | 145001050 | 145000952 | − | ENST00000345136; ENST00000357649; ENST00000354589; ENST00000398774; ENST00000322810; ENST00000354958; ENST00000356346; ENST00000436759; ENST00000527096; ENST00000527303 | chr8 | 144977746 | 144977671 | − | TSF |
| 8% | chr8 | 145001050 | 145000952 | − | ENST00000345136; ENST00000357649; ENST00000354589; ENST00000398774; ENST00000322810; ENST00000354958; ENST00000356346; ENST00000436759; ENST00000527096; ENST00000527303 | chr8 | 144977746 | 144977671 | − | TSF |
| 8% | chr8 | 145001050 | 145000952 | − | ENST00000345136; ENST00000357649; ENST00000354589; ENST00000398774; ENST00000322810; ENST00000354958; ENST00000356346; ENST00000436759; ENST00000527096; ENST00000527303 | chr8 | 144977746 | 144977671 | − | TSF |
| 8% | chr8 | 145001050 | 145000952 | − | ENST00000345136; ENST00000357649; ENST00000354589; ENST00000398774; ENST00000322810; ENST00000354958; ENST00000356346; ENST00000436759; ENST00000527096; ENST00000527303 | chr8 | 144977746 | 144977671 | − | TSF |
| 8% | chr8 | 145001050 | 145000952 | − | ENST00000345136; ENST00000357649; ENST00000354589; ENST00000398774; ENST00000322810; ENST00000354958; ENST00000356346; ENST00000436759; ENST00000527096; ENST00000527303 | chr8 | 144977746 | 144977671 | − | TSF |
| 8% | chr8 | 145001050 | 145000952 | − | ENST00000345136; ENST00000357649; ENST00000354589; ENST00000398774; ENST00000322810; ENST00000354958; ENST00000356346; ENST00000436759; ENST00000527096; ENST00000527303 | chr8 | 144977746 | 144977671 | − | TSF |
| 8% | chr8 | 145001050 | 145000952 | − | ENST00000345136; ENST00000357649; ENST00000354589; ENST00000398774; ENST00000322810; ENST00000354958; ENST00000356346; ENST00000436759; ENST00000527096; ENST00000527303 | chr8 | 144977746 | 144977671 | − | TSF |
| 8% | chr8 | 145001050 | 145000952 | − | ENST00000345136; ENST00000357649; ENST00000354589; ENST00000398774; ENST00000322810; ENST00000354958; ENST00000356346; ENST00000436759; ENST00000527096; ENST00000527303 | chr8 | 144977746 | 144977671 | − | TSF |
| 7% | chr10 | 5788142 | 5788607 | + | ENST00000328090 | chr10 | 5845506 | 5845586 | + | TSF |
| 7% | chr8 | 104778455 | 104778765 | + | ENST00000504942; ENST00000406091 | chr8 | 104821508 | 104821527 | + | TSF |
| 7% | chr4 | 169086398 | 169086477 | + | ENST00000359299 | chr4 | 169090666 | 169090754 | + | TSF |
| 7% | chr8 | 25240190 | 25240294 | 1 | ENST00000276440 | chr8 | 25246325 | 25246384 | + | TSF |
| 7% | chr16 | 16149949 | 16150152 | + | ENST00000399410; ENST00000345148; ENST00000346370; ENST00000349029; ENST00000351154; ENST00000399408; ENST00000572882 | chr16 | 16151288 | 16151380 | + | TSF |
| 7% | chr16 | 16149949 | 16150152 | + | ENST00000399410; ENST00000345148; ENST00000346370; ENST00000349029; ENST00000351154; ENST00000399408; ENST00000572882 | chr16 | 16151288 | 16151380 | + | TSF |
| 7% | chr22 | 38321668; 38321854 | 38322050 | + | ENST00000215957; ENST00000454685 | chr22 | 38322963 | 38322967 | + | TSF |

TABLE 21-continued

Transcript fusion for Esophageal Carcinoma (ESCA) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 7% | chr22 | 38321668; 38321854 | 38322050 | + | ENST00000215957; ENST00000454685 | chr22 | 38322963 | 38322967 | + | TSF |
| 7% | chr22 | 25202408 | 25202451 | + | ENST00000400358; ENST00000400359 | chr22 | 25209976 | 25210040 | + | TSF |
| 7% | chr2 | 241555805 | 241555928 | + | ENST00000270634 | chr2 | 241556208 | 241556489 | + | TSF |
| 7% | chr1 | 234546277 | 234546191 | − | ENST00000040877 | chr1 | 234545319 | 234545287 | − | TSF |
| 7% | chr17 | 39777343 | 39777323 | − | ENST00000311208; ENST00000540235; ENST00000463128 | chr17 | 39757580 | 39757497 | − | TSF |
| 7% | chr17 | 39777343 | 39777323 | − | ENST00000311208; ENST00000540235; ENST00000463128 | chr17 | 39757580 | 39757497 | − | TSF |
| 7% | chr17 | 39777343 | 39777323 | − | ENST00000311208; ENST00000540235; ENST00000463128 | chr17 | 39757580 | 39757497 | − | TSF |
| 6% | chr12 | 86272123 | 86272347 | + | ENST00000256010 | chr12 | 86274455 | 86274746 | + | TSF |
| 6% | chr5 | 175723254 | 175723323 | + | ENST00000341199; ENST00000430704; ENST00000443967; ENST00000429602 | chr5 | 175731557 | 175732243 | + | TSF |
| 6% | chr5 | 175723254 | 175723323 | + | ENST00000341199; ENST00000430704; ENST00000443967; ENST00000429602 | chr5 | 175731557 | 175732243 | + | TSF |
| 6% | chr5 | 175723254 | 175723323 | + | ENST00000341199; ENST00000430704; ENST00000443967; ENST00000429602 | chr5 | 175731557 | 175732243 | + | TSF |
| 6% | chr20 | 3614958 | 3615036 | + | ENST00000262919 | chr20 | 3615708 | 3616042 | + | TSF |
| 6% | chr17 | 38634585 | 38634559 | − | ENST00000254051; ENST00000582747 | chr17 | 38633675 | 38633602 | − | TSF |
| 6% | chr17 | 38634585 | 38634559 | − | ENST00000254051; ENST00000582747 | chr17 | 38633675 | 38633602 | − | TSF |
| 6% | chr7 | 5434226; 5434191 | 5434071 | − | ENST00000399537; ENST00000430969; ENST00000434361; ENST00000399434 | chr7 | 5433863 | 5433797 | − | TSF |
| 6% | chr7 | 5434226; 5434191 | 5434071 | − | ENST00000399537; ENST00000430969; ENST00000434361; ENST00000399434 | chr7 | 5433863 | 5433797 | − | TSF |
| 6% | chr14 | 67878776 | 67878735 | − | ENST00000216446; ENST00000553387 | chr14 | 67864772 | 67864768 | − | TSF |
| 6% | chr17 | 39768940 | 39768493 | − | ENST00000301653 | chr17 | 39733779 | 39733579 | − | TSF |
| 5% | chr14 | 66096210; 66096217 | 66096324 | + | ENST00000360689; ENST00000394586; ENST00000342677; ENST00000557164; ENST00000394585; ENST00000358307 | chr14 | 66099743 | 66101298 | + | TSF |
| 5% | chr14 | 66096210; 66096217 | 66096324 | + | ENST00000360689; ENST00000394586; ENST00000342677; ENST00000557164; ENST00000394585; ENST00000358307 | chr14 | 66099743 | 66101298 | + | TSF |
| 5% | chr14 | 66096210; 66096217 | 66096324 | + | ENST00000360689; ENST00000394586; ENST00000342677; ENST00000557164; ENST00000394585; ENST00000358307 | chr14 | 66099743 | 66101298 | + | TSF |
| 5% | chr3 | 183454506 | 183454617 | + | ENST00000305135 | chr3 | 183456939 | 183458206 | + | TSF |
| 5% | chr3 | 189590648 | 189590784 | + | ENST00000264731; ENST00000382063; ENST00000418709; ENST00000320472; ENST00000392460; ENST00000440651; ENST00003546000; ENST00000437221; ENST00000392463; ENST00003924610; ENST00000449992; ENST00000456148 | chr3 | 189602358 | 189602438 | + | TSF |
| 5% | chr3 | 189590648 | 189590784 | + | ENST00000264731; ENST00000382063; ENST00000418709; ENST00000320472; ENST00000392460; ENST00000440651; ENST00003546000; ENST00000437221; ENST00000392463; ENST00003924610; ENST00000449992; ENST00000456148 | chr3 | 189602358 | 189602438 | + | TSF |
| 5% | chr3 | 189590648 | 189590784 | + | ENST00000264731; ENST00000382063; ENST00000418709; ENST00000320472; ENST00000392460; ENST00000440651; ENST00003546000; ENST00000437221; ENST00000392463; ENST00003924610; ENST00000449992; ENST00000456148 | chr3 | 189602358 | 189602438 | + | TSF |
| 5% | chr3 | 189590648 | 189590784 | + | ENST00000264731; ENST00000382063; ENST00000418709; ENST00000320472; ENST00000392460; ENST00000440651; ENST00003546000; ENST00000437221; ENST00000392463; ENST00003924610; ENST00000449992; ENST00000456148 | chr3 | 189602358 | 189602438 | + | TSF |
| 5% | chr3 | 189590648 | 189590784 | + | ENST00000264731; ENST00000382063; ENST00000418709; ENST00000320472; ENST00000392460; ENST00000440651; ENST00003546000; ENST00000437221; ENST00000392463; ENST00003924610; ENST00000449992; ENST00000456148 | chr3 | 189602358 | 189602438 | + | TSF |
| 5% | chr3 | 189590648 | 189590784 | + | ENST00000264731; ENST00000382063; ENST00000418709; ENST00000320472; ENST00000392460; ENST00000440651; ENST00003546000; ENST00000437221; ENST00000392463; ENST00003924610; ENST00000449992; ENST00000456148 | chr3 | 189602358 | 189602438 | + | TSF |

TABLE 21-continued

Transcript fusion for Esophageal Carcinoma (ESCA) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|----|----|
| 5% | chr11 | 60701014 | 60701216 | + | ENST00000453848; ENST00000005286; ENST00000536409 | chr11 | 60701443 | 60701575 | + | TSF |
| 5% | chr11 | 60701014 | 60701216 | + | ENST00000453848; ENST00000005286; ENST00000536409 | chr11 | 60701443 | 60701575 | + | TSF |
| 5% | chr11 | 60701014 | 60701216 | + | ENST00000453848; ENST00000005286; ENST00000536409 | chr11 | 60701443 | 60701575 | + | TSF |
| 5% | chr11 | 71209398; 71209448 | 71209574 | + | ENST00000319023; ENST00000539574; ENST00000530055; ENST00000525593; ENST00000527963 | chr11 | 71216557 | 71216960 | + | TSF |
| 5% | chr11 | 71209398; 71209448 | 71209574 | + | ENST00000319023; ENST00000539574; ENST00000530055; ENST00000525593; ENST00000527963 | chr11 | 71216557 | 71216960 | + | TSF |
| 5% | chr11 | 71209398; 71209448 | 71209574 | + | ENST00000319023; ENST00000539574; ENST00000530055; ENST00000525593; ENST00000527963 | chr11 | 71216557 | 71216960 | + | TSF |
| 5% | chr11 | 71209398; 71209448 | 71209574 | + | ENST00000319023; ENST00000539574; ENST00000530055; ENST00000525593; ENST00000527963 | chr11 | 71216557 | 71216960 | + | TSF |
| 5% | chr11 | 71209398; 71209448 | 71209574 | + | ENST00000319023; ENST00000539574; ENST00000530055; ENST00000525593; ENST00000527963 | chr11 | 71216557 | 71216960 | + | TSF |
| 5% | chr17 | 39914770 | 39914657 | − | ENST00000393930; ENST00000310706; ENST00000393931 | chr17 | 39864294 | 39864007 | − | TSF |
| 5% | chr3 | 50153339 | 50153413 | + | ENST00000347869 | chr3 | 50155909 | 50155909 | + | TSF |
| 5% | chr7 | 23313140 | 23313233 | + | ENST00000258733; ENST00000381990; ENST00000539136; ENST00000453162 | chr7 | 23322924 | 23323223 | + | TSF |
| 5% | chr7 | 23313140 | 23313233 | + | ENST00000258733; ENST00000381990; ENST00000539136; ENST00000453162 | chr7 | 23322924 | 23323223 | + | TSF |
| 5% | chr7 | 23313140 | 23313233 | + | ENST00000258733; ENST00000381990; ENST00000539136; ENST00000453162 | chr7 | 23322924 | 23323223 | + | TSF |
| 5% | chr7 | 23313140 | 23313233 | + | ENST00000258733; ENST00000381990; ENST00000539136; ENST00000453162 | chr7 | 23322924 | 23323223 | + | TSF |
| 5% | chr1 | 32573732 | 32573735 | + | ENST00000373625; ENST00000471599 | chr1 | 32605356 | 32605563 | + | TSF |
| 5% | chr22 | 50639466 | 50640019 | + | ENST00000380903 | chr22 | 50643348 | 50643731 | + | TSF |
| 5% | chr17 | 39780761; 39780716 | 39780413 | − | ENST00000311208; ENST00000577817 | chr17 | 39733779 | 39733579 | − | TSF |
| 5% | chr17 | 39780761; 39780716 | 39780413 | − | ENST00000311208; ENST00000577817 | chr17 | 39733779 | 39733579 | − | TSF |
| 5% | chr8 | 624047; 623326; 623657 | 1623289 | | ENST00000522706; ENST00000523415; ENST00000262109; ENST00000522893 | chr8 | 622204 | 621954 | − | TSF |
| 5% | chr8 | 624047; 623326; 623657 | 1623289 | | ENST00000522706; ENST00000523415; ENST00000262109; ENST00000522893 | chr8 | 622204 | 621954 | − | TSF |
| 5% | chr8 | 624047; 623326; 623657 | 1623289 | | ENST00000522706; ENST00000523415; ENST00000262109; ENST00000522893 | chr8 | 622204 | 621954 | − | TSF |
| 5% | chr8 | 624047; 623326; 623657 | 1623289 | | ENST00000522706; ENST00000523415; ENST00000262109; ENST00000522893 | chr8 | 622204 | 621954 | − | TSF |
| 5% | chr12 | 56742407 | 56742313 | − | ENST00000314128; ENST00000557235 | chr12 | 56740986 | 56740975 | − | TSF |
| 5% | chr12 | 56742407 | 56742313 | − | ENST00000314128; ENST00000557235 | chr12 | 56740986 | 56740975 | − | TSF |
| 5% | chr12 | 58024115 | 58023935 | − | ENST00000341156; ENST00000418555; ENST00000552798; ENST00000549391; ENST00000449184; ENST00000550764; ENST00000552350; ENST00000548888 | chr12 | 58023079 | 58022983 | − | TSF |
| 5% | chr12 | 58024115 | 58023935 | − | ENST00000341156; ENST00000418555; ENST00000552798; ENST00000549391; ENST00000449184; ENST00000550764; ENST00000552350; ENST00000548888 | chr12 | 58023079 | 58022983 | − | TSF |
| 5% | chr12 | 58024115 | 58023935 | − | ENST00000341156; ENST00000418555; ENST00000552798; ENST00000549391; ENST00000449184; ENST00000550764; ENST00000552350; ENST00000548888 | chr12 | 58023079 | 58022983 | − | TSF |
| 5% | chr12 | 58024115 | 58023935 | − | ENST00000341156; ENST00000418555; ENST00000552798; ENST00000549391; ENST00000449184; ENST00000550764; ENST00000552350; ENST00000548888 | chr12 | 58023079 | 58022983 | − | TSF |
| 5% | chr8 | 11704677 | 11704561 | − | ENST00000434271; ENST00000353047; ENST00000530640; ENST00000531089; ENST00000453527; ENST00000345125; ENST00000533455; ENST00000534510 | chr8 | 11700371 | 11700139 | − | TSF |
| 5% | chrX | 41598709 | 41598637 | − | ENST00000421587; ENST00000318588; ENST00000361962; ENST00000378163; ENST00000378158; ENST00000378166; ENST00000442742; ENST00000378154 | chrX | 41557348 | 41557057 | − | TSF |

TABLE 21-continued

Transcript fusion for Esophageal Carcinoma (ESCA) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 5% | chr17 | 39741309 | 39741227 | − | ENST00000167586 | chr17 | 39741017 | 39740999 | − | TSF |
| 5% | chr16 | 72153988; 72154048 | 72153750 | − | ENST00000537465; ENST00000237353; ENST00000355636 | chr16 | 72150929 | 72150229 | − | TSF |
| 5% | chr16 | 72153988; 72154048 | 72153750 | − | ENST00000537465; ENST00000237353; ENST00000355636 | chr16 | 72150929 | 72150229 | − | TSF |
| 5% | chr16 | 72153988; 72154048 | 72153750 | − | ENST00000537465; ENST00000237353; ENST00000355636 | chr16 | 72150929 | 72150229 | − | TSF |
| 4% | chr6 | 29910534 | 29910757 | + | ENST00000396634; ENST00000376806; ENST00000376809; ENST00000376802 | chr6 | 30349606 | 30349643 | + | TSF |
| 4% | chr10 | 48264358 | 48264417 | + | ENST00000357718; ENST00000344416; ENST00000456111 | chr10 | 48270861 | 48270943 | + | TSF |
| 4% | chr10 | 48264358 | 48264417 | + | ENST00000357718; ENST00000344416; ENST00000456111 | chr10 | 48270861 | 48270943 | + | TSF |
| 4% | chr10 | 48264358 | 48264417 | + | ENST00000357718; ENST00000344416; ENST00000456111 | chr10 | 48270861 | 48270943 | + | TSF |
| 4% | chr11 | 61505607 | 61505679 | + | ENST00000257215 | chr11 | 61506649 | 61506706 | + | TSF |
| 4% | chr5 | 172110422 | 172110543 | + | ENST00000522853; ENST00000369800 | chr5 | 172114291 | 172114319 | + | TSF |
| 4% | chr5 | 172110422 | 172110543 | + | ENST00000522853; ENST00000369800 | chr5 | 172114291 | 172114319 | + | TSF |
| 4% | chr16 | 30783410 | 30783511 | + | ENST00000324685; ENST00000402121; ENST00000563683; ENST00000357890 | chr16 | 30785136 | 30785155 | + | TSF |
| 4% | chr16 | 30783410 | 30783511 | + | ENST00000324685; ENST00000402121; ENST00000563683; ENST00000357890 | chr16 | 30785136 | 30785155 | + | TSF |
| 4% | chr16 | 30783410 | 30783511 | + | ENST00000324685; ENST00000402121; ENST00000563683; ENST00000357890 | chr16 | 30785136 | 30785155 | + | TSF |
| 4% | chr16 | 30783410 | 30783511 | + | ENST00000324685; ENST00000402121; ENST00000563683; ENST00000357890 | chr16 | 30785136 | 30785155 | + | TSF |
| 4% | chr7 | 98961166 | 98961256 | + | ENST00000432884; ENST00000262942 | chr7 | 98963096 | 98963255 | + | TSF |
| 4% | chr7 | 98961166 | 98961256 | + | ENST00000432884; ENST00000262942 | chr7 | 98963096 | 98963255 | + | TSF |
| 4% | chr16 | 2825557; 2825626 | 2825452 | − | ENST00000262306; ENST00000409906; ENST00000409477; ENST00000494946 | chr16 | 2823822 | 2823809 | − | TSF |
| 4% | chr16 | 2825557; 2825626 | 2825452 | − | ENST00000262306; ENST00000409906; ENST00000409477; ENST00000494946 | chr16 | 2823822 | 2823809 | − | TSF |
| 4% | chr16 | 2825557; 2825626 | 2825452 | − | ENST00000262306; ENST00000409906; ENST00000409477; ENST00000494946 | chr16 | 2823822 | 2823809 | − | TSF |
| 4% | chr17 | 38640861 | 38640736 | − | ENST00000254051 | chr17 | 38639746 | 38639457 | − | TSF |
| 4% | chr6 | 34386201 | 34386146 | − | ENST00000605528; ENST00000344700 | chr6 | 34385704 | 34385695 | − | TSF |
| 4% | chr17 | 38066177 | 38066009 | − | ENST00000360317; ENST00000394175; ENST00000309481; ENST00000520542; ENST00000394179; ENST00000418519; ENST00000523371; ENST00000524039; ENST00000468820 | chr17 | 38065588 | 38065521 | − | TSF |
| 4% | chr17 | 38066177 | 38066009 | − | ENST00000360317; ENST00000394175; ENST00000309481; ENST00000520542; ENST00000394179; ENST00000418519; ENST00000523371; ENST00000524039; ENST00000468820 | chr17 | 38065588 | 38065521 | − | TSF |
| 4% | chr1 | 43392912 | 43392716 | − | ENST00000426263 | chr1 | 43372275 | 43371386 | − | TSF |
| 4% | chr3 | 195780429 | 195780393 | − | ENST00000426789; ENST00000420415; ENST00000360110; ENST00000392396; ENST00000535031 | chr3 | 195779399 | 195779315 | − | TSF |
| 4% | chr3 | 195780429 | 195780393 | − | ENST00000426789; ENST00000420415; ENST00000360110; ENST00000392396; ENST00000535031 | chr3 | 195779399 | 195779315 | − | TSF |
| 4% | chr3 | 195780429 | 195780393 | − | ENST00000426789; ENST00000420415; ENST00000360110; ENST00000392396; ENST00000535031 | chr3 | 195779399 | 195779315 | − | TSF |
| 4% | chr3 | 195780429 | 195780393 | − | ENST00000426789; ENST00000420415; ENST00000360110; ENST00000392396; ENST00000535031 | chr3 | 195779399 | 195779315 | − | TSF |
| 4% | chr19 | 45895598 | 45895138 | − | ENST00000360957; ENST00000418234 | chr19 | 45889495 | 45889472 | − | TSF |
| 4% | chr19 | 42222047 | 42222099 | + | ENST00000398599; ENST00000221992; ENST00000405816 | chr19 | 42233309 | 42233421 | + | TSF |
| 4% | chr19 | 42222047 | 42222099 | + | ENST00000398599; ENST00000221992; ENST00000405816 | chr19 | 42233309 | 42233421 | + | TSF |
| 4% | chr19 | 14676014 | 14676102 | + | ENST00000215567; ENST00000596073; ENST00000600083; ENST00000436007; ENST00000601187 | chr19 | 14677944 | 14677945 | + | TSF |
| 4% | chr19 | 14676014 | 14676102 | + | ENST00000215567; ENST00000596073; ENST00000600083; ENST00000436007; ENST00000601187 | chr19 | 14677944 | 14677945 | + | TSF |
| 4% | chr19 | 14676014 | 14676102 | + | ENST00000215567; ENST00000596073; ENST00000600083; ENST00000436007; ENST00000601187 | chr19 | 14677944 | 14677945 | + | TSF |
| 4% | chr19 | 14676014 | 14676102 | + | ENST00000215567; ENST00000596073; ENST00000600083; ENST00000436007; ENST00000601187 | chr19 | 14677944 | 14677945 | + | TSF |

TABLE 21-continued

Transcript fusion for Esophageal Carcinoma (ESCA) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 4% | chr19 | 45323962 | 45324032 | + | ENST00000270233 | chr19 | 45324388 | 45324391 | + | TSF |
| 4% | chr12 | 102547647 | 102547754 | + | ENST00000327680; ENST00000378128; ENST00000541394; ENST00000358383; ENST00000392911; ENST00000412715; ENST00000417507; ENST00000457614 | chr12 | 102548605 | 102548938 | + | TSF |
| 4% | chr12 | 102547647 | 102547754 | + | ENST00000327680; ENST00000378128; ENST00000541394; ENST00000358383; ENST00000392911; ENST00000412715; ENST00000417507; ENST00000457614 | chr12 | 102548605 | 102548938 | + | TSF |
| 4% | chr12 | 102547647 | 102547754 | + | ENST00000327680; ENST00000378128; ENST00000541394; ENST00000358383; ENST00000392911; ENST00000412715; ENST00000417507; ENST00000457614 | chr12 | 102548605 | 102548938 | + | TSF |
| 4% | chr12 | 102547647 | 102547754 | + | ENST00000327680; ENST00000378128; ENST00000541394; ENST00000358383; ENST00000392911; ENST00000412715; ENST00000417507; ENST00000457614 | chr12 | 102548605 | 102548938 | + | TSF |
| 4% | chr12 | 102547647 | 102547754 | + | ENST00000327680; ENST00000378128; ENST00000541394; ENST00000358383; ENST00000392911; ENST00000412715; ENST00000417507; ENST00000457614 | chr12 | 102548605 | 102548938 | + | TSF |
| 4% | chr17 | 75303223 | 75303279 | + | ENST00000427177 | chr17 | 75307415 | 75307459 | + | TSF |
| 4% | chr1 | 32696528 | 32696620 | + | ENST00000373586 | chr1 | 32696865 | 32697110 | + | TSF |
| 4% | chr22 | 36661197; 36661246 | 36661833 | + | ENST00000397278; ENST00000422706; ENST00000426053; ENST00000319136; ENST00000347595; ENST00000397279 | chr22 | 36662881 | 36662970 | + | TSF |
| 4% | chr22 | 36661197; 36661246 | 36661833 | + | ENST00000397278; ENST00000422706; ENST00000426053; ENST00000319136; ENST00000347595; ENST00000397279 | chr22 | 36662881 | 36662970 | + | TSF |
| 4% | chr22 | 36661197; 36661246 | 36661833 | + | ENST00000397278; ENST00000422706; ENST00000426053; ENST00000319136; ENST00000347595; ENST00000397279 | chr22 | 36662881 | 36662970 | + | TSF |
| 4% | chr22 | 36661197; 36661246 | 36661833 | + | ENST00000397278; ENST00000422706; ENST00000426053; ENST00000319136; ENST00000347595; ENST00000397279 | chr22 | 36662881 | 36662970 | + | TSF |
| 4% | chr22 | 36661197; 36661246 | 36661833 | + | ENST00000397278; ENST00000422706; ENST00000426053; ENST00000319136; ENST00000347595; ENST00000397279 | chr22 | 36663327 | 36663652 | + | TSF |
| 4% | chr22 | 36661197; 36661246 | 36661833 | + | ENST00000397278; ENST00000422706; ENST00000426053; ENST00000319136; ENST00000347595; ENST00000397279 | chr22 | 36663327 | 36663652 | + | TSF |
| 4% | chr22 | 36661197; 36661246 | 36661833 | + | ENST00000397278; ENST00000422706; ENST00000426053; ENST00000319136; ENST00000347595; ENST00000397279 | chr22 | 36663327 | 36663652 | + | TSF |
| 4% | chr22 | 36661197; 36661246 | 36661833 | + | ENST00000397278; ENST00000422706; ENST00000426053; ENST00000319136; ENST00000347595; ENST00000397279 | chr22 | 36663327 | 36663652 | + | TSF |
| 4% | chr14 | 54903155 | 54903087 | − | ENST00000395573; ENST00000216416; ENST00000557659; ENST00000557690; ENST00000556113 | chr14 | 54854962 | 54854914 | − | TSF |
| 4% | chr10 | 47164993 | 47164934 | − | ENST00000358140; ENST00000359178; ENST00000414655 | chr10 | 47158491 | 47158409 | − | TSF |
| 4% | chr10 | 47164993 | 47164934 | − | ENST00000358140; ENST00000359178; ENST00000414655 | chr10 | 47158491 | 47158409 | − | TSF |
| 4% | chr10 | 47164993 | 47164934 | − | ENST00000358140; ENST00000359178; ENST00000414655 | chr10 | 47158491 | 47158409 | − | TSF |
| 4% | chr1 | 152006276 | 152006124 | − | ENST00000271638 | chr1 | 152005339 | 152005310 | − | TSF |
| 4% | chr6 | 74228333 | 74228077 | − | ENST00000316292; ENST00000309268; ENST00000331523 | chr6 | 74202961 | 74202718 | − | TSF |
| 4% | chr17 | 27493958 | 27492960 | − | ENST00000354329; ENST00000533112; ENST00000531253; ENST00000527372 | chr17 | 27464102 | 27464011 | − | TSF |
| 4% | chr3 | 190030825 | 190030661 | − | ENST00000295522 | chr3 | 190030018 | 190029730 | − | TSF |
| 3% | chr16 | 89795643 | 89795726 | + | ENST00000446326; ENST00000289816; ENST00000568064; ENST00000443381 | chr16 | 89796339 | 89796374 | + | TSF |
| 3% | chr16 | 89795643 | 89795726 | + | ENST00000446326; ENST00000289816; ENST00000568064; ENST00000443381 | chr16 | 89796339 | 89796374 | + | TSF |
| 3% | chr16 | 89795643 | 89795726 | + | ENST00000446326; ENST00000289816; ENST00000568064; ENST00000443381 | chr16 | 89796339 | 89796374 | + | TSF |
| 3% | chr16 | 89795643 | 89795726 | + | ENST00000446326; ENST00000289816; ENST00000568064; ENST00000443381 | chr16 | 89796339 | 89796374 | + | TSF |
| 3% | chr16 | 68729680; 68729728 | 68729826 | + | ENST00000264012; ENST00000429102; ENST00000581171; ENST00000568292; ENST00000569080 | chr16 | 68761056 | 68761347 | + | TSF |
| 3% | chr16 | 68729680; 68729728 | 68729826 | + | ENST00000264012; ENST00000429102; ENST00000581171; ENST00000568292; ENST00000569080 | chr16 | 68761056 | 68761347 | + | TSF |

TABLE 21-continued

Transcript fusion for Esophageal Carcinoma (ESCA) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 3% | chr16 | 68729680; 68729728 | 68729826 | + | ENST00000264012; ENST00000429102; ENST00000581171; ENST00000568292; ENST00000569080 | chr16 | 68761056 | 68761347 | + | TSF |
| 3% | chr16 | 98642687; 98642769 | 68729826 | + | ENST00000264012; ENST00000429102; ENST00000581171; ENST00000568292; ENST00000569080 | chr16 | 68761056 | 68761347 | + | TSF |
| 3% | chr13 | 68729680; 68729728 | 98642791 | + | ENST00000261574; ENST00000357602; ENST00000490680; ENST00000539640; ENST00000469360 | chr13 | 98643835 | 98643958 | + | TSF |
| 3% | chr13 | 68729680; 68729728 | 98642791 | + | ENST00000261574; ENST00000357602; ENST00000490680; ENST00000539640; ENST00000469360 | chr13 | 98643835 | 98643958 | + | TSF |
| 3% | chr13 | 68729680; 68729728 | 98642791 | + | ENST00000261574; ENST00000357602; ENST00000490680; ENST00000539640; ENST00000469360 | chr13 | 98643835 | 98643958 | + | TSF |
| 3% | chr13 | 68729680; 68729728 | 98642791 | + | ENST00000261574; ENST00000357602; ENST00000490680; ENST00000539640; ENST00000469360 | chr13 | 98643835 | 98643958 | + | TSF |
| 3% | chr17 | 66040437 | 66040619 | + | ENST00000330459; ENST00000537025 | chr17 | 66040935 | 66041225 | + | TSF |
| 3% | chr10 | 47756033 | 47756092 | + | ENST00000340243; ENST00000374277; ENST00000538825 | chr10 | 47762533 | 47762615 | + | TSF |
| 3% | chr10 | 47756033 | 47756092 | + | ENST00000340243; ENST00000374277; ENST00000538825 | chr10 | 47762533 | 47762615 | + | TSF |
| 3% | chr10 | 47756033 | 47756092 | + | ENST00000340243; ENST00000374277; ENST00000538825 | chr10 | 47762533 | 47762615 | + | TSF |
| 3% | chr4 | 57319769 | 57319927 | + | ENST00000514888; ENST00000264221; ENST00000505164; ENST00000399688; ENST00000512576 | chr4 | 57321183 | 57321327 | + | TSF |
| 3% | chr4 | 57319769 | 57319927 | + | ENST00000514888; ENST00000264221; ENST00000505164; ENST00000399688; ENST00000512576 | chr4 | 57321183 | 57321327 | + | TSF |
| 3% | chr4 | 57319769 | 57319927 | + | ENST00000514888; ENST00000264221; ENST00000505164; ENST00000399688; ENST00000512576 | chr4 | 57321183 | 57321327 | + | TSF |
| 3% | chr20 | 62328681 | 62328875 | + | ENST00000369996 | chr20 | 62334477 | 62334522 | + | TSF |
| 3% | chr17 | 16012226 | 16012100 | − | ENST00000268712; ENST00000395851; ENST00000395848 | chr17 | 16009741 | 16009580 | − | TSF |
| 3% | chr17 | 16012226 | 16012100 | − | ENST00000268712; ENST00000395851; ENST00000395848 | chr17 | 16009741 | 16009580 | − | TSF |
| 3% | chr1 | 63955889 | 63955754 | − | ENST00000371092; ENST00000271002; SENST00000489099; ENT00000283568 | chr1 | 63952444 | 63951983 | − | TSF |
| 3% | chr1 | 63955889 | 63955754 | − | ENST00000371092; ENST00000271002; SENST00000489099; ENT00000283568 | chr1 | 63952444 | 63951983 | − | TSF |
| 3% | chr17 | 79912179 | 79912132 | − | ENST00000409678 | chr17 | 79911834 | 79911647 | − | TSF |
| 3% | chr14 | 106208132 | 106207921 | − | ENST00000390548; ENST00000390549; ENST00000390542 | chr14 | 106043673 | 106043390 | − | TSF |
| 3% | chr14 | 106208132 | 106207921 | − | ENST00000390548; ENST00000390549; ENST00000390542 | chr14 | 106043673 | 106043390 | − | TSF |
| 3% | chr12 | 111803370 | 111803368 | − | ENST00000361483 | chr12 | 111803267 | 111803247 | − | TSF |
| 3% | chr19 | 46627413 | 46627143 | − | ENST00000341415 | chr19 | 46623577 | 46622963 | − | TSF |
| 3% | chr7 | 98741403 | 98741349 | − | ENST00000361368; ENST00000361125 | chr7 | 98680363 | 98679576 | − | TSF |

TABLE 22

Transcript fusion for Esophageal Carcinoma (ESCA) Coordinates of the fusion sequences for which the donor is the TE.

| 1 | 2' | 3' | 4 | 5' | 6' | 7 | 8' | 9' | 10' | 11' |
|---|---|---|---|---|---|---|---|---|---|---|
| 62% | chr7 | 116364854 | 116364901 | + | chr7 | 116371722 | 116371913 | + | ENST00000397752; ENST00000318493; ENST00000436117 | TAF |
| 62% | chr7 | 116364854 | 116364901 | + | chr7 | 116371722 | 116371913 | + | ENST00000397752; ENST00000318493; ENST00000436117 | TAF |
| 62% | chr7 | 116364854 | 116364901 | + | chr7 | 116371722 | 116371913 | + | ENST00000397752; ENST00000318493; ENST00000436117 | TAF |
| 52% | chr7 | 56018506 | 56018522 | + | chr7 | 56020872 | 56021011 | + | ENST00000426595 | TSF |
| 48% | chr11 | 93468219 | 93468129 | − | chr11 | 93467826 | 93467791; 93467814 | − | ENST00000393259; ENST00000527169 | TAF |
| 48% | chr11 | 93468219 | 93468129 | − | chr11 | 93467826 | 93467791; 93467814 | − | ENST00000393259; ENST00000527169 | TAF |

TABLE 22-continued

Transcript fusion for Esophageal Carcinoma (ESCA) Coordinates of the fusion sequences for which the donor is the TE.

| 1 | 2' | 3' | 4 | 5' | 6' | 7 | 8' | 9' | 10' | 11' |
|---|---|---|---|---|---|---|---|---|---|---|
| 47% | chr17 | 75318693 | 75318752 | + | chr17 | 75398141 | 75398484; 75398785; 75398497; 75398565 | + | ENST00000589070; ENST00000427177; ENST00000591198; ENST00000329047; ENST00000590294; ENST00000591934; ENST00000423034; ENST00000589140 | TAF |
| 47% | chr17 | 75318693 | 75318752 | + | chr17 | 75398141 | 75398484; 75398785; 75398497; 75398565 | + | ENST00000589070; ENST00000427177; ENST00000591198; ENST00000329047; ENST00000590294; ENST00000591934; ENST00000423034; ENST00000589140 | TAF |
| 47% | chr17 | 75318693 | 75318752 | + | chr17 | 75398141 | 75398484; 75398785; 75398497; 75398565 | + | ENST00000589070; ENST00000427177; ENST00000591198; ENST00000329047; ENST00000590294; ENST00000591934; ENST00000423034; ENST00000589140 | TAF |
| 47% | chr17 | 75318693 | 75318752 | + | chr17 | 75398141 | 75398484; 75398785; 75398497; 75398565 | + | ENST00000589070; ENST00000427177; ENST00000591198; ENST00000329047; ENST00000590294; ENST00000591934; ENST00000423034; ENST00000589140 | TAF |
| 41% | chr4 | 39699858 | 39699922 | + | chr4 | 39739040 | 39739133 | + | ENST00000261427; ENST00000510934; ENST00000295963; ENST00000445950 | TAF |
| 41% | chr4 | 39699858 | 39699922 | + | chr4 | 39739040 | 39739133 | + | ENST00000261427; ENST00000510934; ENST00000295963; ENST00000445950 | TAF |
| 41% | chr4 | 39699858 | 39699922 | + | chr4 | 39739040 | 39739133 | + | ENST00000261427; ENST00000510934; ENST00000295963; ENST00000445950 | TAF |
| 41% | chr4 | 39699858 | 39699922 | + | chr4 | 39739040 | 39739133 | + | ENST00000261427; ENST00000510934; ENST00000295963; ENST00000445950 | TAF |
| 41% | chr3 | 185411133 | 185410965 | − | chr3 | 185410550 | 185410487 | − | ENST00000382199; ENST00000421047; ENST00000457616; ENST00000346192 | TAF |
| 41% | chr3 | 185411133 | 185410965 | − | chr3 | 185410550 | 185410487 | − | ENST00000382199; ENST00000421047; ENST00000457616; ENST00000346192 | TAF |
| 40% | chr9 | 100872455 | 100872351 | − | chr9 | 100872266 | 100872171 | − | ENST00000375098; ENST0000034 ENST000003420431469; | TAF |
| 39% | chr3 | 128359904 | 128359849 | − | chr3 | 128356948 | 128356642 | − | ENST0000296255 | TAF |
| 38% | chr12 | 64687157 | 64687061 | − | chr12 | 64679840 | 64679734 | − | ENST00000543942; ENST00000333722 | TAF |
| 37% | chr10 | 5826921 | 5825287 | − | chr10 | 5815904 | 5815805 | − | ENST00000380191; ENST00000447751; ENST00000380132; ENST00000380181; ENST00000456041 | TAF |
| 37% | chr10 | 5826921 | 5825287 | − | chr10 | 5815904 | 5815805 | − | ENST00000380191; ENST00000447751; ENST00000380132; ENST00000380181; ENST00000456041 | TAF |
| 37% | chr10 | 5826921 | 5825287 | − | chr10 | 5815904 | 5815805 | − | ENST00000380191; ENST00000447751; ENST00000380132; ENST00000380181; ENST00000456041 | TAF |
| 36% | chr3 | 47700203 | 47700048 | − | chr3 | 47680270 | 47680215 | − | ENST00000254480 | TAF |
| 35% | chr4 | 39585332 | 39585284 | − | chr4 | 39459881 | 39459814 | − | ENST00000295955; ENST00000449470; ENST00000508595; ENST00000503040; ENST00000504470 | TSF |
| 35% | chr4 | 39585332 | 39585284 | − | chr4 | 39459881 | 39459814 | − | ENST00000295955; ENST00000449470; ENST00000508595; ENST00000503040; ENST00000504470 | TSF |
| 35% | chr4 | 39585332 | 39585284 | − | chr4 | 39459881 | 39459814 | − | ENST00000295955; ENST00000449470; ENST00000508595; ENST00000503040; ENST00000504470 | TSF |
| 35% | chr2 | 38983894 | 38983253 | − | chr2 | 38977336 | 38977156 | − | ENST00000313117; ENST00000425778; ENST00000425941; ENST00000446327; ENST00000409276; ENST00000431066; ENST00000443213 | TSF |
| 35% | chr2 | 38983894 | 38983253 | − | chr2 | 38977336 | 38977156 | − | ENST00000313117; ENST00000425778; ENST00000425941; ENST00000446327; ENST00000409276; ENST00000431066; ENST00000443213 | TSF |
| 35% | chr2 | 38983894 | 38983253 | − | chr2 | 38977336 | 38977156 | − | ENST00000313117; ENST00000425778; ENST00000425941; ENST00000446327; ENST00000409276; ENST00000431066; ENST00000443213 | TSF |
| 35% | chr2 | 38983894 | 38983253 | − | chr2 | 38977336 | 38977156 | − | ENST00000313117; ENST00000425778; ENST00000425941; ENST00000446327; ENST00000409276; ENST00000431066; ENST00000443213 | TSF |
| 35% | chr2 | 38983894 | 38983253 | − | chr2 | 38977336 | 38977156 | − | ENST00000313117; ENST00000425778; ENST00000425941; ENST00000446327; ENST00000409276; ENST00000431066; ENST00000443213 | TSF |
| 32% | chr17 | 30771499 | 30771536 | + | chr17 | 30773963 | 30774064 | + | ENST00000261712; ENST00000457654; ENST00000579451 | TAF |
| 32% | chr17 | 30771499 | 30771536 | + | chr17 | 30773963 | 30774064 | + | ENST00000261712; ENST00000457654; ENST00000579451 | TAF |

TABLE 22-continued

Transcript fusion for Esophageal Carcinoma (ESCA) Coordinates of the fusion sequences for which the donor is the TE.

| 1 | 2' | 3 | 4 | 5' | 6' | 7 | 8' | 9' | 10' | 11' |
|---|---|---|---|---|---|---|---|---|---|---|
| 30% | chr19 | 56187371 | 56187420 | 1 | chr19 | 56189893 | 56190221 | + | ENST00000411543 | TAF |
| 29% | chr5 | 76107394 | 76108135 | + | chr5 | 76128515 | 76129626 | + | ENST00000296677 | TSF |
| 28% | chr21 | 42597177 | 42597622 | + | chr21 | 42598193 | 42598281 | + | ENST00000328735; ENST00000330333; ENST00000347667 | TAF |
| 28% | chr21 | 42597177 | 42597622 | + | chr21 | 42598193 | 42598281 | + | ENST00000328735; ENST00000330333; ENST00000347667 | TAF |
| 28% | chr21 | 42597177 | 42597622 | + | chr21 | 42598193 | 42598281 | + | ENST00000328735; ENST00000330333; ENST00000347667 | TAF |
| 28% | chr17 | 74261446 | 74261484 | + | chr17 | 74261988 | 74262050 | + | ENST00000327490 | TAF |
| 28% | chr12 | 122430912 | 122431615 | + | chr12 | 122437622 | 122437850 | + | ENST00000288912 | TAF |
| 28% | chr2 | 38983894 | 38983132 | − | chr2 | 38977336 | 38977156 | − | ENST00000313117; ENST00000425778; ENST00000425941; ENST00000446327; ENST00000409276; ENST00000431066; ENST00000443213 | TAF |
| 28% | chr2 | 38983894 | 38983132 | − | chr2 | 38977336 | 38977156 | − | ENST00000313117; ENST00000425778; ENST00000425941; ENST00000446327; ENST00000409276; ENST00000431066; ENST00000443213 | TAF |
| 28% | chr2 | 38983894 | 38983132 | − | chr2 | 38977336 | 38977156 | − | ENST00000313117; ENST00000425778; ENST00000425941; ENST00000446327; ENST00000409276; ENST00000431066; ENST00000443213 | TAF |
| 28% | chr2 | 38983894 | 38983132 | − | chr2 | 38977336 | 38977156 | − | ENST00000313117; ENST00000425778; ENST00000425941; ENST00000446327; ENST00000409276; ENST00000431066; ENST00000443213 | TAF |
| 28% | chr2 | 38983894 | 38983132 | − | chr2 | 38977336 | 38977156 | − | ENST00000313117; ENST00000425778; ENST00000425941; ENST00000446327; ENST00000409276; ENST00000431066; ENST00000443213 | TAF |
| 28% | chr12 | 123873690 | 123873729 | + | chr12 | 123873980 | 123874101 | + | ENST00000330479; ENST00000402868 | TSF |
| 27% | chr5 | 823586 | 823504 | − | chr5 | 822010 | 821976 | − | ENST00000424784; ENST00000283441 | TAF |
| 27% | chr11 | 70006969 | 70007088 | + | chr11 | 70007267 | 70007468 | + | ENST00000355303; ENST00000398543; ENST00000538023; ENST00000316296; ENST00000530676; ENST00000531349; ENST00000531300 | TSF |
| 27% | chr11 | 70006969 | 70007088 | + | chr11 | 70007267 | 70007468 | + | ENST00000355303; ENST00000398543; ENST00000538023; ENST00000316296; ENST00000530676; ENST00000531349; ENST00000531300 | TSF |
| 27% | chr11 | 70006969 | 70007088 | + | chr11 | 70007267 | 70007468 | + | ENST00000355303; ENST00000398543; ENST00000538023; ENST00000316296; ENST00000530676; ENST00000531349; ENST00000531300 | TSF |
| 25% | chr12 | 122387836 | 122388242 | + | chr12 | 122389386 | 122389436 | + | ENST00000288912; ENST00000397454 | TSF |
| 25% | chr12 | 122387836 | 122388242 | + | chr12 | 122389386 | 122389436 | + | ENST00000288912; ENST00000397454 | TSF |
| 24% | chr2 | 9737072 | 9736908 | − | chr2 | 9731644 | 9731521 | − | ENST00000381844; ENST00000238081; ENST00000446619 | TAF |
| 24% | chr2 | 9737072 | 9736908 | − | chr2 | 9731644 | 9731521 | − | ENST00000381844; ENST00000238081; ENST00000446619 | TAF |
| 24% | chr16 | 23118718 | 23118652 | − | chr16 | 23117808 | 23117720 | − | ENST00000219689 | TAF |
| 23% | chr22 | 37419605 | 37419606 | + | chr22 | 37420233 | 37420851 | + | ENST00000397129 | TAF |
| 23% | chr16 | 603045 | 603077 | + | chr16 | 603343 | 603516 | + | ENST00000219611 | TAF |
| 23% | chr16 | 603045 | 603138 | + | chr16 | 603343 | 603516 | + | ENST00000219611 | TAF |
| 23% | chr5 | 76107394 | 76108212 | + | chr5 | 76128515 | 76129626 | + | ENST00000296677 | TSF |
| 23% | chr10 | 89682344 | 89682384 | + | chr10 | 89685270 | 89685314 | + | ENST00000371953 | TSF |
| 22% | chr15 | 43889497 | 43889601 | + | chr15 | 43890391 | 43890525 | + | ENST00000300283; ENST00000441322 | TAF |
| 22% | chr5 | 10732874 | 10732658 | − | chr5 | 10683683 | 10683641 | − | ENST00000230895 | TAF |
| 22% | chr17 | 78344149 | 78344187 | + | chr17 | 78345674 | 78345785 | + | ENST00000508628; ENST00000582970; ENST00000336301 | TSF |
| 22% | chr1 | 44446234 | 44446286 | + | chr1 | 44446781 | 44447145 | + | ENST00000309519 | TSF |
| 21% | chr20 | 35844460 | 35844528 | + | chr20 | 35852281 | 35852372 | + | ENST00000237530; ENST00000373622 | TSF |
| 21% | chr20 | 35844460 | 35844528 | + | chr20 | 35852281 | 35852372 | + | ENST00000237530; ENST00000373622 | TAF |
| 21% | chr12 | 122387836 | 122388242 | + | chr12 | 122392026 | 122392240 | + | ENST00000288912; ENST00000397454 | TSF |
| 21% | chr12 | 122387836 | 122388242 | + | chr12 | 122392026 | 122392240 | + | ENST00000288912; ENST00000397454 | TSF |
| 20% | chr12 | 6602868 | 6602840 | − | chr12 | 6602138 | 6602028 | | ENST00000229238 | TAF |
| 20% | chr13 | 98628730 | 98628756 | + | chr13 | 98628947 | 98629040; 98629046 | + | ENST00000460070; ENST00000481455; ENST00000261574; ENST00000493281; ENST00000490369; ENST00000463157; ENST00000489058; ENST00000481689; ENST00000480611; ENST00000485433; ENST00000496368; ENST00000421861 | TAF |
| 20% | chr13 | 98628730 | 98628756 | + | chr13 | 98628947 | 98629040; 98629046 | + | ENST00000460070; ENST00000481455; ENST00000261574; ENST00000493281; ENST00000490369; ENST00000463157; | TAF |

TABLE 22-continued

Transcript fusion for Esophageal Carcinoma (ESCA) Coordinates of the fusion sequences for which the donor is the TE.

| 1 | 2' | 3' | 4 | 5' | 6' | 7 | 8' | 9' | 10' | 11' |
|---|---|---|---|---|---|---|---|---|---|---|
| | 20% | chr13 | 98628730 | 98628756 | + | chr13 | 98628947 | 98629040; 98629046 | + | ENST00000489058; ENST00000481689; ENST00000480611; ENST00000485433; ENST00000496368; ENST00000421861 ENST00000460070; ENST00000481455; ENST00000261574; ENST00000493281; ENST00000490369; ENST00000463157; ENST00000489058; ENST00000481689; ENST00000480611; ENST00000485433; ENST00000496368; ENST00000421861 | TAF |
| | 20% | chr13 | 98628730 | 98628756 | + | chr13 | 98628947 | 98629040; 98629046 | + | ENST00000460070; ENST00000481455; ENST00000261574; ENST00000493281; ENST00000490369; ENST00000463157; ENST00000489058; ENST00000481689; ENST00000480611; ENST00000485433; ENST00000496368; ENST00000421861 | TAF |
| | 20% | chr13 | 98628730 | 98628756 | + | chr13 | 98628947 | 98629040; 98629046 | + | ENST00000460070; ENST00000481455; ENST00000261574; ENST00000493281; ENST00000490369; ENST00000463157; ENST00000489058; ENST00000481689; ENST00000480611; ENST00000485433; ENST00000496368; ENST00000421861 | TAF |
| | 20% | chr13 | 98628730 | 98628756 | + | chr13 | 98628947 | 98629040; 98629046 | + | ENST00000460070; ENST00000481455; ENST00000261574; ENST00000493281; ENST00000490369; ENST00000463157; ENST00000489058; ENST00000481689; ENST00000480611; ENST00000485433; ENST00000496368; ENST00000421861 | TAF |
| | 20% | chr13 | 98628730 | 98628756 | + | chr13 | 98628947 | 98629040; 98629046 | + | ENST00000460070; ENST00000481455; ENST00000261574; ENST00000493281; ENST00000490369; ENST00000463157; ENST00000489058; ENST00000481689; ENST00000480611; ENST00000485433; ENST00000496368; ENST00000421861 | TAF |
| | 20% | chr13 | 98628730 | 98628756 | + | chr13 | 98628947 | 98629040; 98629046 | + | ENST00000460070; ENST00000481455; ENST00000261574; ENST00000493281; ENST00000490369; ENST00000463157; ENST00000489058; ENST00000481689; ENST00000480611; ENST00000485433; ENST00000496368; ENST00000421861 | TAF |
| | 20% | chr13 | 98628730 | 98628756 | + | chr13 | 98628947 | 98629040; 98629046 | + | ENST00000460070; ENST00000481455; ENST00000261574; ENST00000493281; ENST00000490369; ENST00000463157; ENST00000489058; ENST00000481689; ENST00000480611; ENST00000485433; ENST00000496368; ENST00000421861 | TAF |
| | 20% | chr13 | 98628730 | 98628756 | + | chr13 | 98628947 | 98629040; 98629046 | + | ENST00000460070; ENST00000481455; ENST00000261574; ENST00000493281; ENST00000490369; ENST00000463157; ENST00000489058; ENST00000481689; ENST00000480611; ENST00000485433; ENST00000496368; ENST00000421861 | TAF |
| | 20% | chr13 | 98628730 | 98628756 | + | chr13 | 98628947 | 98629040; 98629046 | + | ENST00000460070; ENST00000481455; ENST00000261574; ENST00000493281; ENST00000490369; ENST00000463157; ENST00000489058; ENST00000481689; ENST00000480611; ENST00000485433; ENST00000496368; ENST00000421861 | TAF |
| | 20% | chr13 | 98628730 | 98628756 | + | chr13 | 98628947 | 98629040; 98629046 | + | ENST00000460070; ENST00000481455; ENST00000261574; ENST00000493281; ENST00000490369; ENST00000463157; ENST00000489058; ENST00000481689; ENST00000480611; ENST00000485433; ENST00000496368; ENST00000421861 | TAF |
| | 20% | chr3 | 146238022 | 146237953 | − | chr3 | 146234954 | 146234793; 146234876; 146234936; 146234945 | − | ENST00000342435; ENST00000487389; ENST00000448787; ENST00000483300; ENST00000462666; ENST00000486631; ENST00000472349 | TAF |
| | 20% | chr3 | 146238022 | 146237953 | − | chr3 | 146234954 | 146234793; 146234876; 146234936; 146234945 | − | ENST00000342435; ENST00000487389; ENST00000448787; ENST00000483300; ENST00000462666; ENST00000486631; ENST00000472349 | TAF |
| | 20% | chr3 | 146238022 | 146237953 | − | chr3 | 146234954 | 146234793; 146234876; 146234936; 146234945 | − | ENST00000342435; ENST00000487389; ENST00000448787; ENST00000483300; ENST00000462666; ENST00000486631; ENST00000472349 | TAF |

TABLE 22-continued

Transcript fusion for Esophageal Carcinoma (ESCA) Coordinates of the fusion sequences for which the donor is the TE.

| 1 | 2' | 3' | 4 | 5' | 6' | 7 | 8' | 9' | 10' | 11' |
|---|---|---|---|---|---|---|---|---|---|---|
| 20% | chr3 | 146238022 | 146237953 | − | chr3 | 146234954 | 146234793; 146234876; 146234936; 146234945 | − | ENST00000342435; ENST00000487389; ENST00000448787; ENST00000483300; ENST00000462666; ENST00000486631; ENST00000472349 | TAF |
| 20% | chr3 | 146238022 | 146237953 | − | chr3 | 146234954 | 146234793; 146234876; 146234936; 146234945 | − | ENST00000342435; ENST00000487389; ENST00000448787; ENST00000483300; ENST00000462666; ENST00000486631; ENST00000472349 | TAF |
| 19% | chr15 | 41968651 | 41968463 | − | chr15 | 41815513 | 41815443 | − | ENST00000561603; ENST00000304330; ENST00000562303 | TAF |
| 19% | chr15 | 41968651 | 41968463 | − | chr15 | 41815513 | 41815443 | − | ENST00000561603; ENST00000304330; ENST00000562303 | TAF |
| 19% | chr15 | 41968651 | 41968463 | − | chr15 | 41815513 | 41815443 | − | ENST00000561603; ENST00000304330; ENST00000562303 | TAF |
| 18% | chr5 | 135398466 | 135398602 | + | chr5 | 135398875 | 135398915; 135398898 | + | ENST00000442011; ENST00000305126; ENST00000514554; ENST00000508076; ENST00000503087 | TAF |
| 18% | chr5 | 135398466 | 135398602 | + | chr5 | 135398875 | 135398915; 135398898 | + | ENST00000442011; ENST00000305126; ENST00000514554; ENST00000508076; ENST00000503087 | TAF |
| 18% | chr19 | 48240207 | 48240273 | + | chr19 | 48244138 | 48244689 | + | ENST00000263277; ENST00000538399 | TAF |
| 18% | chr11 | 87906665 | 87906580 | − | chr11 | 87883123 | 87882843 | − | ENST00000243662; ENST00000526372 | TAF |
| 18% | chr19 | 55562151 | 55562068 | − | chr19 | 55560131 | 55560027 | − | ENST00000415061; ENST00000291892; ENST00000396247; ENST00000592573 | TAF |
| 18% | chr19 | 55562151 | 55562068 | − | chr19 | 55560131 | 55560027 | − | ENST00000415061; ENST00000291892; ENST00000396247; ENST00000592573 | TAF |
| 18% | chr6 | 138423138 | 138423021 | − | chr6 | 138417631 | 138417491 | − | ENST00000421351 | TAF |
| 18% | chr9 | 119603649 | 119602892 | − | chr9 | 119583062 | 119582896 | − | ENST00000373996; ENST00000313400; ENST00000373986; ENST00000361209 | TAF |
| 18% | chr22 | 21972574 | 21972670 | + | chr22 | 21975804 | 21975958 | + | ENST00000458578; ENST00000342192; ENST00000545681 | TSF |
| 17% | chr10 | 5077666 | 5077808 | + | chr10 | 5138602 | 5138769 | + | ENST00000602997; ENST00000605149; ENST00000380554 | TAF |
| 17% | chr10 | 5077666 | 5077808 | + | chr10 | 5138602 | 5138769 | + | ENST00000602997; ENST00000605149; ENST00000380554 | TAF |
| 17% | chr5 | 175826144 | 175825958 | − | chr5 | 175825048 | 175824931; 175824945 | − | ENST00000310418; ENST00000345807; ENST00000508425 | TAF |
| 17% | chr5 | 175826144 | 175825958 | − | chr5 | 175825048 | 175824931; 175824945 | − | ENST00000310418; ENST00000345807; ENST00000508425 | TAF |
| 17% | chr5 | 175826144 | 175825958 | − | chr5 | 175825048 | 175824931; 175824945 | − | ENST00000310418; ENST00000345807; ENST00000508425 | TAF |
| 17% | chr1 | 159014388 | 159014421 | + | chr1 | 159015087 | 159015254 | + | ENST00000368131; ENST00000295809; ENST00000359709; ENST00000430894 | TAF |
| 17% | chr1 | 159014388 | 159014421 | + | chr1 | 159015087 | 159015254 | + | ENST00000368131; ENST00000295809; ENST00000359709; ENST00000430894 | TAF |
| 17% | chr8 | 82194688 | 82194727 | + | chr8 | 82195601 | 82195773 | + | ENST00000297258 | TAF |
| 17% | chr2 | 24544896 | 24544683 | − | chr2 | 24538093 | 24538001 | − | ENST00000361999; ENST00000355123; ENST00000406921; ENST00000412011 | TAF |
| 17% | chr2 | 24544896 | 24544683 | − | chr2 | 24538093 | 24538001 | − | ENST00000361999; ENST00000355123; ENST00000406921; ENST00000412011 | TAF |
| 17% | chr2 | 24544896 | 24544683 | − | chr2 | 24538093 | 24538001 | − | ENST00000361999; ENST00000355123; ENST00000406921; ENST00000412011 | TAF |
| 17% | chr2 | 24544896 | 24544683 | − | chr2 | 24538093 | 24538001 | − | ENST00000361999; ENST00000355123; ENST00000406921; ENST00000412011 | TAF |
| 17% | chr15 | 66170740 | 66170790 | + | chr15 | 66172009 | 66172089; 66172017 | + | ENST00000564910; ENST00000261890; ENST00000569896; ENST000 00567671 | TSF |
| 17% | chr15 | 66170740 | 66170790 | + | chr15 | 66172009 | 66172089; 66172017 | + | ENST00000564910; ENST00000261890; ENST00000569896; ENST00000567671 | TSF |
| 17% | chr15 | 66170740 | 66170790 | + | chr15 | 66172009 | 66172089; 66172017 | + | ENST00000564910; ENST00000261890; ENST00000569896; ENST00000567671 | TSF |
| 17% | chr14 | 105172936 | 105173038 | + | chr14 | 105173247 | 105173388 | + | ENST00000330634; ENST00000392634 | TSF |
| 17% | chr14 | 105172936 | 105173038 | + | chr14 | 105173247 | 105173388 | + | ENST00000330634; ENST00000392634 | TSF |
| 17% | chr19 | 2141057 | 2140989 | − | chr19 | 2138713 | 2138618 | − | ENST00000355272; ENST00000356926; ENST00000350812; ENST00000345016 | TSF |
| 17% | chr19 | 2141057 | 2140989 | − | chr19 | 2138713 | 2138618 | − | ENST00000355272; ENST00000356926; ENST00000350812; ENST00000345016 | TSF |
| 17% | chr19 | 2141057 | 2140989 | − | chr19 | 2138713 | 2138618 | − | ENST00000355272; ENST00000356926; ENST00000350812; ENST000 00345016 | TSF |
| 17% | chr19 | 2141057 | 2140989 | − | chr19 | 2138713 | 2138618 | − | ENST00000355272; ENST00000356926; ENST00000350812; ENST00000345016 | TSF |
| 16% | chr1 | 159014388 | 159014421 | + | chr1 | 159019222 | 159019389 | + | ENST00000368132; ENST00000295809; ENST00000359709; ENST00000430894 | TAF |
| 16% | chr4 | 15791827 | 15792541 | + | chr4 | 15818134 | 15818263 | + | ENST00000502843; ENST00000226279 | TAF |
| 16% | chr4 | 15791827 | 15792541 | + | chr4 | 15818134 | 15818263 | + | ENST00000502843; ENST00000226279 | TAF |
| 16% | chr15 | 43989318 | 43989422 | + | chr15 | 43990212 | 43990346 | + | ENST00000434505; ENST00000413453 | TAF |

TABLE 22-continued

Transcript fusion for Esophageal Carcinoma (ESCA) Coordinates of the fusion sequences for which the donor is the TE.

| 1 | 2' | 3 | 4 | 5' | 6' | 7 | 8' | 9' | 10' | 11' |
|---|---|---|---|---|---|---|---|---|---|---|
| 16% | chr2 | 242174499 | 242174421 | − | chr2 | 242173378 | 242173235; 242173268 | − | ENST00000391975; ENST00000391976; ENST00000310931; ENST00000427183; ENST00000373292 | TAF |
| 16% | chr2 | 242174499 | 242174421 | − | chr2 | 242173378 | 242173235; 242173268 | − | ENST00000391975; ENST00000391976; ENST00000310931; ENST00000427183; ENST00000373292 | TAF |
| 16% | chr3 | 141642131 | 141642345 | + | chr3 | 141644373 | 141644543 | + | ENST00000286371; ENST00000462082 | TAF |
| 16% | chr12 | 21011867 | 21011909 | + | chr12 | 21013951 | 21014072 | + | ENST00000540853; ENST00000261196; ENST00000381545; ENST00000540229; ENST00000553473 | TAF |
| 16% | chr12 | 21011867 | 21011909 | + | chr12 | 21013951 | 21014072 | + | ENST00000540853; ENST00000261196; ENST00000381545; ENST00000540229; ENST00000553473 | TAF |
| 16% | chr12 | 21011867 | 21011909 | + | chr12 | 21013951 | 21014072 | + | ENST00000540853; ENST00000261196; ENST00000381545; ENST00000540229; ENST00000553473 | TAF |
| 16% | chr19 | 35995931 | 35995843 | − | chr19 | 35994349 | 35994323; 35994334 | − | ENST00000474928; ENST00000488892; ENST00000461300; ENST00000447113; ENST00000392206; ENST00000440396; ENST00000458071; ENST00000418261; ENST00000424570; ENST00000451297; ENST00000450261 | TAF |
| 16% | chr19 | 35995931 | 35995843 | − | chr19 | 35994349 | 35994323; 35994334 | − | ENST00000474928; ENST00000488892; ENST00000461300; ENST00000447113; ENST00000392206; ENST00000440396; ENST00000458071; ENST00000418261; ENST00000424570; ENST00000451297; ENST00000450261 | TAF |
| 16% | chr13 | 99121170 | 99121063 | − | chr13 | 99118815 | 99118630 | − | ENST00000376554; ENST00000397517; ENST00000376547; ENST00000539966; ENST00000444574 | TAF |
| 16% | chr13 | 99121170 | 99121063 | − | chr13 | 99118815 | 99118630 | − | ENST00000376554; ENST00000397517; ENST00000376547; ENST00000539966; ENST00000444574 | TAF |
| 16% | chr13 | 99121170 | 99121063 | − | chr13 | 99118815 | 99118630 | − | ENST00000376554; ENST00000397517; ENST00000376547; ENST00000539966; ENST00000444574 | TAF |
| 16% | chr9 | 117824597 | 117824593 | − | chr9 | 117822281 | 117822009 | − | ENST00000350763; ENST00000341037; ENST00000423613 | TSF |
| 16% | chr9 | 117824597 | 117824593 | − | chr9 | 117822281 | 117822009 | − | ENST00000350763; ENST00000341037; ENST00000423613 | TSF |
| 16% | chr9 | 117824597 | 117824593 | − | chr9 | 117822281 | 117822009 | − | ENST00000350763; ENST00000341037; ENST00000423613 | TSF |
| 15% | chr19 | 55559415 | 55559414 | − | chr19 | 55558856 | 55558755 | − | ENST00000415061; ENST00000396247 | TAF |
| 15% | chr11 | 752380 | 752481 | + | chr11 | 755879 | 756002 | + | ENST00000319006; ENST00000528097; ENST00000530440 | TAF |
| 15% | chr11 | 752380 | 752481 | + | chr11 | 755879 | 756002 | + | ENST00000319006; ENST00000528097; ENST00000530440 | TAF |
| 15% | chr11 | 752380 | 752481 | + | chr11 | 755879 | 756002 | + | ENST00000319006; ENST00000528097; ENST00000530440 | TAF |
| 15% | chr19 | 1600051 | 1599987 | − | chr19 | 1599559 | 1599439 | − | ENST00000585937; ENST00000591899; ENST00000589880; ENST00000585671 | TAF |
| 15% | chr14 | 65406849 | 65406835 | − | chr14 | 65406556 | 65406206 | − | ENST00000389614; ENST00000557049 | TAF |
| 15% | chr10 | 105819324 | 105819196 | − | chr10 | 105817948 | 105817904 | − | ENST00000353479; ENST00000369733 | TSF |
| 15% | chr10 | 105819324 | 105819196 | − | chr10 | 105817948 | 105817904 | − | ENST00000353479; ENST00000369733 | TSF |
| 15% | chr17 | 65894489 | 65894534 | + | chr17 | 65899905 | 65900034 | + | ENST00000544778; ENST00000321892; ENST00000335221; ENST00000306378; ENST00000424123 | TSF |
| 15% | chr17 | 65894489 | 65894534 | + | chr17 | 65899905 | 65900034 | + | ENST00000544778; ENST00000321892; ENST00000335221; ENST00000306378; ENST00000424123 | TSF |
| 15% | chr17 | 65894489 | 65894534 | + | chr17 | 65899905 | 65900034 | + | ENST00000544778; ENST00000321892; ENST00000335221; ENST00000306378; ENST00000424123 | TSF |
| 14% | chr19 | 16267516 | 16267566 | + | chr19 | 16268020 | 16268208; 16268205; 16268448; 16268139 | + | ENST00000253680; ENST00000397372; ENST00000593154; ENST00000588246; ENST00000593031 | TAF |
| 14% | chr19 | 16267516 | 16267566 | + | chr19 | 16268020 | 16268208; 16268205; 16268448; 16268139 | + | ENST00000253680; ENST00000397372; ENST00000593154; ENST00000588246; ENST00000593031 | TAF |

TABLE 22-continued

Transcript fusion for Esophageal Carcinoma (ESCA) Coordinates of the fusion sequences for which the donor is the TE.

| 1 | 2' | 3' | 4 | 5' | 6' | 7 | 8' | 9' | 10' | 11' |
|---|---|---|---|---|---|---|---|---|---|---|
| 14% | chr19 | 16267516 | 16267566 | + | chr19 | 16268020 | 16268208; 16268205; 16268448; 16268139 | + | ENST00000253680; ENST00000397372; ENST00000593154; ENST00000588246; ENST00000593031 | TAF |
| 14% | chr19 | 16267516 | 16267566 | + | chr19 | 16268020 | 16268208; 16268205; 16268448; 16268139 | + | ENST00000253680; ENST00000397372; ENST00000593154; ENST00000588246; ENST00000593031 | TAF |
| 14% | chr13 | 43628887 | 43629679 | + | chr13 | 43639822 | 43639873 | + | ENST00000379221 | TAF |
| 14% | chr1 | 27430428 | 27430228 | − | chr1 | 27429803 | 27429714 | − | ENST00000263980; ENST00000545949 | TAF |
| 14% | chr5 | 148909179 | 148909167 | − | chr5 | 148904734 | 148904608 | − | ENST00000261798; ENST00000377843; ENST00000515768 | TAF |
| 14% | chr5 | 148909179 | 148909167 | − | chr5 | 148904734 | 148904608 | − | ENST00000261798; ENST00000377843; ENST00000515768 | TAF |
| 14% | chr5 | 148909179 | 148909167 | − | chr5 | 148904734 | 148904608 | − | ENST00000261798; ENST00000377843; ENST00000515768 | TAF |
| 14% | chr1 | 6380703 | 6380649 | − | chr1 | 6378638 | 6378552 | − | ENST00000608083; ENST00000377842; ENST00000377845; ENST00000377855; ENST00000377860; ENST00000418124; ENST00000545482; ENST00000361521; ENST00000473466; ENST00000541130 | TAF |
| 14% | chr1 | 6380703 | 6380649 | − | chr1 | 6378638 | 6378552 | − | ENST00000608083; ENST00000377842; ENST00000377845; ENST00000377855; ENST00000377860; ENST00000418124; ENST00000545482; ENST00000361521; ENST00000473466; ENST00000541130 | TAF |
| 14% | chr1 | 6380703 | 6380649 | − | chr1 | 6378638 | 6378552 | − | ENST00000608083; ENST00000377842; ENST00000377845; ENST00000377855; ENST00000377860; ENST00000418124; ENST00000545482; ENST00000361521; ENST00000473466; ENST00000541130 | TAF |
| 14% | chr1 | 6380703 | 6380649 | − | chr1 | 6378638 | 6378552 | − | ENST00000608083; ENST00000377842; ENST00000377845; ENST00000377855; ENST00000377860; ENST00000418124; ENST00000545482; ENST00000361521; ENST00000473466; ENST00000541130 | TAF |
| 14% | chr1 | 6380703 | 6380649 | − | chr1 | 6378638 | 6378552 | − | ENST00000608083; ENST00000377842; ENST00000377845; ENST00000377855; ENST00000377860; ENST00000418124; ENST00000545482; ENST00000361521; ENST00000473466; ENST00000541130 | TAF |
| 14% | chr10 | 126455800 | 126455793 | − | chr10 | 126454177 | 126453961 | − | ENST00000494792; ENST00000368836 | TAF |
| 14% | chr10 | 126455800 | 126455793 | − | chr10 | 126454177 | 126453961 | − | ENST00000494792; ENST00000368836 | TAF |
| 14% | chr12 | 86274449 | 86274547 | + | chr12 | 86276001 | 86276153 | + | ENST00000551529; ENST00000256010 | TAF |
| 14% | chr1 | 201354798 | 201354740 | | chr1 | 201353963 | 201353920 | − | ENST00000503578; ENST00000391967; ENST00000367313 | TSF |
| 14% | chr1 | 201354798 | 201354740 | | chr1 | 201353963 | 201353920 | − | ENST00000503578; ENST00000391967; ENST00000367313 | TSF |
| 14% | chr10 | 79700435 | 79700428 | − | chr10 | 79628955 | 79628887 | − | ENST00000372391; ENST00000372388; ENST00000468332 | TSF |
| 14% | chr10 | 79700435 | 79700428 | − | chr10 | 79628955 | 79628887 | − | ENST00000372391; ENST00000372388; ENST00000468332 | TSF |
| 14% | chr10 | 79700435 | 79700428 | − | chr10 | 79628955 | 79628887 | − | ENST00000372391; ENST00000372388; ENST00000468332 | TSF |
| 13% | chr19 | 42217251 | 42217314 | + | chr19 | 42218890 | 42219168 | + | ENST00000398599; ENST00000221992; ENST00000405816; ENST00000595113 | TAF |
| 13% | chr19 | 42217251 | 42217314 | + | chr19 | 42218890 | 42219168 | + | ENST00000398599; ENST00000221992; ENST00000405816; ENST00000595113 | TAF |
| 13% | chr19 | 42217251 | 42217314 | + | chr19 | 42218890 | 42219168 | + | ENST00000398599; ENST00000221992; ENST00000405816; ENST00000595113 | TAF |
| 13% | chr4 | 38696010 | 38696173 | + | chr4 | 38696367 | 38696527 | + | ENST00000261438 | TAF |
| 13% | chr9 | 131002678 | 131002811 | + | chr9 | 131004511 | 131004624 | + | ENST00000475805; ENST00000341179; ENST00000372923; ENST00000393594; ENST00000486160 | TAF |
| 13% | chr9 | 131002678 | 131002811 | + | chr9 | 131004511 | 131004624 | + | ENST00000475805; ENST00000341179; ENST00000372923; ENST00000393594; ENST00000486160 | TAF |
| 13% | chr21 | 19289273 | 19289717 | + | chr21 | 19628826 | 19629135 | + | ENST00000299295; ENST00000543733 | TAF |
| 13% | chr19 | 39347374 | 39346206 | − | chr19 | 39338074 | 39337956 | − | ENST00000221419; ENST00000601449; ENST00000600233; ENST00000601813 | TSF |
| 13% | chr19 | 39347374 | 39346206 | − | chr19 | 39338074 | 39337956 | − | ENST00000221419; ENST00000601449; ENST00000600233; ENST00000601813 | TSF |
| 13% | chr19 | 39347374 | 39346206 | − | chr19 | 39338074 | 39337956 | − | ENST00000221419; ENST00000601449; ENST00000600233; ENST00000601813 | TSF |

TABLE 22-continued

Transcript fusion for Esophageal Carcinoma (ESCA) Coordinates of the fusion sequences for which the donor is the TE.

| 1 | 2' | 3' | 4 | 5' | 6' | 7 | 8' | 9' | 10' | 11' |
|---|---|---|---|---|---|---|---|---|---|---|
| 13% | chr6 | 80022917 | 80022085 | − | chr6 | 79924739 | 79924689 | | ENST00000275036; ENST00000344726 | TSF |
| 13% | chr6 | 80022917 | 80022085 | − | chr6 | 79924739 | 79924689 | | ENST00000275036; ENST00000344726 | TSF |
| 13% | chr17 | 17816540 | 17815566 | − | chr17 | 17810845 | 17810761 | − | ENST00000581396; ENST00000379504; ENST00000318094; ENST00000395739; ENST00000535933; ENST00000540946; ENST00000542206 | TSF |
| 13% | chr17 | 17816540 | 17815566 | − | chr17 | 17810845 | 17810761 | − | ENST00000581396; ENST00000379504; ENST00000318094; ENST00000395739; ENST00000535933; ENST00000540946; ENST00000542206 | TSF |
| 13% | chr17 | 17816540 | 17815566 | − | chr17 | 17810845 | 17810761 | − | ENST00000581396; ENST00000379504; ENST00000318094; ENST00000395739; ENST00000535933; ENST00000540946; ENST00000542206 | TSF |
| 13% | chr17 | 17816540 | 17815566 | − | chr17 | 17810845 | 17810761 | − | ENST00000581396; ENST00000379504; ENST00000318094; ENST00000395739; ENST00000535933; ENST00000540946; ENST00000542206 | TSF |
| 13% | chr17 | 17816540 | 17815566 | − | chr17 | 17810845 | 17810761 | − | ENST00000581396; ENST00000379504; ENST00000318094; ENST00000395739; ENST00000535933; ENST00000540946; ENST00000542206 | TSF |
| 13% | chr17 | 17816540 | 17815566 | − | chr17 | 17810845 | 17810761 | − | ENST00000581396; ENST00000379504; ENST00000318094; ENST00000395739; ENST00000535933; ENST00000540946; ENST00000542206 | TSF |
| 12% | chr9 | 130900342 | 130900452 | + | chr9 | 130913917 | 130913996 | + | ENST00000373017; ENST00000540948; ENST00000277480; ENST00000373013 | TAF |
| 12% | chr9 | 130900342 | 130900452 | + | chr9 | 130913917 | 130913996 | + | ENST00000373017; ENST00000540948; ENST00000277480; ENST00000373013 | TAF |
| 12% | chr1 | 201356770 | 201356732 | − | chr1 | 201356306 | 201355463 | | ENST00000391967; ENST00000367313 | TAF |
| 12% | chr12 | 123873690 | 123873729 | + | chr12 | 123875258 | 123875333 | + | ENST00000330479; ENST00000402868; ENST00000437519; ENST00000437502 | TAF |
| 12% | chr12 | 123873690 | 123873729 | + | chr12 | 123875258 | 123875333 | + | ENST00000330479; ENST00000402868; ENST00000437519; ENST00000437502 | TAF |
| 12% | chr12 | 123873690 | 123873729 | + | chr12 | 123875258 | 123875333 | + | ENST00000330479; ENST00000402868; ENST00000437519; ENST00000437502 | TAF |
| 12% | chr7 | 139048120 | 139048198 | + | chr7 | 139060808 | 139060902 | + | ENST00000541170; ENST00000541515; ENST00000354926; ENST00000456182; ENST00000263545 | TAF |
| 12% | chr7 | 139048120 | 139048198 | + | chr7 | 139060808 | 139060902 | + | ENST00000541170; ENST00000541515; ENST00000354926; ENST00000456182; ENST00000263545 | TAF |
| 12% | chr7 | 139048120 | 139048198 | + | chr7 | 139060808 | 139060902 | + | ENST00000541170; ENST00000541515; ENST00000354926; ENST00000456182; ENST00000263545 | TAF |
| 12% | chr21 | 47410358 | 47410419 | + | chr21 | 47410687 | 47410740 | + | ENST00000361866 | TAF |
| 12% | chr9 | 130569975 | 130570054 | + | chr9 | 130570513 | 130570590; 130570580 | + | ENST00000373247; ENST00000373245; ENST00000393706; ENST00000373228; ENST00000373225; ENST00000431857; ENST00000423577 | TAF |
| 12% | chr9 | 130569975 | 130570054 | + | chr9 | 130570513 | 130570590; 130570580 | + | ENST00000373247; ENST00000373245; ENST00000393706; ENST00000373228; ENST00000373225; ENST00000431857; ENST00000423577 | TAF |
| 12% | chr9 | 130569975 | 130570054 | + | chr9 | 130570513 | 130570590; 130570580 | + | ENST00000373247; ENST00000373245; ENST00000393706; ENST00000373228; ENST00000373225; ENST00000431857; ENST00000423577 | TAF |
| 12% | chr9 | 130569975 | 130570054 | + | chr9 | 130570513 | 130570590; 130570580 | + | ENST00000373247; ENST00000373245; ENST00000393706; ENST00000373228; ENST00000373225; ENST00000431857; ENST00000423577 | TAF |
| 12% | chr2 | 29015237 | 29015290 | + | chr2 | 29016729 | 29016863 | + | ENST00000358506; ENST00000296122; ENST00000395366 | TAF |
| 12% | chr6 | 128380624 | 128380622 | − | chr6 | 128330413 | 128330275 | − | ENST00000368226; ENST00000368227; ENST00000532331; ENST00000368213; ENST00000368210; ENST00000368207; ENST00000415046 | TAF |
| 12% | chr6 | 128380624 | 128380622 | − | chr6 | 128330413 | 128330275 | − | ENST00000368226; ENST00000368227; ENST00000532331; ENST00000368213; ENST00000368210; ENST00000368207; ENST00000415046 | TAF |
| 12% | chr6 | 128380624 | 128380622 | − | chr6 | 128330413 | 128330275 | − | ENST00000368226; ENST00000368227; ENST00000532331; ENST00000368213; | TAF |

TABLE 22-continued

Transcript fusion for Esophageal Carcinoma (ESCA) Coordinates of the fusion sequences for which the donor is the TE.

| 1 | 2' | 3' | 4 | 5' | 6' | 7 | 8' | 9' | 10' | 11' |
|---|---|---|---|---|---|---|---|---|---|---|
| 12% | chr6 | 128380624 | 128380622 | − | chr6 | 128330413 | 128330275 | − | ENST00000368210; ENST00000368207; ENST00000415046 ENST00000368226; ENST00000368227; ENST00000532331; ENST00000368213 | TAF |
| 12% | chr6 | 128380624 | 128380622 | − | chr6 | 128330413 | 128330275 | − | ENST00000368210; ENST00000368207; ENST00000415046 ENST00000368226; ENST00000368227; ENST00000532331; ENST00000368213 | TAF |
| 12% | chr6 | 128380624 | 128380622 | − | chr6 | 128330413 | 128330275 | − | ENST00000368210; ENST00000368207; ENST00000415046 ENST00000368226; ENST00000368227; ENST00000532331; ENST00000368213 | TAF |
| 12% | chr6 | 128380624 | 128380622 | − | chr6 | 128330413 | 128330275 | − | ENST00000368210; ENST00000368207; ENST00000415046 ENST00000368226; ENST00000368227; ENST00000532331; ENST00000368213 | TAF |
| 12% | chr17 | 38639751 | 38639593 | − | chr17 | 38638668 | 38638576 | − | ENST00000254051 | TSF |
| 12% | chr7 | 56020443 | 56020541 | + | chr7 | 56020872 | 56021011 | + | ENST00000426595 | TSF |
| 12% | chr15 | 40187476 | 40186733 | − | chr15 | 40099459 | 40099207 | − | ENST00000561100; ENST00000543580 | TSF |
| 11% | chr13 | 43659219 | 43659268 | + | chr13 | 43659904 | 43659974 | + | ENST00000379221 | TAF |
| 11% | chr17 | 80440912 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |
| 11% | chr17 | 80440912 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |
| 11% | chr17 | 80440912 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |
| 11% | chr17 | 80440912 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |
| 11% | chr8 | 134272238 | 134272103 | − | chr8 | 134271473 | 134271411; 134271461 | − | ENST00000323851; ENST00000517599; ENST00000537882; ENST00000414097; ENST00000522476; ENST00000522377; ENST00000520230; ENST00000518480; ENST00000519228; ENST00000519580; ENST00000522890; ENST00000520943; ENST00000521544; ENST00000522738 | TAF |
| 11% | chr8 | 134272238 | 134272103 | − | chr8 | 134271473 | 134271411; 134271461 | − | ENST00000323851; ENST00000517599; ENST00000537882; ENST00000414097; ENST00000522476; ENST00000522377; ENST00000520230; ENST00000518480; ENST00000519228; ENST00000519580; ENST00000522890; ENST00000520943; ENST00000521544; ENST00000522738 | TAF |
| 11% | chr8 | 134272238 | 134272103 | − | chr8 | 134271473 | 134271411; 134271461 | − | ENST00000323851; ENST00000517599; ENST00000537882; ENST00000414097; ENST00000522476; ENST00000522377; ENST00000520230; ENST00000518480; ENST00000519228; ENST00000519580; ENST00000522890; ENST00000520943; ENST00000521544; ENST00000522738 | TAF |
| 11% | chr8 | 134272238 | 134272103 | − | chr8 | 134271473 | 134271411; 134271461 | − | ENST00000323851; ENST00000517599; ENST00000537882; ENST00000414097; ENST00000522476; ENST00000522377; ENST00000520230; ENST00000518480; ENST00000519228; ENST00000519580; ENST00000522890; ENST00000520943; ENST00000521544; ENST00000522738 | TAF |
| 11% | chr8 | 134272238 | 134272103 | − | chr8 | 134271473 | 134271411; 134271461 | − | ENST00000323851; ENST00000517599; ENST00000537882; ENST00000414097; ENST00000522476; ENST00000522377; ENST00000520230; ENST00000518480; ENST00000519228; ENST00000519580; ENST00000522890; ENST00000520943; ENST00000521544; ENST00000522738 | TAF |

TABLE 22-continued

Transcript fusion for Esophageal Carcinoma (ESCA) Coordinates of the fusion sequences for which the donor is the TE.

| 1 | 2' | 3' | 4 | 5' | 6' | 7 | 8' | 9' | 10' | 11' |
|---|---|---|---|---|---|---|---|---|---|---|
| 11% | chr8 | 134272238 | 134272103 | − | chr8 | 134271473 | 134271411; 134271461 | − | ENST00000323851; ENST00000517599; ENST00000537882; ENST00000414097; ENST00000522476; ENST00000522377; ENST00000520230; ENST00000518480; ENST00000519228; ENST00000519580; ENST00000522890; ENST00000520943; ENST00000521544; ENST00000522738 | TAF |
| 11% | chr8 | 134272238 | 134272103 | − | chr8 | 134271473 | 134271411; 134271461 | − | ENST00000323851; ENST00000517599; ENST00000537882; ENST00000414097; ENST00000522476; ENST00000522377; ENST00000520230; ENST00000518480; ENST00000519228; ENST00000519580; ENST00000522890; ENST00000520943; ENST00000521544; ENST00000522738 | TAF |
| 11% | chr8 | 134272238 | 134272103 | − | chr8 | 134271473 | 134271411; 134271461 | − | ENST00000323851; ENST00000517599; ENST00000537882; ENST00000414097; ENST00000522476; ENST00000522377; ENST00000520230; ENST00000518480; ENST00000519228; ENST00000519580; ENST00000522890; ENST00000520943; ENST00000521544; ENST00000522738 | TAF |
| 11% | chr8 | 134272238 | 134272103 | − | chr8 | 134271473 | 134271411; 134271461 | − | ENST00000323851; ENST00000517599; ENST00000537882; ENST00000414097; ENST00000522476; ENST00000522377; ENST00000520230; ENST00000518480; ENST00000519228; ENST00000519580; ENST00000522890; ENST00000520943; ENST00000521544; ENST00000522738 | TAF |
| 11% | chr8 | 134272238 | 134272103 | − | chr8 | 134271473 | 134271411; 134271461 | − | ENST00000323851; ENST00000517599; ENST00000537882; ENST00000414097; ENST00000522476; ENST00000522377; ENST00000520230; ENST00000518480; ENST00000519228; ENST00000519580; ENST00000522890; ENST00000520943; ENST00000521544; ENST00000522738 | TAF |
| 11% | chr17 | 18390031 | 18390254 | + | chr17 | 18390961 | 18391071 | + | ENST00000581545; ENST00000582333; ENST00000328114; ENST00000412421; ENST00000583322; ENST00000584941 | TAF |
| 11% | chr17 | 18390031 | 18390254 | + | chr17 | 18390961 | 18391071 | + | ENST00000581545; ENST00000582333; ENST00000328114; ENST00000412421; ENST00000583322; ENST00000584941 | TAF |
| 11% | chr17 | 18390031 | 18390254 | + | chr17 | 18390961 | 18391071 | + | ENST00000581545; ENST00000582333; ENST00000328114; ENST00000412421; ENST00000583322; ENST00000584941 | TAF |
| 11% | chr17 | 18390031 | 18390254 | + | chr17 | 18390961 | 18391071 | + | ENST00000581545; ENST00000582333; ENST00000328114; ENST00000412421; ENST00000583322; ENST00000584941 | TAF |
| 11% | chr17 | 18390031 | 18390254 | + | chr17 | 18390961 | 18391071 | + | ENST00000581545; ENST00000582333; ENST00000328114; ENST00000412421; ENST00000583322; ENST00000584941 | TAF |
| 11% | chr2 | 201253013 | 201253278 | + | chr2 | 201253946 | 201254006 | + | ENST00000409755; ENST00000409151 | TAF |
| 11% | chr16 | 19487389 | 19487488 | + | chr16 | 19488762 | 19488840 | + | ENST00000541464; ENST00000381414; ENST00000396229; ENST00000542583; ENST00000219821; ENST00000561503; ENST00000564959 | TAF |
| 11% | chr16 | 19487389 | 19487488 | + | chr16 | 19488762 | 19488840 | + | ENST00000541464; ENST00000381414; ENST00000396229; ENST00000542583; ENST00000219821; ENST00000561503; ENST00000564959 | TAF |
| 11% | chr17 | 79214190 | 79214239 | + | chr17 | 79214787 | 79214816; 79214953 | + | ENST00000431388; ENST00000576002 | TAF |
| 11% | chr17 | 79214190 | 79214239 | + | chr17 | 79214787 | 79214816; 79214953 | + | ENST00000431388; ENST00000576002 | TAF |
| 11% | chr10 | 120902016 | 120901765 | − | chr10 | 120900831 | 120900754 | − | ENST00000355697; ENST00000330036 | TAF |
| 11% | chr14 | 65408081 | 65408080 | − | chr14 | 65406556 | 65406206 | − | ENST00000389614; ENST00000557049 | ITAF |
| 11% | chr12 | 27557551 | 27557646 | + | chr12 | 27568802 | 27568880 | + | ENST00000544915; ENST00000395901; ENST00000546179; ENST00000311001; ENST00000261178; ENST00000266503; ENST00000457040; ENST00000542388 | TSF |
| 11% | chr12 | 27557551 | 27557646 | + | chr12 | 27568802 | 27568880 | + | ENST00000544915; ENST00000395901; ENST00000546179; ENST00000311001; ENST00000261178; ENST00000266503; ENST00000457040; ENST00000542388 | TSF |

TABLE 22-continued

Transcript fusion for Esophageal Carcinoma (ESCA) Coordinates of the fusion sequences for which the donor is the TE.

| 1 | 2' | 3' | 4 | 5' | 6' | 7 | 8' | 9' | 10' | 11' |
|---|---|---|---|---|---|---|---|---|---|---|
| 11% | chr1 | 19672366 | 19672295 | − | chr1 | 19671746 | 19671681 | − | ENST00000401084; ENST00000264203; ENST00000375144; ENST00000375142; ENST00000433834; ENST00000264202; ENST00000413711 | TSF |
| 11% | chr1 | 19672366 | 19672295 | − | chr1 | 19671746 | 19671681 | − | ENST00000401084; ENST00000264203; ENST00000375144; ENST00000375142; ENST00000433834; ENST00000264202; ENST00000413711 | TSF |
| 11% | chr1 | 19672366 | 19672295 | − | chr1 | 19671746 | 19671681 | − | ENST00000401084; ENST00000264203; ENST00000375144; ENST00000375142; ENST00000433834; ENST00000264202; ENST00000413711 | TSF |
| 11% | chr1 | 19672366 | 19672295 | − | chr1 | 19671746 | 19671681 | − | ENST00000401084; ENST00000264203; ENST00000375144; ENST00000375142; ENST00000433834; ENST00000264202; ENST00000413711 | TSF |
| 11% | chr19 | 39347374 | 39346430 | − | chr19 | 39338074 | 39337956 | − | ENST00000221419; ENST00000601449; ENST00000600233; ENST00000601813 | TSF |
| 11% | chr19 | 39347374 | 39346430 | − | chr19 | 39338074 | 39337956 | − | ENST00000221419; ENST00000601449; ENST00000600233; ENST00000601813 | TSF |
| 11% | chr19 | 39347374 | 39346430 | − | chr19 | 39338074 | 39337956 | − | ENST00000221419; ENST00000601449; ENST00000600233; ENST00000601813 | TSF |
| 11% | chr2 | 38983894 | 38983086 | − | chr2 | 38977336 | 38977156 | − | ENST00000313117; ENST00000425778; ENST00000425941; ENST00000446327; ENST00000409276; ENST00000431066; ENST00000443213 | TSF |
| 11% | chr2 | 38983894 | 38983086 | − | chr2 | 38977336 | 38977156 | − | ENST00000313117; ENST00000425778; ENST00000425941; ENST00000446327; ENST00000409276; ENST00000431066; ENST00000443213 | TSF |
| 11% | chr2 | 38983894 | 38983086 | − | chr2 | 38977336 | 38977156 | − | ENST00000313117; ENST00000425778; ENST00000425941; ENST00000446327; ENST00000409276; ENST00000431066; ENST00000443213 | TSF |
| 11% | chr2 | 38983894 | 38983086 | − | chr2 | 38977336 | 38977156 | − | ENST00000313117; ENST00000425778; ENST00000425941; ENST00000446327; ENST00000409276; ENST00000431066; ENST00000443213 | TSF |
| 11% | chr2 | 38983894 | 38983086 | − | chr2 | 38977336 | 38977156 | − | ENST00000313117; ENST00000425778; ENST00000425941; ENST00000446327; ENST00000409276; ENST00000431066; ENST00000443213 | TSF |
| 11% | chr9 | 130732697 | 130732597 | − | chr9 | 130716204 | 130716084 | − | ENST00000373095 | TSF |
| 11% | chr16 | 28836248 | 28836298 | + | chr16 | 28836687 | 28836723 | + | ENST00000340394; ENST00000325215; ENST00000336783; ENST00000382686; ENST00000395547; ENST00000564304; ENST00000570200; ENST00000568266 | TSF |
| 11% | chr16 | 28836248 | 28836298 | + | chr16 | 28836687 | 28836723 | + | ENST00000340394; ENST00000325215; ENST00000336783; ENST00000382686; ENST00000395547; ENST00000564304; ENST00000570200; ENST00000568266 | TSF |
| 11% | chr16 | 28836248 | 28836298 | + | chr16 | 28836687 | 28836723 | + | ENST00000340394; ENST00000325215; ENST00000336783; ENST00000382686; ENST00000395547; ENST00000564304; ENST00000570200; ENST00000568266 | TSF |
| 11% | chr16 | 28836248 | 28836298 | + | chr16 | 28836687 | 28836723 | + | ENST00000340394; ENST00000325215; ENST00000336783; ENST00000382686; ENST00000395547; ENST00000564304; ENST00000570200; ENST00000568266 | TSF |
| 11% | chr16 | 28836248 | 28836298 | + | chr16 | 28836687 | 28836723 | + | ENST00000340394; ENST00000325215; ENST00000336783; ENST00000382686; ENST00000395547; ENST00000564304; ENST00000570200; ENST00000568266 | TSF |
| 11% | chr16 | 28836248 | 28836298 | + | chr16 | 28836687 | 28836723 | + | ENST00000340394; ENST00000325215; ENST00000336783; ENST00000382686; ENST00000395547; ENST00000564304; ENST00000570200; ENST00000568266 | TSF |
| 11% | chr16 | 28836248 | 28836298 | + | chr16 | 28836687 | 28836723 | + | ENST00000340394; ENST00000325215; ENST00000336783; ENST00000382686; ENST00000395547; ENST00000564304; ENST00000570200; ENST00000568266 | TSF |
| 11% | chr16 | 28836248 | 28836298 | + | chr16 | 28836687 | 28836723 | + | ENST00000340394; ENST00000325215; ENST00000336783; ENST00000382686; ENST00000395547; ENST00000564304; ENST00000570200; ENST00000568266 | TSF |

TABLE 22-continued

Transcript fusion for Esophageal Carcinoma (ESCA) Coordinates of the fusion sequences for which the donor is the TE.

| 1 | 2' | 3 | 4 | 5' | 6' | 7 | 8' | 9' | 10' | 11' |
|---|---|---|---|---|---|---|---|---|---|---|
| 11% | chrX | 76851229 | 76851182 | − | chrX | 76849319 | 76849166 | − | ENST00000373344; ENST00000395603 | TSF |
| 11% | chr22 | 38620420 | 38620354 | − | chr22 | 38617717 | 38617476 | − | ENST00000361906; ENST00000361684 | TSF |
| 10% | chr19 | 42217251 | 42217314 | + | chr19 | 42223849 | 42224127; 42223947 | + | ENST00000398599; ENST00000221992; ENST00000405816; ENST00000595403 | TAF |
| 10% | chr19 | 42217251 | 42217314 | + | chr19 | 42223849 | 42224127; 42223947 | + | ENST00000398599; ENST00000221992; ENST00000405816; ENST00000595403 | TAF |
| 10% | chr5 | 179238653 | 179238682 | + | chr5 | 179249989 | 179250053 | + | ENST00000389805; ENST00000504627; ENST00000510187 | TAF |
| 10% | chr5 | 179238653 | 179238682 | + | chr5 | 179249989 | 179250053 | + | ENST00000389805; ENST00000504627; ENST00000510187 | TAF |
| 10% | chr5 | 179238653 | 179238682 | + | chr5 | 179249989 | 179250053 | + | ENST00000389805; ENST00000504627; ENST00000510187 | TAF |
| 10% | chr16 | 29915789 | 29915910 | + | chr16 | 29916173 | 29916286 | + | ENST00000563177; ENST00000483405; ENST00000308748; ENST00000414952; ENST00000566693 | TAF |
| 10% | chr16 | 29915789 | 29915910 | + | chr16 | 29916173 | 29916286 | + | ENST00000563177; ENST00000483405; ENST00000308748; ENST00000414952; ENST00000566693 | TAF |
| 10% | chr2 | 220407466 | 220407420 | − | chr2 | 220406911 | 220406338; 220406329 | − | ENST00000243776; ENST00000373891 | TAF |
| 10% | chr2 | 220407466 | 220407420 | − | chr2 | 220406911 | 220406338; 220406329 | − | ENST00000243776; ENST00000373891 | TAF |
| 10% | chr5 | 147206892 | 147206839 | − | chr5 | 147204269 | 147204224 | − | ENST00000296695 | TAF |
| 10% | chr19 | 5902574 | 5902426 | − | chr19 | 5897008 | 5896916 | − | ENST00000592091; ENST00000585661; ENST00000586349; ENST00000418389; ENST00000592634; ENST00000308961 | TAF |
| 10% | chr19 | 5902574 | 5902426 | − | chr19 | 5897008 | 5896916 | − | ENST00000592091; ENST00000585661; ENST00000586349; ENST00000418389; ENST00000592634; ENST00000308961 | TAF |
| 10% | chr19 | 5902574 | 5902426 | − | chr19 | 5897008 | 5896916 | − | ENST00000592091; ENST00000585661; ENST00000586349; ENST00000418389; ENST00000592634; ENST00000308961 | TAF |
| 10% | chr19 | 5902574 | 5902426 | − | chr19 | 5897008 | 5896916 | − | ENST00000592091; ENST00000585661; ENST00000586349; ENST00000418389; ENST00000592634; ENST00000308961 | TAF |
| 10% | chr19 | 5902574 | 5902426 | − | chr19 | 5897008 | 5896916 | − | ENST00000592091; ENST00000585661; ENST00000586349; ENST00000418389; ENST00000592634; ENST00000308961 | TAF |
| 10% | chr19 | 5902574 | 5902426 | − | chr19 | 5897008 | 5896916 | − | ENST00000592091; ENST00000585661; ENST00000586349; ENST00000418389; ENST00000592634; ENST00000308961 | TAF |
| 10% | chr19 | 5902574 | 5902426 | − | chr19 | 5897008 | 5896916 | − | ENST00000592091; ENST00000585661; ENST00000586349; ENST00000418389; ENST00000592634; ENST00000308961 | TAF |
| 10% | chr19 | 5902574 | 5902426 | − | chr19 | 5897008 | 5896916 | − | ENST00000592091; ENST00000585661; ENST00000586349; ENST00000418389 | TAF |
| 10% | chr4 | 39933437 | 39933081 | − | chr4 | 39929784 | 39929581 | − | ENST00000303538; ENST00000503396 | TSF |
| 10% | chr4 | 39933437 | 39933081 | − | chr4 | 39929784 | 39929581 | − | ENST00000303538; ENST00000503396 | TSF |
| 10% | chr5 | 64050585 | 64050405 | − | chr5 | 64050189 | 64050142 | − | ENST00000513458 | TSF |
| 10% | chr5 | 167685522 | 167685690 | + | chr5 | 167687288 | 167687418 | + | ENST00000518659; ENST00000545108; ENST00000519204; ENST00000520394; ENST00000403607 | TSF |
| 10% | chr15 | 74004214 | 74004264 | + | chr15 | 74005275 | 74005297 | + | ENST00000318443; ENST00000537340; ENST00000318424; ENST00000564751; ENST00000561176; ENST00000559073 | TSF |
| 10% | chrX | 151410500 | 151410406 | − | chrX | 151393317 | 151393235 | − | ENST00000370314; ENST00000535043 | TSF |
| 9% | chr3 | 100461913 | 100462018 | + | chr3 | 100463677 | 100463775 | + | ENST00000418917; ENST00000490574; ENST00000240851; ENST00000476228 | TSF |
| 9% | chr16 | 16100474 | 16100650 | + | chr16 | 16101673 | 16101849 | + | ENST00000399410; ENST00000345148; ENST00000346370; ENST00000349029; ENST00000351154; ENST00000399408 | TSF |
| 9% | chr16 | 16100474 | 16100650 | + | chr16 | 16101673 | 16101849 | + | ENST00000399410; ENST00000345148; ENST00000346370; ENST00000349029; ENST00000351154; ENST00000399408 | TSF |
| 9% | chr16 | 16100474 | 16100650 | + | chr16 | 16101673 | 16101849 | + | ENST00000399410; ENST00000345148; ENST00000346370; ENST00000349029; ENST00000351154; ENST00000399408 | TSF |
| 9% | chr16 | 16100474 | 16100650 | + | chr16 | 16101673 | 16101849 | + | ENST00000399410; ENST00000345148; ENST00000346370; ENST00000349029; ENST00000351154; ENST00000399408 | TSF |
| 9% | chr16 | 16100474 | 16100650 | + | chr16 | 16101673 | 16101849 | + | ENST00000399410; ENST00000345148; ENST00000346370; ENST00000349029; ENST00000351154; ENST00000399408 | TSF |

TABLE 22-continued

Transcript fusion for Esophageal Carcinoma (ESCA) Coordinates of the fusion sequences for which the donor is the TE.

| 1 | 2' | 3' | 4 | 5' | 6' | 7 | 8' | 9' | 10' | 11' |
|---|---|---|---|---|---|---|---|---|---|---|
| 9% | chr16 | 16100474 | 16100650 | + | chr16 | 16101673 | 16101849 | + | ENST00000399410; ENST00000345148; ENST00000346370; ENST00000349029; ENST00000351154; ENST00000399408 | TSF |
| 9% | chr17 | 38649720 | 38649640 | − | chr17 | 38645221 | 38644798 | − | ENST00000254051 | TSF |
| 9% | chr16 | 16227557 | 16227839 | + | chr16 | 16228207 | 16228365 | + | ENST00000399410; ENST00000345148; ENST00000346370; ENST00000349029; ENST00000351154; ENST00000399408; ENST00000572882 | TSF |
| 9% | chr16 | 16227557 | 16227839 | + | chr16 | 16228207 | 16228365 | + | ENST00000399410; ENST00000345148; ENST00000346370; ENST00000349029; ENST00000351154; ENST00000399408; ENST00000572882 | TSF |
| 9% | chr7 | 134212336 | 134212386 | + | chr7 | 134215479 | 134215562 | + | ENST00000359579 | TSF |
| 9% | chr4 | 6592594 | 6592648 | + | chr4 | 6594900 | 6595077; 6595011 | + | ENST00000285599; ENST00000504248; ENST00000505907 | TSF |
| 9% | chr4 | 6592594 | 6592648 | + | chr4 | 6594900 | 6595077; 6595011 | + | ENST00000285599; ENST00000504248; ENST00000505907 | TSF |
| 9% | chr4 | 6592594 | 6592648 | + | chr4 | 6594900 | 6595077; 6595011 | + | ENST00000285599; ENST00000504248; ENST00000505907 | TSF |
| 9% | chr3 | 183680609 | 183680541 | − | chr3 | 183679442 | 183679299 | − | ENST00000334444; ENST00000265586 | TSF |
| 9% | chr3 | 183680609 | 183680541 | − | chr3 | 183679442 | 183679299 | − | ENST00000334444; ENST00000265586 | TSF |
| 9% | chr11 | 14589824 | 14589773 | | chr11 | 14540587 | 14540543 | − | ENST00000419365; ENST00000555531; ENST00000396394; ENST00000396393; ENST00000418988 | TSF |
| 9% | chr11 | 14589824 | 14589773 | | chr11 | 14540587 | 14540543 | − | ENST00000419365; ENST00000555531; ENST00000396394; ENST00000396393; ENST00000418988 | TSF |
| 9% | chr7 | 7559044 | 7558760 | − | chr7 | 7557468 | 7557427 | − | ENST00000399429; ENST00000444268 | TSF |
| 9% | chr7 | 7559044 | 7558760 | − | chr7 | 7557468 | 7557427 | − | ENST00000399429; ENST00000444268 | TSF |
| 9% | chr11 | 60934781 | 60933962 | − | chr11 | 60901679 | 60901508 | − | ENST00000301765; ENST00000538036 | TSF |
| 9% | chr11 | 60934781 | 60933962 | − | chr11 | 60901679 | 60901508 | − | ENST00000301765; ENST00000538036 | TSF |
| 8% | chr19 | 1114930 | 1114676 | − | chr19 | 1114421 | 1114230 | − | ENST00000361757; ENST00000587024; ENST00000438103 | TSF |
| 8% | chr3 | 150463581 | 150463483 | − | chr3 | 150460485 | 150459928; 150460275 | − | ENST00000312960; ENST00000482706 | TSF |
| 8% | chr3 | 150463581 | 150463483 | − | chr3 | 150460485 | 150459928; 150460275 | − | ENST00000312960; ENST00000482706 | TSF |
| 8% | chr10 | 101420120 | 101420239 | + | chr10 | 101421203 | 101421385 | + | ENST00000370489 | TSF |
| 8% | chr6 | 124669760 | 124669850 | + | chr6 | 124676413 | 124676493 | + | ENST00000368416; ENST00000368417; ENST00000546092; ENST00000545433 | TSF |
| 8% | chr6 | 124669760 | 124669850 | + | chr6 | 124676413 | 124676493 | + | ENST00000368416; ENST00000368417; ENST00000546092; ENST00000545433 | TSF |
| 8% | chr6 | 124669760 | 124669850 | + | chr6 | 124676413 | 124676493 | + | ENST00000368416; ENST00000368417; ENST00000546092; ENST00000545433 | TSF |
| 8% | chr6 | 124669760 | 124669850 | + | chr6 | 124676413 | 124676493 | + | ENST00000368416; ENST00000368417; ENST00000546092; ENST00000545433 | TSF |
| 8% | chr7 | 56018506 | 56018522 | + | chr7 | 56022602 | 56022871; 56022865 | + | ENST00000426595; ENST00000285298; ENST00000443449 | TSF |
| 8% | chr7 | 56018506 | 56018522 | + | chr7 | 56022602 | 56022871; 56022865 | + | ENST00000426595; ENST00000285298; ENST00000443449 | TSF |
| 8% | chr9 | 137248112 | 137248203 | + | chr9 | 137293478 | 137293728 | + | ENST00000481739 | TSF |
| 8% | chr12 | 14506971 | 14507749 | + | chr12 | 14576843 | 14578407 | ++ | ENST00000544627 | TSF |
| 8% | chr16 | 48451457 | 48450727 | − | chr16 | 48396341 | 48395491 | − | ENST00000356721 | TSF |
| 8% | chr1 | 153431306 | 153431207 | − | chr1 | 153430446 | 153430282 | − | ENST00000368722; ENST00000368723 | TSF |
| 8% | chr7 | 100850556 | 100850506 | − | chr7 | 100850185 | 100850060 | − | ENST00000454310; ENST00000223127 | TSF |
| 7% | chr19 | 56811235 | 56811344 | + | chr19 | 56813337 | 56813464 | + | ENST00000588026 | TSF |
| 7% | chr20 | 8624404 | 8625147 | + | chr20 | 8626749 | 8626828 | + | ENST00000378641; ENST00000338037; ENST00000378637; ENST00000404098 | TSF |
| 7% | chr20 | 8624404 | 8625147 | + | chr20 | 8626749 | 8626828 | + | ENST00000378641; ENST00000338037; ENST00000378637; ENST00000404098 | TSF |
| 7% | chr20 | 8624404 | 8625147 | + | chr20 | 8626749 | 8626828 | + | ENST00000378641; ENST00000338037; ENST00000378637; ENST00000404098 | TSF |
| 7% | chr20 | 110606 | 110697 | + | chr20 | 126056 | 126333 | + | ENST00000382398 | TSF |
| 7% | chr20 | 10628319 | 10628254 | − | chr20 | 10627751 | 10627587 | − | ENST00000254958; ENST00000423891 | TSF |
| 7% | chr17 | 39976225 | 39976301 | + | chr17 | 39976521 | 39976713 | + | ENST00000321562; ENST00000455106; ENST00000544340 | TSF |
| 7% | chr17 | 39974832 | 39974893 | + | chr17 | 39975462 | 39975651 | + | ENST00000321562 | TSF |
| 7% | chr1 | 200882539 | 200882562 | + | chr1 | 200882665 | 200882757 | + | ENST00000367342; ENST00000413687 | TSF |
| 7% | chr4 | 873272 | 873014 | − | chr4 | 871597 | 871403 | − | ENST00000314167; ENST00000511163 | TSF |
| 7% | chr12 | 52849815 | 52849601 | − | chr12 | 52845683 | 52845323 | − | ENST00000252252 | TSF |
| 7% | chr12 | 6602868 | 6602754 | − | chr12 | 6602138 | 6602028 | − | ENST00000229238 | TSF |
| 7% | chrX | 53579130 | 53578958 | − | chrX | 53578441 | 53578227 | − | ENST00000427052; ENST00000342160; ENST00000262854 | TSF |

TABLE 22-continued

Transcript fusion for Esophageal Carcinoma (ESCA) Coordinates of the fusion sequences for which the donor is the TE.

| 1 | 2' | 3' | 4 | 5' | 6' | 7 | 8' | 9' | 10' | 11' |
|---|---|---|---|---|---|---|---|---|---|---|
| 7% | chr1 | 33270876 | 33270146 | – | chr1 | 33263444 | 33263364 | – | ENST00000373477 | TSF |
| 7% | chr1 | 6366296 | 6365480 | – | chr1 | 6355040 | 6354924 | – | ENST00000608083; ENST00000377842; ENST00000377845; ENST00000377855; ENST00000377860; ENST00000418124; ENST00000545482; ENST00000361521; ENST00000473466 | TSF |
| 7% | chr1 | 6366296 | 6365480 | – | chr1 | 6355040 | 6354924 | – | ENST00000608083; ENST00000377842; ENST00000377845; ENST00000377855; ENST00000377860; ENST00000418124; ENST00000545482; ENST00000361521; ENST00000473466 | TSF |
| 7% | chr1 | 6366296 | 6365480 | – | chr1 | 6355040 | 6354924 | – | ENST00000608083; ENST00000377842; ENST00000377845; ENST00000377855; ENST00000377860; ENST00000418124; ENST00000545482; ENST00000361521; ENST00000473466 | TSF |
| 7% | chr1 | 6366296 | 6365480 | – | chr1 | 6355040 | 6354924 | – | ENST00000608083; ENST00000377842; ENST00000377845; ENST00000377855; ENST00000377860; ENST00000418124; ENST00000545482; ENST00000361521; ENST00000473466 | TSF |
| 7% | chrX | 154534914 | 154534817 | – | chrX | 154528458 | 154528349 | – | ENST00000369449; ENST00000321926 | TSF |
| 7% | chrX | 154534914 | 154534817 | – | chrX | 154528458 | 154528349 | – | ENST00000369449; ENST00000321926 | TSF |
| 7% | chr17 | 43485811 | 43485601 | | chr17 | 43483449 | 43483042; 43483213 | – | ENST00000532038; ENST00000428638; ENST00000442348; ENST00000532891; ENST00000528677 | TSF |
| 7% | chr17 | 43485811 | 43485601 | | chr17 | 43483449 | 43483042; 43483213 | – | ENST00000532038; ENST00000428638; ENST00000442348; ENST00000532891; ENST00000528677 | TSF |
| 7% | chr17 | 43485811 | 43485601 | | chr17 | 43483449 | 43483042; 43483213 | – | ENST00000532038; ENST00000428638; ENST00000442348; ENST00000532891; ENST00000528677 | TSF |
| 7% | chr17 | 43485811 | 43485601 | | chr17 | 43483449 | 43483042; 43483213 | – | ENST00000532038; ENST00000428638; ENST00000442348; ENST00000532891; ENST00000528677 | TSF |
| 6% | chr3 | 184639788 | 184640271 | + | chr3 | 184642650 | 184642769 | + | ENST00000287546; ENST00000437079; ENST00000436792; ENST00000446204 | TSF |
| 6% | chr12 | 53835137 | 53835233 | + | chr12 | 53836479 | 53836517 | + | ENST00000547368 | TSF |
| 6% | chr17 | 37902588 | 37902638 | + | chr17 | 37903004 | 37903150 | + | ENST00000309156; ENST00000394211; ENST00000445327; ENST00000394209 | TSF |
| 6% | chr2 | 101567739 | 101568117 | + | chr2 | 101580520 | 101580638 | + | ENST00000335681; ENST00000542504 | TSF |
| 6% | chr16 | 28838911 | 28839140 | + | chr16 | 28840722 | 28840813 | + | ENST00000340394; ENST00000325215; ENST00000336783; ENST00000382686; ENST00000395547; ENST00000564304; ENST00000570200; ENST00000568266 | TSF |
| 6% | chr16 | 28838911 | 28839140 | + | chr16 | 28840722 | 28840813 | + | ENST00000340394; ENST00000325215; ENST00000336783; ENST00000382686; ENST00000395547; ENST00000564304; ENST00000570200; ENST00000568266 | TSF |
| 6% | chr16 | 28838911 | 28839140 | + | chr16 | 28840722 | 28840813 | + | ENST00000340394; ENST00000325215; ENST00000336783; ENST00000382686; ENST00000395547; ENST00000564304; ENST00000570200; ENST00000568266 | TSF |
| 6% | chr16 | 28838911 | 28839140 | + | chr16 | 28840722 | 28840813 | + | ENST00000340394; ENST00000325215; ENST00000336783; ENST00000382686; ENST00000395547; ENST00000564304; ENST00000570200; ENST00000568266 | TSF |
| 6% | chr16 | 28838911 | 28839140 | + | chr16 | 28840722 | 28840813 | + | ENST00000340394; ENST00000325215; ENST00000336783; ENST00000382686; ENST00000395547; ENST00000564304; ENST00000570200; ENST00000568266 | TSF |
| 6% | chr16 | 28838911 | 28839140 | + | chr16 | 28840722 | 28840813 | + | ENST00000340394; ENST00000325215; ENST00000336783; ENST00000382686; ENST00000395547; ENST00000564304; ENST00000570200; ENST00000568266 | TSF |
| 6% | chr16 | 28838911 | 28839140 | + | chr16 | 28840722 | 28840813 | + | ENST00000340394; ENST00000325215; ENST00000336783; ENST00000382686; ENST00000395547; ENST00000564304; ENST00000570200; ENST00000568266 | TSF |
| 6% | chr7 | 134215952 | 134215973 | + | chr7 | 134216660 | 134216776 | + | ENST00000359579 | TSF |
| 6% | chr3 | 183693430 | 183693330 | – | chr3 | 183689707 | 183689351 | – | ENST00000334444; ENST00000265586 | TSF |

TABLE 22-continued

Transcript fusion for Esophageal Carcinoma (ESCA) Coordinates of the fusion sequences for which the donor is the TE.

| 1 | 2' | 3' | 4 | 5' | 6' | 7 | 8' | 9' | 10' | 11' |
|---|---|---|---|---|---|---|---|---|---|---|
| 6% | chr3 | 183693430 | 183693330 | − | chr3 | 183689707 | 183689351 | − | ENST00000334444; ENST00000265586 | TSF |
| 6% | chr20 | 48264330 | 48264298 | − | chr20 | 48263615 | 48263502 | − | ENST00000371711 | TSF |
| 6% | chr20 | 48763148 | 48763055 | − | chr20 | 48760158 | 48760039 | − | ENST00000341698; ENST00000557021; ENST00000371650; ENST00000371652; ENST00000371658 | TSF |
| 6% | chr20 | 48763148 | 48763055 | − | chr20 | 48760158 | 48760039 | − | ENST00000341698; ENST00000557021; ENST00000371650; ENST00000371652; ENST00000371658 | TSF |
| 6% | chr20 | 48763148 | 48763055 | − | chr20 | 48760158 | 48760039 | − | ENST00000341698; ENST00000557021; ENST00000371650; ENST00000371652; ENST00000371658 | TSF |
| 6% | chr20 | 48763148 | 48763055 | − | chr20 | 48760158 | 48760039 | − | ENST00000341698; ENST00000557021; ENST00000371650; ENST00000371652; ENST00000371658 | TSF |
| 5% | chr14 | 51360331 | 51362440 | + | chr14 | 51368547 | 51368629 | + | ENST00000337334; ENST00000353130; ENST00000395752 | TSF |
| 5% | chr20 | 35778650 | 35779434 | + | chr20 | 35812583 | 35812776 | + | ENST00000237530; ENST00000373622; ENST00000373632 | TSF |
| 5% | chr20 | 35778650 | 35779434 | + | chr20 | 35812583 | 35812776 | + | ENST00000237530; ENST00000373622; ENST00000373632 | TSF |
| 5% | chr20 | 35778650 | 35779434 | + | chr20 | 35812583 | 35812776 | + | ENST00000237530; ENST00000373622; ENST00000373632 | TSF |
| 5% | chr3 | 132014279 | 132014543 | + | chr3 | 132047111 | 132047206 | + | ENST00000336375; ENST00000495911; ENST00000475741; ENST00000351273 | TSF |
| 5% | chr3 | 132014279 | 132014543 | + | chr3 | 132047111 | 132047206 | + | ENST00000336375; ENST00000495911; ENST00000475741; ENST00000351273 | TSF |
| 5% | chr3 | 132014279 | 132014543 | + | chr3 | 132047111 | 132047206 | + | ENST00000336375; ENST00000495911; ENST00000475741; ENST00000351273 | TSF |
| 5% | chr3 | 132014279 | 132014543 | + | chr3 | 132047111 | 132047206 | + | ENST00000336375; ENST00000495911; ENST00000475741; ENST00000351273 | TSF |
| 5% | chr11 | 66953459 | 66954052 | + | chr11 | 66974981 | 66975159 | + | ENST00000398645; ENST00000529006 | TSF |
| 5% | chr11 | 66953459 | 66954052 | + | chr11 | 66974981 | 66975159 | + | ENST00000398645; ENST00000529006 | TSF |
| 5% | chr15 | 73976790 | 73976801 | + | chr15 | 73994596 | 73994914; 73994934; 73994926; 73994838; 73994671 | + | ENST00000567189; ENST00000318443; ENST00000318424; ENST00000558689; ENST00000560786; ENST00000561213; ENST00000563584; ENST00000561416; ENST00000560995; ENST00000561260; ENST00000564751 | TSF |
| 5% | chr15 | 73976790 | 73976801 | + | chr15 | 73994596 | 73994914; 73994934; 73994926; 73994838; 73994671 | + | ENST00000567189; ENST00000318443; ENST00000318424; ENST00000558689; ENST00000560786; ENST00000561213; ENST00000563584; ENST00000561416; ENST00000560995; ENST00000561260; ENST00000564751 | TSF |
| 5% | chr15 | 73976790 | 73976801 | + | chr15 | 73994596 | 73994914; 73994934; 73994926; 73994838; 73994671 | + | ENST00000567189; ENST00000318443; ENST00000318424; ENST00000558689; ENST00000560786; ENST00000561213; ENST00000563584; ENST00000561416; ENST00000560995; ENST00000561260; ENST00000564751 | TSF |
| 5% | chr15 | 73976790 | 73976801 | + | chr15 | 73994596 | 73994914; 73994934; 73994926; 73994838; 73994671 | + | ENST00000567189; ENST00000318443; ENST00000318424; ENST00000558689; ENST00000560786; ENST00000561213; ENST00000563584; ENST00000561416; ENST00000560995; ENST00000561260; ENST00000564751 | TSF |
| 5% | chr15 | 73976790 | 73976801 | + | chr15 | 73994596 | 73994914; 73994934; 73994926; 73994838; 73994671 | + | ENST00000567189; ENST00000318443; ENST00000318424; ENST00000558689; ENST00000560786; ENST00000561213; ENST00000563584; ENST00000561416; ENST00000560995; ENST00000561260; ENST00000564751 | TSF |
| 5% | chr15 | 73976790 | 73976801 | + | chr15 | 73994596 | 73994914; 73994934; 73994926; 73994838; 73994671 | + | ENST00000567189; ENST00000318443; ENST00000318424; ENST00000558689; ENST00000560786; ENST00000561213; ENST00000563584; ENST00000561416; ENST00000560995; ENST00000561260; ENST00000564751 | TSF |
| 5% | chr15 | 73976790 | 73976801 | + | chr15 | 73994596 | 73994914; 73994934; 73994926; 73994838; 73994671 | + | ENST00000567189; ENST00000318443; ENST00000318424; ENST00000558689; ENST00000560786; ENST00000561213; ENST00000563584; ENST00000561416; ENST00000560995; ENST00000561260; ENST00000564751 | TSF |

TABLE 22-continued

Transcript fusion for Esophageal Carcinoma (ESCA) Coordinates of the fusion sequences for which the donor is the TE.

| 1 | 2' | 3 | 4 | 5' | 6' | 7 | 8' | 9' | 10' | 11' |
|---|---|---|---|---|---|---|---|---|---|---|
| 5% | chr15 | 73976790 | 73976801 | + | chr15 | 73994596 | 73994914; 73994934; 73994926; 73994838; 73994671 | + | ENST00000567189; ENST00000318443; ENST00000318424; ENST00000558689; ENST00000560786; ENST00000561213; ENST00000563584; ENST00000561416; ENST00000560995; ENST00000561260; ENST00000564751 | TSF |
| 5% | chr15 | 73976790 | 73976801 | + | chr15 | 73994596 | 73994914; 73994934; 73994926; 73994838; 73994671 | + | ENST00000567189; ENST00000318443; ENST00000318424; ENST00000558689; ENST00000560786; ENST00000561213; ENST00000563584; ENST00000561416; ENST00000560995; ENST00000561260; ENST00000564751 | TSF |
| 5% | chr2 | 3431377 | 3431530 | + | chr2 | 3624182 | 3624220 | + | ENST00000304921; ENST00000407445; ENST00000403564; ENST00000406376 | TSF |
| 5% | chr2 | 3431377 | 3431530 | + | chr2 | 3624182 | 3624220 | + | ENST00000304921; ENST00000407445; ENST00000403564; ENST00000406376 | TSF |
| 5% | chr10 | 5120335 | 5120493 | + | chr10 | 5138602 | 5138769 | + | ENST00000602997; ENST00000605149; ENST00000380554 | TSF |
| 5% | chr10 | 5120335 | 5120493 | + | chr10 | 5138602 | 5138769 | + | ENST00000602997; ENST00000605149; ENST00000380554 | TSF |
| 5% | chr10 | 74501505 | 74501603 | + | chr10 | 74594117 | 74594186; 74594190 | + | ENST00000373053; ENST00000357157; ENST00000536019; ENST00000604152 | TSF |
| 5% | chr10 | 74501505 | 74501603 | + | chr10 | 74594117 | 74594186; 74594190 | + | ENST00000373053; ENST00000357157; ENST00000536019; ENST00000604152 | TSF |
| 5% | chr10 | 74501505 | 74501603 | + | chr10 | 74594117 | 74594186; 74594190 | + | ENST00000373053; ENST00000357157; ENST00000536019; ENST00000604152 | TSF |
| 5% | chr12 | 14506971 | 14507672 | + | chr12 | 14576843 | 14578407 | + | ENST00000544627 | TSF |
| 5% | chr20 | 634541 | 634468 | − | chr20 | 629561 | 629358; 629500 | − | ENST00000381962; ENST00000488788 | TSF |
| 5% | chr20 | 634541 | 634468 | − | chr20 | 629561 | 629358; 629500 | − | ENST00000381962; ENST00000488788 | TSF |
| 5% | chr11 | 61087201 | 61087135 | − | chr11 | 61084039 | 61083964 | − | ENST00000301764; ENST00000540166; ENST00000535967; ENST00000539739; ENST00000535174 | TSF |
| 5% | chr11 | 61087201 | 61087135 | − | chr11 | 61084039 | 61083964 | − | ENST00000301764; ENST00000540166; ENST00000535967; ENST00000539739; ENST00000535174 | TSF |
| 5% | chr11 | 61087201 | 61087135 | − | chr11 | 61084039 | 61083964 | − | ENST00000301764; ENST00000540166; ENST00000535967; ENST00000539739; ENST00000535174 | TSF |
| 5% | chr11 | 61087201 | 61087135 | − | chr11 | 61084039 | 61083964 | − | ENST00000301764; ENST00000540166; ENST00000535967; ENST00000539739; ENST00000535174 | TSF |
| 5% | chr11 | 61087201 | 61087135 | − | chr11 | 61084039 | 61083964 | − | ENST00000301764; ENST00000540166; ENST00000535967; ENST00000539739; ENST00000535174 | TSF |
| 5% | chr15 | 83667946 | 83667078 | − | chr15 | 83660798 | 83660684 | − | ENST00000451195 | TSF |
| 5% | chr22 | 46778472 | 46778374 | − | chr22 | 46777947 | 46777743 | − | ENST00000262738 | TSF |
| 5% | chr10 | 5057417 | 5057095 | − | chr10 | 5043873 | 5043706 | − | ENST00000380753; ENST00000421196; ENST00000407674; ENST00000604507; ENST00000455190 | TSF |
| 5% | chr10 | 5057417 | 5057095 | − | chr10 | 5043873 | 5043706 | − | ENST00000380753; ENST00000421196; ENST00000407674; ENST00000604507; ENST00000455190 | TSF |
| 5% | chr10 | 5057417 | 5057095 | − | chr10 | 5043873 | 5043706 | − | ENST00000380753; ENST00000421196; ENST00000407674; ENST00000604507; ENST00000455190 | TSF |
| 5% | chr10 | 5057417 | 5057095 | − | chr10 | 5043873 | 5043706 | − | ENST00000380753; ENST00000421196; ENST00000407674; ENST00000604507; ENST00000455190 | TSF |
| 5% | chr1 | 45988716 | 45988450 | − | chr1 | 45980667 | 45980545 | − | ENST00000262746; ENST00000319248; ENST00000447184; ENST00000424390 | TSF |
| 5% | chr1 | 45988716 | 45988450 | − | chr1 | 45980667 | 45980545 | − | ENST00000262746; ENST00000319248; ENST00000447184; ENST00000424390 | TSF |
| 5% | chr6 | 117763870 | 117763597 | − | chr6 | 117739669 | 117739625 | − | ENST00000368507; ENST00000368508 | TSF |
| 5% | chr6 | 117763870 | 117763597 | − | chr6 | 117739669 | 117739625 | − | ENST00000368507; ENST00000368508 | TSF |
| 5% | chr10 | 90437871 | 90437988 | + | chr10 | 90438202 | 90438438 | + | ENST00000394375; ENST00000608620; ENST00000238983; ENST00000355843 | TSF |
| 5% | chr1 | 172134550 | 172134843 | + | chr1 | 172222713 | 172222822; 172222718 | + | ENST00000358155; ENST00000355305; ENST00000367731; ENST00000520906; ENST00000523513 | TSF |
| 5% | chr1 | 172134550 | 172134843 | + | chr1 | 172222713 | 172222822; 172222718 | + | ENST00000358155; ENST00000355305; ENST00000367731; ENST00000520906; ENST00000523513 | TSF |

TABLE 22-continued

Transcript fusion for Esophageal Carcinoma (ESCA) Coordinates of the fusion sequences for which the donor is the TE.

| 1 | 2' | 3' | 4 | 5' | 6' | 7 | 8' | 9' | 10' | 11' |
|---|---|---|---|---|---|---|---|---|---|---|
| 5% | chr1 | 172134550 | 172134843 | + | chr1 | 172222713 | 172222822; 172222718 | + | ENST00000358155; ENST00000355305; ENST00000367731; ENST00000520906; ENST00000523513 | TSF |
| 5% | chr1 | 172134550 | 172134843 | + | chr1 | 172222713 | 172222822; 172222718 | + | ENST00000358155; ENST00000355305; ENST00000367731; ENST00000520906; ENST00000523513 | TSF |
| 5% | chr5 | 175697409 | 175697523 | + | chr5 | 175716657 | 175717958 | + | ENST00000443967; ENST00000429602 | TSF |
| 5% | chr5 | 175697409 | 175697523 | + | chr5 | 175716657 | 175717958 | + | ENST00000443967; ENST00000429602 | TSF |
| 5% | chr1 | 117473681 | 117473836 | + | chr1 | 117484337 | 117484705 | + | ENST00000393203 | TSF |
| 5% | chr4 | 15791827 | 15792504 | + | chr4 | 15818134 | 15818263 | + | ENST00000502843; ENST00000226279 | TSF |
| 5% | chr4 | 15791827 | 15792504 | + | chr4 | 15818134 | 15818263 | + | ENST00000502843; ENST00000226279 | TSF |
| 5% | chr17 | 75313396 | 75313709 | + | chr17 | 75398141 | 75398484; 75398785; 75398497; 75398565 | + | ENST00000589070; ENST00000427177; ENST00000591198; ENST00000329047; ENST00000590294; ENST00000591934; ENST00000423034; ENST00000589140 | TSF |
| 5% | chr17 | 75313396 | 75313709 | + | chr17 | 75398141 | 75398484; 75398785; 75398497; 75398565 | + | ENST00000589070; ENST00000427177; ENST00000591198; ENST00000329047; ENST00000590294; ENST00000591934; ENST00000423034; ENST00000589140 | TSF |
| 5% | chr17 | 75313396 | 75313709 | + | chr17 | 75398141 | 75398484; 75398785; 75398497; 75398565 | + | ENST00000589070; ENST00000427177; ENST00000591198; ENST00000329047; ENST00000590294; ENST00000591934; ENST00000423034; ENST00000589140 | TSF |
| 5% | chr17 | 75313396 | 75313709 | + | chr17 | 75398141 | 75398484; 75398785; 75398497; 75398565 | + | ENST00000589070; ENST00000427177; ENST00000591198; ENST00000329047; ENST00000590294; ENST00000591934; ENST00000423034; ENST00000589140 | TSF |
| 5% | chr1 | 1562829 | 1562875 | + | chr1 | 1563053 | 1563209 | + | ENST00000520777; ENST00000357210; ENST00000360522; ENST00000378710; ENST00000355826; ENST00000518681; ENST00000505820; ENST00000487053; ENST00000378712; ENST00000504599; ENST00000378708; ENST00000514234 | TSF |
| 5% | chr1 | 1562829 | 1562875 | + | chr1 | 1563053 | 1563209 | + | ENST00000520777; ENST00000357210; ENST00000360522; ENST00000378710; ENST00000355826; ENST00000518681; ENST00000505820; ENST00000487053; ENST00000378712; ENST00000504599; ENST00000378708; ENST00000514234 | TSF |
| 5% | chr1 | 1562829 | 1562875 | + | chr1 | 1563053 | 1563209 | + | ENST00000520777; ENST00000357210; ENST00000360522; ENST00000378710; ENST00000355826; ENST00000518681; ENST00000505820; ENST00000487053; ENST00000378712; ENST00000504599; ENST00000378708; ENST00000514234 | TSF |
| 5% | chr5 | 76107394 | 76108438 | + | chr5 | 76128515 | 76129626 | + | ENST00000296677 | TSF |
| 5% | chr11 | 46390474 | 46390524 | + | chr11 | 46391044 | 46391100; 46391047 | + | ENST00000343674; ENST00000532868; ENST00000395574; ENST00000527911; ENST00000533376; ENST00000456247; ENST00000421244; ENST00000318201; ENST00000454345; ENST00000524448 | TSF |
| 5% | chr11 | 46390474 | 46390524 | + | chr11 | 46391044 | 46391100; 46391047 | + | ENST00000343674; ENST00000532868; ENST00000395574; ENST00000527911; ENST00000533376; ENST00000456247; ENST00000421244; ENST00000318201; ENST00000454345; ENST00000524448 | TSF |
| 5% | chr11 | 46390474 | 46390524 | + | chr11 | 46391044 | 46391100; 46391047 | + | ENST00000343674; ENST00000532868; ENST00000395574; ENST00000527911; ENST00000533376; ENST00000456247; ENST00000421244; ENST00000318201; ENST00000454345; ENST00000524448 | TSF |
| 5% | chr11 | 46390474 | 46390524 | + | chr11 | 46391044 | 46391100; 46391047 | + | ENST00000343674; ENST00000532868; ENST00000395574; ENST00000527911; ENST00000533376; ENST00000456247; ENST00000421244; ENST00000318201; ENST00000454345; ENST00000524448 | TSF |
| 5% | chr11 | 46390474 | 46390524 | + | chr11 | 46391044 | 46391100; 46391047 | + | ENST00000343674; ENST00000532868; ENST00000395574; ENST00000527911; ENST00000533376; ENST00000456247; ENST00000421244; ENST00000318201; ENST00000454345; ENST00000524448 | TSF |
| 5% | chr11 | 46390474 | 46390524 | + | chr11 | 46391044 | 46391100; 46391047 | + | ENST00000343674; ENST00000532868; ENST00000395574; ENST00000527911; | TSF |
| 5% | chr12 | 53353926 | 53353678 | − | chr12 | 52913570 | 52913526; 52913535 | − | ENST00000252242; ENST00000549420; ENST00000551275 | TSF |

TABLE 22-continued

Transcript fusion for Esophageal Carcinoma (ESCA) Coordinates of the fusion sequences for which the donor is the TE.

| 1 | 2' | 3' | 4 | 5' | 6' | 7 | 8' | 9' | 10' | 11' |
|---|---|---|---|---|---|---|---|---|---|---|
| 5% | chr12 | 53353926 | 53353678 | − | chr12 | 52913570 | 52913526; 52913535 | − | ENST00000252242; ENST00000549420; ENST00000551275 | TSF |
| 5% | chr12 | 53353926 | 53353678 | − | chr12 | 52913570 | 52913526; 52913535 | − | ENST00000252242; ENST00000549420; ENST00000551275 | TSF |
| 5% | chr19 | 35979015 | 35978880 | − | chr19 | 35978661 | 35978614 | − | ENST00000484218; ENST00000338897 | TSF |
| 5% | chr4 | 83774285 | 83774211 | − | chr4 | 83772757 | 83772584; 83772667 | − | ENST00000348405; ENST00000513858; ENST00000395310; ENST00000443462; ENST00000509142; ENST00000311785; ENST00000326950; ENST00000432794; ENST00000448323; ENST00000505472; ENST00000500777; ENST00000508502; ENST00000355196; ENST00000264405; ENST00000505984; ENST00000508479; ENST00000507828; ENST00000512664 | TSF |
| 5% | chr4 | 83774285 | 83774211 | − | chr4 | 83772757 | 83772584; 83772667 | − | ENST00000348405; ENST00000513858; ENST00000395310; ENST00000443462; ENST00000509142; ENST00000311785; ENST00000326950; ENST00000432794; ENST00000448323; ENST00000505472; ENST00000500777; ENST00000508502; ENST00000355196; ENST00000264405; ENST00000505984; ENST00000508479; ENST00000507828; ENST00000512664 | TSF |
| 5% | chr4 | 83774285 | 83774211 | − | chr4 | 83772757 | 83772584; 83772667 | − | ENST00000348405; ENST00000513858; ENST00000395310; ENST00000443462; ENST00000509142; ENST00000311785; ENST00000326950; ENST00000432794; ENST00000448323; ENST00000505472; ENST00000500777; ENST00000508502; ENST00000355196; ENST00000264405; ENST00000505984; ENST00000508479; ENST00000507828; ENST00000512664 | TSF |
| 5% | chr4 | 83774285 | 83774211 | − | chr4 | 83772757 | 83772584; 83772667 | − | ENST00000348405; ENST00000513858; ENST00000395310; ENST00000443462; ENST00000509142; ENST00000311785; ENST00000326950; ENST00000432794; ENST00000448323; ENST00000505472; ENST00000500777; ENST00000508502; ENST00000355196; ENST00000264405; ENST00000505984; ENST00000508479; ENST00000507828; ENST00000512664 | TSF |
| 5% | chr4 | 83774285 | 83774211 | − | chr4 | 83772757 | 83772584; 83772667 | − | ENST00000348405; ENST00000513858; ENST00000395310; ENST00000443462; ENST00000509142; ENST00000311785; ENST00000326950; ENST00000432794; ENST00000448323; ENST00000505472; ENST00000500777; ENST00000508502; ENST00000355196; ENST00000264405; ENST00000505984; ENST00000508479; ENST00000507828; ENST00000512664 | TSF |
| 5% | chr4 | 83774285 | 83774211 | − | chr4 | 83772757 | 83772584; 83772667 | − | ENST00000348405; ENST00000513858; ENST00000395310; ENST00000443462; ENST00000509142; ENST00000311785; ENST00000326950; ENST00000432794; ENST00000448323; ENST00000505472; ENST00000500777; ENST00000508502; ENST00000355196; ENST00000264405; ENST00000505984; ENST00000508479; ENST00000507828; ENST00000512664 | TSF |
| 5% | chr4 | 83774285 | 83774211 | − | chr4 | 83772757 | 83772584; 83772667 | − | ENST00000348405; ENST00000513858; ENST00000395310; ENST00000443462; ENST00000509142; ENST00000311785; ENST00000326950; ENST00000432794; ENST00000448323; ENST00000505472; ENST00000500777; ENST00000508502; ENST00000355196; ENST00000264405; ENST00000505984; ENST00000508479; ENST00000507828; ENST00000512664 | TSF |
| 5% | chr4 | 83774285 | 83774211 | − | chr4 | 83772757 | 83772584; 83772667 | − | ENST00000348405; ENST00000513858; ENST00000395310; ENST00000443462; ENST00000509142; ENST00000311785; ENST00000326950; ENST00000432794; ENST00000448323; ENST00000505472; ENST00000500777; ENST00000508502; | TSF |

TABLE 22-continued

Transcript fusion for Esophageal Carcinoma (ESCA) Coordinates of the fusion sequences for which the donor is the TE.

| 1 | 2' | 3' | 4 | 5' | 6' | 7 | 8' | 9' | 10' | 11' |
|---|----|----|---|----|----|---|----|----|-----|-----|
| 5% | chr4 | 83774285 | 83774211 | − | chr4 | 83772757 | 83772584; 83772667 | − | ENST00000355196; ENST00000264405; ENST00000505984; ENST00000508479; ENST00000507828; ENST00000512664 ENST00000348405; ENST00000513858; ENST00000395310; ENST00000443462; ENST00000509142; ENST00000311785; ENST00000326950; ENST00000432794; ENST00000448323; ENST00000505472; ENST00000500777; ENST00000508502; ENST00000355196; ENST00000264405; ENST00000505984; ENST00000508479; ENST00000507828; ENST00000512664 | TSF |
| 5% | chr1 | 156716197 | 156716133 | − | chr1 | 156715165 | 156715089 | − | ENST00000357325; ENST00000537739; ENST00000368209; ENST00000368206 | TSF |
| 5% | chrX | 134954053 | 134953756 | − | chrX | 134950187 | 134950078 | − | ENST00000420087; ENST00000463085; ENST00000370724; ENST00000491480 | TSF |
| 5% | chrX | 134954053 | 134953756 | − | chrX | 134950187 | 134950078 | − | ENST00000420087; ENST00000463085; ENST00000370724; ENST00000491480 | TSF |
| 5% | chr7 | 5433736 | 5433673 | − | chr7 | 5430259 | 5430116; 5429988 | − | ENST00000399537; ENST00000430969; ENST00000434361; ENST00000399434 | TSF |
| 5% | chr7 | 5433736 | 5433673 | − | chr7 | 5430259 | 5430116; 5429988 | − | ENST00000399537; ENST00000430969; ENST00000434361; ENST00000399434 | TSF |
| 5% | chr7 | 5433736 | 5433673 | − | chr7 | 5430259 | 5430116; 5429988 | − | ENST00000399537; ENST00000430969; ENST00000434361; ENST00000399434 | TSF |
| 5% | chr7 | 5433736 | 5433673 | − | chr7 | 5430259 | 5430116; 5429988 | − | ENST00000399537; ENST00000430969; ENST00000434361; ENST00000399434 | TSF |
| 5% | chr17 | 1005272 | 1005174 | − | chr17 | 1003975 | 1003877 | − | ENST00000302538; ENST00000544583; ENST00000574437; ENST00000291107; ENST00000574139; ENST00000570525; ENST00000574266 | TSF |
| 5% | chr17 | 1005272 | 1005174 | − | chr17 | 1003975 | 1003877 | − | ENST00000302538; ENST00000544583; ENST00000574437; ENST00000291107; ENST00000574139; ENST00000570525; ENST00000574266 | TSF |
| 5% | chr17 | 1005272 | 1005174 | − | chr17 | 1003975 | 1003877 | − | ENST00000302538; ENST00000544583; ENST00000574437; ENST00000291107; ENST00000574139; ENST00000570525; ENST00000574266 | TSF |
| 5% | chr17 | 1005272 | 1005174 | − | chr17 | 1003975 | 1003877 | − | ENST00000302538; ENST00000544583; ENST00000574437; ENST00000291107; ENST00000574139; ENST00000570525; ENST00000574266 | TSF |
| 4% | chr12 | 96340433 | 96341255 | + | chr12 | 96346495 | 96346601 | + | ENST00000266736; ENST00000548310 | TSF |
| 4% | chr12 | 96340433 | 96341255 | + | chr12 | 96346495 | 96346601 | + | ENST00000266736; ENST00000548310 | TSF |
| 4% | chr7 | 2403615 | 2403665 | + | chr7 | 2404007 | 2404164; 2404031 | + | ENST00000431643; ENST00000360876; ENST00000413917; ENST000 00397011 | TSF |
| 4% | chr7 | 2403615 | 2403665 | + | chr7 | 2404007 | 2404164; 2404031 | + | ENST00000431643; ENST00000360876; ENST00000413917; ENST000 00397011 | TSF |
| 4% | chr7 | 2403615 | 2403665 | + | chr7 | 2404007 | 2404164; 2404031 | + | ENST00000431643; ENST00000360876; ENST00000413917; ENST000 00397011 | TSF |
| 4% | chrX | 107293989 | 107294242 | + | chrX | 107301268 | 107301431 | + | ENST00000415430; ENST00000217957; ENST00000458383 | TSF |
| 4% | chrX | 107293989 | 107294242 | + | chrX | 107301268 | 107301431 | + | ENST00000415430; ENST00000217957; ENST00000458383 | TSF |
| 4% | chrX | 107293989 | 107294242 | + | chrX | 107301268 | 107301431 | + | ENST00000415430; ENST00000217957; ENST00000458383 | TSF |
| 4% | chr17 | 37898260 | 37898291 | + | chr17 | 37898505 | 37898709 | + | ENST00000445327 | TSF |
| 4% | chr3 | 126729058 | 126729222 | + | chr3 | 126730801 | 126731001 | + | ENST00000251772; ENST00000393409 | TSF |
| 4% | chr7 | 66386440 | 66386448 | + | chr7 | 66409963 | 66410248; 66410147; 66410019; 66410221; 66410248; | + | ENST00000341567; ENST00000607045; ENST00000433271; ENST00000413593; ENST00000424964; ENST00000418375 | TSF |
| 4% | chr7 | 66386440 | 66386448 | + | chr7 | 66409963 | 66410147; 66410019; 66410221; 66410248; 66410147; | + | ENST00000341567; ENST00000607045; ENST00000433271; ENST00000413593; ENST00000424964; ENST00000418375 | TSF |
| 4% | chr7 | 66386440 | 66386448 | + | chr7 | 66409963 | 66410019; 66410221; 66410248; 66410147; 66410019; | + | ENST00000341567; ENST00000607045; ENST00000433271; ENST00000413593; ENST00000424964; ENST00000418375 | TSF |
| 4% | chr7 | 66386440 | 66386448 | + | chr7 | 66409963 | 66410221; 66410248; | + | ENST00000341567; ENST00000607045; ENST00000433271; ENST00000413593; | TSF |

TABLE 22-continued

Transcript fusion for Esophageal Carcinoma (ESCA) Coordinates of the fusion sequences for which the donor is the TE.

| 1 | 2' | 3' | 4 | 5' | 6' | 7 | 8' | 9' | 10' | 11' |
|---|---|---|---|---|---|---|---|---|---|---|
| 4% | chr7 | 66386440 | 66386448 | + | chr7 | 66409963 | 66410147; 66410019; 66410221; 66410248; 66410147; 66410019; 66410221; 66410248; | + | ENST00000424964; ENST00000418375 ENST00000341567; ENST00000607045; ENST00000433271; ENST00000413593; ENST00000424964; ENST00000418375 | TSF |
| 4% | chr7 | 66386440 | 66386448 | + | chr7 | 66409963 | 66410147; 66410019; 66410221; 66410248; 66410147; | + | ENST00000341567; ENST00000607045; ENST00000433271; ENST00000413593; ENST00000424964; ENST00000418375 | TSF |
| 4% | chr14 | 97013173 | 97013272 | + | chr14 | 97014134 | 97014255 | + | ENST00000216277; ENST00000392990; ENST00000555626 | TSF |
| 4% | chr14 | 97013173 | 97013272 | + | chr14 | 97014134 | 97014255 | + | ENST00000216277; ENST00000392990; ENST00000555626 | TSF |
| 4% | chr14 | 97013173 | 97013272 | + | chr14 | 97014134 | 97014255 | + | ENST00000216277; ENST00000392990; ENST00000555626 | TSF |
| 4% | chr11 | 71508077 | 71508126 | + | chr11 | 71510607 | 71510693 | + | ENST00000346333; ENST00000359244; ENST00000426628 | TSF |
| 4% | chr1 | 1562829 | 1562926 | + | chr1 | 1563053 | 1563209 | + | ENST00000520777; ENST00000357210; ENST00000360522; ENST00000378710; ENST00000355826; ENST00000518681; ENST00000505820; ENST00000487053; ENST00000378712; ENST00000504599; ENST00000378708; ENST00000514234 | TSF |
| 4% | chr1 | 1562829 | 1562926 | + | chr1 | 1563053 | 1563209 | + | ENST00000520777; ENST00000357210; ENST00000360522; ENST00000378710; ENST00000355826; ENST00000518681; ENST00000505820; ENST00000487053; ENST00000378712; ENST00000504599; ENST00000378708; ENST00000514234 | TSF |
| 4% | chr1 | 1562829 | 1562926 | + | chr1 | 1563053 | 1563209 | + | ENST00000520777; ENST00000357210; ENST00000360522; ENST00000378710; ENST00000355826; ENST00000518681; ENST00000505820; ENST00000487053; ENST00000378712; ENST00000504599; ENST00000378708; ENST00000514234 | TSF |
| 4% | chr7 | 56020443 | 56020509 | + | chr7 | 56020872 | 56021011 | + | ENST00000426595 | TSF |
| 4% | chr2 | 202073108 | 202073190 | + | chr2 | 202073793 | 202074285 | + | ENST00000286186; ENST00000272879; ENST00000346817; ENST00000313728; ENST00000448480 | TSF |
| 4% | chr2 | 202073108 | 202073190 | + | chr2 | 202073793 | 202074285 | + | ENST00000286186; ENST00000272879; ENST00000346817; ENST00000313728; ENST00000448480 | TSF |
| 4% | chr15 | 74330065 | 74330296 | + | chr15 | 74335330 | 74335521; 74335480 | + | ENST00000395135; ENST00000268058; ENST00000565898; ENST00000564428 | TSF |
| 4% | chr15 | 74330065 | 74330296 | + | chr15 | 74335330 | 74335521; 74335480 | + | ENST00000395135; ENST00000268058; ENST00000565898; ENST00000564428 | TSF |
| 4% | chr7 | 33006587 | 33006627 | + | chr7 | 33014229 | 33014374 | + | ENST00000242209; ENST00000538336 | TSF |
| 4% | chr10 | 12277215 | 12277329 | + | chr10 | 12279143 | 12279265; 12279223 | + | ENST00000281141; ENST00000442050; ENST00000440613 | TSF |
| 4% | chr10 | 12277215 | 12277329 | + | chr10 | 12279143 | 12279265; 12279223 | + | ENST00000281141; ENST00000442050; ENST00000440613 | TSF |
| 4% | chr10 | 12277215 | 12277329 | + | chr10 | 12279143 | 12279265; 12279223 | + | ENST00000281141; ENST00000442050; ENST00000440613 | TSF |
| 4% | chr7 | 100877200 | 100877154 | − | chr7 | 100876195 | 100876114 | − | ENST00000308344; ENST00000401528; ENST00000414035; ENST00000412417 | TSF |
| 4% | chr7 | 100877200 | 100877154 | − | chr7 | 100876195 | 100876114 | − | ENST00000308344; ENST00000401528; ENST00000414035; ENST00000412417 | TSF |
| 4% | chr7 | 100877200 | 100877154 | − | chr7 | 100876195 | 100876114 | − | ENST00000308344; ENST00000401528; ENST00000414035; ENST00000412417 | TSF |
| 4% | chr9 | 132580720 | 132580632 | − | chr9 | 132576501 | 132576251 | − | ENST00000351698 | TSF |
| 4% | chr16 | 21060024 | 21059927 | − | chr16 | 21053525 | 21053349 | − | ENST00000261383; ENST00000415178 | TSF |
| 4% | chr16 | 21060024 | 21059927 | − | chr16 | 21053525 | 21053349 | − | ENST00000261383; ENST00000415178 | TSF |
| 4% | chr1 | 8924664 | 8924519 | − | chr1 | 8924151 | 8923950 | − | ENST00000234590 | TSF |
| 4% | chr9 | 130717031 | 130716974 | − | chr9 | 130716204 | 130716084 | − | ENST00000373095 | TSF |
| 4% | chr16 | 23606905 | 23606750 | − | chr16 | 23598640 | 23598518 | − | ENST00000007516; ENST00000570319 | TSF |
| 4% | chr15 | 69718867 | 69718995 | + | chr15 | 69721450 | 69721552 | + | ENST00000559279; ENST00000395392; ENST00000352331; ENST00000260363; ENST00000558585; ENST00000559283; ENST00000537891 | TSF |

TABLE 22-continued

Transcript fusion for Esophageal Carcinoma (ESCA) Coordinates of the fusion sequences for which the donor is the TE.

| 1 | 2' | 3' | 4 | 5' | 6' | 7 | 8' | 9' | 10' | 11' |
|---|---|---|---|---|---|---|---|---|---|---|
| 4% | chr15 | 69718867 | 69718995 | + | chr15 | 69721450 | 69721552 | + | ENST00000559279; ENST00000395392; ENST00000352331; ENST00000260363; ENST00000558585; ENST00000559283; ENST00000537891 | TSF |
| 4% | chr15 | 69718867 | 69718995 | + | chr15 | 69721450 | 69721552 | + | ENST00000559279; ENST00000395392; ENST00000352331; ENST00000260363; ENST00000558585; ENST00000559283; ENST00000537891 | TSF |
| 4% | chr15 | 69718867 | 69718995 | + | chr15 | 69721450 | 69721552 | + | ENST00000559279; ENST00000395392; ENST00000352331; ENST00000260363; ENST00000558585; ENST00000559283; ENST00000537891 | TSF |
| 4% | chr1 | 116594535 | 116594632 | + | chr1 | 116605383 | 116605503 | + | ENST00000369503 | TSF |
| 4% | chr10 | 48230850 | 48230877 | + | chr10 | 48231779 | 48231814 | + | ENST00000453919; ENST00000456984 | TSF |
| 4% | chr10 | 48230850 | 48230877 | + | chr10 | 48231779 | 48231814 | + | ENST00000453919; ENST00000456984 | TSF |
| 4% | chr12 | 51048448 | 51048823 | + | chr12 | 51053977 | 51054102 | + | ENST00000301180 | TSF |
| 4% | chr20 | 60878087 | 60878105 | + | chr20 | 60878775 | 60878837 | + | ENST00000253003 | TSF |
| 4% | chr12 | 122387836 | 122388242 | + | chr12 | 122394980 | 122395174 | + | ENST00000288912; ENST00000397454 | TSF |
| 4% | chr12 | 122387836 | 122388242 | + | chr12 | 122394980 | 122395174 | + | ENST00000288912; ENST00000397454 | TSF |
| 4% | chr1 | 1562829 | 1562973 | + | chr1 | 1563053 | 1563209 | + | ENST00000520777; ENST00000357210; ENST00000360522; ENST00000378710; ENST00000355826; ENST00000518681; ENST00000505820; ENST00000487053; ENST00000378712; ENST00000504599; ENST00000378708; ENST00000514234 | TSF |
| 4% | chr1 | 1562829 | 1562973 | + | chr1 | 1563053 | 1563209 | + | ENST00000520777; ENST00000357210; ENST00000360522; ENST00000378710; ENST00000355826; ENST00000518681; ENST00000505820; ENST00000487053; ENST00000378712; ENST00000504599; ENST00000378708; ENST00000514234 | TSF |
| 4% | chr1 | 1562829 | 1562973 | + | chr1 | 1563053 | 1563209 | + | ENST00000520777; ENST00000357210; ENST00000360522; ENST00000378710; ENST00000355826; ENST00000518681; ENST00000505820; ENST00000487053; ENST00000378712; ENST00000504599; ENST00000378708; ENST00000514234 | TSF |
| 4% | chr20 | 45337040 | 45337192 | + | chr20 | 45353680 | 45354963 | + | ENST00000359271 | TSF |
| 4% | chr14 | 20973494 | 20974255 | + | chr14 | 20978626 | 20979281 | + | ENST00000430083 | TSF |
| 4% | chr12 | 49659927 | 49660025 | + | chr12 | 49663248 | 49663470; 49663252 | + | ENST00000541364; ENST00000552125; ENST00000301072; ENST00000549183 | TSF |
| 4% | chr12 | 49659927 | 49660025 | + | chr12 | 49663248 | 49663470; 49663252 | + | ENST00000541364; ENST00000552125; ENST00000301072; ENST00000549183 | TSF |
| 4% | chr12 | 49659927 | 49660025 | + | chr12 | 49663248 | 49663470; 49663252 | + | ENST00000541364; ENST00000552125; ENST00000301072; ENST00000549183 | TSF |
| 4% | chr14 | 106174427 | 106174466 | + | chr14 | 106173770 | 106173505 | − | ENST00000390547 | TSF |
| 4% | chr1 | 45988716 | 45988450 | − | chr1 | 45981479 | 45981326 | − | ENST00000262746; ENST00000319248; ENST00000447184; ENST00000424390 | TSF |
| 4% | chr1 | 45988716 | 45988450 | − | chr1 | 45981479 | 45981326 | − | ENST00000262746; ENST00000319248; ENST00000447184; ENST00000424390 | TSF |
| 4% | chr10 | 5060345 | 5060092 | − | chr10 | 5040939 | 5040817 | − | ENST00000380753; ENST00000421196; ENST00000407674; ENST00000604507 | TSF |
| 4% | chr10 | 5060345 | 5060092 | − | chr10 | 5040939 | 5040817 | − | ENST00000380753; ENST00000421196; ENST00000407674; ENST00000604507 | TSF |
| 4% | chr20 | 33351314 | 33350530 | − | chr20 | 33346736 | 33346608 | − | ENST00000374796; ENST00000359003 | TSF |
| 4% | chrX | 53664297 | 53664254 | − | chrX | 53661250 | 53661188 | − | ENST00000342160; ENST00000262854; ENST00000218328 | TSF |
| 4% | chrX | 53664297 | 53664254 | − | chrX | 53661250 | 53661188 | − | ENST00000342160; ENST00000262854; ENST00000218328 | TSF |
| 4% | chr12 | 58023123 | 58023062 | − | chr12 | 58022929 | 58022831; 58022905 | − | ENST00000341156; ENST00000418555; ENST00000552798; ENST00000549391 | TSF |
| 4% | chr12 | 58023123 | 58023062 | − | chr12 | 58022929 | 58022831; 58022905 | − | ENST00000341156; ENST00000418555; ENST00000552798; ENST00000549391 | TSF |
| 4% | chr5 | 145541009 | 145540727 | − | chr5 | 145540049 | 145539937 | − | ENST00000394434; ENST00000545646; ENST00000274562; ENST00000510191 | TSF |
| 4% | chrX | 134971303 | 134971006 | − | chrX | 134950187 | 134950078 | − | ENST00000420087; ENST00000463085; ENST00000370724; ENST00000491480 | TSF |
| 4% | chrX | 134971303 | 134971006 | − | chrX | 134950187 | 134950078 | − | ENST00000420087; ENST00000463085; ENST00000370724; ENST00000491480 | TSF |
| 4% | chr17 | 17816540 | 17815655 | − | chr17 | 17810845 | 17810761 | − | ENST00000581396; ENST00000379504; ENST00000318094; ENST00000395739; ENST00000535933; ENST00000540946; ENST00000542206 | TSF |
| 4% | chr17 | 17816540 | 17815655 | − | chr17 | 17810845 | 17810761 | − | ENST00000581396; ENST00000379504; ENST00000318094; ENST00000395739; | TSF |

TABLE 22-continued

Transcript fusion for Esophageal Carcinoma (ESCA) Coordinates of the fusion sequences for which the donor is the TE.

| 1 | 2' | 3' | 4 | 5' | 6' | 7 | 8' | 9' | 10' | 11' |
|---|---|---|---|---|---|---|---|---|---|---|
| 4% | chr17 | 17816540 | 17815655 | − | chr17 | 17810845 | 17810761 | − | ENST00000535933; ENST00000540946; ENST00000542206 ENST00000581396; ENST00000379504; ENST00000318094; ENST00000395739; | TSF |
| 4% | chr17 | 17816540 | 17815655 | − | chr17 | 17810845 | 17810761 | − | ENST00000535933; ENST00000540946; ENST00000542206 ENST00000581396; ENST00000379504; ENST00000318094; ENST00000395739; | TSF |
| 4% | chr17 | 17816540 | 17815655 | − | chr17 | 17810845 | 17810761 | − | ENST00000535933; ENST00000540946; ENST00000542206 ENST00000581396; ENST00000379504; ENST00000318094; ENST00000395739; | TSF |
| 4% | chr17 | 17816540 | 17815655 | − | chr17 | 17810845 | 17810761 | − | ENST00000535933; ENST00000540946; ENST00000542206 ENST00000581396; ENST00000379504; ENST00000318094; ENST00000395739; | TSF |
| 4% | chr1 | 32152700 | 32152171 | − | chr1 | 32151880 | 32151845 | − | ENST00000271069; ENST00000373672; ENST00000373668 | TSF |
| 4% | chr1 | 32152700 | 32152171 | − | chr1 | 32151880 | 32151845 | − | ENST00000271069; ENST00000373672; ENST00000373668 | TSF |
| 4% | chr1 | 32152700 | 32152171 | − | chr1 | 32151880 | 32151845 | − | ENST00000271069; ENST00000373672; ENST00000373668 | TSF |
| 4% | chr17 | 39741127 | 39741014 | − | chr17 | 39659564 | 39659539 | − | ENST00000246635; ENST00000336861; ENST00000587544; ENST00000590425; ENST00000587435 | TSF |
| 4% | chr17 | 39741127 | 39741014 | − | chr17 | 39659564 | 39659539 | − | ENST00000246635; ENST00000336861; ENST00000587544; ENST00000590425; ENST00000587435 | TSF |
| 4% | chr17 | 39741127 | 39741014 | − | chr17 | 39659564 | 39659539 | − | ENST00000246635; ENST00000336861; ENST00000587544; ENST00000590425; ENST00000587435 | TSF |
| 4% | chr17 | 39741127 | 39741014 | − | chr17 | 39659564 | 39659539 | − | ENST00000246635; ENST00000336861; ENST00000587544; ENST00000590425; ENST00000587435 | TSF |
| 4% | chr17 | 39741127 | 39741014 | − | chr17 | 39659564 | 39659539 | − | ENST00000246635; ENST00000336861; ENST00000587544; ENST00000590425; ENST00000587435 | TSF |
| 4% | chr1 | 217698243 | 217697476 | − | chr1 | 217688231 | 217688164 | − | ENST00000366935 | TSF |
| 4% | chr19 | 5714928 | 5714878 | − | chr19 | 5714282 | 5714194 | − | ENST00000360614; ENST00000590558; ENST00000585374; ENST00000593119; ENST00000590729 | TSF |
| 4% | chr19 | 5714928 | 5714878 | − | chr19 | 5714282 | 5714194 | − | ENST00000360614; ENST00000590558; ENST00000585374; ENST00000593119; ENST00000590729 | TSF |
| 4% | chr19 | 5714928 | 5714878 | − | chr19 | 5714282 | 5714194 | − | ENST00000360614; ENST00000590558; ENST00000585374; ENST00000593119; ENST00000590729 | TSF |
| 4% | chr12 | 14670381 | 14670239 | − | chr12 | 14664645 | 14664445 | − | ENST00000240617 | TSF |
| 4% | chr10 | 47198502 | 47198475 | − | chr10 | 47197573 | 47197538 | − | ENST00000452145; ENST00000413193; ENST00000355232 | TSF |
| 4% | chr10 | 47198502 | 47198475 | − | chr10 | 47197573 | 47197538 | − | ENST00000452145; ENST00000413193; ENST00000355232 | TSF |
| 4% | chr10 | 47198502 | 47198475 | − | chr10 | 47197573 | 47197538 | − | ENST00000452145; ENST00000413193; ENST00000355232 | TSF |
| 4% | chr17 | 27441253 | 27441216 | − | chr17 | 27441115 | 27441029 | − | ENST00000354329; ENST00000533112; ENST00000531253; ENST00000527372 | TSF |
| 4% | chr17 | 27441253 | 27441216 | − | chr17 | 27441115 | 27441029 | − | ENST00000354329; ENST00000533112; ENST00000531253; ENST00000527372 | TSF |
| 4% | chr17 | 27441253 | 27441216 | − | chr17 | 27441115 | 27441029 | − | ENST00000354329; ENST00000533112; ENST00000531253; ENST00000527372 | TSF |
| 4% | chrX | 134971303 | 134971006 | − | chrX | 134967437 | 134967328 | − | ENST00000491002; ENST00000448053; ENST00000472834 | TSF |
| 4% | chrX | 134975955 | 134975496 | − | chrX | 134950187 | 134950078 | − | ENST00000420087; ENST00000463085; ENST00000370724; ENST00000491480 | TSF |
| 4% | chrX | 134975955 | 134975496 | − | chrX | 134950187 | 134950078 | − | ENST00000420087; ENST00000463085; ENST00000370724; ENST00000491480 | TSF |
| 4% | chr7 | 97938760 | 97938714 | − | chr7 | 97937208 | 97937001 | − | ENST00000005260 | TSF |
| 4% | chrX | 134975955 | 134975496 | − | chrX | 134967437 | 134967328 | − | ENST00000491002; ENST00000448053; ENST00000472834 | TSF |
| 3% | chr19 | 45365391 | 45365456 | + | chr19 | 45368528 | 45368917 | + | ENST00000252485; ENST00000252483 | TSF |
| 3% | chr19 | 45365391 | 45365456 | + | chr19 | 45368528 | 45368917 | + | ENST00000252485; ENST00000252483 | TSF |
| 3% | chr2 | 28630786 | 28630878 | + | chr2 | 28631626 | 28631733 | + | ENST00000379619; ENST00000264716; ENST00000436647; ENST00000545753 | TSF |

TABLE 22-continued

Transcript fusion for Esophageal Carcinoma (ESCA) Coordinates of the fusion sequences for which the donor is the TE.

| 1 | 2' | 3' | 4 | 5' | 6' | 7 | 8' | 9' | 10' | 11' |
|---|---|---|---|---|---|---|---|---|---|---|
| 3% | chr2 | 28630786 | 28630878 | + | chr2 | 28631626 | 28631733 | + | ENST00000379619; ENST00000264716; ENST00000436647; ENST00000545753 | TSF |
| 3% | chr2 | 28630786 | 28630878 | + | chr2 | 28631626 | 28631733 | + | ENST00000379619; ENST00000264716; ENST00000436647; ENST00000545753 | TSF |
| 3% | chr17 | 48820020 | 48820202 | + | chr17 | 48821067 | 48821171 | + | ENST00000505658; ENST00000393227; ENST00000240304; ENST00000544170 | TSF |
| 3% | chr17 | 48820020 | 48820202 | + | chr17 | 48821067 | 48821171 | + | ENST00000505658; ENST00000393227; ENST00000240304; ENST00000544170 | TSF |
| 3% | chr17 | 48820020 | 48820202 | + | chr17 | 48821067 | 48821171 | + | ENST00000505658; ENST00000393227; ENST00000240304; ENST00000544170 | TSF |
| 3% | chr7 | 134213194 | 134213199 | + | chr7 | 134215395 | 134215562 | + | ENST00000359579 | TSF |
| 3% | chr22 | 37963762 | 37963951 | + | chr22 | 37964115 | 37964827 | + | ENST00000249014 | TSF |
| 3% | chr11 | 61544394 | 61544423 | + | chr11 | 61544736 | 61544936 | + | ENST00000278836; ENST00000265460; ENST00000327797 | TSF |
| 3% | chr11 | 61544394 | 61544423 | + | chr11 | 61544736 | 61544936 | + | ENST00000278836; ENST00000265460; ENST00000327797 | TSF |
| 3% | chr11 | 61544394 | 61544423 | + | chr11 | 61544736 | 61544936 | + | ENST00000278836; ENST00000265460; ENST00000327797 | TSF |
| 3% | chr3 | 155605105 | 155605320 | + | chr3 | 155611307 | 155611488 | + | ENST00000496455 | TSF |
| 3% | chr3 | 130586141 | 130586917 | + | chr3 | 130649260 | 130649370 | + | ENST00000393221; ENST00000533801; ENST00000510168; ENST00000508532; ENST00000505072; ENST00000509662; ENST00000328560; ENST00000428331; ENST00000359644; ENST00000422190 | TSF |
| 3% | chr3 | 130586141 | 130586917 | + | chr3 | 130649260 | 130649370 | + | ENST00000393221; ENST00000533801; ENST00000510168; ENST00000508532; ENST00000505072; ENST00000509662; ENST00000328560; ENST00000428331; ENST00000359644; ENST00000422190 | TSF |
| 3% | chr3 | 130586141 | 130586917 | + | chr3 | 130649260 | 130649370 | + | ENST00000393221; ENST00000533801; ENST00000510168; ENST00000508532; ENST00000505072; ENST00000509662; ENST00000328560; ENST00000428331; ENST00000359644; ENST00000422190 | TSF |
| 3% | chr3 | 130586141 | 130586917 | + | chr3 | 130649260 | 130649370 | + | ENST00000393221; ENST00000533801; ENST00000510168; ENST00000508532; ENST00000505072; ENST00000509662; ENST00000328560; ENST00000428331; ENST00000359644; ENST00000422190 | TSF |
| 3% | chr3 | 130586141 | 130586917 | + | chr3 | 130649260 | 130649370 | + | ENST00000393221; ENST00000533801; ENST00000510168; ENST00000508532; ENST00000505072; ENST00000509662; ENST00000328560; ENST00000428331; ENST00000359644; ENST00000422190 | TSF |
| 3% | chr3 | 130586141 | 130586917 | + | chr3 | 130649260 | 130649370 | + | ENST00000393221; ENST00000533801; ENST00000510168; ENST00000508532; ENST00000505072; ENST00000509662; ENST00000328560; ENST00000428331; ENST00000359644; ENST00000422190 | TSF |
| 3% | chr3 | 130586141 | 130586917 | + | chr3 | 130649260 | 130649370 | + | ENST00000393221; ENST00000533801; ENST00000510168; ENST00000508532; ENST00000505072; ENST00000509662; ENST00000328560; ENST00000428331; ENST00000359644; ENST00000422190 | TSF |
| 3% | chr16 | 53866877 | 53867152 | + | chr16 | 53878067 | 53878210; 53878156 | + | ENST00000471389; ENST00000464071 | TSF |
| 3% | chr16 | 53866877 | 53867152 | + | chr16 | 53878067 | 53878210; 53878156 | + | ENST00000471389; ENST00000464071 | TSF |
| 3% | chr4 | 57321042 | 57321258 | + | chr4 | 57325538 | 57325704; 57325665 | + | ENST00000514888; ENST00000264221; ENST00000505164; ENST00000399688; ENST00000512576 | TSF |
| 3% | chr4 | 57321042 | 57321258 | + | chr4 | 57325538 | 57325704; 57325665 | + | ENST00000514888; ENST00000264221; ENST00000505164; ENST00000399688; ENST00000512576 | TSF |
| 3% | chrX | 134883429 | 134883726 | + | chrX | 134887292 | 134887401 | + | ENST00000370734; ENST00000485366; ENST00000443882 | TSF |
| 3% | chr3 | 189566580 | 189567255 | + | chr3 | 189582021 | 189582207; 189582057 | + | ENST00000264731; ENST00000382063; ENST00000418709; ENST00000320472; ENST00000392460; ENST00000440651; ENST00000354600; ENST00000434928; ENST00000437221; ENST00000392463; ENST00000392461; ENST00000449992; ENST00000456148 | TSF |
| 3% | chr3 | 189566580 | 189567255 | + | chr3 | 189582021 | 189582207; 189582057 | + | ENST00000264731; ENST00000382063; ENST00000418709; ENST00000320472; | TSF |

TABLE 22-continued

Transcript fusion for Esophageal Carcinoma (ESCA) Coordinates of the fusion sequences for which the donor is the TE.

| 1 | 2' | 3' | 4 | 5' | 6' | 7 | 8' | 9' | 10' | 11' |
|---|----|----|---|----|----|---|----|----|-----|-----|
| | | | | | | | | | ENST00000392460; ENST00000440651; ENST00000354600; ENST00000434928; ENST00000437221; ENST00000392463; ENST00000392461; ENST00000449992; ENST00000456148 | |
| | 3% | chr3 | 189566580 | 189567255 | + | chr3 | 189582021 | 189582207; 189582057 | + | ENST00000264731; ENST00000382063; ENST00000418709; ENST00000320472; ENST00000392460; ENST00000440651; ENST00000354600; ENST00000434928; ENST00000437221; ENST00000392463; ENST00000392461; ENST00000449992; ENST00000456148 | TSF |
| | 3% | chr3 | 189566580 | 189567255 | + | chr3 | 189582021 | 189582207; 189582057 | + | ENST00000264731; ENST00000382063; ENST00000418709; ENST00000320472; ENST00000392460; ENST00000440651; ENST00000354600; ENST00000434928; ENST00000437221; ENST00000392463; ENST00000392461; ENST00000449992; ENST00000456148 | TSF |
| | 3% | chr3 | 189566580 | 189567255 | + | chr3 | 189582021 | 189582207; 189582057 | + | ENST00000264731; ENST00000382063; ENST00000418709; ENST00000320472; ENST00000392460; ENST00000440651; ENST00000354600; ENST00000434928; ENST00000437221; ENST00000392463; ENST00000392461; ENST00000449992; ENST00000456148 | TSF |
| | 3% | chr3 | 189566580 | 189567255 | + | chr3 | 189582021 | 189582207; 189582057 | + | ENST00000264731; ENST00000382063; ENST00000418709; ENST00000320472; ENST00000392460; ENST00000440651; ENST00000354600; ENST00000434928; ENST00000437221; ENST00000392463; ENST00000392461; ENST00000449992; ENST00000456148 | TSF |
| | 3% | chr1 | 233789624 | 233790730 | + | chr1 | 233802341 | 233802736 | + | ENST00000366621; ENST00000366620; ENST00000446915 | TSF |
| | 3% | chr1 | 233789624 | 233790730 | + | chr1 | 233802341 | 233802736 | + | ENST00000366621; ENST00000366620; ENST00000446915 | TSF |
| | 3% | chr2 | 242276229 | 242276279 | + | chr2 | 242276797 | 242276931; 242276900; 242276863; 242276848 | + | ENST00000391973; ENST00000428282; ENST00000360051; ENST00000391971; ENST00000401990; ENST00000407971; ENST00000436795; ENST00000411484; ENST00000402092; ENST00000443492; ENST00000437066; ENST00000449239; ENST00000457874 | TSF |
| | 3% | chr2 | 242276229 | 242276279 | + | chr2 | 242276797 | 242276931; 242276900; 242276863; 242276848 | + | ENST00000391973; ENST00000428282; ENST00000360051; ENST00000391971; ENST00000401990; ENST00000407971; ENST00000436795; ENST00000411484; ENST00000402092; ENST00000443492; ENST00000437066; ENST00000449239; ENST00000457874 | TSF |
| | 3% | chr2 | 242276229 | 242276279 | + | chr2 | 242276797 | 242276931; 242276900; 242276863; 242276848 | + | ENST00000391973; ENST00000428282; ENST00000360051; ENST00000391971; ENST00000401990; ENST00000407971; ENST00000436795; ENST00000411484; ENST00000402092; ENST00000443492; ENST00000437066; ENST00000449239; ENST00000457874 | TSF |
| | 3% | chr2 | 242276229 | 242276279 | + | chr2 | 242276797 | 242276931; 242276900; 242276863; 242276848 | + | ENST00000391973; ENST00000428282; ENST00000360051; ENST00000391971; ENST00000401990; ENST00000407971; ENST00000436795; ENST00000411484; ENST00000402092; ENST00000443492; ENST00000437066; ENST00000449239; ENST00000457874 | TSF |
| | 3% | chr2 | 242276229 | 242276279 | + | chr2 | 242276797 | 242276931; 242276900; 242276863; 242276848 | + | ENST00000391973; ENST00000428282; ENST00000360051; ENST00000391971; ENST00000401990; ENST00000407971; ENST00000436795; ENST00000411484; ENST00000402092; ENST00000443492; ENST00000437066; ENST00000449239; ENST00000457874 | TSF |

TABLE 22-continued

Transcript fusion for Esophageal Carcinoma (ESCA) Coordinates of the fusion sequences for which the donor is the TE.

| 1 | 2' | 3' | 4 | 5' | 6' | 7 | 8' | 9' | 10' | 11' |
|---|---|---|---|---|---|---|---|---|---|---|
| 3% | chr2 | 242276229 | 242276279 | + | chr2 | 242276797 | 242276931; 242276900; 242276863; 242276848 | + | ENST00000391973; ENST00000428282; ENST00000360051; ENST00000391971; ENST00000401990; ENST00000407971; ENST00000436795; ENST00000411484; ENST00000402092; ENST00000443492; ENST00000437066; ENST00000449239; ENST00000457874 | TSF |
| 3% | chr2 | 242276229 | 242276279 | + | chr2 | 242276797 | 242276931; 242276900; 242276863; 242276848 | + | ENST00000391973; ENST00000428282; ENST00000360051; ENST00000391971; ENST00000401990; ENST00000407971; ENST00000436795; ENST00000411484; ENST00000402092; ENST00000443492; ENST00000437066; ENST00000449239; ENST00000457874 | TSF |
| 3% | chr2 | 242276229 | 242276279 | + | chr2 | 242276797 | 242276931; 242276900; 242276863; 242276848 | + | ENST00000391973; ENST00000428282; ENST00000360051; ENST00000391971; ENST00000401990; ENST00000407971; ENST00000436795; ENST00000411484; ENST00000402092; ENST00000443492; ENST00000437066; ENST00000449239; ENST00000457874 | TSF |
| 3% | chr2 | 102468305 | 102468327 | + | chr2 | 102472439 | 102472600 | + | ENST00000425019; ENST00000302217; ENST00000324219; ENST00000350198; ENST00000413150; ENST00000347699; ENST00000456652; ENST00000417294; ENST00000350878; ENST00000421882; ENST00000418101 | TSF |
| 3% | chr2 | 102468305 | 102468327 | + | chr2 | 102472439 | 102472600 | + | ENST00000425019; ENST00000302217; ENST00000324219; ENST00000350198; ENST00000413150; ENST00000347699; ENST00000456652; ENST00000417294; ENST00000350878; ENST00000421882; ENST00000418101 | TSF |
| 3% | chr2 | 102468305 | 102468327 | + | chr2 | 102472439 | 102472600 | + | ENST00000425019; ENST00000302217; ENST00000324219; ENST00000350198; ENST00000413150; ENST00000347699; ENST00000456652; ENST00000417294; ENST00000350878; ENST00000421882; ENST00000418101 | TSF |
| 3% | chr2 | 102468305 | 102468327 | + | chr2 | 102472439 | 102472600 | + | ENST00000425019; ENST00000302217; ENST00000324219; ENST00000350198; ENST00000413150; ENST00000347699; ENST00000456652; ENST00000417294; ENST00000350878; ENST00000421882; ENST00000418101 | TSF |
| 3% | chr2 | 102468305 | 102468327 | + | chr2 | 102472439 | 102472600 | + | ENST00000425019; ENST00000302217; ENST00000324219; ENST00000350198; ENST00000413150; ENST00000347699; ENST00000456652; ENST00000417294; ENST00000350878; ENST00000421882; ENST00000418101 | TSF |
| 3% | chr2 | 102468305 | 102468327 | + | chr2 | 102472439 | 102472600 | + | ENST00000425019; ENST00000302217; ENST00000324219; ENST00000350198; ENST00000413150; ENST00000347699; ENST00000456652; ENST00000417294; ENST00000350878; ENST00000421882; ENST00000418101 | TSF |
| 3% | chr2 | 102468305 | 102468327 | + | chr2 | 102472439 | 102472600 | + | ENST00000425019; ENST00000302217; ENST00000324219; ENST00000350198; ENST00000413150; ENST00000347699; ENST00000456652; ENST00000417294; ENST00000350878; ENST00000421882; ENST00000418101 | TSF |
| 3% | chr2 | 102468305 | 102468327 | + | chr2 | 102472439 | 102472600 | + | ENST00000425019; ENST00000302217; ENST00000324219; ENST00000350198; ENST00000413150; ENST00000347699; ENST00000456652; ENST00000417294; ENST00000350878; ENST00000421882; ENST00000418101 | TSF |
| 3% | chr2 | 102468305 | 102468327 | + | chr2 | 102472439 | 102472600 | + | ENST00000425019; ENST00000302217; ENST00000324219; ENST00000350198; ENST00000413150; ENST00000347699; ENST00000456652; ENST00000417294; ENST00000350878; ENST00000421882; ENST00000418101 | TSF |

TABLE 22-continued

Transcript fusion for Esophageal Carcinoma (ESCA) Coordinates of the fusion sequences for which the donor is the TE.

| 1 | 2' | 3' | 4 | 5' | 6' | 7 | 8' | 9' | 10' | 11' |
|---|---|---|---|---|---|---|---|---|---|---|
| 3% | chr2 | 102468305 | 102468327 | + | chr2 | 102472439 | 102472600 | + | ENST00000425019; ENST00000302217; ENST00000324219; ENST00000350198; ENST00000413150; ENST00000347699; ENST00000456652; ENST00000417294; ENST00000350878; ENST00000421882; ENST00000418101 | TSF |
| 3% | chr2 | 102468305 | 102468327 | + | chr2 | 102472439 | 102472600 | + | ENST00000425019; ENST00000302217; ENST00000324219; ENST00000350198; ENST00000413150; ENST00000347699; ENST00000456652; ENST00000417294; ENST00000350878; ENST00000421882; ENST00000418101 | TSF |
| 3% | chr11 | 102045048 | 102045146 | + | chr11 | 102056749 | 102056862 | + | ENST00000282441; ENST00000537274; ENST00000531439; ENST00000524575 | TSF |
| 3% | chr11 | 102045048 | 102045146 | + | chr11 | 102056749 | 102056862 | + | ENST00000282441; ENST00000537274; ENST00000531439; ENST00000524575 | TSF |
| 3% | chr11 | 102045048 | 102045146 | + | chr11 | 102056749 | 102056862 | + | ENST00000282441; ENST00000537274; ENST00000531439; ENST00000524575 | TSF |
| 3% | chr15 | 44051756 | 44051953 | + | chr15 | 44053622 | 44053729 | + | ENST00000300289; ENST00000538521 | TSF |
| 3% | chr15 | 89717587 | 89717675 | + | chr15 | 89719043 | 89719226 | + | ENST00000352732; ENST00000565973; ENST00000355100 | TSF |
| 3% | chr16 | 56972194 | 56972244 | + | chr16 | 56973149 | 56973271 | + | ENST00000439977; ENST00000300302; ENST00000379792; ENST00000569429; ENST00000563343; ENST00000568358 | TSF |
| 3% | chr16 | 56972194 | 56972244 | + | chr16 | 56973149 | 56973271 | + | ENST00000439977; ENST00000300302; ENST00000379792; ENST00000569429; ENST00000563343; ENST00000568358 | TSF |
| 3% | chr16 | 56972194 | 56972244 | + | chr16 | 56973149 | 56973271 | + | ENST00000439977; ENST00000300302; ENST00000379792; ENST00000569429; ENST00000563343; ENST00000568358 | TSF |
| 3% | chr16 | 56972194 | 56972244 | + | chr16 | 56973149 | 56973271 | + | ENST00000439977; ENST00000300302; ENST00000379792; ENST00000569429; ENST00000563343; ENST00000568358 | TSF |
| 3% | chr7 | 55464873 | 55464924 | + | chr7 | 55466116 | 55466323 | + | ENST00000254770 | TSF |
| 3% | chr4 | 124087242 | 124087575 | + | chr4 | 124177171 | 124177335 | + | ENST00000274008 | TSF |
| 3% | chr6 | 74413627 | 74413676 | + | chr6 | 74432974 | 74433002 | + | ENST00000422508; ENST00000437994; ENST00000287097 | TSF |
| 3% | chr6 | 74413627 | 74413676 | + | chr6 | 74432974 | 74433002 | + | ENST00000422508; ENST00000437994; ENST00000287097 | TSF |
| 3% | chr6 | 74413627 | 74413676 | + | chr6 | 74432974 | 74433002 | + | ENST00000422508; ENST00000437994; ENST00000287097 | TSF |
| 3% | chr9 | 131541764 | 131542578 | + | chr9 | 131550613 | 131550686 | + | ENST00000372648; ENST00000223865 | TSF |
| 3% | chr9 | 131541764 | 131542578 | + | chr9 | 131550613 | 131550686 | + | ENST00000372648; ENST00000223865 | TSF |
| 3% | chr7 | 23290404 | 23290481 | + | chr7 | 23292926 | 23293078 | + | ENST00000258733; ENST00000381990; ENST00000409458; ENST00000453162 | TSF |
| 3% | chr7 | 23290404 | 23290481 | + | chr7 | 23292926 | 23293078 | + | ENST00000258733; ENST00000381990; ENST00000409458; ENST00000453162 | TSF |
| 3% | chr7 | 23290404 | 23290481 | + | chr7 | 23292926 | 23293078 | + | ENST00000258733; ENST00000381990; ENST00000409458; ENST00000453162 | TSF |
| 3% | chr7 | 23290404 | 23290481 | + | chr7 | 23292926 | 23293078 | + | ENST00000258733; ENST00000381990; ENST00000409458; ENST00000453162 | TSF |
| 3% | chr12 | 122430912 | 122431655 | + | chr12 | 122439403 | 122439504 | + | ENST00000288912 | TSF |
| 3% | chr22 | 38166164 | 38166230 | + | chr22 | 38167657 | 38167743 | + | ENST00000406386; ENST00000403663 | TSF |
| 3% | chr16 | 58758969 | 58758792 | − | chr16 | 58757806 | 58757650 | − | ENST00000245206; ENST00000434819 | TSF |
| 3% | chr16 | 58758969 | 58758792 | − | chr16 | 58757806 | 58757650 | − | ENST00000245206; ENST00000434819 | TSF |
| 3% | chr12 | 54862718 | 54862609 | − | chr12 | 54858951 | 54858851 | − | ENST00000546931; ENST00000552397; ENST00000305879 | TSF |
| 3% | chr12 | 54862718 | 54862609 | − | chr12 | 54858951 | 54858851 | − | ENST00000546931; ENST00000552397; ENST00000305879 | TSF |
| 3% | chr11 | 93468219 | 93468129 | − | chr11 | 93466563 | 93466528 | − | ENST00000393259 | TSF |
| 3% | chr22 | 40898710 | 40898220 | − | chr22 | 40859290 | 40859225 | − | ENST00000422851 | TSF |
| 3% | chrX | 134954053 | 134953756 | − | chrX | 134932924 | 134932815 | − | ENST00000487941; ENST00000434966; ENST00000494421 | TSF |
| 3% | chr1 | 43634418 | 43634409 | − | chr1 | 43632906 | 43632831 | − | ENST00000431635; ENST00000236051 | TSF |
| 3% | chrX | 134936794 | 134936497 | − | chrX | 134932924 | 134932815 | − | ENST00000487941; ENST00000434966; ENST00000494421 | TSF |
| 3% | chr13 | 95233957 | 95233815 | − | chr13 | 95233443 | 95233345 | − | ENST00000261296 | TSF |
| 3% | chr11 | 64599672 | 64599483 | − | chr11 | 64599193 | 64598977 | − | ENST00000342711 | TSF |

TABLE 23

Transcript fusion for Glioblastoma Multiforme (GBM)
Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 93% | chr17 | 40812657 | 40812725 | + | ENST00000251412 | chr17 | 40813219 | 40813265 | + | TAF |
| 82% | chr5 | 146460699; 146460671 | 146460622 | − | ENST00000504198; ENST00000394409 | chr5 | 146414803 | 146414648 | − | TAF |
| 82% | chr5 | 146460699; 146460671 | 146460622 | − | ENST00000504198; ENST00000394409 | chr5 | 146414803 | 146414648 | − | TAF |
| 76% | chr11 | 73589824 | 73589864 | + | ENST00000310571 | chr11 | 73598085 | 73598225 | + | TAF |
| 75% | chr6 | 36762426 | 36762367 | − | ENST00000244751 | chr6 | 36760223 | 36760189 | − | TAF |
| 75% | chr14 | 31922550 | 31922481 | − | ENST00000549185; ENST00000547378; ENST00000310850; ENST00000356180 | chr14 | 31907346 | 31905965 | − | TSF |
| 66% | chrX | 64743587; 64743497 | 64743440 | − | ENST00000374807; ENST00000374811; ENST00000374804; ENST00000469091 | chrX | 64742373 | 64741630 | − | TAF |
| 66% | chrX | 64743587; 64743497 | 64743440 | − | ENST00000374807; ENST00000374811; ENST00000374804; ENST00000469091 | chrX | 64742373 | 64741630 | − | TAF |
| 66% | chrX | 64743587; 64743497 | 64743440 | − | ENST00000374807; ENST00000374811; ENST00000374804; ENST00000469091 | chrX | 64742373 | 64741630 | − | TAF |
| 66% | chrX | 64743587; 64743497 | 64743440 | − | ENST00000374807; ENST00000374811; ENST00000374804; ENST00000469091 | chrX | 64742373 | 64741630 | − | TAF |
| 60% | chr4 | 134084132 | 134084437 | + | ENST00000264360 | chr4 | 134129231 | 134129518 | + | TAF |
| 50% | chr9 | 131002264 | 131002275 | + | ENST00000475805; ENST00000341179; ENST00000372923; ENST00000393594; ENST00000486160 | chr9 | 131002706 | 131002973 | + | TAF |
| 50% | chr9 | 131002264 | 131002275 | + | ENST00000475805; ENST00000341179; ENST00000372923; ENST00000393594; ENST00000486160 | chr9 | 131002706 | 131002973 | + | TAF |
| 45% | chr19 | 1235564 | 1235500 | − | ENST00000590083; ENST00000382477; ENST00000215376; ENST00000589260 | chr19 | 1235389 | 1235290 | − | TAF |
| 45% | chr19 | 1235564 | 1235500 | − | ENST00000590083; ENST00000382477; ENST00000215376; ENST00000589260 | chr19 | 1235389 | 1235290 | − | TAF |
| 44% | chr19 | 44129402 | 44129230 | − | ENST00000222374 | chr19 | 44129055 | 44128921 | − | TAF |
| 41% | chr2 | 175809671 | 175809616 | − | ENST00000409900; ENST00000409156 | chr2 | 175805622 | 175805109 | − | TAF |
| 39% | chr1 | 224544627 | 224544695 | + | ENST00000465271; ENST00000366858; ENST00000366857; ENST00000366856 | chr1 | 224551811 | 224551931 | + | TAF |
| 36% | chr1 | 48771550 | 48771459 | − | ENST00000371847; ENST00000371843; ENST00000396199 | chr1 | 48730486 | 48730045 | − | TSF |
| 36% | chr1 | 48771550 | 48771459 | − | ENST00000371847; ENST00000371843; ENST00000396199 | chr1 | 48730486 | 48730045 | − | TSF |
| 36% | chr1 | 48771550 | 48771459 | − | ENST00000371847; ENST00000371843; ENST00000396199 | chr1 | 48730486 | 48730045 | − | TSF |
| 30% | chr20 | 53092486 | 53092551 | + | ENST00000262593 | chr20 | 53111339 | 53111426 | + | TAF |
| 28% | chr11 | 61197619 | 61197654 | + | ENST00000542794; ENST00000541135; ENST00000301761; ENST00000542074; ENST00000534878; ENST00000359614; ENST00000537782; ENST00000538594; ENST00000544801; ENST00000536250; ENST00000543265 | chr11 | 61240217 | 61240660 | + | TAF |
| 28% | chr6 | 10749855; 10749898 | 10749931 | + | ENST00000379542; ENST00000473166; ENST00000463448; ENST00000460341; ENST00000480294; ENST00000473807; ENST00000461342; ENST00000475942; ENST00000379530; ENST00000463100; ENST00000481240; ENST00000467317; ENST00000478732 | chr6 | 10829240 | 10829256 | + | TAF |
| 28% | chr6 | 10749855; 10749898 | 10749931 | + | ENST00000379542; ENST00000473166; ENST00000463448; ENST00000460341; ENST00000480294; ENST00000473807; ENST00000461342; ENST00000475942; ENST00000379530; ENST00000463100; ENST00000481240; ENST00000467317; ENST00000478732 | chr6 | 10829240 | 10829256 | + | TAF |
| 28% | chr18 | 54318306 | 54318248 | − | ENST00000587613 | chr18 | 54314766 | 54314664 | − | TSF |
| 26% | chr1 | 31347435 | 31347144 | − | ENST00000336798; ENST00000339394 | chr1 | 31340352 | 31340311 | − | TSF |
| 26% | chr1 | 31347435 | 31347144 | − | ENST00000336798; ENST00000339394 | chr1 | 31340352 | 31340311 | − | TSF |
| 25% | chr11 | 73589824 | 73589864 | + | ENST00000310571 | chr11 | 73598076 | 73598225 | + | TAF |
| 25% | chrX | 152730513 | 152730446 | − | ENST00000370211; ENST00000370212; ENST00000370210 | chrX | 152728559 | 152728505 | − | TAF |
| 25% | chrX | 152730513 | 152730446 | − | ENST00000370211; ENST00000370212; ENST00000370210 | chrX | 152728559 | 152728505 | − | TAF |
| 25% | chr2 | 230411808 | 230411663 | − | ENST00000341772 | chr2 | 230409543 | 230409247 | − | TSF |
| 22% | chr4 | 47583977 | 47584081 | + | ENST00000273859 | chr4 | 47584886 | 47585171 | + | TAF |
| 22% | chr7 | 136936138 | 136935977 | − | ENST00000348225; ENST00000393083 | chr7 | 136925784 | 136925658 | − | TAF |
| 21% | chr22 | 24323139 | 24323226 | + | ENST00000215780; ENST00000402588 | chr22 | 24324557 | 24324632 | + | TAF |
| 21% | chr7 | 27582719 | 27582586 | − | ENST00000265395; ENST00000425715 | chr7 | 27581374 | 27579272 | − | TAF |
| 21% | chr7 | 27582719 | 27582586 | − | ENST00000265395; ENST00000425715 | chr7 | 27581374 | 27579272 | − | TAF |
| 21% | chr17 | 63173850 | 63173921 | + | ENST00000584234; ENST00000262406 | chr17 | 63176114 | 63176128 | + | TAF |
| 21% | chr1 | 99380476 | 99380342 | − | ENST00000263177 | chr1 | 99378537 | 99378478 | − | TSF |

TABLE 23-continued

Transcript fusion for Glioblastoma Multiforme (GBM)
Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 20% | chr8 | 63502273 | 63502353 | + | ENST00000523211; ENST00000328472 | chr8 | 63546747 | 63547118 | + | TSF |
| 19% | chr6 | 11000397 | 11000320 | − | ENST00000354666 | chr6 | 11000151 | 11000002 | − | TAF |
| 19% | chr12 | 102074121 | 102074307 | + | ENST00000547405; ENST00000452455; ENST00000360610; ENST00000441232; ENST00000392934; ENST00000547509; ENST00000361685; ENST00000549145; ENST00000553190; ENST00000536007; ENST00000541119; ENST00000545503; ENST00000361466; ENST00000551300; ENST00000550270 | chr12 | 102089430 | 102089665 | + | TAF |
| 19% | chr12 | 102074121 | 102074307 | + | ENST00000547405; ENST00000452455; ENST00000360610; ENST00000441232; ENST00000392934; ENST00000547509; ENST00000361685; ENST00000549145; ENST00000553190; ENST00000536007; ENST00000541119; ENST00000545503; ENST00000361466; ENST00000551300; ENST00000550270 | chr12 | 102089430 | 102089665 | + | TAF |
| 19% | chr12 | 102074121 | 102074307 | + | ENST00000547405; ENST00000452455; ENST00000360610; ENST00000441232; ENST00000392934; ENST00000547509; ENST00000361685; ENST00000549145; ENST00000553190; ENST00000536007; ENST00000541119; ENST00000545503; ENST00000361466; ENST00000551300; ENST00000550270 | chr12 | 102089430 | 102089665 | + | TAF |
| 19% | chr12 | 102074121 | 102074307 | + | ENST00000547405; ENST00000452455; ENST00000360610; ENST00000441232; ENST00000392934; ENST00000547509; ENST00000361685; ENST00000549145; ENST00000553190; ENST00000536007; ENST00000541119; ENST00000545503; ENST00000361466; ENST00000551300; ENST00000550270 | chr12 | 102089430 | 102089665 | + | TAF |
| 19% | chr12 | 102074121 | 102074307 | + | ENST00000547405; ENST00000452455; ENST00000360610; ENST00000441232; ENST00000392934; ENST00000547509; ENST00000361685; ENST00000549145; ENST00000553190; ENST00000536007; ENST00000541119; ENST00000545503; ENST00000361466; ENST00000551300; ENST00000550270 | chr12 | 102089430 | 102089665 | + | TAF |
| 19% | chr12 | 102074121 | 102074307 | + | ENST00000547405; ENST00000452455; ENST00000360610; ENST00000441232; ENST00000392934; ENST00000547509; ENST00000361685; ENST00000549145; ENST00000553190; ENST00000536007; ENST00000541119; ENST00000545503; ENST00000361466; ENST00000551300; ENST00000550270 | chr12 | 102089430 | 102089665 | + | TAF |
| 19% | chr12 | 102074121 | 102074307 | + | ENST00000547405; ENST00000452455; ENST00000360610; ENST00000441232; ENST00000392934; ENST00000547509; ENST00000361685; ENST00000549145; ENST00000553190; ENST00000536007; ENST00000541119; ENST00000545503; ENST00000361466; ENST00000551300; ENST00000550270 | chr12 | 102089430 | 102089665 | + | TAF |
| 19% | chr12 | 102074121 | 102074307 | + | ENST00000547405; ENST00000045255; ENST00000360610; ENST00000441232; ENST00000392934; ENST00000547509; ENST00000361685; ENST00000549145; ENST00000553190; ENST00000536007; ENST00000541119; ENST00000545503; ENST00000361466; ENST00000551300; ENST00000550270 | chr12 | 102089430 | 102089665 | + | TAF |
| 19% | chr12 | 102074121 | 102074307 | + | ENST00000547405; ENST00000452455; ENST00000360610; ENST00000441232; ENST00000392934; ENST00000547509; ENST00000361685; ENST00000549145; ENST00000553190; ENST00000536007; ENST00000541119; ENST00000545503; ENST00000361466; ENST00000551300; ENST00000550270 | chr12 | 102089430 | 102089665 | + | TAF |
| 19% | chr12 | 102074121 | 102074307 | + | ENST00000547405; ENST00000452455 | chr12 | 102089430 | 102089665 | + | TAF |

TABLE 23-continued

Transcript fusion for Glioblastoma Multiforme (GBM)
Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
|   |   |   |   |   | ENST00000360610; ENST00000441232; ENST00000392934; ENST00000547509; ENST00000361685; ENST00000549145; ENST00000553190; ENST00000536007; ENST00000541119; ENST00000545503; ENST00000361466; ENST00000551300; ENST00000550270 |   |   |   |   |   |
| 19% | chr4 | 151124947 | 151125041 | + | ENST00000296550; ENST00000411937; ENST00000506325; ENST00000302176 | chr4 | 151135817 | 151135831 | + | TSF |
| 19% | chr4 | 151124947 | 151125041 | + | ENST00000296550; ENST00000411937; ENST00000506325; ENST00000302176 | chr4 | 151135817 | 151135831 | + | TSF |
| 19% | chr1 | 70820635 | 70820794 | + | ENST00000359875; ENST00000370940; ENST00000531950; ENST00000432224 | chr1 | 70831829 | 70831848 | + | TSF |
| 18% | chr19 | 5208068 | 5207933 | − | ENST00000262963; ENST00000348075; ENST00000353284; ENST00000357368; ENST00000372412; ENST00000587303; ENST00000588012; ENST00000592099 | chr19 | 5159115 | 5158876 | − | TAF |
| 18% | chr19 | 5208068 | 5207933 | − | ENST00000262963; ENST00000348075; ENST00000353284; ENST00000357368; ENST00000372412; ENST00000587303; ENST00000588012; ENST00000592099 | chr19 | 5159115 | 5158876 | − | TAF |
| 18% | chr19 | 5208068 | 5207933 | − | ENST00000262963; ENST00000348075; ENST00000353284; ENST00000357368; ENST00000372412; ENST00000587303; ENST00000588012; ENST00000592099 | chr19 | 5159115 | 5158876 | − | TAF |
| 18% | chr19 | 5208068 | 5207933 | − | ENST00000262963; ENST00000348075; ENST00000353284; ENST00000357368; ENST00000372412; ENST00000587303; ENST00000588012; ENST00000592099 | chr19 | 5159115 | 5158876 | − | TAF |
| 18% | chr19 | 5208068 | 5207933 | − | ENST00000262963; ENST00000348075; ENST00000353284; ENST00000357368; ENST00000372412; ENST00000587303; ENST00000588012; ENST00000592099 | chr19 | 5159115 | 5158876 | − | TAF |
| 17% | chr7 | 135635430 | 135635347 | − | ENST00000393085 | chr7 | 135585557 | 135585512 | − | TSF |
| 16% | chr7 | 102307711 | 102307537 | − | ENST00000591000; ENST00000476151; ENST00000358438 | chr7 | 102207490 | 102207365 | − | TAF |
| 16% | chr1 | 99380476 | 99380357 | − | ENST00000370188; ENST00000263177 | chr1 | 99378537 | 99378478 | − | TSF |
| 16% | chr11 | 117710545 | 117710496 | − | ENST00000532984; ENST00000584394; ENST00000529335 | chr11 | 117703821 | 117703741 | − | TSF |
| 16% | chr11 | 117710545 | 117710496 | − | ENST00000532984; ENST00000584394; ENST00000529335 | chr11 | 117703821 | 117703741 | − | TSF |
| 16% | chr11 | 117710545 | 117710496 | − | ENST00000532984; ENST00000584394; ENST00000529335 | chr11 | 117703821 | 117703741 | − | TSF |
| 15% | chr3 | 28357824 | 28357914 | + | ENST00000466830; ENST00000423894; ENST00000418849 | chr3 | 28360223 | 28360364 | + | TAF |
| 15% | chr3 | 28357824 | 28357914 | + | ENST00000466830; ENST00000423894; ENST00000418849 | chr3 | 28360223 | 28360364 | + | TAF |
| 15% | chr3 | 28357824 | 28357914 | + | ENST00000466830; ENST00000423894; ENST00000418849 | chr3 | 28360223 | 28360364 | + | TAF |
| 15% | chr2 | 153591508 | 153591640 | + | ENST00000326446 | chr2 | 153613426 | 153613893 | + | TAF |
| 15% | chr18 | 72250797 | 72250944 | + | ENST00000358821; ENST00000582365 | chr18 | 72256555 | 72256578 | + | TAF |
| 15% | chr18 | 72250797 | 72250944 | + | ENST00000358821; ENST00000582365 | chr18 | 72256555 | 72256578 | + | TAF |
| 15% | chr3 | 33636460 | 33636443 | − | ENST00000468888; ENST00000399362; ENST00000307312; ENST00000359576; ENST00000480013; ENST00000461133 | chr3 | 33635629 | 33635332 | − | TAF |
| 15% | chr3 | 33636460 | 33636443 | − | ENST00000468888; ENST00000399362; ENST00000307312; ENST00000359576; ENST00000480013; ENST00000461133 | chr3 | 33635629 | 33635332 | − | TAF |
| 15% | chr3 | 33636460 | 33636443 | − | ENST00000468888; ENST00000399362; ENST00000307312; ENST00000359576; ENST00000480013; ENST00000461133 | chr3 | 33635629 | 33635332 | − | TAF |
| 15% | chr3 | 33636460 | 33636443 | − | ENST00000468888; ENST00000399362; ENST00000307312; ENST00000359576; ENST00000480013; ENST00000461133 | chr3 | 33635629 | 33635332 | − | TAF |
| 15% | chr7 | 91509397 | 91509369 | − | ENST00000351870; ENST00000442961 | chr7 | 91430582 | 91429696 | − | TSF |
| 15% | chr19 | 50213980 | 50214114 | + | ENST00000323446; ENST00000392518; ENST00000354199; ENST00000598293; ENST00000405931; ENST00000595031 | chr19 | 50214968 | 50214999 | + | TSF |
| 15% | chr19 | 50213980 | 50214114 | + | ENST00000323446; ENST00000392518; ENST00000354199; ENST00000598293; ENST00000405931; ENST00000595031 | chr19 | 50214968 | 50214999 | + | TSF |
| 15% | chr19 | 50213980 | 50214114 | + | ENST00000323446; ENST00000392518; ENST00000354199; ENST00000598293; ENST00000405931; ENST00000595031 | chr19 | 50214968 | 50214999 | + | TSF |
| 14% | chr19 | 3544937 | 3544807 | − | ENST00000389395; ENST00000398558 | chr19 | 3538708 | 3538306 | − | TAF |

TABLE 23-continued

Transcript fusion for Glioblastoma Multiforme (GBM)
Coordinates of the fusion sequences for which the donor is the exon.

| 1 | 2 | 3 | 4 | 5 | 6 | 7 | 8 | 9 | 10 | 11 |
|---|---|---|---|---|---|---|---|---|----|----|
| 14% | chr19 | 3544937 | 3544807 | − | ENST00000389395; ENST00000398558; ENST00000588918; ENST00000355415; ENST00000589063 | chr19 | 3538708 | 3538306 | − | TAF |
| 14% | chr19 | 3544937 | 3544807 | − | ENST00000389395; ENST00000398558; ENST00000588918; ENST00000355415; ENST00000589063 | chr19 | 3538708 | 3538306 | − | TAF |
| 14% | chr5 | 146435301; 146435306 | 146435228 | − | ENST00000394414; ENST00000336640; ENST00000522831; ENST00000515880; ENST00000512011 | chr5 | 146414803 | 146414648 | − | TAF |
| 14% | chr5 | 146435301; 146435306 | 146435228 | − | ENST00000394414; ENST00000336640; ENST00000522831; ENST00000515880; ENST00000512011 | chr5 | 146414803 | 146414648 | − | TAF |
| 14% | chr19 | 12146354 | 12146352 | − | ENST00000344980; ENST00000550507; ENST00000548669 | chr19 | 12100261 | 12100168 | − | TAF |
| 14% | chr6 | 29913011 | 29913058 | + | ENST00000396634; ENST00000376806; ENST00000376809 | chr6 | 29915459 | 29916523 | + | TAF |
| 14% | chr6 | 29913011 | 29913058 | + | ENST00000396634; ENST00000376806; ENST00000376809 | chr6 | 29915459 | 29916523 | + | TAF |
| 14% | chr1 | 1237426 | 1237368 | − | ENST00000354700; ENST00000353662 | chr1 | 1236310 | 1236145 | − | TAF |
| 14% | chr1 | 1237426 | 1237368 | − | ENST00000354700; ENST00000353662 | chr1 | 1236310 | 1236145 | − | TAF |
| 13% | chr7 | 99821698 | 99821505 | − | ENST00000436886 | chr7 | 99810756 | 99810604 | − | TAF |
| 12% | chr6 | 35314915 | 35314927 | + | ENST00000448077 | chr6 | 35351354 | 35351915 | + | TAF |
| 12% | chr15 | 89011139 | 89011255 | + | ENST00000560708; ENST00000325844; ENST00000353598 | chr15 | 89011993 | 89012264 | + | TAF |
| 12% | chr6 | 36762426 | 36762367 | − | ENST00000244751 | chr6 | 36760220 | 36760189 | − | TAF |
| 12% | chr15 | 32976758; 32976761 | 32976870 | + | ENST00000300175; ENST00000413748; ENST00000494364; ENST00000497208; ENST00000471027 | chr15 | 32977789 | 32977906 | + | TAF |
| 12% | chr15 | 32976758; 32976761 | 32976870 | + | ENST00000300175; ENST00000413748; ENST00000494364; ENST00000497208; ENST00000471027 | chr15 | 32977789 | 32977906 | + | TAF |
| 12% | chr15 | 32976758; 32976761 | 32976870 | + | ENST00000300175; ENST00000413748; ENST00000494364; ENST00000497208; ENST00000471027 | chr15 | 32977789 | 32977906 | + | TAF |
| 12% | chr3 | 58553091 | 58552935 | − | ENST00000360997; ENST00000394481; ENST00000464064; ENST00000474531; ENST00000447756 | chr3 | 58550140 | 58549790 | − | TAF |
| 12% | chr3 | 58553091 | 58552935 | − | ENST00000360997; ENST00000394481; ENST00000464064; ENST00000474531; ENST00000447756 | chr3 | 58550140 | 58549790 | − | TAF |
| 12% | chr3 | 58553091 | 58552935 | − | ENST00000360997; ENST00000394481; ENST00000464064; ENST00000474531; ENST00000447756 | chr3 | 58550140 | 58549790 | − | TAF |
| 11% | chr2 | 26624858 | 26625012 | + | ENST00000288710; ENST00000421869 | chr2 | 26630464 | 26631004 | + | TAF |
| 11% | chr5 | 173040258; 173040180 | 173040134 | − | ENST00000311086; ENST00000285908; ENST00000462674 | chr5 | 173012591 | 173012432 | − | TAF |
| 11% | chr5 | 173040258; 173040180 | 173040134 | − | ENST00000311086; ENST00000285908; ENST00000462674 | chr5 | 173012591 | 173012432 | − | TAF |
| 11% | chrX | 103219096 | 103219195 | + | ENST00000419165; ENST00000563257; ENST00000540220; ENST00000436583; ENST00000567181; ENST00000569577 | chrX | 103231301 | 103231354 | + | TSF |
| 11% | chr5 | 146460699; 146460671 | 146460622 | − | ENST00000504198; ENST00000394409 | chr5 | 146321615 | 146321345 | − | TSF |
| 11% | chr5 | 146460699; 146460671 | 146460622 | − | ENST00000504198; ENST00000394409 | chr5 | 146321615 | 146321345 | − | TSF |
| 10% | chr19 | 13869914; 13869931; 13869925 | 13870086 | + | ENST00000586600; ENST00000221554; ENST00000586666; ENST00000588809; ENST00000585844 | chr19 | 13872305 | 13872412 | + | TAF |
| 10% | chr19 | 13869914; 13869931; 13869925 | 13870086 | + | ENST00000586600; ENST00000221554; ENST00000586666; ENST00000588809; ENST00000585844 | chr19 | 13872305 | 13872412 | + | TAF |
| 10% | chr19 | 13869914; 13869931; 13869925 | 13870086 | + | ENST00000586600; ENST00000221554; ENST00000586666; ENST00000588809; ENST00000585844 | chr19 | 13872305 | 13872412 | + | TAF |
| 10% | chr19 | 13869914; 13869931; 13869925 | 13870086 | + | ENST00000586600; ENST00000221554; ENST00000586666; ENST00000588809; ENST00000585844 | chr19 | 13872305 | 13872412 | + | TAF |
| 10% | chr5 | 149629872 | 149629789 | − | ENST00000348628; ENST00000398376 | chr5 | 149628210 | 149627911 | − | TSF |
| 10% | chr7 | 92083816 | 92083999 | + | ENST00000287957 | chr7 | 92090633 | 92090800 | + | TSF |
| 10% | chr3 | 98236033; 98236004 | 98235896 | − | ENST00000502288; ENST00000507874; ENST00000341181; ENST00000437922; ENST00000394180; ENST00000506885; ENST00000503004; ENST00000394185; | chr3 | 98228614 | 98228468 | − | TSF |

TABLE 23-continued

Transcript fusion for Glioblastoma Multiforme (GBM)
Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| | | | | | ENST00000394181; ENST00000513873; ENST00000510545; ENST00000511081; ENST00000513287; ENST00000511667; ENST00000513452; ENST00000502299; ENST00000512147; ENST00000508902; ENST00000510541; ENST00000514537; ENST00000515620 | | | | | |
| 10% | chr3 | 98236033; 98236004 | 98235896 | − | ENST00000502288; ENST00000507874; ENST00000341181; ENST00000437922; ENST00000394180; ENST00000506885; ENST00000503004; ENST00000394185; ENST00000394181; ENST00000513873; ENST00000510545; ENST00000511081; ENST00000513287; ENST00000511667; ENST00000513452; ENST00000502299; ENST00000512147; ENST00000508902; ENST00000510541; ENST00000514537; ENST00000515620 | chr3 | 98228614 | 98228468 | − | TSF |
| 10% | chr3 | 98236033; 98236004 | 98235896 | − | ENST00000502288; ENST00000507874; ENST00000341181; ENST00000437922; ENST00000394180; ENST00000506885; ENST00000503004; ENST00000394185; ENST00000394181; ENST00000513873; ENST00000510545; ENST00000511081; ENST00000513287; ENST00000511667; ENST00000513452; ENST00000502299; ENST00000512147; ENST00000508902; ENST00000510541; ENST00000514537; ENST00000515620 | chr3 | 98228614 | 98228468 | − | TSF |
| 10% | chr3 | 98236033; 98236004 | 98235896 | − | ENST00000502288; ENST00000507874; ENST00000341181; ENST00000437922; ENST00000394180; ENST00000506885; ENST00000503004; ENST00000394185; ENST00000394181; ENST00000513873; ENST00000510545; ENST00000511081; ENST00000513287; ENST00000511667; ENST00000513452; ENST00000502299; ENST00000512147; ENST00000508902; ENST00000510541; ENST00000514537; ENST00000515620 | chr3 | 98228614 | 98228468 | − | TSF |
| 10% | chr3 | 98236033; 98236004 | 98235896 | − | ENST00000502288; ENST00000507874; ENST00000341181; ENST00000437922; ENST00000394180; ENST00000506885; ENST00000503004; ENST00000394185; ENST00000394181; ENST00000513873; ENST00000510545; ENST00000511081; ENST00000513287; ENST00000511667; ENST00000513452; ENST00000502299; ENST00000512147; ENST00000508902; ENST00000510541; ENST00000514537; ENST00000515620 | chr3 | 98228614 | 98228468 | − | TSF |
| 10% | chr3 | 98236033; 98236004 | 98235896 | − | ENST00000502288; ENST00000507874; ENST00000341181; ENST00000437922; ENST00000394180; ENST00000506885; ENST00000503004; ENST00000394185; ENST00000394181; ENST00000513873; ENST00000510545; ENST00000511081; ENST00000513287; ENST00000511667; ENST00000513452; ENST00000502299; ENST00000512147; ENST00000508902; ENST00000510541; ENST00000514537; ENST00000515620 | chr3 | 98228614 | 98228468 | − | TSF |
| 10% | chr3 | 98236033; 98236004 | 98235896 | − | ENST00000502288; ENST00000507874; ENST00000341181; ENST00000437922; ENST00000394180; ENST00000506885; ENST00000503004; ENST00000394185; ENST00000394181; ENST00000513873; ENST00000510545; ENST00000511081; ENST00000513287; ENST00000511667; ENST00000513452; ENST00000502299; ENST00000512147; ENST00000508902; ENST00000510541; ENST00000514537; ENST00000515620 | chr3 | 98228614 | 98228468 | − | TSF |
| 9% | chr7 | 65751498 | 65751696 | + | ENST00000304842 | chr7 | 65781807 | 65782076 | + | TSF |
| 9% | chr15 | 83102759 | 83103078 | + | ENST00000561062; ENST00000358583 | chr15 | 83193141 | 83193227 | + | TSF |

TABLE 23-continued

Transcript fusion for Glioblastoma Multiforme (GBM)
Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 9% | chr15 | 65687596 | 65687432 | − | ENST00000352385 | chr15 | 65687004 | 65686908 | − | TSF |
| 8% | chr7 | 55270210 | 55270401 | + | ENST00000455089 | chr7 | 55272949 | 55272949 | + | TSF |
| 8% | chr13 | 31531010 | 31531166 | + | ENST00000380473 | chr13 | 31534099 | 31534280 | + | TSF |
| 8% | chr4 | 159620139 | 159620282 | + | ENST00000511912; ENST00000307738 | chr4 | 159622027 | 159622060 | + | TSF |
| 8% | chr4 | 159620139 | 159620282 | + | ENST00000511912; ENST00000307738 | chr4 | 159622027 | 159622060 | + | TSF |
| 6% | chr22 | 48885405 | 48885516 | + | ENST00000402357; ENST00000336769 | chr22 | 48915770 | 48916108 | + | TSF |
| 6% | chr2 | 217366064 | 217366082 | + | ENST00000491306; ENST00000456586 | chr2 | 217393993 | 217394327 | + | TSF |
| 6% | chr2 | 217366064 | 217366082 | + | ENST00000491306; ENST00000456586 | chr2 | 217393993 | 217394327 | + | TSF |
| 6% | chr8 | 27461912 | 27461808 | − | ENST00000316403; ENST00000546343; ENST00000560366; ENST00000405140; ENST00000523500; ENST00000522098 | chr8 | 27458611 | 27458570 | − | TSF |
| 6% | chr8 | 27461912 | 27461808 | − | ENST00000316403; ENST00000546343; ENST00000560366; ENST00000405140; ENST00000523500; ENST00000522098 | chr8 | 27458611 | 27458570 | − | TSF |
| 6% | chr8 | 27461912 | 27461808 | − | ENST00000316403; ENST00000546343; ENST00000560366; ENST00000405140; ENST00000523500; ENST00000522098 | chr8 | 27458611 | 27458570 | − | TSF |
| 6% | chr8 | 27461912 | 27461808 | − | ENST00000316403; ENST00000546343; ENST00000560366; ENST00000405140; ENST00000523500; ENST00000522098 | chr8 | 27458611 | 27458570 | − | TSF |
| 6% | chrX | 74725682 | 74725656 | − | ENST00000373367; ENST00000373361 | chrX | 74722103 | 74721880 | − | TSF |
| 6% | chr20 | 62070073 | 62069978 | − | ENST00000357249; ENST00000359125; ENST00000354587; ENST00000359689; ENST00000360480; ENST00000370224; ENST00000344462; ENST00000344425 | chr20 | 62066140 | 62065806 | − | TSF |
| 6% | chr7 | 55468867 | 55469013 | + | ENST00000254770 | chr7 | 55477218 | 55477724 | + | TSF |
| 6% | chr15 | 23810930 | 23811234 | + | ENST00000314520; ENST00000568252; ENST00000564592 | chr15 | 23872913 | 23873108 | + | TSF |
| 6% | chr19 | 55178148; 55178145 | 55178200 | + | ENST00000391736; ENST00000270452; ENST00000430952; ENST00000391734; ENST00000391733; ENST00000434286 | chr19 | 55178294 | 55178458 | + | TSF |
| 6% | chr19 | 55178148; 55178145 | 55178200 | + | ENST00000391736; ENST00000270452; ENST00000430952; ENST00000391734; ENST00000391733; ENST00000434286 | chr19 | 55178294 | 55178458 | + | TSF |
| 6% | chr19 | 55178148; 55178145 | 55178200 | + | ENST00000391736; ENST00000270452; ENST00000430952; ENST00000391734; ENST00000391733; ENST00000434286 | chr19 | 55178294 | 55178458 | + | TSF |
| 6% | chr8 | 109468102 | 109468159 | + | ENST00000220853; ENST00000519642 | chr8 | 109468381 | 109468590 | + | TSF |
| 6% | chr8 | 109468102 | 109468159 | + | ENST00000220853; ENST00000519642 | chr8 | 109468381 | 109468590 | + | TSF |
| 6% | chr12 | 113623819 | 113623826 | + | ENST00000552495 | chr12 | 113623998 | 113624117 | + | TSF |
| 6% | chr12 | 58024115 | 58023935 | − | ENST00000341156; ENST00000418555; ENST00000552798; ENST00000549391; ENST00000449184; ENST00000550764; ENST00000552350; ENST00000548888 | chr12 | 58023225 | 58023117 | − | TSF |
| 6% | chr12 | 58024115 | 58023935 | − | ENST00000341156; ENST00000418555; ENST00000552798; ENST00000549391; ENST00000449184; ENST00000550764; ENST00000552350; ENST00000548888 | chr12 | 58023225 | 58023117 | − | TSF |
| 6% | chr12 | 58024115 | 58023935 | − | ENST00000341156; ENST00000418555; ENST00000552798; ENST00000549391; ENST00000449184; ENST00000550764; ENST00000552350; ENST00000548888 | chr12 | 58023225 | 58023117 | − | TSF |
| 6% | chr19 | 11567963 | 11567925 | − | ENST00000359227; ENST00000438662 | chr19 | 11567647 | 11567483 | − | TSF |
| 6% | chr13 | 53307494; 53307473 | 53307354 | − | ENST00000448904; ENST00000377962; ENST00000431550 | chr13 | 53304269 | 53303967 | − | TSF |
| 6% | chr13 | 53307494; 53307473 | 53307354 | − | ENST00000448904; ENST00000377962; ENST00000431550 | chr13 | 53304269 | 53303967 | − | TSF |
| 6% | chr2 | 133426110; 133426006 | 133425973 | − | ENST00000397463; ENST00000345008 | chr2 | 133381838 | 133381614 | − | TSF |
| 6% | chr2 | 133426110; 133426006 | 133425973 | − | ENST00000397463; ENST00000345008 | chr2 | 133381838 | 133381614 | − | TSF |
| 6% | chr12 | 58024115 | 58023935 | − | ENST00000341156; ENST00000418555; ENST00000552798; ENST00000549391; ENST00000449184; ENST00000550764; ENST00000552350; ENST00000548888 | chr12 | 58023079 | 58022983 | − | TSF |
| 6% | chr12 | 58024115 | 58023935 | − | ENST00000341156; ENST00000418555; ENST00000552798; ENST00000549391; ENST00000449184; ENST00000550764; ENST00000552350; ENST00000548888 | chr12 | 58023079 | 58022983 | − | TSF |
| 6% | chr12 | 58024115 | 58023935 | − | ENST00000341156; ENST00000418555; ENST00000552798; ENST00000549391; | chr12 | 58023079 | 58022983 | − | TSF |

TABLE 23-continued

Transcript fusion for Glioblastoma Multiforme (GBM)
Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 6% | chr12 | 58024115 | 58023935 | − | ENST00000449184; ENST00000550764; ENST00000552350; ENST00000548888 ENST00000341156; ENST00000418555; ENST00000552798; ENST00000549391; ENST00000449184; ENST00000550764; ENST00000552350; ENST00000548888 | chr12 | 58023079 | 58022983 | − | TSF |
| 5% | chr4 | 57319769 | 57319927 | + | ENST00000514888; ENST00000264221; ENST00000505164; ENST00000399688; ENST00000512576 | chr4 | 57321183 | 57321327 | + | TSF |
| 5% | chr4 | 57319769 | 57319927 | + | ENST00000514888; ENST00000264221; ENST00000505164; ENST00000399688; ENST00000512576 | chr4 | 57321183 | 57321327 | + | TSF |
| 5% | chr4 | 57319769 | 57319927 | + | ENST00000514888; ENST00000264221; ENST00000505164; ENST00000399688; ENST00000512576 | chr4 | 57321183 | 57321327 | + | TSF |
| 5% | chr19 | 3869015; 3869013 | 3868963 | − | ENST00000262961; ENST00000438164; ENST00000587212; ENST00000586578; ENST00000439086 | chr19 | 3855694 | 3855445 | − | TSF |
| 5% | chr19 | 3869015; 3869013 | 3868963 | − | ENST00000262961; ENST00000438164; ENST00000587212; ENST00000586578; ENST00000439086 | chr19 | 3855694 | 3855445 | − | TSF |
| 5% | chr10 | 127483547 | 127483449 | − | ENST00000368797; ENST00000368786 | chr10 | 127473829 | 127473633 | − | TSF |
| 5% | chr16 | 30783410 | 30783511 | + | ENST00000324685; ENST00000402121; ENST00000563683; ENST00000357890 | chr16 | 30785136 | 30785155 | + | TSF |
| 5% | chr16 | 30783410 | 30783511 | + | ENST00000324685; ENST00000402121; ENST00000563683; ENST00000357890 | chr16 | 30785136 | 30785155 | + | TSF |
| 5% | chr16 | 30783410 | 30783511 | + | ENST00000324685; ENST00000402121; ENST00000563683; ENST00000357890 | chr16 | 30785136 | 30785155 | + | TSF |
| 5% | chr16 | 30783410 | 30783511 | + | ENST00000324685; ENST00000402121; ENST00000563683; ENST00000357890 | chr16 | 30785136 | 30785155 | + | TSF |
| 5% | chr7 | 39610105 | 39610226 | + | ENST00000223273; ENST00000448268; ENST00000432096 | chr7 | 39618101 | 39618410 | + | TSF |
| 5% | chr1 | 11115983; 11115877 | 11115838 | − | ENST00000376957; ENST00000490101 | chr1 | 11115464 | 11115178 | − | TSF |
| 5% | chr1 | 11115983; 11115877 | 11115838 | − | ENST00000376957; ENST00000490101 | chr1 | 11115464 | 11115178 | − | TSF |
| 5% | chr1 | 144852443 | 144852394 | − | ENST00000369356 | chr1 | 144836558 | 144836419 | − | TSF |
| 4% | chr2 | 112933291 | 112933416 | + | ENST00000331203; ENST00000409903; ENST00000409450; ENST00000441565 | chr2 | 112935633 | 112935771 | + | TSF |
| 4% | chr2 | 112933291 | 112933416 | + | ENST00000331203; ENST00000409903; ENST00000409450; ENST00000441565 | chr2 | 112935633 | 112935771 | + | TSF |
| 4% | chr7 | 74168178 | 74168361 | + | ENST00000324896; ENST00000346152; ENST00000353920; ENST00000416070 | chr7 | 74168612 | 74168748 | + | TSF |
| 4% | chr7 | 74168178 | 74168361 | + | ENST00000324896; ENST00000346152; ENST00000353920; ENST00000416070 | chr7 | 74168612 | 74168748 | + | TSF |
| 4% | chr7 | 74168178 | 74168361 | + | ENST00000324896; ENST00000346152; ENST00000353920; ENST00000416070 | chr7 | 74168612 | 74168748 | + | TSF |
| 4% | chr7 | 74168178 | 74168361 | + | ENST00000324896; ENST00000346152; ENST00000353920; ENST00000416070 | chr7 | 74168612 | 74168748 | + | TSF |
| 4% | chr20 | 24565492 | 24565629 | + | ENST00000376862 | chr20 | 24627217 | 24627262 | + | TSF |
| 4% | chr19 | 19349062; 19349068 | 19349220 | + | ENST00000252575; ENST00000538881; ENST00000588231 | chr19 | 19350543 | 19350866 | + | TSF |
| 4% | chr19 | 19349062; 19349068 | 19349220 | + | ENST00000252575; ENST00000538881; ENST00000588231 | chr19 | 19350543 | 19350866 | + | TSF |
| 4% | chr19 | 19349062; 19349068 | 19349220 | + | ENST00000252575; ENST00000538881; ENST00000588231 | chr19 | 19350543 | 19350866 | + | TSF |
| 4% | chr1 | 44804994; 44804988 | 44804717 | − | ENST00000372257; ENST00000457571 | chr1 | 44801643 | 44801548 | − | TSF |
| 4% | chr1 | 44804994; 44804988 | 44804717 | − | ENST00000372257; ENST00000457571 | chr1 | 44801643 | 44801548 | − | TSF |
| 4% | chr1 | 1255909 | 1255836 | − | ENST00000435064; ENST00000540437; ENST00000450926; ENST00000545578; ENST00000528879; ENST00000434694; ENST00000526797; ENST00000527719; ENST00000530031; ENST00000534345; ENST00000498476 | chr1 | 1255223 | 1254988 | − | TSF |
| 4% | chr1 | 1255909 | 1255836 | − | ENST00000435064; ENST00000540437; ENST00000450926; ENST00000545578; ENST00000528879; ENST00000434694; ENST00000526797; ENST00000527719; ENST00000530031; ENST00000534345; ENST00000498476 | chr1 | 1255223 | 1254988 | − | TSF |
| 4% | chr1 | 1255909 | 1255836 | − | ENST00000435064; ENST00000540437; ENST00000450926; ENST00000545578; ENST00000528879; ENST00000434694; | chr1 | 1255223 | 1254988 | − | TSF |

TABLE 23-continued

Transcript fusion for Glioblastoma Multiforme (GBM)
Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 4% | chr1 | 1255909 | 1255836 | − | ENST00000526797; ENST00000527719; ENST00000530031; ENST00000534345; ENST00000498476 ENST00000435064; ENST00000540437; ENST00000450926; ENST00000545578; ENST00000528879; ENST00000434694; | chr1 | 1255223 | 1254988 | − | TSF |
| 4% | chr1 | 1255909 | 1255836 | − | ENST00000526797; ENST00000527719; ENST00000530031; ENST00000534345; ENST00000498476 ENST00000435064; ENST00000540437; ENST00000450926; ENST00000545578; ENST00000528879; ENST00000434694; | chr1 | 1255223 | 1254988 | − | TSF |
| 4% | chr1 | 1255909 | 1255836 | − | ENST00000526797; ENST00000527719; ENST00000530031; ENST00000534345; ENST00000498476 ENST00000435064; ENST00000540437; ENST00000450926; ENST00000545578; ENST00000528879; ENST00000434694; ENST00000526797; ENST00000527719; ENST00000530031; ENST00000534345; ENST00000498476 | chr1 | 1255223 | 1254988 | − | TSF |
| 4% | chr19 | 23556639 | 23556544 | − | ENST00000599743; ENST00000300619 | chr19 | 23491899 | 23491588 | − | TSF |

TABLE 24

Transcript fusion for Glioblastoma Multiforme (GBM)
Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 100% | chr17 | 42989790 | 42989722 | − | chr17 | 42989165 | 42989040; 42989042; 42989065 | − | ENST00000253408; ENST00000435360; ENST00000586793; ENST00000587997; ENST00000588957; ENST00000588316 | TAF |
| 100% | chr17 | 42989790 | 42989722 | − | chr17 | 42989165 | 42989040; 42989042; 42989065 | − | ENST00000253408; ENST00000435360; ENST00000586793; ENST00000587997; ENST00000588957; ENST00000588316 | TAF |
| 100% | chr17 | 42989790 | 42989722 | − | chr17 | 42989165 | 42989040; 42989042; 42989065 | − | ENST00000253408; ENST00000435360; ENST00000586793; ENST00000587997; ENST00000588957; ENST00000588316 | TAF |
| 100% | chr17 | 42989790 | 42989722 | − | chr17 | 42989165 | 42989040; 42989042; 42989065 | − | ENST00000253408; ENST00000435360; ENST00000586793; ENST00000587997; ENST00000588957; ENST00000588316 | TAF |
| 100% | chr17 | 42989790 | 42989722 | − | chr17 | 42989165 | 42989040; 42989042; 42989065 | − | ENST00000253408; ENST00000435360; ENST00000586793; ENST00000587997; ENST00000588957; ENST00000588316 | TAF |
| 100% | chr17 | 42989790 | 42989722 | − | chr17 | 42989165 | 42989040; 42989042; 42989065 | − | ENST00000253408; ENST00000435360; ENST00000586793; ENST00000587997; ENST00000588957; ENST00000588316 | TAF |
| 92% | chr4 | 174310858 | 174310746 | − | chr4 | 174309546 | 174309492 | − | ENST00000296506 | TAF |
| 91% | chr19 | 54930702 | 54930716 | + | chr19 | 54932451 | 54932562 | + | ENST00000423529; ENST00000301194; ENST00000376530; ENST00000445095; ENST00000391739; ENST00000376531 | TAF |
| 91% | chr19 | 54930702 | 54930716 | + | chr19 | 54932451 | 54932562 | + | ENST00000423529; ENST00000301194; ENST00000376530; ENST00000445095; ENST00000391739; ENST00000376531 | TAF |
| 91% | chr19 | 54930702 | 54930716 | + | chr19 | 54932451 | 54932562 | + | ENST00000423529; ENST00000301194; ENST00000376530; ENST00000445095; ENST00000391739; ENST00000376531 | TAF |
| 91% | chr19 | 54930702 | 54930716 | + | chr19 | 54932451 | 54932562 | + | ENST00000423529; ENST00000301194; ENST00000376530; ENST00000445095; ENST00000391739; ENST00000376531 | TAF |
| 91% | chr19 | 54930702 | 54930716 | + | chr19 | 54932451 | 54932562 | + | ENST00000423529; ENST00000301194; ENST00000376530; ENST00000445095; ENST00000391739; ENST00000376531 | TAF |
| 91% | chr19 | 54930702 | 54930716 | + | chr19 | 54932451 | 54932562 | + | ENST00000423529; ENST00000301194; ENST00000376530; ENST00000445095; ENST00000391739; ENST00000376531 | TAF |
| 82% | chr1 | 156374721 | 156374537 | − | chr1 | 156374393 | 156374318; 156374346 | − | ENST00000400991; ENST00000368242; ENST00000310027; ENST00000368243; ENST00000357975 | TAF |
| 82% | chr1 | 156374721 | 156374537 | − | chr1 | 156374393 | 156374318; 156374346 | − | ENST00000400991; ENST00000368242; ENST00000310027; ENST00000368243; | TAF |

TABLE 24-continued

Transcript fusion for Glioblastoma Multiforme (GBM)
Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 73% | chr7 | 150938296 | 150938250 | − | chr7 | 150937608 | 150937511 | − | ENST00000357975; ENST00000262188; ENST00000392811; ENST00000356800 | TAF |
| 71% | chr3 | 115350112 | 115350159 | + | chr3 | 115394860 | 115395457 | + | ENST00000305124; ENST00000393780 | TSF |
| 60% | chr9 | 131002678 | 131002811 | + | chr9 | 131004511 | 131004624 | + | ENST00000475805; ENST00000341179; ENST00000372923; ENST00000393594; ENST00000486160 | TAF |
| 60% | chr9 | 131002678 | 131002811 | + | chr9 | 131004511 | 131004624 | + | ENST00000475805; ENST00000341179; ENST00000372923; ENST00000393594; ENST00000486160 | TAF |
| 52% | chr17 | 80440912 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |
| 52% | chr17 | 80440912 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |
| 52% | chr17 | 80440912 | 80441180 | + | chr17 | 80441592 | 80441655; 804416159 | + | ENST00000390006; ENST00000309794; ENST00000345415; ENST00000457415; ENST00000412079; ENST00000577432; ENST00000584513 | TAF |
| 52% | chr17 | 80440912 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |
| 52% | chr9 | 130569975 | 130570054 | + | chr9 | 130570513 | 130570590; 130570580 | + | ENST00000373247; ENST00000373245; ENST00000393706; ENST00000373228; ENST00000373225; ENST00000431857; ENST00000423577 | TAF |
| 52% | chr9 | 130569975 | 130570054 | + | chr9 | 130570513 | 130570590; 130570580 | + | ENST00000373247; ENST00000373245; ENST00000393706; ENST00000373228; ENST00000373225; ENST00000431857; ENST00000423577 | TAF |
| 52% | chr9 | 130569975 | 130570054 | + | chr9 | 130570513 | 130570590; 130570580 | + | ENST00000373247; ENST00000373245; ENST00000393706; ENST00000373228; ENST00000373225; ENST00000431857; ENST00000423577 | TAF |
| 52% | chr9 | 130569975 | 130570054 | + | chr9 | 130570513 | 130570590; 130570580 | + | ENST00000373247; ENST00000373245; ENST00000393706; ENST00000373228; ENST00000373225; ENST00000431857; ENST00000423577 | TAF |
| 47% | chr8 | 82194688 | 94782127 | + | chr8 | 82195601 | 82195773 | + | ENST00000297258 | TAF |
| 45% | chr9 | 128362212 | 128362114 | − | chr9 | 128348006 | 128347834 | − | ENST00000373511; ENST00000373498; ENST00000350766; ENST00000265960; ENST00000394060; ENST00000468896 | TAF |
| 45% | chr9 | 128362212 | 128362114 | − | chr9 | 128348006 | 128347834 | − | ENST00000373511; ENST00000373498; ENST00000350766; ENST00000265960; ENST00000394060; ENST00000468896 | TAF |
| 45% | chr9 | 128362212 | 128362114 | − | chr9 | 128348006 | 128347834 | − | ENST00000373511; ENST00000373498; ENST00000350766; ENST00000265960; ENST00000394060; ENST00000468896 | TAF |
| 45% | chr9 | 128362212 | 128362114 | − | chr9 | 128348006 | 128347834 | − | ENST00000373511; ENST00000373498; ENST00000350766; ENST00000265960; ENST00000394060; ENST00000468896 | TAF |
| 45% | chr9 | 128362212 | 128362114 | − | chr9 | 128348006 | 128347834 | − | ENST00000373511; ENST00000373498; ENST00000350766; ENST00000265960; ENST00000394060; ENST00000468896 | TAF |
| 44% | chr2 | 230409549 | 230409481 | − | chr2 | 230377652 | 230377499 | − | ENST00000341772 | TAF |
| 42% | chr19 | 41816860 | 41816920 | + | chr19 | 41822289 | 41822744 | + | ENST00000269967 | TAF |
| 42% | chr3 | 98482258 | 98482283 | + | chr3 | 98487274 | 98487373 | + | ENST00000492254 | TAF |
| 41% | chr19 | 49121994 | 49121817 | − | chr19 | 49121134 | 49121048 | − | ENST00000549920; ENST00000547897; ENST00000084795; ENST00000550645; ENST00000549370; ENST00000549273 | TAF |
| 41% | chr19 | 49121994 | 49121817 | − | chr19 | 49121134 | 49121048 | − | ENST00000549920; ENST00000547897; ENST00000084795; ENST00000550645; ENST00000549370; ENST00000549273 | TAF |
| 41% | chr19 | 49121994 | 49121817 | − | chr19 | 49121134 | 49121048 | − | ENST00000549920; ENST00000547897; ENST00000084795; ENST00000550645; ENST00000549370; ENST00000549273 | TAF |
| 41% | chr19 | 49121994 | 49121817 | − | chr19 | 49121134 | 49121048 | − | ENST00000549920; ENST00000547897; ENST00000084795; ENST00000550645; ENST00000549370; ENST00000549273 | TAF |
| 41% | chr19 | 49121994 | 49121817 | − | chr19 | 49121134 | 149121048 | − | ENST00000549920; ENST00000547897; ENST00000084795; ENST00000550645; | TAF |

TABLE 24-continued

Transcript fusion for Glioblastoma Multiforme (GBM)
Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 40% | chr6 | 3247564 | 7553243 | – | chr6 | 3226903 | 3226795 | – | ENST00000549370; ENST00000549273 ENST00000259818 | TAF |
| 38% | chr12 | 102411559 | 102411498 | – | chr12 | 102406970 | 102406886 | – | ENST00000240079; ENST00000545679; ENST00000542923 | TAF |
| 38% | chr2 | 175806110 | 175805544 | – | chr2 | 175783293 | 175783262 | – | ENST00000409900; ENST00000409156 | TAF |
| 38% | chr2 | 175806110 | 175805544 | – | chr2 | 175783293 | 175783262 | – | ENST00000409900; ENST00000409156 | TAF |
| 37% | chr7 | 73098299 | 73098330 | + | chr7 | 73100966 | 73101061 | + | ENST00000265758; ENST00000432522; ENST00000421744; ENST00000428163; ENST00000423166; ENST00000423497 | TAF |
| 37% | chr7 | 73098299 | 73098330 | + | chr7 | 73100966 | 73101061 | + | ENST00000265758; ENST00000432522; ENST00000421744; ENST00000428163; ENST00000423166; ENST00000423497 | TAF |
| 37% | chr7 | 73098299 | 73098330 | + | chr7 | 73100966 | 73101061 | + | ENST00000265758; ENST00000432522; ENST00000421744; ENST00000428163; ENST00000423166; ENST00000423497 | TAF |
| 37% | chr7 | 73098299 | 73098330 | + | chr7 | 73100966 | 73101061 | + | ENST00000265758; ENST00000432522; ENST00000421744; ENST00000428163; ENST00000423166; ENST00000423497 | TAF |
| 37% | chr7 | 73098299 | 73098330 | + | chr7 | 73100966 | 73101061 | + | ENST00000265758; ENST00000432522; ENST00000421744; ENST00000428163; ENST00000423166; ENST00000423497 | TAF |
| 37% | chr8 | 51556816 | 51557016 | + | chr8 | 51569469 | 51569585 | + | ENST00000518864; ENST00000522124; ENST00000517473; ENST00000520825; ENST00000276467; ENST00000524004 | TSF |
| 37% | chr8 | 51556816 | 51557016 | + | chr8 | 51569469 | 51569585 | + | ENST00000518864; ENST00000522124; ENST00000517473; ENST00000520825; ENST00000276467; ENST00000524004 | TSF |
| 37% | chr8 | 51556816 | 51557016 | + | chr8 | 51569469 | 51569585 | + | ENST00000518864; ENST00000522124; ENST00000517473; ENST00000520825; ENST00000276467; ENST00000524004 | TSF |
| 37% | chr8 | 51556816 | 51557016 | + | chr8 | 51569469 | 51569585 | + | ENST00000518864; ENST00000522124; ENST00000517473; ENST00000520825; ENST00000276467; ENST00000524004 | TSF |
| 35% | chr15 | 75891737 | 175891599 | – | chr15 | 75891022 | 75890699 | – | ENST00000567134; ENST00000308588; ENST00000371091; ENST00000564644; ENST00000564675 | TSF |
| 34% | chr7 | 99747312 | 99747315 | + | chr7 | 99751023 | 99751140; 99751352 | + | ENST00000341942; ENST00000441173 | TAF |
| 34% | chr7 | 99747312 | 99747315 | + | chr7 | 99751023 | 99751140; 99751352 | + | ENST00000341942; ENST00000441173 | TAF |
| 34% | chr11 | 93468219 | 93468129 | – | chr11 | 93467826 | 93467791; 93467814 | – | ENST00000393259; ENST00000527169 | TAF |
| 34% | chr11 | 93468219 | 93468129 | – | chr11 | 93467826 | 93467791; 93467814 | – | ENST00000393259; ENST00000527169 | TAF |
| 32% | chr20 | 43919547 | 43919514 | – | chr20 | 43882374 | 43882216 | – | ENST00000338380 | TAF |
| 32% | chr5 | 176950300 | 176950160 | – | chr5 | 176949072 | 176948976 | – | ENST00000514747; ENST00000329540; ENST00000443375; ENST00000524677 | TAF |
| 30% | chr5 | 176950016 | 176949956 | – | chr5 | 176949072 | 176948976 | – | ENST00000514747; ENST00000329540; ENST00000443375; ENST00000524677 | TAF |
| 29% | chr3 | 39544232 | 39544405 | + | chr3 | 39554874 | 39554913; 39554874 | + | ENST00000428261; ENST00000415443; ENST00000447324; ENST00000383754; ENST00000311042; ENST00000452959; ENST00000396228; ENST00000442631 | TAF |
| 29% | chr3 | 39544232 | 39544405 | + | chr3 | 39554874 | 39554913; 39554874 | + | ENST00000428261; ENST00000415443; ENST00000447324; ENST00000383754; ENST00000311042; ENST00000452959; ENST00000396228; ENST00000442631 | TAF |
| 28% | chr1 | 79124611 | 79124650 | + | chr1 | 79124997 | 79125168; 79125113 | + | ENST00000370747; ENST00000438486 | TAF |
| 28% | chr1 | 79124611 | 79124650 | + | chr1 | 79124997 | 79125168; 79125113 | + | ENST00000370747; ENST00000438486 | TAF |
| 28% | chr4 | 151135833 | 151135882 | + | chr4 | 151141858 | 151141930 | + | ENST00000296550; ENST00000411937; ENST00000506325; ENST00000302176 | TSF |
| 28% | chr4 | 151135833 | 151135882 | + | chr4 | 151141858 | 151141930 | + | ENST00000296550; ENST00000411937; ENST00000506325; ENST00000302176 | TSF |
| 26% | chr19 | 58515808 | 58516068 | + | chr19 | 58517275 | 58517367; 58517363 | + | ENST00000550135; ENST00000553254 | TAF |
| 26% | chr19 | 58515808 | 58516068 | + | chr19 | 58517275 | 58517367; 58517363 | + | ENST00000550135; ENST00000553254 | TAF |
| 26% | chr16 | 29915789 | 29915910 | + | chr16 | 29916173 | 29916286 | + | ENST00000563177; ENST00000483405; ENST00000308748; ENST00000414952; ENST00000566693 | TAF |
| 26% | chr16 | 29915789 | 29915910 | + | chr16 | 29916173 | 29916286 | + | ENST00000563177; ENST00000483405; ENST00000308748; ENST00000414952; ENST00000566693 | TAF |

TABLE 24-continued

Transcript fusion for Glioblastoma Multiforme (GBM)
Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 26% | chr7 | 29899867 | 29900179 | + | chr7 | 29915446 | 29915578 | + | ENST00000409123; ENST00000242140; ENST00000409290 | TSF |
| 26% | chr7 | 29899867 | 29900179 | + | chr7 | 29915446 | 29915578 | + | ENST00000409123; ENST00000242140; ENST00000409290 | TSF |
| 26% | chr4 | 151135833 | 151135882 | + | chr4 | 151141855 | 151141930 | + | ENST00000296550; ENST00000302176 | TSF |
| 25% | chr12 | 6602868 | 6602840 | − | chr12 | 6602138 | 6602028 | − | ENST00000229238 | TAF |
| 24% | chr20 | 43581305 | 43581345 | + | chr20 | 43586978 | 43587052 | + | ENST00000372826 | TAF |
| 24% | chr11 | 66048968 | 66049045 | + | chr11 | 66049730 | 66049798; 66049824 | + | ENST00000528852; ENST00000311445; ENST00000528063 | TSF |
| 24% | chr11 | 66048968 | 66049045 | + | chr11 | 66049730 | 66049798; 66049824 | + | ENST00000528852; ENST00000311445; ENST00000528063 | TSF |
| 24% | chr11 | 66048968 | 66049045 | + | chr11 | 66049730 | 66049798; 66049824 | + | ENST00000528852; ENST00000311445; ENST00000528063 | TSF |
| 24% | chr1 | 246581335 | 246580598 | − | chr1 | 246518396 | 246518333 | − | ENST00000388985; ENST00000403792 | TSF |
| 24% | chr1 | 246581335 | 246580598 | − | chr1 | 246518396 | 246518333 | − | ENST00000388985; ENST00000403792 | TSF |
| 23% | chr13 | 111287310 | 111287482 | + | chr13 | 111287815 | 111287935 | + | ENST00000458711; ENST00000424185; ENST00000309957 | TAF |
| 23% | chr13 | 111287310 | 111287482 | + | chr13 | 111287815 | 111287935 | + | ENST00000458711; ENST00000424185; ENST00000309957 | TAF |
| 22% | chr20 | 62066436 | 62065933 | − | chr20 | 62065256 | 62065162; 62065098 | − | ENST00000357249; ENST00000359125; ENST00000354587; ENST00000359689; ENST00000360480; ENST00000370224; ENST00000344462; ENST00000344425 | TSF |
| 22% | chr20 | 62066436 | 62065933 | − | chr20 | 62065256 | 62065162; 62065098 | − | ENST00000357249; ENST00000359125; ENST00000354587; ENST00000359689; ENST00000360480; ENST00000370224; ENST00000344462; ENST00000344425 | TSF |
| 22% | chr20 | 62066436 | 62065933 | − | chr20 | 62065256 | 62065162; 62065098 | − | ENST00000357249; ENST00000359125; ENST00000354587; ENST00000359689; ENST00000360480; ENST00000370224; ENST00000344462; ENST00000344425 | TSF |
| 22% | chr20 | 62066436 | 62065933 | − | chr20 | 62065256 | 62065162; 62065098 | − | ENST00000357249; ENST00000359125; ENST00000354587; ENST00000359689; ENST00000360480; ENST00000370224; ENST00000344462; ENST00000344425 | TSF |
| 22% | chr20 | 62066436 | 62065933 | − | chr20 | 62065256 | 62065162; 62065098 | − | ENST00000357249; ENST00000359125; ENST00000354587; ENST00000359689; ENST00000360480; ENST00000370224; ENST00000344462; ENST00000344425 | TSF |
| 22% | chr20 | 62066436 | 62065933 | − | chr20 | 62065256 | 62065162; 62065098 | − | ENST00000357249; ENST00000359125; ENST00000354587; ENST00000359689; ENST00000360480; ENST00000370224; ENST00000344462; ENST00000344425 | TSF |
| 22% | chr20 | 62066436 | 62065933 | − | chr20 | 62065256 | 62065162; 62065098 | − | ENST00000357249; ENST00000359125; ENST00000354587; ENST00000359689; ENST00000360480; ENST00000370224; ENST00000344462; ENST00000344425 | TSF |
| 22% | chr20 | 62066436 | 62065933 | − | chr20 | 62065256 | 62065162; 62065098 | − | ENST00000357249; ENST00000359125; ENST00000354587; ENST00000359689; ENST00000360480; ENST00000370224; ENST00000344462; ENST00000344425 | TSF |
| 22% | chr15 | 93592614 | 93592599 | − | chr15 | 93588935 | 93588228; 93588877 | − | ENST00000425933; ENST00000543599; ENST00000329082; ENST00000542321; ENST00000538818; ENST00000557301; ENST00000557420; ENST00000556658 | TSF |
| 22% | chr15 | 93592614 | 93592599 | − | chr15 | 93588935 | 93588228; 93588877 |   | ENST00000425933; ENST00000543599; ENST00000329082; ENST00000542321; ENST00000538818; ENST00000557301; ENST00000557420; ENST00000556658 | TSF |
| 21% | chr17 | 40813377 | 40813974 | + | chr17 | 40815395 | 40815521 | + | ENST00000251412 | TAF |
| 20% | chr1 | 31346734 | 31346686 | − | chr1 | 31346224 | 31346058 | − | ENST00000336798; ENST00000339394 | TAF |
| 19% | chr22 | 45064651 | 45064685 | + | chr22 | 45098372 | 45098488 | + | ENST00000403581; ENST00000336985; ENST00000403696; ENST00000431834; ENST00000361473; ENST00000352766; ENST00000517296 | TAF |
| 19% | chr22 | 45064651 | 45064685 | + | chr22 | 45098372 | 45098488 | + | ENST00000403581; ENST00000336985; ENST00000403696; ENST00000431834; ENST00000361473; ENST00000352766; ENST00000517296 | TAF |
| 19% | chr22 | 45064651 | 45064685 | + | chr22 | 45098372 | 45098488 | + | ENST00000403581; ENST00000336985; ENST00000403696; ENST00000431834; ENST00000361473; ENST00000352766; ENST00000517296 | TAF |
| 19% | chr22 | 45064651 | 45064685 | + | chr22 | 45098372 | 45098488 | + | ENST00000403581; ENST00000336985; ENST00000403696; ENST00000431834; | TAF |

TABLE 24-continued

Transcript fusion for Glioblastoma Multiforme (GBM)
Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 19% | chr22 | 45064651 | 64645085 | + | chr22 | 45098372 | 45098488 | + | ENST00000361473; ENST00000352766; ENST00000517296 ENST00000403581; ENST00000336985; ENST00000403696; ENST00000431834; ENST00000361473; ENST00000352766; ENST00000517296 | TAF |
| 19% | chr5 | 92920103 | 92920128 | + | chr5 | 92921107 | 92921192 | + | ENST00000327111 | TAF |
| 19% | chr7 | 55464873 | 55464924 | + | chr7 | 55466116 | 55466323 | + | ENST00000254770 | TSF |
| 18% | chr9 | 69269543 | 69269396 | − | chr9 | 69259308 | 69259222; 69259214 | − | ENST00000377457; ENST00000377449; ENST00000382399; ENST00000377441; ENST00000377439 | TAF |
| 18% | chr9 | 69269543 | 69269396 | − | chr9 | 69259308 | 69259222; 69259214 | − | ENST00000377457; ENST00000377449; ENST00000382399; ENST00000377441; ENST00000377439 | TAF |
| 18% | chr9 | 69269543 | 69269396 | − | chr9 | 69259308 | 69259222; 69259214 | − | ENST00000377457; ENST00000377449; ENST00000382399; ENST00000377441; ENST00000377439 | TAF |
| 18% | chr9 | 69269543 | 69269396 | − | chr9 | 69259308 | 69259222; 69259214 | − | ENST00000377457; ENST00000377449; ENST00000382399; ENST00000377441; ENST00000377439 | TAF |
| 18% | chr7 | 55477082 | 55477474 | + | chr7 | 55479600 | 55479782 | + | ENST00000254770 | TSF |
| 18% | chr2 | 101024262 | 101024202 | − | chr2 | 101023169 | 101023038 | − | ENST00000542617; ENST00000448989 | TSF |
| 18% | chr2 | 101024262 | 101024202 | − | chr2 | 101023169 | 101023038 | − | ENST00000542617; ENST00000448989 | TSF |
| 18% | chr9 | 117824597 | 117824593 | − | chr9 | 117822281 | 117822009 | − | ENST00000350763; ENST00000341037; ENST00000423613 | TSF |
| 18% | chr9 | 117824597 | 117824593 | − | chr9 | 117822281 | 117822009 | − | ENST00000350763; ENST00000341037; ENST00000423613 | TSF |
| 18% | chr9 | 117824597 | 117824593 | − | chr9 | 117822281 | 117822009 | − | ENST00000350763; ENST00000341037; ENST00000423613 | TSF |
| 17% | chr9 | 131189761 | 131190058 | + | chr9 | 131190581 | 131190700; 131190702 | + | ENST00000372842; ENST00000420512; ENST00000372838 | TAF |
| 17% | chr9 | 131189761 | 190131058 | + | chr9 | 131190581 | 131190700; 131190702 | + | ENST00000372842; ENST00000420512; ENST00000372838 | TAF |
| 17% | chr18 | 48249804 | 48249890 | + | chr18 | 48252332 | 48252545 | + | ENST00000400384; ENST00000540640 | TAF |
| 17% | chr1 | 151683281 | 151683172 | − | chr1 | 151682267 | 151682219 | − | ENST00000290585; ENST00000290583; ENST00000420342 | TAF |
| 17% | chr1 | 151683281 | 151683172 | − | chr1 | 151682267 | 151682219 | − | ENST00000290585; ENST00000290583; ENST00000420342 | TAF |
| 17% | chr1 | 151683281 | 151683172 | − | chr1 | 151682267 | 151682219 | − | ENST00000290585; ENST00000290583; ENST00000420342 | TAF |
| 17% | chr9 | 100309652 | 100309653 | + | chr9 | 100315563 | 100315682 | + | ENST00000395211; ENST00000259365 | TAF |
| 17% | chr5 | 79293955 | 79294198 | + | chr5 | 79335900 | 79336103 | + | ENST00000350881 | TSF |
| 16% | chr14 | 72944225 | 44272989 | + | chr14 | 72944976 | 72945037 | + | ENST00000553525; ENST00000555571; ENST00000553530; ENST00000554474; ENST00000556437; ENST00000355512; ENST00000404301; ENST00000406236; ENST00000407322; ENST00000343854; ENST00000402788; ENST00000434263; ENST00000554782 | TAF |
| 16% | chr14 | 72944225 | 72944289 | + | chr14 | 72944976 | 72945037 | + | ENST00000553525; ENST00000555571; ENST00000553530; ENST00000554474; ENST00000556437; ENST00000355512; ENST00000404301; ENST00000406236; ENST00000407322; ENST00000343854; ENST00000402788; ENST00000434263; ENST00000554782 | TAF |
| 16% | chr14 | 72944225 | 44272989 | + | chr14 | 72944976 | 72945037 | + | ENST00000553525; ENST00000555571; ENST00000553530; ENST00000554474; ENST00000556437; ENST00000355512; ENST00000404301; ENST00000406236; ENST00000407322; ENST00000343854; ENST00000402788; ENST00000434263; ENST00000554782 | TAF |
| 16% | chr14 | 72944225 | 44272989 | + | chr14 | 72944976 | 72945037 | + | ENST00000553525; ENST00000555571; ENST00000553530; ENST00000554474; ENST00000556437; ENST00000355512; ENST00000404301; ENST00000406236; ENST00000407322; ENST00000343854; ENST00000402788; ENST00000434263; ENST00000554782 | TAF |
| 16% | chr14 | 72944225 | 72944289 | + | chr14 | 72944976 | 72945037 | + | ENST00000553525; ENST00000555571; ENST00000553530; ENST00000554474; ENST00000556437; ENST00000355512; ENST00000404301; ENST00000406236; ENST00000407322; ENST00000343854; | TAF |

TABLE 24-continued

Transcript fusion for Glioblastoma Multiforme (GBM)
Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 16% | chr14 | 72944225 | 72944289 | + | chr14 | 72944976 | 72945037 | + | ENST00000402788; ENST00000434263; ENST00000554782 ENST00000553525; ENST00000555571; ENST00000553530; ENST00000554474; ENST00000556437; ENST00000355512; ENST00000404301; ENST00000406236; ENST00000407322; ENST00000343854; ENST00000402788; ENST00000434263; ENST00000554782 | TAF |
| 16% | chr14 | 72944225 | 72944289 | + | chr14 | 72944976 | 72945037 | + | ENST00000553525; ENST00000555571; ENST00000553530; ENST00000554474; ENST00000556437; ENST00000355512; ENST00000404301; ENST00000406236; ENST00000407322; ENST00000343854; ENST00000402788; ENST00000434263; ENST00000554782 | TAF |
| 16% | chr14 | 72944225 | 72944289 | + | chr14 | 72944976 | 72945037 | + | ENST00000553525; ENST00000555571; ENST00000553530; ENST00000554474; ENST00000556437; ENST00000355512; ENST00000404301; ENST00000406236; ENST00000407322; ENST00000343854; ENST00000402788; ENST00000434263; ENST00000554782 | TAF |
| 16% | chr14 | 72944225 | 72944289 | + | chr14 | 72944976 | 72945037 | + | ENST00000553525; ENST00000555571; ENST00000553530; ENST00000554474; ENST00000556437; ENST00000355512; ENST00000404301; ENST00000406236; ENST00000407322; ENST00000343854; ENST00000402788; ENST00000434263; ENST00000554782 | TAF |
| 16% | chr14 | 72944225 | 72944289 | + | chr14 | 72944976 | 72945037 | + | ENST00000553525; ENST00000555571; ENST00000553530; ENST00000554474; ENST00000556437; ENST00000355512; ENST00000404301; ENST00000406236; ENST00000407322; ENST00000343854; ENST00000402788; ENST00000434263; ENST00000554782 | TAF |
| 16% | chr16 | 75685621 | 75685636 | + | chr16 | 75688171 | 75688295; 75688183 | + | ENST00000300086; ENST00000569234 | TAF |
| 16% | chr16 | 75685621 | 75685636 | + | chr16 | 75688171 | 75688295; 75688183 | + | ENST00000300086; ENST00000569234 | TAF |
| 16% | chr11 | 125351332 | 125351294 | − | chr11 | 125333466 | 125333380 | − | ENST00000278919; ENST00000577924 | TAF |
| 16% | chr11 | 125351332 | 125435194 | − | chr11 | 12533466 | 125333380 | − | ENST00000278919; ENST00000577924 | TAF |
| 16% | chr7 | 55435136 | 55435321 | + | chr7 | 55459486 | 55459603 | + | ENST00000254770 | TSF |
| 15% | chr7 | 65819313 | 65819316 | + | chr7 | 65821812 | 65821829 | + | ENST00000304842 | TAF |
| 15% | chr12 | 21478885 | 21477528 | − | chr12 | 21471857 | 21471716; 21471765 | − | ENST00000307378; ENST00000452078; ENST00000544020; ENST00000544290; ENST00000390670; ENST00000422327; ENST00000453443; ENST00000421294; ENST00000450590; ENST00000435179; ENST00000445053; ENST00000421287 | TAF |
| 15% | chr12 | 21478885 | 21477528 | − | chr12 | 21471857 | 21471716; 21471765 | − | ENST00000307378; ENST00000452078; ENST00000544020; ENST00000544290; ENST00000390670; ENST00000422327; ENST00000453443; ENST00000421294; ENST00000450590; ENST00000435179; ENST00000445053; ENST00000421287 | TAF |
| 15% | chr12 | 21478885 | 21477528 | − | chr12 | 21471857 | 21471716; 21471765 | − | ENST00000307378; ENST00000452078; ENST00000544020; ENST00000544290; ENST00000390670; ENST00000422327; ENST00000453443; ENST00000421294; ENST00000450590; ENST00000435179; ENST00000445053; ENST00000421287 | TAF |
| 15% | chr12 | 21478885 | 21477528 | − | chr12 | 21471857 | 21471716; 21471765 | − | ENST00000307378; ENST00000452078; ENST00000544020; ENST00000544290; ENST00000390670; ENST00000422327; ENST00000453443; ENST00000421294; ENST00000450590; ENST00000435179; ENST00000445053; ENST00000421287 | TAF |
| 15% | chr12 | 21478885 | 21477528 | − | chr12 | 21471857 | 21471716; 21471765 | − | ENST00000307378; ENST00000452078; ENST00000544020; ENST00000544290; ENST00000390670; ENST00000422327; ENST00000453443; ENST00000421294; ENST00000450590; ENST00000435179; ENST00000445053; ENST00000421287 | TAF |

TABLE 24-continued

Transcript fusion for Glioblastoma Multiforme (GBM)
Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 15% | chr12 | 21478885 | 21477528 | – | chr12 | 21471857 | 21471716; 21471765 | – | ENST00000307378; ENST00000452078; ENST00000544020; ENST00000544290; ENST00000390670; ENST00000422327; ENST00000453443; ENST00000421294; ENST00000450590; ENST00000435179; ENST00000445053; ENST00000421287 | TAF |
| 15% | chr12 | 21478885 | 21477528 | – | chr12 | 21471857 | 21471716; 21471765 | – | ENST00000307378; ENST00000452078; ENST00000544020; ENST00000544290; ENST00000390670; ENST00000422327; ENST00000453443; ENST00000421294; ENST00000450590; ENST00000435179; ENST00000445053; ENST00000421287 | TAF |
| 15% | chr12 | 21478885 | 21477528 | – | chr12 | 21471857 | 21471716; 21471765 | – | ENST00000307378; ENST00000452078; ENST00000544020; ENST00000544290; ENST00000390670; ENST00000422327; ENST00000453443; ENST00000421294; ENST00000450590; ENST00000435179; ENST00000445053; ENST00000421287 | TAF |
| 15% | chr12 | 21478885 | 77521428 | – | chr12 | 21471857 | 21471716; 21471765 | – | ENST00000307378; ENST00000452078; ENST00000544020; ENST00000544290; ENST00000390670; ENST00000422327; ENST00000453443; ENST00000421294; ENST00000450590; ENST00000435179; ENST00000445053; ENST00000421287 | TAF |
| 15% | chr12 | 21478885 | 21477528 | – | chr12 | 21471857 | 21471716; 21471765 | – | ENST00000307378; ENST00000452078; ENST00000544020; ENST00000544290; ENST00000390670; ENST00000422327; ENST00000453443; ENST00000421294; ENST00000450590; ENST00000435179; ENST00000445053; ENST00000421287 | TAF |
| 15% | chr5 | 68663671 | 63668666 | – | chr5 | 68662422 | 68662330 | – | ENST00000380822; ENST00000380818 | TAF |
| 15% | chr7 | 149571552 | 149571710 | + | chr7 | 149572687 | 149572734 | + | ENST00000421974; ENST00000456496; ENST00000464683; ENST00000479613; ENST00000606024; ENST00000471877; ENST00000464662; ENST00000425642 | TAF |
| 15% | chr7 | 149571552 | 149571710 | + | chr7 | 149572687 | 149572734 | + | ENST00000421974; ENST00000456496; ENST00000464683; ENST00000479613; ENST00000606024; ENST00000471877; ENST00000464662; ENST00000425642 | TAF |
| 15% | chr7 | 149571552 | 149571710 | + | chr7 | 149572687 | 149572734 | + | ENST00000421974; ENST00000456496; ENST00000464683; ENST00000479613; ENST00000606024; ENST00000471877; ENST00000464662; ENST00000425642 | TAF |
| 15% | chr7 | 149571552 | 149571710 | + | chr7 | 149572687 | 149572734 | + | ENST00000421974; ENST00000456496; ENST00000464683; ENST00000479613; ENST00000606024; ENST00000471877; ENST00000464662; ENST00000425642 | TAF |
| 15% | chr4 | 491211 | 490916 | – | chr4 | 466490 | 466364 | – | ENST00000515578; ENST00000506646; ENST00000505900 | TAF |
| 15% | chr4 | 491211 | 490916 | – | chr4 | 466490 | 466364 | – | ENST00000515578; ENST00000506646; ENST00000505900 | TAF |
| 15% | chr4 | 491211 | 490916 | – | chr4 | 466490 | 466364 | – | ENST00000515578; ENST00000506646; ENST00000505900 | TAF |
| 15% | chr14 | 23040829 | 23040779 | – | chr14 | 23034037 | 23034012 | – | ENST00000538631 | TAF |
| 15% | chr2 | 25110247 | 25109962 | – | chr2 | 25095588 | 25095439 | – | ENST00000260600; ENST00000433852 | TAF |
| 15% | chr2 | 25110247 | 25109962 | – | chr2 | 25095588 | 25095439 | – | ENST00000260600; ENST00000433852 | TAF |
| 15% | chr12 | 49602693 | 49602732 | + | chr12 | 49621874 | 49621949 | + | ENST00000541364; ENST00000549818; ENST00000552448; ENST00000552125 | TSF |
| 15% | chr12 | 49602693 | 49602732 | + | chr12 | 49621874 | 49621949 | + | ENST00000541364; ENST00000549818; ENST00000552448; ENST00000552125 | TSF |
| 15% | chr12 | 49602693 | 49602732 | + | chr12 | 49621874 | 49621949 | + | ENST00000541364; ENST00000549818; ENST00000552448; ENST00000552125 | TSF |
| 14% | chr11 | 113094670 | 113094176 | + | chr11 | 113102367 | 113102517 | + | ENST00000533760; ENST00000524665; ENST00000534015; ENST00000401611; ENST00000316851 | TAF |
| 14% | chr11 | 113094670 | 113094766 | + | chr11 | 113102367 | 113102517 | + | ENST00000533760; ENST00000524665; ENST00000534015; ENST00000401611; ENST00000316851 | TAF |
| 14% | chr11 | 113094670 | 113094766 | + | chr11 | 113102367 | 113102517 | + | ENST00000533760; ENST00000524665; ENST00000534015; ENST00000401611; ENST00000316851 | TAF |
| 14% | chr11 | 113094670 | 113094766 | + | chr11 | 113102367 | 113102517 | + | ENST00000533760; ENST00000524665; ENST00000534015; ENST00000401611; ENST00000316851 | TAF |
| 14% | chr11 | 113094670 | 113094766 | + | chr11 | 113102367 | 113102517 | + | ENST00000533760; ENST00000524665; | TAF |

TABLE 24-continued

Transcript fusion for Glioblastoma Multiforme (GBM)
Coordinates of the fusion sequences for which the donor is the TE.

| 1 | 2' | 3' | 4' | 5' 6' | 7' | 8' | 9' 10' | 11' |
|---|---|---|---|---|---|---|---|---|
| | | | | | | | ENST00000534015; ENST00000401611; ENST00000316851 | |
| 14% | chr17 | 74261446 | 74261484 | + chr17 | 74261988 | 74262050 | + ENST00000327490 | TAF |
| 14% | chr11 | 60615047 | 60615096 | + chr11 | 60615397 | 60615526 | + ENST00000227520 | TAF |
| 14% | chr4 | 89454580 | 89454120 | − chr4 | 89443180 | 89443039 | − ENST00000273968 | TAF |
| 14% | chrX | 13907696 | 13907571 | − chrX | 13803927 | 13803741 | − ENST00000316715; ENST00000454189; ENST00000493677; ENST00000355135; ENST00000356942; ENST00000475307 | TAF |
| 14% | chrX | 13907696 | 13907571 | − chrX | 13803927 | 13803741 | − ENST00000316715; ENST00000454189; ENST00000493677; ENST00000355135; ENST00000356942; ENST00000475307 | TAF |
| 14% | chrX | 13907696 | 139107571 | − chrX | 13803927 | 13803741 | − ENST00000316715; ENST00000454189; ENST00000493677; ENST00000355135; ENST00000356942; ENST00000475307 | TAF |
| 14% | chr1 | 99718539 | 99718543 | + chr1 | 99753521 | 99753706 | + ENST00000370185; ENST00000457765 | TSF |
| 14% | chr1 | 99718539 | 99718543 | + chr1 | 99753521 | 99753706 | + ENST00000370185; ENST00000457765 | TSF |
| 14% | chr7 | 55985644 | 55985990 | + chr7 | 55990855 | 55990981 | + ENST00000426595; ENST00000429591 | TSF |
| 14% | chr7 | 55985644 | 55985990 | + chr7 | 55990855 | 55990981 | + ENST00000426595; ENST00000429591 | TSF |
| 14% | chr8 | 82356115 | 82355982 | − chr8 | 82355683 | 82355633; 82355676 | − ENST00000256103; ENST00000519260 | TSF |
| 14% | chr8 | 82356115 | 82355982 | − chr8 | 82355683 | 82355633; 82355676 | ENST00000256103; ENST00000519260 | TSF |
| 13% | chr11 | 73367079 | 73367447 | + chr11 | 73371798 | 73371897; 73371801; 73371811; 73371815; 73371918; 73371840 | + ENST00000354190; ENST00000398492; ENST00000227214; ENST00000398494; ENST00000543085; ENST00000539157; ENST00000546251; ENST00000535582; ENST00000538227; ENST00000543524; ENST00000541597; ENST00000535129; ENST00000542389; ENST00000540431 | TAF |
| 13% | chr11 | 73367079 | 73367447 | + chr11 | 73371798 | 73371897; 73371801; 73371811; 73371815; 73371918; 73371840 | + ENST00000354190; ENST00000398492; ENST00000227214; ENST00000398494; ENST00000543085; ENST00000539157; ENST00000546251; ENST00000535582; ENST00000538227; ENST00000543524; ENST00000541597; ENST00000535129; ENST00000542389; ENST00000540431 | TAF |
| 13% | chr11 | 73367079 | 73367447 | + chr11 | 73371798 | 73371897; 73371801; 73371811; 73371815; 73371918; 73371840 | + ENST00000354190; ENST00000398492; ENST00000227214; ENST00000398494; ENST00000543085; ENST00000539157; ENST00000546251; ENST00000535582; ENST00000538227; ENST00000543524; ENST00000541597; ENST00000535129; ENST00000542389; ENST00000540431 | TAF |
| 13% | chr11 | 73367079 | 73367447 | + chr11 | 73371798 | 73371897; 73371801; 73371811; 73371815; 73371918; 73371840 | + ENST00000354190; ENST00000398492; ENST00000227214; ENST00000398494; ENST00000543085; ENST00000539157; ENST00000546251; ENST00000535582; ENST00000538227; ENST00000543524; ENST00000541597; ENST00000535129; ENST00000542389; ENST00000540431 | TAF |
| 13% | chr11 | 73367079 | 73367447 | + chr11 | 73371798 | 73371897; 73371801; 73371811; 73371815; 73371918; 73371840 | + ENST00000354190; ENST00000398492; ENST00000227214; ENST00000398494; ENST00000543085; ENST00000539157; ENST00000546251; ENST00000535582; ENST00000538227; ENST00000543524; ENST00000541597; ENST00000535129; ENST00000542389; ENST00000540431 | TAF |
| 13% | chr11 | 73367079 | 73367447 | + chr11 | 73371798 | 73371897; 73371801; 73371811; 73371815; 73371918; 73371840 | + ENST00000354190; ENST00000398492; ENST00000227214; ENST00000398494; ENST00000543085; ENST00000539157; ENST00000546251; ENST00000535582; ENST00000538227; ENST00000543524; ENST00000541597; ENST00000535129; ENST00000542389; ENST00000540431 | TAF |
| 13% | chr11 | 73367079 | 73367447 | + chr11 | 73371798 | 73371897; 73371801; 73371811; 73371815; 73371918; 73371840 | + ENST00000354190; ENST00000398492; ENST00000227214; ENST00000398494; ENST00000543085; ENST00000539157; ENST00000546251; ENST00000535582; ENST00000538227; ENST00000543524; ENST00000541597; ENST00000535129; ENST00000542389; ENST00000540431 | TAF |
| 13% | chr11 | 73367079 | 73367447 | + chr11 | 73371798 | 73371897; 73371801; 73371811; 73371815; | + ENST00000354190; ENST00000398492; ENST00000227214; ENST00000398494; ENST00000543085; ENST00000539157; ENST00000546251; ENST00000535582; | TAF |

TABLE 24-continued

Transcript fusion for Glioblastoma Multiforme (GBM)
Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 13% | chr11 | 73367079 | 73367447 | + | chr11 | 73371798 | 73371918; 73371840 73371897; 73371801; 73371811; 73371815; 73371918; 73371840 | + | ENST00000538227; ENST00000543524; ENST00000541597; ENST00000535129; ENST00000542389; ENST00000540431 ENST00000354190; ENST00000398492; ENST00000227214; ENST00000398494; ENST00000543085; ENST00000539157; ENST00000546251; ENST00000535582; ENST00000538227; ENST00000543524; ENST00000541597; ENST00000535129; ENST00000542389; ENST00000540431 | TAF |
| 13% | chr2 | 79731998 | 79732308 | + | chr2 | 79878678 | 79878784 | + | ENST00000361291 | TAF |
| 13% | chr19 | 13127972 | 13127986 | + | chr19 | 13135835 | 13136366; 13135976; 13136309 | + | ENST00000397661; ENST00000592199; ENST00000587760; ENST00000585575; ENST00000360105; ENST00000586797; ENST00000591028; ENST00000587260; ENST00000358552 | TAF |
| 13% | chr19 | 13127972 | 13127986 | + | chr19 | 13135835 | 13136366; 13135976; 13136309 | + | ENST00000397661; ENST00000592199; ENST00000587760; ENST00000585575; ENST00000360105; ENST00000586797; ENST00000591028; ENST00000587260; ENST00000358552 | TAF |
| 13% | chr19 | 13127972 | 13127986 | + | chr19 | 13135835 | 13136366; 13135976; 13136309 | + | ENST00000397661; ENST00000592199; ENST00000587760; ENST00000585575; ENST00000360105; ENST00000586797; ENST00000591028; ENST00000587260; ENST00000358552 | TAF |
| 13% | chr19 | 13127972 | 13127986 | + | chr19 | 13135835 | 13136366; 13135976; 13136309 | + | ENST00000397661; ENST00000592199; ENST00000587760; ENST00000585575; ENST00000360105; ENST00000586797; ENST00000591028; ENST00000587260; ENST00000358552 | TAF |
| 13% | chr19 | 13127972 | 13127986 | + | chr19 | 13135835 | 13136366; 13135976; 13136309 | + | ENST00000397661; ENST00000592199; ENST00000587760; ENST00000585575; ENST00000360105; ENST00000586797; ENST00000591028; ENST00000587260; ENST00000358552 | TAF |
| 13% | chr19 | 13127972 | 13127986 | + | chr19 | 13135835 | 13136366; 13135976; 13136309 | + | ENST00000397661; ENST00000592199; ENST00000587760; ENST00000585575; ENST00000360105; ENST00000586797; ENST00000591028; ENST00000587260; ENST00000358552 | TAF |
| 13% | chr17 | 39974832 | 39974854 | + | chr17 | 39975462 | 39975651 | + | ENST00000321562 | TAF |
| 13% | chr19 | 44244036 | 44243825 | − | chr19 | 44242369 | 44242274 | − | ENST00000270066; ENST00000601170 | TAF |
| 13% | chr19 | 44244036 | 44243825 | − | chr19 | 44242369 | 44242274 | − | ENST00000270066; ENST00000601170 | TAF |
| 13% | chr13 | 51289548 | 51289014 | − | chr13 | 51287376 | 51287353 | − | ENST00000400393 | TSF |
| 13% | chr17 | 42991959 | 42991849 | − | chr17 | 42991456 | 42991396 | − | ENST00000253408; ENST00000435360; ENST00000586793; ENST00000592320; ENST00000588316; ENST00000588037 | TSF |
| 13% | chr17 | 42991959 | 42991849 | − | chr17 | 42991456 | 42991396 | − | ENST00000253408; ENST00000435360; ENST00000586793; ENST00000592320; ENST00000588316; ENST00000588037 | TSF |
| 13% | chr17 | 42991959 | 42991849 | − | chr17 | 42991456 | 42991396 | − | ENST00000253408; ENST00000435360; ENST00000586793; ENST00000592320; ENST00000588316; ENST00000588037 | TSF |
| 13% | chr17 | 42991959 | 42991849 | − | chr17 | 42991456 | 42991396 | − | ENST00000253408; ENST00000435360; ENST00000586793; ENST00000592320; ENST00000588316; ENST00000588037 | TSF |
| 13% | chr17 | 42991959 | 42991849 | − | chr17 | 42991456 | 42991396 | − | ENST00000253408; ENST00000435360; ENST00000586793; ENST00000592320; ENST00000588316; ENST00000588037 | TSF |
| 13% | chr17 | 42991959 | 42991849 | − | chr17 | 42991456 | 42991396 | − | ENST00000253408; ENST00000435360; ENST00000586793; ENST00000592320; ENST00000588316; ENST00000588037 | TSF |
| 13% | chr6 | 3229888 | 3229779 | − | chr6 | 3226903 | 3226795 | − | ENST00000259818 | TSF |
| 13% | chr6 | 34338198 | 34338038 | − | chr6 | 34309749 | 34309639 | − | ENST00000607016; ENST00000605528 | TSF |
| 13% | chr6 | 34338198 | 34338038 | − | chr6 | 34309749 | 34309639 | − | ENST00000607016; ENST00000605528 | TSF |
| 12% | chr13 | 115049833 | 115049833 | + | chr13 | 115051777 | 115051875 | + | ENST00000375299 | TAF |
| 12% | chr4 | 166400036 | 166400127 | + | chr4 | 166403394 | 166403474; 166403511; 166403499 | + | ENST00000513982; ENST00000402744; ENST00000431967; ENST00000511992 | TAF |
| 12% | chr4 | 166400036 | 166400127 | + | chr4 | 166403394 | 166403474; 166403511; 166403499 | + | ENST00000513982; ENST00000402744; ENST00000431967; ENST00000511992 | TAF |
| 12% | chr4 | 166400036 | 166400127 | + | chr4 | 166403394 | 166403474; 166403511; | + | ENST00000513982; ENST00000402744; ENST00000431967; ENST00000511992 | TAF |

TABLE 24-continued

Transcript fusion for Glioblastoma Multiforme (GBM)
Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 12% | chr4 | 166400036 | 166400127 | + | chr4 | 166403394 | 166403499 166403474; 166403511; 166403499 | + | ENST00000513982; ENST00000402744; ENST00000431967; ENST00000511992 | TAF |
| 12% | chr11 | 85339945 | 85340247 | + | chr11 | 85342189 | 85342230 | + | ENST00000531718; ENST00000528361; ENST00000529197 | TAF |
| 12% | chr6 | 24710791 | 24710723 | − | chr6 | 24709139 | 24709005 | − | ENST00000378119; ENST00000540769; ENST00000378102 | TAF |
| 12% | chr1 | 183600359 | 183599874 | − | chr1 | 183599772 | 183599596 | − | ENST00000367534; ENST00000359856; ENST00000294742 | TAF |
| 12% | chr1 | 183600359 | 183599874 | − | chr1 | 183599772 | 183599596 | − | ENST00000367534; ENST00000359856; ENST00000294742 | TAF |
| 12% | chr7 | 130127044 | 130127065 | + | chr7 | 130135209 | 130135363 | + | ENST00000223215; ENST00000437945 | TAF |
| 12% | chr7 | 130127044 | 130127065 | + | chr7 | 130135209 | 130135363 | + | ENST00000223215; ENST00000437945 | TAF |
| 12% | chr7 | 2289080 | 2289115 | + | chr7 | 2289492 | 2289637 | + | ENST00000356714; ENST00000397049; ENST00000397046; ENST00000397048; ENST00000339737; ENST00000343985 | TAF |
| 12% | chr17 | 79214190 | 79214239 | + | chr17 | 79214787 | 79214816; 79214953 | + | ENST00000431388; ENST00000576002 | TAF |
| 12% | chr17 | 79214190 | 79214239 | + | chr17 | 79214787 | 79214816; 79214953 | + | ENST00000431388; ENST00000576002 | TAF |
| 12% | chr2 | 133363747 | 133363763 | + | chr2 | 133402674 | 133403179 | + | ENST00000329321 | TAF |
| 12% | chrX | 13804185 | 13804092 | − | chrX | 13803927 | 13803741 | − | ENST00000316715; ENST00000454189; ENST00000493677; ENST00000355135; ENST00000356942; ENST00000475307 | TAF |
| 12% | chrX | 13804185 | 13804092 | − | chrX | 13803927 | 13803741 | − | ENST00000316715; ENST00000454189; ENST00000493677; ENST00000355135; ENST00000356942; ENST00000475307 | TAF |
| 12% | chrX | 13804185 | 13804092 | − | chrX | 13803927 | 13803741 | − | ENST00000316715; ENST00000454189; ENST00000493677; ENST00000355135; ENST00000356942; ENST00000475307 | TAF |
| 12% | chr7 | 99761456 | 99761407 | − | chr7 | 99758582 | 99757551; 99758045 | − | ENST00000413800; ENST00000360039; ENST00000423751; ENST00000411994; ENST00000426974 | TAF |
| 12% | chr7 | 99761456 | 61499707 | − | chr7 | 99758582 | 99757551; 99758045 | − | ENST00000413800; ENST00000360039; ENST00000423751; ENST00000411994; ENST00000426974 | TAF |
| 12% | chr17 | 39976225 | 76339901 | + | chr17 | 39976521 | 39976713 | + | ENST00000321562; ENST00000455106; ENST00000544340 | TSF |
| 12% | chr17 | 39974832 | 39974893 | + | chr17 | 39975462 | 39975651 | + | ENST00000321562 | TSF |
| 12% | chr1 | 32262195 | 32262170 | − | chr1 | 32259836 | 32259725 | − | ENST00000257100; ENST00000360482; ENST00000452755; ENST00000533231; ENST00000528579 | TSF |
| 12% | chr1 | 32262195 | 32262170 | − | chr1 | 32259836 | 32259725 | − | ENST00000257100; ENST00000360482; ENST00000452755; ENST00000533231; ENST00000528579 | TSF |
| 12% | chr1 | 32262195 | 32262170 | − | chr1 | 32259836 | 32259725 | − | ENST00000257100; ENST00000360482; ENST00000452755; ENST00000533231; ENST00000528579 | TSF |
| 12% | chr20 | 25843181 | 25842039 | − | chr20 | 25755948 | 25755497; 25755659 | − | ENST00000376403; ENST00000584071 | TSF |
| 12% | chr20 | 25843181 | 25842039 | − | chr20 | 25755948 | 25755497; 25755659 | − | ENST00000376403; ENST00000584071 | TSF |
| 11% | chr6 | 21201067 | 21201123 | + | chr6 | 21201341 | 21201505 | + | ENST00000274695; ENST00000378624; ENST00000378610 | TAF |
| 11% | chr7 | 150730019 | 150730148 | + | chr7 | 150730692 | 150730929; 150731004; 150730700 | + | ENST00000461373; ENST00000358849; ENST00000489192; ENST00000297504; ENST00000356058; ENST00000498578; ENST00000477719; ENST00000477092 | TAF |
| 11% | chr7 | 150730019 | 150730148 | + | chr7 | 150730692 | 150730929; 150731004; 150730700 | + | ENST00000461373; ENST00000358849; ENST00000489192; ENST00000297504; ENST00000356058; ENST00000498578; ENST00000477719; ENST00000477092 | TAF |
| 11% | chr7 | 150019730 | 150730148 | + | chr7 | 150730692 | 150730929; 150731004; 150730700 | + | ENST00000461373; ENST00000358849; ENST00000489192; ENST00000297504; ENST00000356058; ENST00000498578; ENST00000477719; ENST00000477092 | TAF |
| 11% | chr7 | 150730019 | 150730148 | + | chr7 | 150730692 | 150730929; 150731004; 150730700 | + | ENST00000461373; ENST00000358849; ENST00000489192; ENST00000297504; ENST00000356058; ENST00000498578; ENST00000477719; ENST00000477092 | TAF |
| 11% | chr7 | 150730019 | 150730148 | + | chr7 | 150730692 | 150730929; 150731004; 150730700 | + | ENST00000461373; ENST00000358849; ENST00000489192; ENST00000297504; ENST00000356058; ENST00000498578; ENST00000477719; ENST00000477092 | TAF |

TABLE 24-continued

Transcript fusion for Glioblastoma Multiforme (GBM)
Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 11% | chr7 | 150730019 | 150730148 | + | chr7 | 150730692 | 150730929; 150731004; 150730700 | + | ENST00000461373; ENST00000358849; ENST00000489192; ENST00000297504; ENST00000356058; ENST00000498578; ENST00000477719; ENST00000477092 | TAF |
| 11% | chr7 | 150730019 | 150730148 | + | chr7 | 150730692 | 150730929; 150731004; 150730700 | + | ENST00000461373; ENST00000358849; ENST00000489192; ENST00000297504; ENST00000356058; ENST00000498578; ENST00000477719; ENST00000477092 | TAF |
| 11% | chr5 | 179238653 | 179238682 | + | chr5 | 179260032 | 179260246; 179260227 | + | ENST00000376929; ENST00000389805; ENST00000402874; ENST00000510187; ENST00000360718 | TAF |
| 11% | chr5 | 179238653 | 179238682 | + | chr5 | 179260032 | 179260246; 179260227 | + | ENST00000376929; ENST00000389805; ENST00000402874; ENST00000510187; ENST00000360718 | TAF |
| 11% | chr3 | 146238022 | 146237953 | − | chr3 | 146234954 | 146234793; 146234876; 146234936; 146234945 | − | ENST00000342435; ENST00000487389; ENST00000448787; ENST00000483300; ENST00000462666; ENST00000486631; ENST00000472349 | TAF |
| 11% | chr3 | 146238022 | 146237953 | − | chr3 | 146234954 | 146234793; 146234876; 146234936; 146234945 | − | ENST00000342435; ENST00000487389; ENST00000448787; ENST00000483300; ENST00000462666; ENST00000486631; ENST00000472349 | TAF |
| 11% | chr3 | 146238022 | 146237953 | − | chr3 | 146234954 | 146234793; 146234876; 146234936; 146234945 | − | ENST00000342435; ENST00000487389; ENST00000448787; ENST00000483300; ENST00000462666; ENST00000486631; ENST00000472349 | TAF |
| 11% | chr3 | 146238022 | 146237953 | − | chr3 | 146234954 | 146234793; 146234876; 146234936; 146234945 | − | ENST00000342435; ENST00000487389; ENST00000448787; ENST00000483300; ENST00000462666; ENST00000486631; ENST00000472349 | TAF |
| 11% | chr3 | 146238022 | 146237953 | − | chr3 | 146234954 | 146234793; 146234876; 146234936; 146234945 | − | ENST00000342435; ENST00000487389; ENST00000448787; ENST00000483300; ENST00000462666; ENST00000486631; ENST00000472349 | TAF |
| 11% | chr17 | 21476521 | 21476490 | − | chr17 | 21438799 | 21438561; 21438772 | − | ENST00000391411; ENST00000412778 | TAF |
| 11% | chr17 | 21476521 | 21476490 | − | chr17 | 21438799 | 21438561; 21438772 | − | ENST00000391411; ENST00000412778 | TAF |
| 11% | chr19 | 5976359 | 6275973 | − | chr19 | 5957984 | 5957929; 5957918 | − | ENST00000439268; ENST00000340578; ENST00000592771; ENST00000591092; ENST00000034275; ENST00000587159; ENST00000589353; ENST00000587463; ENST00000588010; ENST00000592133; ENST00000587263; ENST00000591333 | TAF |
| 11% | chr19 | 5976359 | 6275973 | − | chr19 | 5957984 | 5957929; 5957918 | − | ENST00000439268; ENST00000340578; ENST00000592771; ENST00000591092; ENST00000034275; ENST00000587159; ENST00000589353; ENST00000587463; ENST00000588010; ENST00000592133; ENST00000587263; ENST00000591333 | TAF |
| 11% | chr19 | 5976359 | 5976273 | − | chr19 | 5957984 | 5957929; 5957918 | − | ENST00000439268; ENST00000340578; ENST00000592771; ENST00000591092; ENST00000034275; ENST00000587159; ENST00000589353; ENST00000587463; ENST00000588010; ENST00000592133; ENST00000587263; ENST00000591333 | TAF |
| 11% | chr19 | 5976359 | 5976273 | − | chr19 | 5957984 | 5957929; 5957918 | − | ENST00000439268; ENST00000340578; ENST00000592771; ENST00000591092; ENST00000034275; ENST00000587159; ENST00000589353; ENST00000587463; ENST00000588010; ENST00000592133; ENST00000587263; ENST00000591333 | TAF |
| 11% | chr19 | 5976359 | 6275973 | − | chr19 | 5957984 | 5957929; 5957918 | − | ENST00000439268; ENST00000340578; ENST00000592771; ENST00000591092; ENST00000034275; ENST00000587159; ENST00000589353; ENST00000587463; ENST00000588010; ENST00000592133; ENST00000587263; ENST00000591333 | TAF |
| 11% | chr19 | 5976359 | 5976273 | − | chr19 | 5957984 | 5957929; 5957918 | − | ENST00000439268; ENST00000340578; ENST00000592771; ENST00000591092; ENST00000034275; ENST00000587159; ENST00000589353; ENST00000587463; ENST00000588010; ENST00000592133; ENST00000587263; ENST00000591333 | TAF |
| 11% | chr19 | 5976359 | 5976273 | − | chr19 | 5957984 | 5957929; | − | ENST00000439268; ENST00000340578; | TAF |

TABLE 24-continued

Transcript fusion for Glioblastoma Multiforme (GBM)
Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| | | | | | | | 5957918 | | ENST00000592771; ENST00000591092; ENST00000034275; ENST00000587159; ENST00000589353; ENST00000587463; ENST00000588010; ENST00000592133; ENST00000587263; ENST00000591333 | |
| 11% | chr19 | 5976359 | 5976273 | − | chr19 | 5957984 | 5957929; 5957918 | − | ENST00000439268; ENST00000340578; ENST00000592771; ENST00000591092; ENST00000034275; ENST00000587159; ENST00000589353; ENST00000587463; ENST00000588010; ENST00000592133; ENST00000587263; ENST00000591333 | TAF |
| 11% | chr19 | 5976359 | 5976273 | − | chr19 | 5957984 | 5957929; 5957918 | − | ENST00000439268; ENST00000340578; ENST00000592771; ENST00000591092; ENST00000034275; ENST00000587159; ENST00000589353; ENST00000587463; ENST00000588010; ENST00000592133; ENST00000587263; ENST00000591333 | TAF |
| 11% | chr19 | 5976359 | 5976273 | − | chr19 | 5957984 | 5957929; 5957918 | − | ENST00000439268; ENST00000340578; ENST00000592771; ENST00000591092; ENST00000034275; ENST00000587159; ENST00000589353; ENST00000587463; ENST00000588010; ENST00000592133; ENST00000587263; ENST00000591333 | TAF |
| 11% | chr19 | 5976359 | 5976273 | − | chr19 | 5957984 | 5957929; 5957918 | − | ENST00000439268; ENST00000340578; ENST00000592771; ENST00000591092; ENST00000034275; ENST00000587159; ENST00000589353; ENST00000587463; ENST00000588010; ENST00000592133; ENST00000587263; ENST00000591333 | TAF |
| 11% | chr19 | 5976359 | 5976273 | − | chr19 | 5957984 | 5957929; 5957918 | − | ENST00000439268; ENST00000340578; ENST00000592771; ENST00000591092; ENST00000034275; ENST00000587159; ENST00000589353; ENST00000587463; ENST00000588010; ENST00000592133; ENST00000587263; ENST00000591333 | TAF |
| 11% | chr22 | 21972574 | 21972670 | + | chr22 | 21975804 | 21975958 | + | ENST00000458578; ENST00000342192; ENST00000545681 | TSF |
| 11% | chr11 | 62651471 | 62651559 | + | chr11 | 62651929 | 62651997 | + | ENST00000377892; ENST00000377890; ENST00000377891; ENST00000377889; ENST00000535296; ENST00000338663 | TSF |
| 11% | chr11 | 47013185 | 47013198 | + | chr11 | 47073939 | 47074069 | + | ENST00000528488; ENST00000278460; ENST00000378618; ENST00000395460; ENST00000378615; ENST00000525895 | TSF |
| 11% | chr11 | 47013185 | 47013198 | + | chr11 | 47073939 | 47074069 | + | ENST00000528488; ENST00000278460; ENST00000378618; ENST00000395460; ENST00000378615; ENST00000525895 | TSF |
| 11% | chr11 | 47013185 | 13147098 | + | chr11 | 47073939 | 47074069 | + | ENST00000528488; ENST00000278460; ENST00000378618; ENST00000395460; ENST00000378615; ENST00000525895 | TSF |
| 11% | chr11 | 47013185 | 47013198 | + | chr11 | 47073939 | 47074069 | + | ENST00000528488; ENST00000278460; ENST00000378618; ENST00000395460; ENST00000378615; ENST00000525895 | TSF |
| 11% | chr11 | 47013185 | 47013198 | + | chr11 | 47073939 | 47074069 | + | ENST00000528488; ENST00000278460; ENST00000378618; ENST00000395460; ENST00000378615; ENST00000525895 | TSF |
| 11% | chr11 | 47013185 | 47013198 | + | chr11 | 47073939 | 47074069 | + | ENST00000528488; ENST00000278460; ENST00000378618; ENST00000395460; ENST00000378615; ENST00000525895 | TSF |
| 11% | chr20 | 25844836 | 25843696 | − | chr20 | 25755948 | 25755497; 25755659 | − | ENST00000376403; ENST00000584071 | TSF |
| 11% | chr20 | 25844836 | 25843696 | − | chr20 | 25755948 | 25755497; 25755659 | − | ENST00000376403; ENST00000584071 | TSF |
| 11% | chr2 | 99224680 | 99224660 | − | chr2 | 99220654 | 99220571 | − | ENST00000328709; ENST00000409997 | TSF |
| 11% | chr2 | 99224680 | 99224660 | − | chr2 | 99220654 | 99220571 | − | ENST00000328709; ENST00000409997 | TSF |
| 10% | chr7 | 73776149 | 73776406 | + | chr7 | 73778585 | 73778645 | + | ENST00000361545; ENST00000223398; ENST00000395060 | TAF |
| 10% | chr7 | 73776149 | 73776406 | + | chr7 | 73778585 | 73778645 | + | ENST00000361545; ENST00000223398; ENST00000395060 | TAF |
| 10% | chr4 | 47584885 | 47584978 | + | chr4 | 47589036 | 47589223 | + | ENST00000273859 | TAF |
| 10% | chr4 | 106355281 | 106355184 | − | chr4 | 106345479 | 106345353; 106345406 | − | ENST00000341695; ENST00000348706; ENST00000432483; ENST00000357415; ENST00000380004; ENST00000510015; ENST00000508518; ENST00000310267; ENST00000504028 | TAF |
| 10% | chr4 | 106355281 | 106355184 | − | chr4 | 106345479 | 106345353; | − | ENST00000341695; ENST00000348706; | TAF |

TABLE 24-continued

Transcript fusion for Glioblastoma Multiforme (GBM)
Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| | | | | | | | 106345406 | | ENST00000432483; ENST00000357415; ENST00000380004; ENST00000510015; ENST00000508518; ENST00000310267; ENST00000504028 | |
| 10% | chr4 | 106355281 | 106355184 | − | chr4 | 106345479 | 106345353; 106345406 | − | ENST00000341695; ENST00000348706; ENST00000432483; ENST00000357415; ENST00000380004; ENST00000510015; ENST00000508518; ENST00000310267; ENST00000504028 | TAF |
| 10% | chr4 | 106355281 | 106355184 | − | chr1 | 106345479 | 106345353; 106345406 | − | ENST00000341695; ENST00000348706; ENST00000432483; ENST00000357415; ENST00000380004; ENST00000510015; ENST00000508518; ENST00000310267; ENST00000504028 | TAF |
| 10% | chr4 | 106355281 | 106355184 | − | chr4 | 106345479 | 106345353; 106345406 | − | ENST00000341695; ENST00000348706; ENST00000432483; ENST00000357415; ENST00000380004; ENST00000510015; ENST00000508518; ENST00000310267; ENST00000504028 | TAF |
| 10% | chr1 | 40781678 | 40781517 | − | chr1 | 40781336 | 40781262 | − | ENST00000372748; ENST00000417105; ENST00000372736 | TAF |
| 10% | chr1 | 40781678 | 40781517 | − | chr1 | 40781336 | 40781262 | − | ENST00000372748; ENST00000417105; ENST00000372736 | TAF |
| 10% | chr1 | 40781678 | 40781517 | − | chr1 | 40781336 | 40781262 | − | ENST00000372748; ENST00000417105; ENST00000372736 | TAF |
| 10% | chr14 | 35035301 | 35035230 | − | chr14 | 35032381 | 35032328 | − | ENST00000396526; ENST00000396534; ENST00000362031; ENST00000355110 | TAF |
| 10% | chr14 | 69847661 | 69847502 | − | chr14 | 69847357 | 69847255 | − | ENST00000557016 | TAF |
| 10% | chr22 | 42083838 | 42083757 | − | chr22 | 42076368 | 42076248 | − | ENST00000355257; ENST00000215956; ENST00000401959; ENST00000402458 | TAF |
| 10% | chr14 | 52338594 | 52338741 | + | chr14 | 52344335 | 52344375 | + | ENST00000556522 | TSF |
| 10% | chr4 | 54932915 | 54932834 | − | chr4 | 54915472 | 54915418 | − | ENST00000263921; ENST00000512964; ENST00000510894 | TSF |
| 10% | chr4 | 54932915 | 54932834 | − | chr4 | 54915472 | 54915418 | − | ENST00000263921; ENST00000512964; ENST00000510894 | TSF |
| 10% | chr4 | 54932915 | 54932834 | − | chr4 | 154915472 | 54915418 | − | ENST00000263921; ENST00000512964; ENST00000510894 | TSF |
| 10% | chr20 | 25841506 | 25840376 | − | chr20 | 25755948 | 25755497; 25755659 | − | ENST00000376403; ENST00000584071 | TSF |
| 10% | chr20 | 25841506 | 258140376 | − | chr20 | 25755948 | 25755497; 25755659 | − | ENST00000376403; ENST00000584071 | TSF |
| 10% | chr11 | 15114123 | 15112973 | − | chr6 | 32497961 | 32497902 | − | ENST00000374975 | TSF |
| 9% | chr6 | 31941780 | 31941829 | + | chr6 | 31946680 | 87; 31946759 31946775; 319467 | + | ENST00000375331; ENST00000375333; ENST00000483801; ENST00000519179 | TSF |
| 9% | chr6 | 31941780 | 31941829 | + | chr6 | 31946680 | 31946775; 31946787; 31946759 | + | ENST00000375331; ENST00000375333; ENST00000483801; ENST00000519179 | TSF |
| 9% | chr6 | 31941780 | 31941829 | + | chr6 | 31946680 | 31946775; 31946787; 31946759 | + | ENST00000375331; ENST00000375333; ENST00000483801; ENST00000519179 | TSF |
| 9% | chr7 | 65819313 | 65819361 | + | chr7 | 65821812 | 65821829 | + | ENST00000304842 | TSF |
| 9% | chr7 | 56018506 | 56018522 | + | chr7 | 56020872 | 56021011 | + | ENST00000426595 | TSF |
| 9% | chr15 | 74004214 | 74004264 | + | chr15 | 74005275 | 74005297 | + | ENST00000318443; ENST00000537340; ENST00000318424; ENST00000564751; ENST00000561176; ENST00000559073 | TSF |
| 9% | chr12 | 58023123 | 58023062 | − | chr12 | 58022929 | 58022831; 58022905 | − | ENST00000341156; ENST00000418555; ENST00000552798; ENST00000549391 | TSF |
| 9% | chr12 | 58023123 | 58023062 | − | chr12 | 58022929 | 58022831; 58022905 | − | ENST00000341156; ENST00000418555; ENST00000552798; ENST00000549391 | TSF |
| 8% | chr19 | 54944914 | 54945078 | + | chr19 | 54946722 | 54946864 | + | ENST00000301194; ENST00000376530; ENST00000391739; ENST00000376531 | TSF |
| 8% | chr19 | 54944914 | 54945078 | + | chr19 | 54946722 | 54946864 | + | ENST00000301194; ENST00000376530; ENST00000391739; ENST00000376531 | TSF |
| 8% | chr19 | 54944914 | 54945078 | + | chr19 | 54946722 | 54946864 | + | ENST00000301194; ENST00000376530; ENST00000391739; ENST00000376531 | TSF |
| 8% | chr19 | 54944914 | 54945078 | + | chr19 | 54946722 | 54946864 | + | ENST00000301194; ENST00000376530; ENST00000391739; ENST00000376531 | TSF |
| 8% | chr17 | 40813111 | 13240845 | + | chr17 | 40815395 | 40815521 | + | ENST00000251412 | TSF |
| 8% | chr6 | 123101055 | 101123091 | + | chr6 | 123101436 | 123101608 | + | ENST00000368444; ENST00000356535 | TSF |
| 8% | chr6 | 123101055 | 123101091 | + | chr6 | 123101436 | 123101608 | + | ENST00000368444; ENST00000356535 | TSF |
| 8% | chr16 | 70714570 | 70714506 | − | chr16 | 70713958 | 70713874 | − | ENST00000338779 | TSF |
| 8% | chr8 | 82194688 | 82194723 | + | chr8 | 82195601 | 82195773 | + | ENST00000297258 | TSF |
| 8% | chr17 | 73847069 | 73847024 | − | chr17 | 73845820 | 73845685 | − | ENST00000254806; ENST00000585462; ENST00000591399; ENST00000591831; ENST00000590221; ENST00000344296; | TSF |

TABLE 24-continued

Transcript fusion for Glioblastoma Multiforme (GBM)
Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| | 8% | chr17 | 73847069 | 73847024 | − | chr17 | 73845820 | 73845685 | − | ENST00000433525; ENST00000593002 ENST00000254806; ENST00000585462; ENST00000591399; ENST00000591831; ENST00000590221; ENST00000344296; | TSF |
| | 8% | chr17 | 73847069 | 173847024 | − | chr17 | 73845820 | 73845685 | − | ENST00000433525; ENST00000593002 ENST00000254806; ENST00000585462; ENST00000591399; ENST00000591831; ENST00000590221; ENST00000344296; | TSF |
| | 8% | chr17 | 73847069 | 73847024 | − | chr17 | 73845820 | 73845685 | − | ENST00000433525; ENST00000593002 ENST00000254806; ENST00000585462; ENST00000591399; ENST00000591831; ENST00000590221; ENST00000344296; | TSF |
| | 8% | chr17 | 73847069 | 73847024 | − | chr17 | 73845820 | 73845685 | − | ENST00000433525; ENST00000593002 ENST00000254806; ENST00000585462; ENST00000591399; ENST00000591831; ENST00000590221; ENST00000344296; | TSF |
| | 8% | chr17 | 42991959 | 91942941 | − | chr17 | 42991456 | 42991396 | − | ENST00000253408; ENST00000435360; ENST00000586793; ENST00000592320; ENST00000588316; ENST00000588037 | TSF |
| | 8% | chr17 | 42991959 | 91942941 | − | chr17 | 42991456 | 42991396 | − | ENST00000253408; ENST00000435360; ENST00000586793; ENST00000592320; ENST00000588316; ENST00000588037 | TSF |
| | 8% | chr17 | 42991959 | 91942941 | − | chr17 | 42991456 | 42991396 | − | ENST00000253408; ENST00000435360; ENST00000586793; ENST00000592320; ENST00000588316; ENST00000588037 | TSF |
| | 8% | chr17 | 42991959 | 91942941 | − | chr17 | 42991456 | 42991396 | − | ENST00000253408; ENST00000435360; ENST00000586793; ENST00000592320; ENST00000588316; ENST00000588037 | TSF |
| | 8% | chr17 | 42991959 | 42991941 | − | chr17 | 42991456 | 42991396 | − | ENST00000253408; ENST00000435360; ENST00000586793; ENST00000592320; ENST00000588316; ENST00000588037 | TSF |
| | 8% | chr17 | 42991959 | 42991941 | − | chr17 | 42991456 | 42991396 | − | ENST00000253408; ENST00000435360; ENST00000586793; ENST00000592320; ENST00000588316; ENST00000588037 | TSF |
| | 8% | chr5 | 150155913 | 150155583 | − | chr5 | 150136049 | 150135979 | − | ENST00000447998; ENST00000446090; ENST00000521448; ENST00000517421 | TSF |
| | 8% | chr5 | 150155913 | 150155583 | − | chr5 | 150136049 | 150135979 | − | ENST00000447998; ENST00000446090; ENST00000521448; ENST00000517421 | TSF |
| | 8% | chr5 | 150155913 | 150155583 | − | chr5 | 150136049 | 150135979 | − | ENST00000447998; ENST00000446090; ENST00000521448; ENST00000517421 | TSF |
| | 7% | chr11 | 60694460 | 94560642 | + | chr11 | 60694676 | 60694890 | + | ENST00000453848; ENST00000005286 | TSF |
| | 7% | chr11 | 60694460 | 94560642 | + | chr11 | 60694676 | 60694890 | + | ENST00000453848; ENST00000005286 | TSF |
| | 7% | chr19 | 19353662 | 19353712 | + | chr19 | 19356122 | 19356266 | + | ENST00000252575; ENST00000538881; ENST00000588231 | TSF |
| | 7% | chr19 | 19353662 | 53719312 | + | chr19 | 19356122 | 19356266 | + | ENST00000252575; ENST00000538881; ENST00000588231 | TSF |
| | 7% | chr20 | 45138455 | 38245144 | − | chr20 | 45133379 | 45133253 | − | ENST00000593880; ENST00000347606 | TSF |
| | 7% | chr20 | 45138455 | 38245144 | − | chr20 | 45133379 | 45133253 | − | ENST00000593880; ENST00000347606 | TSF |
| | 7% | chr4 | 5830600 | 5830583 | − | chr4 | 5830395 | 5830216 | − | ENST00000324989; ENST00000397890; ENST00000512574 | TSF |
| | 6% | chr7 | 149537664 | 537696149 | + | chr7 | 149541714 | 149541825 | + | ENST00000223210 | TSF |
| | 6% | chr7 | 121663316 | 121441663 | + | chr7 | 121668606 | 121668697 | + | ENST00000393386; ENST00000449182 | TSF |
| | 6% | chr7 | 121663316 | 121441663 | + | chr7 | 121668606 | 121668697 | + | ENST00000393386; ENST00000449182 | TSF |
| | 6% | chr4 | 5869106 | 5868912 | − | chr4 | 5868483 | 5868395 | − | ENST00000324989; ENST00000397890; ENST00000512574 | TSF |
| | 6% | chr5 | 150159175 | 150159192 | + | chr5 | 150174992 | 150174996 | + | ENST00000600109 | TSF |
| | 6% | chr7 | 56037040 | 56037358 | + | chr7 | 56045819 | 56045958 | + | ENST00000322090; ENST00000446778; ENST00000456204 | TSF |
| | 6% | chr7 | 56037040 | 56037358 | + | chr7 | 56045819 | 56045958 | + | ENST00000322090; ENST00000446778; ENST00000456204 | TSF |
| | 6% | chr7 | 56037040 | 56037358 | + | chr7 | 56045819 | 56045958 | + | ENST00000322090; ENST00000446778; ENST00000456204 | TSF |
| | 6% | chr8 | 6585268 | 6585281 | + | chr8 | 6588232 | 6588347; 6588279 | + | ENST00000285518; ENST00000523234 | TSF |
| | 6% | chr8 | 6585268 | 6585281 | + | chr8 | 6588232 | 6588347; 6588279 | + | ENST00000285518; ENST00000523234 | TSF |
| | 6% | chr19 | 18991807 | 18991757 | − | chr19 | 18991244 | 18991083 | − | ENST00000427170; ENST00000429504; ENST00000542296; ENST00000596048 | TSF |
| | 6% | chr19 | 18991807 | 18991757 | − | chr19 | 18991244 | 18991083 | − | ENST00000427170; ENST00000429504; ENST00000542296; ENST00000596048 | TSF |
| | 6% | chr19 | 18991807 | 18991757 | − | chr19 | 18991244 | 18991083 | − | ENST00000427170; ENST00000429504; ENST00000542296; ENST00000596048 | TSF |
| | 6% | chr3 | 139244518 | 139244462 | − | chr3 | 139237364 | 139237263 | − | ENST00000232219 | TSF |

TABLE 24-continued

Transcript fusion for Glioblastoma Multiforme (GBM)
Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 6% | chr12 | 58023123 | 58023062 | − | chr12 | 58022686 | 58022496; 58022484 | − | ENST00000341156; ENST00000418555; ENST00000449184 | TSF |
| 6% | chr12 | 58023123 | 58023062 | − | chr12 | 58022686 | 58022496; 58022484 | − | ENST00000341156; ENST00000418555; ENST00000449184 | TSF |
| 6% | chr8 | 82357757 | 82357691 | − | chr8 | 82357224 | 82357052 | − | ENST00000256103 | TSF |
| 6% | chr14 | 92586341 | 86292520 | − | chr14 | 92583986 | 92583842 | − | ENST00000329559 | TSF |
| 6% | chr7 | 102208027 | 102207972 | − | chr7 | 102207530 | 102207498; 102207444; 102207440 | − | ENST00000379340; ENST00000486319; ENST00000508848; ENST00000513506; ENST00000514917; ENST00000507355; ENST00000608621; ENST00000511313 | TSF |
| 6% | chr7 | 102208027 | 102207972 | − | chr7 | 102207530 | 102207498; 102207444; 102207440 | − | ENST00000379340; ENST00000486319; ENST00000508848; ENST00000513506; ENST00000514917; ENST00000507355; ENST00000608621; ENST00000511313 | TSF |
| 6% | chr7 | 102208027 | 102207972 | − | chr7 | 102207530 | 102207444; 102207498; 102207440 | − | ENST00000379340; ENST00000486319; ENST00000508848; ENST00000513506; ENST00000514917; ENST00000507355; ENST00000608621; ENST00000511313 | TSF |
| 6% | chr7 | 102208027 | 102207972 | − | chr7 | 102207530 | 102207498; 102207444; 102207440 | − | ENST00000379340; ENST00000486319; ENST00000508848; ENST00000513506; ENST00000514917; ENST00000507355; ENST00000608621; ENST00000511313 | TSF |
| 6% | chr7 | 102208027 | 102207972 | − | chr7 | 102207530 | 102207498; 102207444; 102207440 | − | ENST00000379340; ENST00000486319; ENST00000508848; ENST00000513506; ENST00000514917; ENST00000507355; ENST00000608621; ENST00000511313 | TSF |
| 6% | chr7 | 102208027 | 102207972 | − | chr7 | 102207530 | 102207498; 102207444; 102207440 | − | ENST00000379340; ENST00000486319; ENST00000508848; ENST00000513506; ENST00000514917; ENST00000507355; ENST00000608621; ENST00000511313 | TSF |
| 5% | chr7 | 73816114 | 73816214 | + | chr7 | 73818167 | 173818178 | + | ENST00000361545; ENST00000223398; ENST00000395060; ENST00000487447 | TSF |
| 5% | chr19 | 11469032 | 11469050 | + | chr19 | 11470208 | 11470396; 11470395 | + | ENST00000251473; ENST00000591329 | TSF |
| 5% | chr19 | 11469032 | 11469050 | + | chr19 | 11470208 | 11470396; 11470395 | + | ENST00000251473; ENST00000591329 | TSF |
| 5% | chr3 | 134857832 | 134857845 | + | chr3 | 134872994 | 134873118 | + | ENST00000398015 | TSF |
| 5% | chr2 | 216976986 | 216977153 | + | chr2 | 216977739 | 216977852 | + | ENST00000392133; ENST00000392132 | TSF |
| 5% | chr8 | 9629642 | 9939623 | + | chr8 | 9634160 | 9634246 | + | ENST00000310430; ENST00000518281 | TSF |
| 5% | chr2 | 138746163 | 138746213 | + | chr2 | 138758488 | 138758595 | + | ENST00000410115; ENST00000280097 | TSF |
| 5% | chr19 | 10471727 | 10471638 | − | chr19 | 10469978 | 10469851 | − | ENST00000264818; ENST00000524462; ENST00000525621; ENST00000529370 | TSF |
| 5% | chr19 | 10471727 | 10471638 | − | chr19 | 10469978 | 10469851 | − | ENST00000264818; ENST00000524462; ENST00000525621; ENST00000529370 | TSF |
| 5% | chr21 | 34624467 | 34624553 | + | chr21 | 34624967 | 34625135 | + | ENST00000382264; ENST00000382241; ENST00000404220; ENST00000342136; ENST00000342101; ENST00000413881; ENST00000443073; ENST00000433395; ENST00000432231 | TSF |
| 5% | chr21 | 34624467 | 34624553 | + | chr21 | 34624967 | 34625135 | + | ENST00000382264; ENST00000382241; ENST00000404220; ENST00000342136; ENST00000342101; ENST00000413881; ENST00000443073; ENST00000433395; ENST00000432231 | TSF |
| 5% | chr21 | 34624467 | 34624553 | + | chr21 | 34624967 | 34625135 | + | ENST00000382264; ENST00000382241; ENST00000404220; ENST00000342136; ENST00000342101; ENST00000413881; ENST00000443073; ENST00000433395; ENST00000432231 | TSF |
| 5% | chr21 | 34624467 | 34624553 | + | chr21 | 34624967 | 34625135 | + | ENST00000382264; ENST00000382241; ENST00000404220; ENST00000342136; ENST00000342101; ENST00000413881; ENST00000443073; ENST00000433395; ENST00000432231 | TSF |
| 5% | chr21 | 34624467 | 34624553 | + | chr21 | 34624967 | 34625135 | + | ENST00000382264; ENST00000382241; ENST00000404220; ENST00000342136; ENST00000342101; ENST00000413881; ENST00000443073; ENST00000433395; ENST00000432231 | TSF |
| 5% | chr21 | 34624467 | 24534653 | + | chr21 | 34624967 | 34625135 | + | ENST00000382264; ENST00000382241; ENST00000404220; ENST00000342136; ENST00000342101; ENST00000413881; ENST00000443073; ENST00000433395; ENST00000432231 | TSF |
| 5% | chr18 | 9805890 | 9805956 | + | chr18 | 9814017 | 9814088 | + | ENST00000578921 | TSF |

TABLE 24-continued

Transcript fusion for Glioblastoma Multiforme (GBM)
Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| | 5% | chr19 | 17384225 | 17384260 | + | chr19 | 17384713 | 17384833; 17384754; 17384789 | + | ENST00000598188; ENST00000594247; ENST00000359435; ENST00000596542; ENST00000599474; ENST00000599057; ENST00000447614; ENST00000601043; ENST00000596335; ENST00000601436; ENST00000601938; ENST00000602066; ENST00000598567 | TSF |
| | 5% | chr19 | 17384225 | 17384260 | + | chr19 | 17384713 | 17384833; 17384754; 17384789 | + | ENST00000598188; ENST00000594247; ENST00000359435; ENST00000596542; ENST00000599474; ENST00000599057; ENST00000447614; ENST00000601043; ENST00000596335; ENST00000601436; ENST00000601938; ENST00000602066; ENST00000598567 | TSF |
| | 5% | chr19 | 17384225 | 17384260 | + | chr19 | 17384713 | 17384833; 17384754; 17384789 | + | ENST00000598188; ENST00000594247; ENST00000359435; ENST00000596542; ENST00000599474; ENST00000599057; ENST00000447614; ENST00000601043; ENST00000596335; ENST00000601436; ENST00000601938; ENST00000602066; ENST00000598567 | TSF |
| | 5% | chr19 | 17384225 | 17384260 | + | chr19 | 17384713 | 17384833; 17384754; 17384789 | + | ENST00000598188; ENST00000594247; ENST00000359435; ENST00000596542; ENST00000599474; ENST00000599057; ENST00000447614; ENST00000601043; ENST00000596335; ENST00000601436; ENST00000601938; ENST00000602066; ENST00000598567 | TSF |
| | 5% | chr19 | 17384225 | 17384260 | + | chr19 | 17384713 | 17384833; 17384754; 17384789 | + | ENST00000598188; ENST00000594247; ENST00000359435; ENST00000596542; ENST00000599474; ENST00000599057; ENST00000447614; ENST00000601043; ENST00000596335; ENST00000601436; ENST00000601938; ENST00000602066; ENST00000598567 | TSF |
| | 5% | chr19 | 17384225 | 17384260 | + | chr19 | 17384713 | 17384833; 17384754; 17384789 | + | ENST00000598188; ENST00000594247; ENST00000359435; ENST00000596542; ENST00000599474; ENST00000599057; ENST00000447614; ENST00000601043; ENST00000596335; ENST00000601436; ENST00000601938; ENST00000602066; ENST00000598567 | TSF |
| | 5% | chr19 | 17384225 | 17384260 | + | chr19 | 17384713 | 17384833; 17384754; 17384789 | + | ENST00000598188; ENST00000594247; ENST00000359435; ENST00000596542; ENST00000599474; ENST00000599057; ENST00000447614; ENST00000601043; ENST00000596335; ENST00000601436; ENST00000601938; ENST00000602066; ENST00000598567 | TSF |
| | 5% | chr19 | 17384225 | 17384260 | + | chr19 | 17384713 | 17384833; 17384754; 17384789 | + | ENST00000598188; ENST00000594247; ENST00000359435; ENST00000596542; ENST00000599474; ENST00000599057; ENST00000447614; ENST00000601043; ENST00000596335; ENST00000601436; ENST00000601938; ENST00000602066; ENST00000598567 | TSF |
| | 5% | chr19 | 17384225 | 17384260 | + | chr19 | 17384713 | 17384833; 17384754; 17384789 | + | ENST00000598188; ENST00000594247; ENST00000359435; ENST00000596542; ENST00000599474; ENST00000599057; ENST00000447614; ENST00000601043; ENST00000596335; ENST00000601436; ENST00000601938; ENST00000602066; ENST00000598567 | TSF |
| | 5% | chr19 | 17384225 | 17384260 | + | chr19 | 17384713 | 17384833; 17384754; 17384789 | + | ENST00000598188; ENST00000594247; ENST00000359435; ENST00000596542; ENST00000599474; ENST00000599057; ENST00000447614; ENST00000601043; ENST00000596335; ENST00000601436; ENST00000601938; ENST00000602066; ENST00000598567 | TSF |
| | 5% | chr19 | 17384225 | 17384260 | + | chr19 | 17384713 | 17384833; 17384754; 17384789 | + | ENST00000598188; ENST00000594247; ENST00000359435; ENST00000596542; ENST00000599474; ENST00000599057; ENST00000447614; ENST00000601043; ENST00000596335; ENST00000601436; | TSF |

TABLE 24-continued

Transcript fusion for Glioblastoma Multiforme (GBM)
Coordinates of the fusion sequences for which the donor is the TE.

| 1 | 2' | 3' | 4' | 5' | 6' | 7' | 8' | 9' | 10' | 11' |
|---|----|----|----|----|----|----|----|----|-----|-----|
|   |    |    |    |    |    |    |    |    | ENST00000601938; ENST00000602066; ENST00000598567 |   |
| 5% | chr9 | 35846065 | 35846070 | + | chr9 | 35846255 | 35846378 | + | ENST00000377996; ENST00000439587; ENST00000377991; ENST00000377988 | TSF |
| 5% | chr9 | 35846065 | 35846070 | + | chr9 | 35846255 | 35846378 | + | ENST00000377996; ENST00000439587; ENST00000377991; ENST00000377988 | TSF |
| 5% | chr17 | 42149044 | 42149179 | + | chr17 | 42151528 | 42151634; 42151597 | + | ENST00000269097; ENST00000591696 | TSF |
| 5% | chr17 | 42149044 | 42149179 | + | chr17 | 42151528 | 42151634; 42151597 | + | ENST00000269097; ENST00000591696 | TSF |
| 5% | chrX | 43703705 | 43703702 | − | chrX | 43703010 | 43702916 | − | ENST00000378069 | TSF |
| 5% | chr7 | 14309025 | 14308524 | − | chr7 | 14217776 | 14217656 | − | ENST00000258767; ENST00000399322; ENST00000403951; ENST00000402815; ENST00000407950; ENST00000444700; ENST00000406247 | TSF |
| 5% | chr7 | 14309025 | 14308524 | − | chr7 | 14217776 | 14217656 | − | ENST00000258767; ENST00000399322; ENST00000403951; ENST00000402815; ENST00000407950; ENST00000444700; ENST00000406247 | TSF |
| 5% | chr7 | 102307107 | 102307052 | − | chr7 | 102306610 | 102306578; 102306524 | − | ENST00000591000; ENST00000476151; ENST00000333432 | TSF |
| 5% | chr7 | 102307107 | 102307052 | − | chr7 | 102306610 | 102306578; 102306524 | − | ENST00000591000; ENST00000476151; ENST00000333432 | TSF |
| 5% | chr12 | 6602868 | 6602754 | − | chr12 | 6602138 | 6602028 | − | ENST00000229238 | TSF |
| 5% | chr9 | 132580720 | 132580632 | − | chr9 | 132576501 | 132576251 | − | ENST00000351698 | TSF |
| 5% | chr2 | 101024262 | 101024223 |   | chr2 | 101023169 | 101023038 | − | ENST00000542617; ENST00000448989 | TSF |
| 5% | chr2 | 101024262 | 101024223 | − | chr2 | 101023169 | 101023038 | − | ENST00000542617; ENST00000448989 | TSF |
| 5% | chr8 | 130855946 | 130855855 | − | chr8 | 130854451 | 130854388 | − | ENST00000519824; ENST00000522746; ENST00000523509; ENST00000401979; ENST00000519110; ENST00000522250; ENST00000517654; ENST00000519540; ENST00000522941 | TSF |
| 5% | chr1 | 212862111 | 212861639 | − | chr1 | 212860321 | 212860133 | − | ENST00000243440 | TSF |
| 5% | chr1 | 32264516 | 32264490 | − | chr1 | 32264202 | 32264043; 32264174 | − | ENST00000257100; ENST00000373648; ENST00000360482; ENST00000452755; ENST00000533231; ENST00000528579 | TSF |
| 5% | chr1 | 32264516 | 32264490 |   | chr1 | 32264202 | 32264043; 32264174 | − | ENST00000257100; ENST00000373648; ENST00000360482; ENST00000452755; ENST00000533231; ENST00000528579 | TSF |
| 5% | chr1 | 32264516 | 32264490 | − | chr1 | 32264202 | 32264043; 32264174 | − | ENST00000257100; ENST00000373648; ENST00000360482; ENST00000452755; ENST00000533231; ENST00000528579 | TSF |
| 5% | chr1 | 32264516 | 32264490 | − | chr1 | 32264202 | 32264043; 32264174 | − | ENST00000257100; ENST00000373648; ENST00000360482; ENST00000452755; ENST00000533231; ENST00000528579 | TSF |
| 5% | chr1 | 32264516 | 32264490 | − | chr1 | 32264202 | 32264043; 32264174 | − | ENST00000257100; ENST00000373648; ENST00000360482; ENST00000452755; ENST00000533231; ENST00000528579 | TSF |
| 5% | chr14 | 67862610 | 67862594 | − | chr14 | 67862300 | 67862119 | − | ENST00000216446; ENST00000555803; ENST00000554395 | TSF |
| 5% | chr14 | 67862610 | 67862594 | − | chr14 | 67862300 | 67862119 | − | ENST00000216446; ENST00000555803; ENST00000554395 | TSF |
| 5% | chr14 | 67862610 | 67862594 | − | chr14 | 678162300 | 67862119 | − | ENST00000216446; ENST00000555803; ENST00000554395 | TSF |
| 5% | chr7 | 76957485 | 76957483 | − | chr7 | 76955590 | 76955529 | − | ENST00000257626; ENST00000415112 | TSF |
| 5% | chr7 | 76957485 | 76957483 | − | chr7 | 76955590 | 76955529 | − | ENST00000257626; ENST00000415112 | TSF |
| 4% | chr6 | 13616316 | 13616338 | + | chr6 | 13616695 | 13616753 | + | ENST00000451315; ENST00000420088 | TSF |
| 4% | chr6 | 13616316 | 13616338 | + | chr6 | 13616695 | 13616753 | + | ENST00000451315; ENST00000420088 | TSF |
| 4% | chr8 | 136621237 | 136621239 | + | chr8 | 136657302 | 136657360; 136657310 | + | ENST00000355849; ENST00000520981; ENST00000517859; ENST00000521461 | TSF |
| 4% | chr8 | 136621237 | 136621239 | + | chr8 | 136657302 | 136657360; 136657310 | + | ENST00000355849; ENST00000520981; ENST00000517859; ENST00000521461 | TSF |
| 4% | chr19 | 13183453 | 13183471 | + | chr19 | 13183861 | 13183923 | + | ENST00000397661; ENST00000592199; ENST00000585382; ENST00000587F760; ENST00000585575; ENST00000360105; ENST00000588228; ENST00000587260; ENST00000358552 | TSF |
| 4% | chr19 | 13183453 | 13183471 | + | chr19 | 13183861 | 13183923 | + | ENST00000397661; ENST00000592199; ENST00000585382; ENST00000587760; ENST00000585575; ENST00000360105; ENST00000588228; ENST00000587260; ENST00000358552 | TSF |
| 4% | chr19 | 13183453 | 83413171 | + | chr19 | 13183861 | 13183923 | + | ENST00000397661; ENST00000592199; ENST00000585382; ENST00000587760; ENST00000585575; ENST00000360105; | TSF |

TABLE 24-continued

Transcript fusion for Glioblastoma Multiforme (GBM)
Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 4% | chr19 | 13183453 | 13183471 | + | chr19 | 13183861 | 13183923 | + | ENST00000588228; ENST00000587260; ENST00000358552 ENST00000397661; ENST00000592199; ENST00000585382; ENST00000587760; ENST00000585575; ENST00000360105; | TSF |
| 4% | chr19 | 13183453 | 13183471 | + | chr19 | 13183861 | 13183923 | + | ENST00000588228; ENST00000587260; ENST00000358552 ENST00000397661; ENST00000592199; ENST00000585382; ENST00000587760; ENST00000585575; ENST00000360105; | TSF |
| 4% | chr2 | 65243329 | 65243368 | + | chr2 | 65243574 | 65243807 | + | ENST00000234256 | |
| 4% | chr8 | 23131391 | 31523113 | + | chr8 | 231460 | 23146146 | | ENST00000411463 | TSF |
| 4% | chr7 | 56020443 | 56020509 | + | chr7 | 56020872 | 56021011 | + | ENST00000426595 | TSF |
| 4% | chr3 | 38538147 | 38538420 | + | chr3 | 38539120 | 38539175; 38539269 | + | ENST00000436414; ENST00000287675; ENST00000431472; ENST00000454803; ENST00000457367; ENST00000453767; ENST00000450732 | TSF |
| 4% | chr3 | 38538147 | 38438520 | + | chr3 | 38539120 | 38539175; 38539269 | + | ENST00000436414; ENST00000287675; ENST00000431472; ENST00000454803; ENST00000457367; ENST00000453767; ENST00000450732 | TSF |
| 4% | chr3 | 38538147 | 38438520 | + | chr3 | 38539120 | 38539175; 38539269 | + | ENST00000436414; ENST00000287675; ENST00000431472; ENST00000454803; ENST00000457367; ENST00000453767; ENST00000450732 | TSF |
| 4% | chr3 | 38538147 | 38438520 | + | chr3 | 38539120 | 38539175; 38539269 | + | ENST00000436414; ENST00000287675; ENST00000431472; ENST00000454803; ENST00000457367; ENST00000453767; ENST00000450732 | TSF |
| 4% | chr3 | 38538147 | 38438520 | + | chr3 | 38539120 | 38539175; 38539269 | + | ENST00000436414; ENST00000287675; ENST00000431472; ENST00000454803; ENST00000457367; ENST00000453767; ENST00000450732 | TSF |
| 4% | chr3 | 38538147 | 38438520 | + | chr3 | 38539120 | 38539175; 38539269 | + | ENST00000436414; ENST00000287675; ENST00000431472; ENST00000454803; ENST00000457367; ENST00000453767; ENST00000450732 | TSF |
| 4% | chr3 | 150344095 | 150344146 | + | chr3 | 150344797 | 150344921 | + | ENST00000480740; ENST00000471696; ENST00000477889; ENST00000485923 | TSF |
| 4% | chr12 | 58344612 | 58344667 | + | chr12 | 58345541 | 58345678; 58345560 | + | ENST00000300145; ENST00000549257 | TSF |
| 4% | chr12 | 58344612 | 58344667 | + | chr12 | 58345541 | 58345678; 58345560 | + | ENST00000300145; ENST00000549257 | TSF |
| 4% | chr16 | 66461229 | 66461334 | + | chr16 | 66503505 | 66503768 | + | ENST00000536005 | TSF |
| 4% | chr12 | 69217149 | 69217294 | + | chr12 | 69218143 | 69218210; 69218173; 69218169 | + | ENST00000462284; ENST00000311420; ENST00000539479; ENST00000393415; ENST00000393416; ENST00000350057; ENST00000481186; ENST00000496959; ENST00000536089; ENST00000537182; ENST00000540352; ENST00000546048 | TSF |
| 4% | chr12 | 69217149 | 69217294 | + | chr12 | 69218143 | 69218210; 69218173; 69218169 | + | ENST00000462284; ENST00000311420; ENST00000539479; ENST00000393415; ENST00000393416; ENST00000350057; ENST00000481186; ENST00000496959; ENST00000536089; ENST00000537182; ENST00000540352; ENST00000546048 | TSF |
| 4% | chr12 | 69217149 | 69217294 | + | chr12 | 69218143 | 69218210; 69218173; 69218169 | + | ENST00000462284; ENST00000311420; ENST00000539479; ENST00000393415; ENST00000393416; ENST00000350057; ENST00000481186; ENST00000496959; ENST00000536089; ENST00000537182; ENST00000540352; ENST00000546048 | TSF |
| 4% | chr12 | 69217149 | 69217294 | + | chr12 | 69218143 | 69218210; 69218173; 69218169 | + | ENST00000462284; ENST00000311420; ENST00000539479; ENST00000393415; ENST00000393416; ENST00000350057; ENST00000481186; ENST00000496959; ENST00000536089; ENST00000537182; ENST00000540352; ENST00000546048 | TSF |
| 4% | chr12 | 69217149 | 69217294 | + | chr12 | 69218143 | 69218169 69218210; 69218173; | + | ENST00000462284; ENST00000311420; ENST00000539479; ENST00000393415; ENST00000393416; ENST00000350057; ENST00000481186; ENST00000496959; ENST00000536089; ENST00000537182; | TSF |

TABLE 24-continued

Transcript fusion for Glioblastoma Multiforme (GBM)
Coordinates of the fusion sequences for which the donor is the TE.

| 1 | 2' | 3' | 4' | 5' 6' | 7' | 8' | 9' | 10' | 11' |
|---|----|----|----|-------|----|----|----|-----|-----|
| | 4% | chr12 | 69217149 | 69217294 | + chr12 | 69218143 | 69218210; 69218173; 69218169 | + | ENST00000540352; ENST00000546048 ENST00000462284; ENST00000311420; ENST00000539479; ENST00000393415; ENST00000393416; ENST00000350057; ENST00000481186; ENST00000496959; ENST00000536089; ENST00000537182; | TSF |
| | 4% | chr12 | 69217149 | 69217294 | + chr12 | 69218143 | 69218210; 69218173; 69218169 | + | ENST00000540352; ENST00000546048 ENST00000462284; ENST00000311420; ENST00000539479; ENST00000393415; ENST00000393416; ENST00000350057; ENST00000481186; ENST00000496959; ENST00000536089; ENST00000537182; | TSF |
| | 4% | chr17 | 40985441 | 40985522 | + chr17 | 40986361 | 40986393 | + | ENST00000540352; ENST00000546048 ENST00000590720; ENST00000441946; ENST00000589469; ENST00000543428; ENST00000293362; ENST00000592169 | TSF |
| | 4% | chr17 | 40985441 | 85540922 | + chr17 | 40986361 | 40986393 | + | ENST00000590720; ENST00000441946; ENST00000589469; ENST00000543428; ENST00000293362; ENST00000592169 | TSF |
| | 4% | chr17 | 40985441 | 40985522 | + chr17 | 40986361 | 40986393 | + | ENST00000590720; ENST00000441946; ENST00000589469; ENST00000543428; ENST00000293362; ENST00000592169 | TSF |
| | 4% | chr17 | 40985441 | 40985522 | + chr17 | 40986361 | 40986393 | + | ENST00000590720; ENST00000441946; ENST00000589469; ENST00000543428; ENST00000293362; ENST00000592169 | TSF |
| | 4% | chr17 | 40985441 | 40985522 | + chr17 | 40986361 | 40986393 | + | ENST00000590720; ENST00000441946; ENST00000589469; ENST00000543428; ENST00000293362; ENST00000592169 | TSF |
| | 4% | chr16 | 47350611 | 47350483 | − chr16 | 47347734 | 47347640 | − | ENST00000320640; ENST00000544001 | TSF |
| | 4% | chr16 | 47350611 | 47350483 | − chr16 | 47347734 | 47347640 | − | ENST00000320640; ENST00000544001 | TSF |
| | 4% | chr3 | 59852391 | 59851867 | chr3 | 59738047 | 59737952 | − | ENST00000476844; ENST00000492590; ENST00000468189; ENST00000341848 | TSF |
| | 4% | chr19 | 18982032 | 18981924 | − chr19 | 18981428 | 18981386 | − | ENST00000427170 | TSF |
| | 4% | chr2 | 223509679 | 223509604 | − chr2 | 223507724 | 223507570 | − | ENST00000281828 | TSF |
| | 4% | chr7 | 95055853 | 95055720 | − chr7 | 95053897 | 95053827 | − | ENST00000536183; ENST00000455123; ENST00000433091; ENST00000222572; ENST00000446142 | TSF |
| | 4% | chr7 | 95055853 | 95055720 | − chr7 | 95053897 | 95053827 | − | ENST00000536183; ENST00000455123; ENST00000433091; ENST00000222572; −ENST00000446142 | TSF |
| | 4% | chr7 | 95055853 | 95055720 | − chr7 | 95053897 | 95053827 | | ENST00000536183; ENST00000455123; ENST00000433091; ENST00000222572; ENST00000446142 | TSF |
| | 4% | chr7 | 95055853 | 95055720 | − chr7 | 95053897 | 95053827 | − | ENST00000536183; ENST00000455123; ENST00000433091; ENST00000222572; ENST00000446142 | TSF |
| | 4% | chr1 | 156305455 | 156305264 | − chr1 | 156304709 | 156304659 | − | ENST00000295688; ENST00000368258; ENST00000413555; ENST00000496684; ENST00000478640; ENST00000415548 | TSF |
| | 4% | chr1 | 156305455 | 156305264 | − chr1 | 156304709 | 156304659 | − | ENST00000295688; ENST00000368258; ENST00000413555; ENST00000496684; ENST00000478640; ENST00000415548 | TSF |
| | 4% | chr1 | 156305455 | 156305264 | − chr1 | 156304709 | 156304659 | − | ENST00000295688; ENST00000368258; ENST00000413555; ENST00000496684; ENST00000478640; ENST00000415548 | TSF |
| | 4% | chr1 | 156305455 | 156305264 | − chr1 | 156304709 | 156304659 | − | ENST00000295688; ENST00000368258; ENST00000413555; ENST00000496684; ENST00000478640; ENST00000415548 | TSF |
| | 4% | chr1 | 156305455 | 156305264 | − chr1 | 156304709 | 156304659 | − | ENST00000295688; ENST00000368258; ENST00000413555; ENST00000496684; ENST00000478640; ENST00000415548 | TSF |
| | 4% | chr1 | 156305455 | 156305264 | − chr1 | 156304709 | 156304659 | − | ENST00000295688; ENST00000368258; ENST00000413555; ENST00000496684; ENST00000478640; ENST00000415548 | TSF |
| | 4% | chr3 | 139245547 | 139245400 | − chr3 | 139237364 | 139237263 | − | ENST00000232219 | TSF |

TABLE 25

Transcript fusion for Head-Neck Squamous Cell Carcinoma HNSC) Coordinates of the fusion sequences for which the donor is the exon.

| 1 | 2 | 3 | 4 | 5 | 6 |
|---|---|---|---|---|---|
| 42% | chr5 | 54993786 | 54993674 | − | ENST00000396865;ENST00000539768;ENST00000318672;ENST00000508124;ENST00000511233;ENST00000503891;ENST00000513993;ENST00000505563;ENST00000506624;ENST00000507109 |
| 40% | chr10 | 47747112 | 47747132 | + | ENST00000340243;ENST00000374277;ENST00000449464;ENST00000538825 |
| 34% | chr12 | 71509738 | 71509630 | − | ENST00000549357 |
| 29% | chr8 | 54793576 | 54793644 | + | ENST00000276500 |
| 23% | chr1 | 153534067 | 153533988 | − | ENST00000368708;ENST00000487430;ENST00000497140;ENST00000368710;ENST00000368709 |
| 23% | chr1 | 153534067 | 153533988 | − | ENST00000368708;ENST00000487430;ENST00000497140;ENST00000368710;ENST00000368709 |
| 21% | chr6 | 41606488 | 41606563 | + | ENST00000432027;ENST00000419164;ENST00000373051;ENST00000441667;ENST00000230321;ENST00000373050;ENST00000446650;ENST00000435476 |
| 18% | chr19 | 14063948 | 14063931 | − | ENST00000538517;ENST00000538371;ENST00000585607 |
| 18% | chr19 | 51452029 | 51451896 | − | ENST00000391809;ENST00000336334;ENST00000593428 |
| 17% | chr3 | 10960014 | 10960138 | + | ENST00000254488 |
| 15% | chr1 | 32696528 | 32696620 | + | ENST00000373586 |
| 14% | chr5 | 82554349 | 82554496 | + | ENST00000282268;ENST00000338635;ENST00000396027;ENST00000511817 |
| 14% | chr3 | 182566264 | 182566345 | + | ENST00000323116;ENST00000498086 |
| 14% | chr3 | 182566264 | 182566345 | + | ENST00000323116;ENST00000498086 |
| 14% | chr4 | 47583977 | 47584081 | + | ENST00000273859 |
| 13% | chr19 | 39077165 | 39077216 | + | ENST00000355481;ENST00000360985;ENST00000359596 |
| 13% | chr19 | 39077165 | 39077216 | + | ENST00000355481;ENST00000360985;ENST00000359596 |
| 13% | chr19 | 39077165 | 39077216 | + | ENST00000355481;ENST00000360985;ENST00000359596 |
| 13% | chr10 | 5040939 | 5040817 | − | ENST00000380753;ENST00000421196;ENST00000407674;ENST00000604507 |
| 13% | chr10 | 5040939 | 5040817 | − | ENST00000380753;ENST00000421196;ENST00000407674;ENST00000604507 |
| 13% | chr3 | 196230044 | 196229744 | − | ENST00000318037;ENST00000437070 |
| 12% | chr19 | 35996667 | 35996620 | − | ENST00000434389;ENST00000402589;ENST00000339686;ENST00000436012;ENST00000414866;ENST00000480502;ENST00000467637;ENST00000429837;ENST00000419602;ENST00000443640;ENST00000597212;ENST00000472252;ENST00000492341;ENST00000602781;ENST00000602679;ENST00000474928;ENST00000488892;ENST00000461300;ENST00000447113;ENST00000392206;ENST00000440396;ENST00000458071;ENST00000418261;ENST00000424570;ENST00000451297;ENST00000450261 |
| 12% | chr19 | 35996667 | 35996620 | − | ENST00000434389;ENST00000402589;ENST00000339686;ENST00000436012;ENST00000414866;ENST00000480502;ENST00000467637;ENST00000429837;ENST00000419602;ENST00000443640;ENST00000597212;ENST00000472252;ENST00000492341;ENST00000602781;ENST00000602679;ENST00000474928;ENST00000488892;ENST00000461300;ENST00000447113;ENST00000392206;ENST00000440396;ENST00000458071;ENST00000418261;ENST00000424570;ENST00000451297;ENST00000450261 |
| 12% | chr19 | 35996667 | 35996620 | − | ENST00000434389;ENST00000402589;ENST00000339686;ENST00000436012;ENST00000414866;ENST00000480502;ENST00000467637;ENST00000429837;ENST00000419602;ENST00000443640;ENST00000597212;ENST00000472252;ENST00000492341;ENST00000602781;ENST00000602679;ENST00000474928;ENST00000488892;ENST00000461300;ENST00000447113;ENST00000392206;ENST00000440396;ENST00000458071;ENST00000418261;ENST00000424570;ENST00000451297;ENST00000450261 |
| 12% | chr19 | 35996667 | 35996620 | − | ENST00000434389;ENST00000402589;ENST00000339686;ENST00000436012;ENST00000414866;ENST00000480502;ENST00000467637;ENST00000429837;ENST00000419602;ENST00000443640;ENST00000597212;ENST00000472252;ENST00000492341;ENST00000602781;ENST00000602679;ENST00000474928;ENST00000488892;ENST00000461300;ENST00000447113;ENST00000392206;ENST00000440396;ENST00000458071;ENST00000418261;ENST00000424570;ENST00000451297;ENST00000450261 |
| 12% | chr19 | 35996667 | 35996620 | − | ENST00000434389;ENST00000402589;ENST00000339686;ENST00000436012;ENST00000414866;ENST00000480502;ENST00000467637;ENST00000429837;ENST00000419602;ENST00000443640;ENST00000597212;ENST00000472252;ENST00000492341;ENST00000602781;ENST00000602679;ENST00000474928;ENST00000488892;ENST00000461300;ENST00000447113;ENST00000392206;ENST00000440396;ENST00000458071;ENST00000418261;ENST00000424570;ENST00000451297;ENST00000450261 |
| 12% | chr19 | 35996667 | 35996620 | − | ENST00000434389;ENST00000402589;ENST00000339686;ENST00000436012;ENST00000414866;ENST00000480502;ENST00000467637;ENST00000429837;ENST00000419602;ENST0000044 |

TABLE 25-continued

Transcript fusion for Head-Neck Squamous Cell Carcinoma HNSC) Coordinates of the fusion sequences for which the donor is the exon.

| | | | | |
|---|---|---|---|---|
| | | | | 3640;ENST00000597212;ENST00000472252;ENST00000492341; ENST00000602781;ENST00000602679;ENST00000474928;ENST00000488892;ENST00000461300;ENST00000447113;ENST00000392206;ENST00000440396;ENST00000458071;ENST00000418261;ENST00000424570;ENST00000451297;ENST00000450261 |
| 12% | chr19 | 35996667 | 35996620 − | ENST00000434389;ENST00000402589;ENST00000339686;ENST00000436012;ENST00000414866;ENST00000480502;ENST00000467637;ENST00000429837;ENST00000419602;ENST00000443640;ENST00000597212;ENST00000472252;ENST00000492341; ENST00000602781;ENST00000602679;ENST00000474928;ENST00000488892;ENST00000461300;ENST00000447113;ENST00000392206;ENST00000440396;ENST00000458071;ENST00000418261;ENST00000424570;ENST00000451297;ENST00000450261 |
| 12% | chr19 | 35996667 | 35996620 − | ENST00000434389;ENST00000402589;ENST00000339686;ENST00000436012;ENST00000414866;ENST00000480502;ENST00000467637;ENST00000429837;ENST00000419602;ENST00000443640;ENST00000597212;ENST00000472252;ENST00000492341; ENST00000602781;ENST00000602679;ENST00000474928;ENST00000488892;ENST00000461300;ENST00000447113;ENST00000392206;ENST00000440396;ENST00000458071;ENST00000418261;ENST00000424570;ENST00000451297;ENST00000450261 |
| 12% | chr19 | 35996667 | 35996620 − | ENST00000434389;ENST00000402589;ENST00000339686;ENST00000436012;ENST00000414866;ENST00000480502;ENST00000467637;ENST00000429837;ENST00000419602;ENST00000443640;ENST00000597212;ENST00000472252;ENST00000492341; ENST00000602781;ENST00000602679;ENST00000474928;ENST00000488892;ENST00000461300;ENST00000447113;ENST00000392206;ENST00000440396;ENST00000458071;ENST00000418261;ENST00000424570;ENST00000451297;ENST00000450261 |
| 12% | chr19 | 35996667 | 35996620 − | ENST00000434389;ENST00000402589;ENST00000339686;ENST00000436012;ENST00000414866;ENST00000480502;ENST00000467637;ENST00000429837;ENST00000419602;ENST00000443640;ENST00000597212;ENST00000472252;ENST00000492341; ENST00000602781;ENST00000602679;ENST00000474928;ENST00000488892;ENST00000461300;ENST00000447113;ENST00000392206;ENST00000440396;ENST00000458071;ENST00000418261;ENST00000424570;ENST00000451297;ENST00000450261 |
| 12% | chr19 | 35996667 | 35996620 − | ENST00000434389;ENST00000402589;ENST00000339686;ENST00000436012;ENST00000414866;ENST00000480502;ENST00000467637;ENST00000429837;ENST00000419602;ENST00000443640;ENST00000597212;ENST00000472252;ENST00000492341; ENST00000602781;ENST00000602679;ENST00000474928;ENST00000488892;ENST00000461300;ENST00000447113;ENST00000392206;ENST00000440396;ENST00000458071;ENST00000418261;ENST00000424570;ENST00000451297;ENST00000450261 |
| 12% | chr19 | 35996667 | 35996620 − | ENST00000434389;ENST00000402589;ENST00000339686;ENST00000436012;ENST00000414866;ENST00000480502;ENST00000467637;ENST00000429837;ENST00000419602;ENST00000443640;ENST00000597212;ENST00000472252;ENST00000492341; ENST00000602781;ENST00000602679;ENST00000474928;ENST00000488892;ENST00000461300;ENST00000447113;ENST00000392206;ENST00000440396;ENST00000458071;ENST00000418261;ENST00000424570;ENST00000451297;ENST00000450261 |
| 12% | chr19 | 35996667 | 35996620 − | ENST00000434389;ENST00000402589;ENST00000339686;ENST00000436012;ENST00000414866;ENST00000480502;ENST00000467637;ENST00000429837;ENST00000419602;ENST00000443640;ENST00000597212;ENST00000472252;ENST00000492341; ENST00000602781;ENST00000602679;ENST00000474928;ENST00000488892;ENST00000461300;ENST00000447113;ENST00000392206;ENST00000440396;ENST00000458071;ENST00000418261;ENST00000424570;ENST00000451297;ENST00000450261 |
| 12% | chr19 | 35996667 | 35996620 − | ENST00000434389;ENST00000402589;ENST00000339686;ENST00000436012;ENST00000414866;ENST00000480502;ENST00000467637;ENST00000429837;ENST00000419602;ENST00000443640;ENST00000597212;ENST00000472252;ENST00000492341; ENST00000602781;ENST00000602679;ENST00000474928;ENST00000488892;ENST00000461300;ENST00000447113;ENST00000392206;ENST00000440396;ENST00000458071;ENST00000418261;ENST00000424570;ENST00000451297;ENST00000450261 |
| 12% | chr19 | 35996667 | 35996620 − | ENST00000434389;ENST00000402589;ENST00000339686;ENST00000436012;ENST00000414866;ENST00000480502;ENST00000467637;ENST00000429837;ENST00000419602;ENST00000443640;ENST00000597212;ENST00000472252;ENST00000492341; ENST00000602781;ENST00000602679;ENST00000474928;ENST00000488892;ENST00000461300;ENST00000447113;ENST00000392206;ENST00000440396;ENST00000458071;ENST00000418261;ENST00000424570;ENST00000451297;ENST00000450261 |

TABLE 25-continued

Transcript fusion for Head-Neck Squamous Cell Carcinoma HNSC) Coordinates of the fusion sequences for which the donor is the exon.

| | | | | |
|---|---|---|---|---|
| 12% | chr19 | 35996667 | 35996620 − | ENST00000434389;ENST00000402589;ENST00000339686;ENST00000436012;ENST00000414866;ENST00000480502;ENST00000467637;ENST00000429837;ENST00000419602;ENST00000443640;ENST00000597212;ENST00000472252;ENST00000492341;ENST00000602781;ENST00000602679;ENST00000474928;ENST00000488892;ENST00000461300;ENST00000447113;ENST00000392206;ENST00000440396;ENST00000458071;ENST00000418261;ENST00000424570;ENST00000451297;ENST00000450261 |
| 12% | chr18 | 21511026 | 21511165 + | ENST00000313654;ENST00000399516;ENST00000269217;ENST00000587184;ENST00000586751;ENST00000588164 |
| 12% | chr18 | 21511026 | 21511165 + | ENST00000313654;ENST00000399516;ENST00000269217;ENST00000587184;ENST00000586751;ENST00000588164 |
| 12% | chr18 | 21511026 | 21511165 + | ENST00000313654;ENST00000399516;ENST00000269217;ENST00000587184;ENST00000586751;ENST00000588164 |
| 12% | chr18 | 21511026 | 21511165 + | ENST00000313654;ENST00000399516;ENST00000269217;ENST00000587184;ENST00000586751;ENST00000588164 |
| 12% | chr18 | 21511026 | 21511165 + | ENST00000313654;ENST00000399516;ENST00000269217;ENST00000587184;ENST00000586751;ENST00000588164 |
| 12% | chr18 | 21511026 | 21511165 + | ENST00000313654;ENST00000399516;ENST00000269217;ENST00000587184;ENST00000586751;ENST00000588164 |
| 12% | chr7 | 22532348 | 22532184 − | ENST00000406890;ENST00000404369;ENST00000424363 |
| 12% | chr7 | 22532348 | 22532184 − | ENST00000406890;ENST00000404369;ENST00000424363 |
| 11% | chr20 | 35842163 | 35842268 + | ENST00000237530;ENST00000373622 |
| 11% | chr20 | 35842163 | 35842268 + | ENST00000237530;ENST00000373622 |
| 11% | chr9 | 101984828 | 101984925 + | ENST00000223641 |
| 11% | chr11 | 11394176 | 11394062 − | ENST00000227756 |
| 10% | chr19 | 35612126 | 35612149 + | ENST00000454903;ENST00000406242;ENST00000604404;ENST00000435734;ENST00000603181;ENST00000604255;ENST00000344013;ENST00000346446;ENST00000603449;ENST00000406988;ENST00000605550;ENST00000604804;ENST00000605552;ENST00000535103;ENST00000603524;ENST00000604621;ENST00000605677 |
| 10% | chr19 | 35612126 | 35612149 + | ENST00000454903;ENST00000406242;ENST00000604404;ENST00000435734;ENST00000603181;ENST00000604255;ENST00000344013;ENST00000346446;ENST00000603449;ENST00000406988;ENST00000605550;ENST00000604804;ENST00000605552;ENST00000535103;ENST00000603524;ENST00000604621;ENST00000605677 |
| 10% | chr7 | 55270210 | 55270401 + | ENST00000455089 |
| 8% | chr19 | 46627413 | 46627143 − | ENST00000341415 |
| 7% | chr16 | 68729680; 68729728 | 68729826 + | ENST00000264012;ENST00000429102;ENST00000581171;ENST00000568292;ENST00000569080 |
| 7% | chr16 | 68729680; 68729728 | 68729826 + | ENST00000264012;ENST00000429102;ENST00000581171;ENST00000568292;ENST00000569080 |
| 7% | chr16 | 68729680; 68729728 | 68729826 + | ENST00000264012;ENST00000429102;ENST00000581171;ENST00000568292;ENST00000569080 |
| 7% | chr16 | 68729680; 68729728 | 68729826 + | ENST00000264012;ENST00000429102;ENST00000581171;ENST00000568292;ENST00000569080 |
| 7% | chr12 | 113403549; 113403702 | 113403834 + | ENST00000228928;ENST00000546973 |
| 7% | chr12 | 113403549; 113403702 | 113403834 + | ENST00000228928;ENST00000546973 |
| 7% | chr19 | 3869015; 3869013 | 3868963 − | ENST00000262961;ENST00000438164;ENST00000587212;ENST00000586578;ENST00000439086 |
| 7% | chr19 | 3869015; 3869013 | 3868963 − | ENST00000262961;ENST00000438164;ENST00000587212;ENST00000586578;ENST00000439086 |
| 6% | chrX | 119708472 | 119708406 − | ENST00000404115 |
| 6% | chr19 | 46627413 | 46627143 − | ENST00000341415 |
| 5% | chr1 | 6531697 | 6531548 − | ENST00000400913;ENST00000340850;ENST00000377748;ENST00000377725;ENST00000377728;ENST00000377732;ENST00000400915;ENST00000377740;ENST00000535355;ENST00000377737;ENST00000537245;ENST00000544978 |
| 5% | chr1 | 6531697 | 6531548 − | ENST00000400913;ENST00000340850;ENST00000377748;ENST00000377725;ENST00000377728;ENST00000377732;ENST00000400915;ENST00000377740;ENST00000535355;ENST00000377737;ENST00000537245;ENST00000544978 |
| 5% | chr1 | 6531697 | 6531548 − | ENST00000400913;ENST00000340850;ENST00000377748;ENST00000377725;ENST00000377728;ENST00000377732;ENST00000400915;ENST00000377740;ENST00000535355;ENST00000377737;ENST00000537245;ENST00000544978 |
| 5% | chr1 | 6531697 | 6531548 − | ENST00000400913;ENST00000340850;ENST00000377748;ENST00000377725;ENST00000377728;ENST00000377732;ENST00000400915;ENST00000377740;ENST00000535355;ENST00000377737;ENST00000537245;ENST00000544978 |
| 5% | chr1 | 6531697 | 6531548 − | ENST00000400913;ENST00000340850;ENST00000377748;ENST00000377725;ENST00000377728;ENST00000377732;ENST00000400915;ENST00000377740;ENST00000535355;ENST0000037 |

TABLE 25-continued

Transcript fusion for Head-Neck Squamous Cell Carcinoma HNSC) Coordinates of the fusion sequences for which the donor is the exon.

| | | | | |
|---|---|---|---|---|
| 5% | chr1 | 6531697 | 6531548 − | 7737;ENST00000537245;ENST00000544978 ENST00000400913;ENST00000340850;ENST00000377748;ENST00000377725;ENST00000377728;ENST00000377732;ENST00000400915;ENST00000377740;ENST00000535355;ENST00000377737;ENST00000537245;ENST00000544978 |
| 5% | chr22 | 38321668; 38321854 | 38322050 + | ENST00000215957;ENST00000454685 |
| 5% | chr22 | 38321668; 38321854 | 38322050 + | ENST00000215957;ENST00000454685 |
| 5% | chr4 | 57319769 | 57319927 + | ENST00000514888;ENST00000264221;ENST00000505164;ENST00000399688;ENST00000512576 |
| 5% | chr4 | 57319769 | 57319927 + | ENST00000514888;ENST00000264221;ENST00000505164;ENST00000399688;ENST00000512576 |
| 5% | chr4 | 57319769 | 57319927 + | ENST00000514888;ENST00000264221;ENST00000505164;ENST00000399688;ENST00000512576 |
| 4% | chr1 | 11115983; 11115877 | 11115838 − | ENST00000376957;ENST00000490101 |
| 4% | chr1 | 11115983; 11115877 | 11115838 − | ENST00000376957;ENST00000490101 |
| 4% | chr18 | 61627392 | 61627509 + | ENST00000408945 |
| 4% | chr12 | 46760728 | 46760647 − | ENST00000256689 |
| 4% | chr17 | 39768940 | 39768493 − | ENST00000301653 |
| 3% | chr9 | 125054028 | 125054119 + | ENST00000297908;ENST00000344641;ENST00000373723;ENST00000373729;ENST00000394315 |
| 3% | chr9 | 125054028 | 125054119 + | ENST00000297908;ENST00000344641;ENST00000373723;ENST00000373729;ENST00000394315 |
| 3% | chr9 | 125054028 | 125054119 + | ENST00000297908;ENST00000344641;ENST00000373723;ENST00000373729;ENST00000394315 |
| 3% | chr2 | 153003822 | 153003676 − | ENST00000263904 |
| 3% | chrX | 41598709 | 41598637 − | ENST00000421587;ENST00000318588;ENST00000361962;ENST00000378163;ENST00000378158;ENST00000378166;ENST00000442742; ENST00000378154 |
| 3% | chr9 | 94991408 | 94991283 − | ENST00000375643;ENST00000443024;ENST00000447699 |
| 3% | chr9 | 94991408 | 94991283 − | ENST00000375643;ENST00000443024;ENST00000447699 |
| 3% | chr2 | 172725333; 172725194 | 172725191 − | ENST00000422440; ENST00000263812; ENST00000392592; ENST00000426896;ENST00000475360 |
| 3% | chr2 | 172725333; 172725194 | 172725191 − | ENST00000422440;ENST00000263812;ENST00000392592;ENST00000426896;ENST00000475360 |
| 3% | chr2 | 172725333; 172725194 | 172725191 − | ENST00000422440;ENST00000263812;ENST00000392592;ENST00000426896;ENST00000475360 |
| 3% | chr14 | 67878776 | 67878735 − | JENST00000216446;ENST00000553387 |
| 3% | chr7 | 81964567 | 81964451 − | ENST00000356860;ENST00000356253;ENST00000423588 |
| 3% | chr19 | 15289752 | 15289634 − | ENST00000263388;ENST00000601011 |
| 3% | chr19 | 15289752 | 15289634 − | ENST00000263388;ENST00000601011 |
| 3% | chr12 | 56742407 | 56742313 − | ENST00000314128;ENST00000557235 |
| 3% | chr12 | 56742407 | 56742313 − | ENST00000314128;ENST00000557235 |
| 3% | chr5 | 150632778 | 150632858 + | ENST00000357164 |
| 3% | chr8 | 42924698; 42924750 | 42924802 + | ENST00000534420;ENST00000302279;ENST00000533998;ENST00000342116;ENST00000531266;ENST00000525699;ENST00000529687;ENST00000533336 |
| 3% | chr8 | 42924698; 42924750 | 42924802 + | ENST00000534420;ENST00000302279;ENST00000533998;ENST00000342116;ENST00000531266;ENST00000525699;ENST00000529687;ENST00000533336 |
| 3% | chr8 | 42924698; 42924750 | 42924802 + | ENST00000534420;ENST00000302279;ENST00000533998;ENST00000342116;ENST00000531266;ENST00000525699;ENST00000529687;ENST00000533336 |
| 3% | chr8 | 42924698; 42924750 | 42924802 + | ENST00000534420;ENST00000302279;ENST00000533998;ENST00000342116;ENST00000531266;ENST00000525699;ENST00000529687;ENST00000533336 |
| 3% | chr8 | 42924698; 42924750 | 42924802 + | ENST00000534420;ENST00000302279;ENST00000533998;ENST00000342116;ENST00000531266;ENST00000525699;ENST00000529687;ENST00000533336 |
| 3% | chr8 | 42924698; 42924750 | 42924802 + | ENST00000534420;ENST00000302279;ENST00000533998;ENST00000342116;ENST00000531266;ENST00000525699;ENST00000529687;ENST00000533336 |
| 3% | chr19 | 3114942 | 3115070 + | ENST00000078429;ENST00000587636 |
| 3% | chr19 | 3114942 | 3115070 + | ENST00000078429;ENST00000587636 |
| 3% | chr12 | 52882332 | 52882112 − | ENST00000330722 |
| 3% | chr3 | 98600611; 98600498 | 98600384 − | ENST00000326840;ENST00000326857;ENST00000449482 |
| 3% | chr3 | 98600611; 98600498 | 98600384 − | ENST00000326840;ENST00000326857;ENST00000449482 |
| 3% | chr1 | 225156461 | 225156576 + | ENST00000430092;ENST00000400952;ENST00000366849;ENST00000439375 |
| 3% | chr1 | 225156461 | 225156576 + | ENST00000430092;ENST00000400952;ENST00000366849;ENST00000439375 |
| 2% | chr22 | 35819207 | 35819334 + | ENST00000216122;ENST00000382011 |

TABLE 25-continued

Transcript fusion for Head-Neck Squamous Cell Carcinoma HNSC) Coordinates of the fusion sequences for which the donor is the exon.

| | | | | |
|---|---|---|---|---|
| 2% | chr22 | 35819207 | 35819334 + | ENST00000216122;ENST00000382011 |
| 2% | chr2 | 176860312; 176860292 | 176860286 − | ENST00000272748;ENST00000544803;ENST00000392540;ENST00000445472 |
| 2% | chr2 | 176860312; 176860292 | 176860286 − | ENST00000272748;ENST00000544803;ENST00000392540;ENST00000445472 |
| 2% | chr9 | 5689959 | 5690038 + | ENST00000251879;ENST00000414202;ENST00000381532;ENST00000418622;ENST00000449720;ENST00000545641 |
| 2% | chr9 | 5689959 | 5690038 + | ENST00000251879;ENST00000414202;ENST00000381532;ENST00000418622;ENST00000449720;ENST00000545641 |
| 2% | chr9 | 5689959 | 5690038 + | ENST00000251879;ENST00000414202;ENST00000381532;ENST00000418622;ENST00000449720;ENST00000545641 |
| 2% | chr10 | 47173918 | 47173898 − | ENST00000358140;ENST00000359178;ENST00000545298;ENST00000414655 |
| 2% | chr1 | 6378638 | 6378552 − | ENST00000608083;ENST00000377842;ENST00000377845;ENST00000377855;ENST00000377860;ENST00000418124;ENST00000545482;ENST00000361521;ENST00000473466;ENST00000541130 |
| 2% | chr1 | 6378638 | 6378552 − | ENST00000608083;ENST00000377842;ENST00000377845;ENST00000377855;ENST00000377860;ENST00000418124;ENST00000545482;ENST00000361521;ENST00000473466;ENST00000541130 |
| 2% | chr1 | 6378638 | 6378552 − | ENST00000608083;ENST00000377842;ENST00000377845;ENST00000377855;ENST00000377860;ENST00000418124;ENST00000545482;ENST00000361521;ENST00000473466;ENST00000541130 |
| 2% | chr1 | 6378638 | 6378552 − | ENST00000608083;ENST00000377842;ENST00000377845;ENST00000377855;ENST00000377860;ENST00000418124;ENST00000545482;ENST00000361521;ENST00000473466;ENST00000541130 |
| 2% | chr1 | 6378638 | 6378552 − | ENST00000608083;ENST00000377842;ENST00000377845;ENST00000377855;ENST00000377860;ENST00000418124;ENST00000545482;ENST00000361521;ENST00000473466;ENST00000541130 |
| 2% | chr1 | 6378638 | 6378552 − | ENST00000608083;ENST00000377842;ENST00000377845;ENST00000377855;ENST00000377860;ENST00000418124;ENST00000545482;ENST00000361521;ENST00000473466;ENST00000541130 |
| 2% | chr1 | 6378638 | 6378552 − | ENST00000608083;ENST00000377842;ENST00000377845;ENST00000377855;ENST00000377860;ENST00000418124;ENST00000545482;ENST00000361521;ENST00000473466;ENST00000541130 |
| 2% | chr5 | 176830398 | 176830255 − | ENST00000253496 |
| 2% | chr16 | 83520082 | 83520260 + | ENST00000566620;ENST00000268613;ENST00000428848 |
| 2% | chr16 | 83520082 | 83520260 + | ENST00000566620;ENST00000268613;ENST00000428848 |
| 2% | chr16 | 83520082 | 83520260 + | ENST00000566620;ENST00000268613;ENST00000428848 |
| 2% | chr10 | 126205749 | 126205840 + | ENST00000368842 |
| 2% | chr16 | 57115439 | 57115522 + | ENST00000262510;ENST00000308149;ENST00000539144 |
| 2% | chr16 | 57115439 | 57115522 + | ENST00000262510;ENST00000308149;ENST00000539144 |
| 2% | chr14 | 24768312 | 24768163 − | ENST00000288111;ENST00000396813;ENST00000558340 |
| 2% | chr15 | 77057413 | 77057302 − | ENST00000538941;ENST00000563290;ENST00000324767;ENST00000564590;ENST00000565970 |
| 2% | chr15 | 77057413 | 77057302 − | ENST00000538941;ENST00000563290;ENST00000324767;ENST00000564590;ENST00000565970 |
| 2% | chr15 | 77057413 | 77057302 − | ENST00000538941;ENST00000563290;ENST00000324767;ENST00000564590;ENST00000565970 |
| 2% | chr8 | 143867103 | 143867005 − | ENST00000301263 |
| 2% | chr3 | 137906397; 137906427 | 137906441 + | ENST00000469044;ENST00000461600;ENST00000461822;ENST00000470821;ENST00000471709;ENST00000393058;ENST00000538260;ENST00000463485 |
| 2% | chr3 | 137906397; 137906427 | 137906441 + | ENST00000469044;ENST00000461600;ENST00000461822;ENST00000470821;ENST00000471709;ENST00000393058;ENST00000538260;ENST00000463485 |
| 2% | chr21 | 45222155 | 45222268 + | ENST00000497547 |
| 2% | chr5 | 1802435 | 1802488 + | ENST00000274137;ENST00000469176 |
| 2% | chr1 | 63955889 | 63955754 − | ENST00000371092;ENST00000271002;ENST00000489099;ENST00000283568 |
| 2% | chr1 | 63955889 | 63955754 − | ENST00000371092;ENST00000271002;ENST00000489099;ENST00000283568 |
| 2% | chr5 | 121405863 | 121405748 − | ENST00000231004 |
| 2% | chr19 | 45895598 | 45895138 − | ENST00000360957;ENST00000418234 |
| 2% | chr8 | 120220779 | 120220844 + | ENST00000276681 |
| 2% | chr3 | 129020793 | 129020985 + | ENST00000509042;ENST00000383463;ENST00000417226;ENST00000502878;ENST00000389735 |
| 2% | chr3 | 129020793 | 129020985 + | ENST00000509042;ENST00000383463;ENST00000417226;ENST00000502878;ENST00000389735 |
| 2% | chr3 | 129020793 | 129020985 + | ENST00000509042;ENST00000383463;ENST00000417226;ENST00000502878;ENST00000389735 |

TABLE 25-continued

Transcript fusion for Head-Neck Squamous Cell Carcinoma HNSC) Coordinates of the fusion sequences for which the donor is the exon.

| | | | | |
|---|---|---|---|---|
| 2% | chr2 | 28352138 | 28352247 + | ENST00000344773;ENST00000379624;ENST00000342045;ENST00000361704;ENST00000379632;ENST00000379629 |
| 2% | chr12 | 46760728 | 46760647 − | ENST00000256689 |
| 2% | chr8 | 42932359 | 42932507 + | ENST00000302279;ENST00000342116;ENST00000529687;ENST00000533336 |
| 2% | chr8 | 42932359 | 42932507 + | ENST00000302279;ENST00000342116;ENST00000529687;ENST00000533336 |
| 2% | chr8 | 42932359 | 42932507 + | ENST00000302279;ENST00000342116;ENST00000529687;ENST00000533336 |
| 2% | chr8 | 42932359 | 42932507 + | ENST00000302279;ENST00000342116;ENST00000529687;ENST00000533336 |
| 2% | chr22 | 47071365 | 47071449 + | ENST00000406902;ENST00000361034;ENST00000408031 |
| 2% | chr22 | 47071365 | 47071449 + | ENST00000406902;ENST00000361034;ENST00000408031 |
| 2% | chr13 | 114157811 | 114157903 + | ENST00000434316;ENST00000375391 |
| 2% | chr16 | 78143675 | 78143732 + | ENST00000566780;ENST00000402655;ENST00000406884;ENST00000539474;ENST00000355860;ENST00000408984 |
| 2% | chr7 | 23300075 | 23300392 + | ENST00000258733;ENST00000381990;ENST00000539136;ENST00000453162 |
| 2% | chr7 | 23300075 | 23300392 + | ENST00000258733;ENST00000381990;ENST00000539136;ENST00000453162 |
| 2% | chr7 | 23300075 | 23300392 + | ENST00000258733;ENST00000381990;ENST00000539136;ENST00000453162 |
| 2% | chr6 | 65098733 | 65098583 − | ENST00000503581;ENST00000370621;ENST00000370616 |
| 2% | chr3 | 190030825 | 190030661 − | ENST00000295522 |
| 2% | chr9 | 130213596 | 130213560 − | ENST00000361436;ENST00000536368 |
| 2% | chr19 | 53352466;53352373 | 53352340 − | ENST00000595646;ENST00000243639;ENST00000597924;ENST00000601847 |
| 2% | chr19 | 53352466;53352373 | 53352340 − | ENST00000595646;ENST00000243639;ENST00000597924;ENST00000601847 |
| 1% | chr4 | 87869686 | 87869723 + | ENST00000395146;ENST00000507468;ENST00000503477 |
| 1% | chr2 | 131704082 | 131704208 + | ENST00000409359;ENST00000326016;ENST00000392953;ENST00000428230;ENST00000438985;ENST00000525839;ENST00000409303 |
| 1% | chr2 | 131704082 | 131704208 + | ENST00000409359;ENST00000326016;ENST00000392953;ENST00000428230;ENST00000438985;ENST00000525839;ENST00000409303 |
| 1% | chr2 | 131704082 | 131704208 + | ENST00000409359;ENST00000326016;ENST00000392953;ENST00000428230;ENST00000438985;ENST00000525839;ENST00000409303 |
| 1% | chr20 | 3614958 | 3615036 + | ENST00000262919 |
| 1% | chr9 | 5689959 | 5690038 + | ENST00000251879;ENST00000414202;ENST00000381532;ENST00000418622;ENST00000449720;ENST00000545641 |
| 1% | chr9 | 5689959 | 5690038 + | ENST00000251879;ENST00000414202;ENST00000381532;ENST00000418622;ENST00000449720;ENST00000545641 |
| 1% | chr9 | 5689959 | 5690038 + | ENST00000251879;ENST00000414202;ENST00000381532;ENST00000418622;ENST00000449720;ENST00000545641 |
| 1% | chr11 | 101937216;101937273 | 101937382 + | ENST00000434758;ENST00000526781;ENST00000529204 |
| 1% | chr11 | 101937216;101937273 | 101937382 + | ENST00000434758;ENST00000526781;ENST00000529204 |
| 1% | chr11 | 60701014 | 60701216 + | ENST00000453848;ENST00000005286;ENST00000536409 |
| 1% | chr11 | 60701014 | 60701216 + | ENST00000453848;ENST00000005286;ENST00000536409 |
| 1% | chr11 | 60701014 | 60701216 + | ENST00000453848;ENST00000005286;ENST00000536409 |
| 1% | chr11 | 71209398;71209448 | 71209574 + | ENST00000319023;ENST00000539574;ENST00000530055;ENST00000525593;ENST00000527963 |
| 1% | chr11 | 71209398;71209448 | 71209574 + | ENST00000319023;ENST00000539574;ENST00000530055;ENST00000525593;ENST00000527963 |
| 1% | chr11 | 71209398;71209448 | 71209574 + | ENST00000319023;ENST00000539574;ENST00000530055;ENST00000525593;ENST00000527963 |
| 1% | chr11 | 71209398;71209448 | 71209574 + | ENST00000319023;ENST00000539574;ENST00000530055;ENST00000525593;ENST00000527963 |
| 1% | chr11 | 71209398;71209448 | 71209574 + | ENST00000319023;ENST00000539574;ENST00000530055;ENST00000525593;ENST00000527963 |
| 1% | chr12 | 71509738 | 71509630 − | ENST00000549357 |
| 1% | chr11 | 10050104 | 10049999 − | ENST00000256190 |
| 1% | chr2 | 27610025 | 27609956 − | ENST00000344034;ENST00000350803 |
| 1% | chr19 | 15289752 | 15289634 − | ENST00000263388;ENST00000601011 |
| 1% | chr19 | 15289752 | 15289634 − | ENST00000263388;ENST00000601011 |
| 1% | chr8 | 71619168 | 71619388 + | ENST00000408926;ENST00000520030 |
| 1% | chr2 | 192546682;192546672 | 192546743 + | ENST00000307834;ENST00000307849;ENST00000410026;ENST00000451500;ENST00000409510;ENST00000425611;ENST00000435931 |
| 1% | chr2 | 192546682;192546672 | 192546743 + | ENST00000307834;ENST00000307849;ENST00000410026;ENST00000451500;ENST00000409510;ENST00000425611;ENST00000435931 |
| 1% | chr2 | 192546682;192546672 | 192546743 + | ENST00000307834;ENST00000307849;ENST00000410026;ENST00000451500;ENST00000409510;ENST00000425611;ENST000 |

TABLE 25-continued

Transcript fusion for Head-Neck Squamous Cell Carcinoma HNSC) Coordinates of the fusion sequences for which the donor is the exon.

| | | | | |
|---|---|---|---|---|
| 1% | chr8 | 104778455 | 104778765 + | 00435931<br>ENST00000504942;ENST00000406091 |
| 1% | chr19 | 14676014 | 14676102 + | ENST00000215567;ENST00000596073;ENST00000600083;ENST00000436007;ENST00000601187 |
| 1% | chr19 | 14676014 | 14676102 + | ENST00000215567;ENST00000596073;ENST00000600083;ENST00000436007;ENST00000601187 |
| 1% | chr19 | 14676014 | 14676102 + | ENST00000215567;ENST00000596073;ENST00000600083;ENST00000436007;ENST00000601187 |
| 1% | chr19 | 14676014 | 14676102 + | ENST00000215567;ENST00000596073;ENST00000600083;ENST00000436007;ENST00000601187 |
| 1% | chr12 | 28605411;<br>28605475 | 28605587 + | ENST00000536154;ENST00000539107;ENST00000545336;ENST00000381256;ENST00000381259;ENST00000306172;ENST00000535212;ENST00000542801 |
| 1% | chr12 | 28605411;<br>28605475 | 28605587 + | ENST00000536154;ENST00000539107;ENST00000545336;ENST00000381256;ENST00000381259;ENST00000306172;ENST00000535212;ENST00000542801 |
| 1% | chr12 | 28605411;<br>28605475 | 28605587 + | ENST00000536154;ENST00000539107;ENST00000545336;ENST00000381256;ENST00000381259;ENST00000306172;ENST00000535212;ENST00000542801 |
| 1% | chr12 | 28605411;<br>28605475 | 28605587 + | ENST00000536154;ENST00000539107;ENST00000545336;ENST00000381256;ENST00000381259;ENST00000306172;ENST00000535212;ENST00000542801 |
| 1% | chr12 | 28605411;<br>28605475 | 28605587 + | ENST00000536154;ENST00000539107;ENST00000545336;ENST00000381256;ENST00000381259;ENST00000306172;ENST00000535212;ENST00000542801 |
| 1% | chr12 | 28605411;<br>28605475 | 28605587 + | ENST00000536154;ENST00000539107;ENST00000545336;ENST00000381256;ENST00000381259;ENST00000306172;ENST00000535212;ENST00000542801 |
| 1% | chr13 | 42457627 | 42457523 − | ENST00000379310;ENST00000281496 |
| 1% | chr8 | 124033739 | 124033687 − | ENST00000259512;ENST00000405944;ENST00000419562;ENST00000519018;ENST00000523036 |
| 1% | chr8 | 124033739 | 124033687 − | ENST00000259512;ENST00000405944;ENST00000419562;ENST00000519018;ENST00000523036 |
| 1% | chr8 | 124033739 | 124033687 − | ENST00000259512;ENST00000405944;ENST00000419562;ENST00000519018;ENST00000523036 |
| 1% | chr19 | 49122400 | 49122398 − | ENST00000549920;ENST00000547897;ENST00000550645;ENST00000552588;ENST00000549370;ENST00000549273 |
| 1% | chr18 | 47794033 | 47793977 − | ENST00000585672;ENST00000592060 |
| 1% | chr18 | 47794033 | 47793977 − | ENST00000585672;ENST00000592060 |
| 1% | chr1 | 33272212 | 33272083 − | ENST00000373477 |
| 1% | chr16 | 72153988;<br>72154048 | 72153750 − | ENST00000537465;ENST00000237353;ENST00000355636 |
| 1% | chr16 | 72153988;<br>72154048 | 72153750 − | ENST00000537465;ENST00000237353;ENST00000355636 |
| 1% | chr16 | 72153988;<br>72154048 | 72153750 − | ENST00000537465;ENST00000237353;ENST00000355636 |

| 7 | 8 | 9 | 10 | 11 |
|---|---|---|---|---|
| chr5 | 54993040 | 54992544 | − | TSF |
| chr10 | 48278725 | 48278896 | + | TAF |
| chr12 | 71504233 | 71503634 | − | TAF |
| chr8 | 54826057 | 54826421 | + | TAF |
| chr1 | 153532853 | 153532704 | − | TAF |
| chr1 | 153532853 | 153532704 | − | TAF |
| chr6 | 41607515 | 41607595 | + | TAF |
| chr19 | 14060442 | 14060422 | − | TAF |
| chr19 | 51445160 | 51445047 | − | TAF |
| chr3 | 10965604 | 10965907 | + | TAF |
| chr1 | 32696861 | 32697110 | + | TAF |
| chr5 | 82606608 | 82606935 | + | TAF |
| chr3 | 182566968 | 182567869 | + | TAF |
| chr3 | 182566968 | 182567869 | + | TAF |
| chr4 | 47584886 | 47585171 | + | TAF |
| chr19 | 39085644 | 39085967 | + | TAF |
| chr19 | 39085644 | 39085967 | + | TAF |
| chr19 | 39085644 | 39085967 | + | TAF |
| chr10 | 5002427 | 5002117 | − | TAF |
| chr10 | 5002427 | 5002117 | − | TAF |
| chr3 | 196223342 | 196223041 | − | TAF |
| chr19 | 35995923 | 35995655 | − | TAF |
| chr19 | 35995923 | 35995655 | − | TAF |
| chr19 | 35995923 | 35995655 | − | TAF |
| chr19 | 35995923 | 35995655 | − | TAF |
| chr19 | 35995923 | 35995655 | − | TAF |
| chr19 | 35995923 | 35995655 | − | TAF |

TABLE 25-continued

Transcript fusion for Head-Neck Squamous Cell Carcinoma HNSC) Coordinates of the fusion sequences for which the donor is the exon.

| | | | |
|---|---|---|---|
| chr19 | 35995923 | 35995655 − | TAF |
| chr19 | 35995923 | 35995655 − | TAF |
| chr19 | 35995923 | 35995655 − | TAF |
| chr19 | 35995923 | 35995655 − | TAF |
| chr19 | 35995923 | 35995655 − | TAF |
| chr19 | 35995923 | 35995655 − | TAF |
| chr19 | 35995923 | 35995655 − | TAF |
| chr19 | 35995923 | 35995655 − | TAF |
| chr18 | 21511381 | 21511478 + | TAF |
| chr18 | 21511381 | 21511478 + | TAF |
| chr18 | 21511381 | 21511478 + | TAF |
| chr18 | 21511381 | 21511478 + | TAF |
| chr18 | 21511381 | 21511478 + | TAF |
| chr18 | 21511381 | 21511478 + | TAF |
| chr7 | 22512853 | 22512669 − | TSF |
| chr7 | 22512853 | 22512669 − | TSF |
| chr20 | 35844460 | 35844765 + | TAF |
| chr20 | 35844460 | 35844765 + | TAF |
| chr9 | 101986374 | 101986588 + | TAF |
| chr11 | 11386990 | 11386568 − | TAF |
| chr19 | 35613565 | 35613610 + | TAF |
| chr19 | 35613565 | 35613610 + | TAF |
| chr7 | 55272949 | 55272949 + | TSF |
| chr19 | 46623577 | 46622963 − | TSF |
| chr16 | 68761056 | 68761347 + | TSF |
| chr16 | 68761056 | 68761347 + | TSF |
| chr16 | 68761056 | 68761347 + | TSF |
| chr16 | 68761056 | 68761347 + | TSF |
| chr12 | 113404028 | 113404051 + | TSF |
| chr12 | 113404028 | 113404051 + | TSF |
| chr19 | 3855694 | 3855445 − | TSF |
| chr19 | 3855694 | 3855445 − | TSF |
| chrX | 119705855 | 119705820 − | TSF |
| chr19 | 46623564 | 46622963 − | TSF |
| chr1 | 6531300 | 6531188 − | TSF |
| chr1 | 6531300 | 6531188 − | TSF |
| chr1 | 6531300 | 6531188 − | TSF |
| chr1 | 6531300 | 6531188 − | TSF |
| chr1 | 6531300 | 6531188 − | TSF |
| chr1 | 6531300 | 6531188 − | TSF |
| chr22 | 38322963 | 38322967 + | TSF |
| chr22 | 38322963 | 38322967 + | TSF |
| chr4 | 57321183 | 57321327 + | TSF |
| chr4 | 57321183 | 57321327 + | TSF |
| chr4 | 57321183 | 57321327 + | TSF |
| chr1 | 11115464 | 11115178 − | TSF |
| chr1 | 11115464 | 11115178 − | TSF |
| chr18 | 61628870 | 61629168 + | TSF |
| chr12 | 46760066 | 46759964 − | TSF |
| chr17 | 39733779 | 39733579 − | TSF |
| chr9 | 125068067 | 125068171 + | TSF |
| chr9 | 125068067 | 125068171 + | TSF |
| chr9 | 125068067 | 125068171 + | TSF |
| chr2 | 153001350 | 153001066 − | TSF |
| chrX | 41557348 | 41557057 − | TSF |
| chr9 | 94990268 | 94989087 − | TSF |
| chr9 | 94990268 | 94989087 − | TSF |
| chr2 | 172723793 | 172722363 − | TSF |
| chr2 | 172723793 | 172722363 − | TSF |
| chr2 | 172723793 | 172722363 − | TSF |
| chr14 | 67864772 | 67864768 − | TSF |
| chr7 | 81929467 | 81929190 − | TSF |
| chr19 | 15289244 | 15289201 − | TSF |
| chr19 | 15289244 | 15289201 − | TSF |
| chr12 | 56740986 | 56740975 − | TSF |
| chr12 | 56740986 | 56740975 − | TSF |
| chr5 | 150637286 | 150637636 + | TSF |
| chr8 | 42925245 | 42925476 + | TSF |
| chr8 | 42925245 | 42925476 + | TSF |
| chr8 | 42925245 | 42925476 + | TSF |
| chr8 | 42925245 | 42925476 + | TSF |
| chr8 | 42925245 | 42925476 + | TSF |
| chr8 | 42925245 | 42925476 + | TSF |
| chr19 | 3115258 | 3115402 + | TSF |
| chr19 | 3115258 | 3115402 + | TSF |
| chr12 | 52462184 | 52462137 − | TSF |

TABLE 25-continued

Transcript fusion for Head-Neck Squamous Cell Carcinoma HNSC) Coordinates of the fusion sequences for which the donor is the exon.

| | | | |
|---|---|---|---|
| chr3 | 98586282 | 98584565 − | TSF |
| chr3 | 98586282 | 98584565 − | TSF |
| chr1 | 225157336 | 225158402 + | TSF |
| chr1 | 225157336 | 225158402 + | TSF |
| chr22 | 35846150 | 35846200 + | TSF |
| chr22 | 35846150 | 35846200 + | TSF |
| chr2 | 176859008 | 176858934 − | TSF |
| chr2 | 176859008 | 176858934 − | TSF |
| chr9 | 5712361 | 5712559 + | TSF |
| chr9 | 5712361 | 5712559 + | TSF |
| chr9 | 5712361 | 5712559 + | TSF |
| chr10 | 47139994 | 47138925 − | TSF |
| chr1 | 6367453 | 6367413 − | TSF |
| chr1 | 6367453 | 6367413 − | TSF |
| chr1 | 6367453 | 6367413 − | TSF |
| chr1 | 6367453 | 6367413 − | TSF |
| chr1 | 6367453 | 6367413 − | TSF |
| chr1 | 6367453 | 6367413 − | TSF |
| chr1 | 6367453 | 6367413 − | TSF |
| chr5 | 176829864 | 176829767 − | TSF |
| chr16 | 83588547 | 83588577 + | TSF |
| chr16 | 83588547 | 83588577 + | TSF |
| chr16 | 83588547 | 83588577 + | TSF |
| chr10 | 126251911 | 126252288 + | TSF |
| chr16 | 57116257 | 57116272 + | TSF |
| chr16 | 57116257 | 57116272 + | TSF |
| chr14 | 24767944 | 24767783 − | TSF |
| chr15 | 77051709 | 77051558 − | TSF |
| chr15 | 77051709 | 77051558 − | TSF |
| chr15 | 77051709 | 77051558 − | TSF |
| chr8 | 143859806 | 143859781 − | TSF |
| chr3 | 137907243 | 137907252 + | TSF |
| chr3 | 137907243 | 137907252 + | TSF |
| chr21 | 45240407 | 45240709 + | TSF |
| chr5 | 1811082 | 1811428 + | TSF |
| chr1 | 63952444 | 63951983 − | TSF |
| chr1 | 63952444 | 63951983 − | TSF |
| chr5 | 121403052 | 121403016 − | TSF |
| chr19 | 45889495 | 45889472 − | TSF |
| chr8 | 120233190 | 120233225 + | TSF |
| chr3 | 129029005 | 129029042 + | TSF |
| chr3 | 129029005 | 129029042 + | TSF |
| chr3 | 129029005 | 129029042 + | TSF |
| chr2 | 28362015 | 28362218 + | TSF |
| chr12 | 46760023 | 46759964 − | TSF |
| chr8 | 42934165 | 42935743 + | TSF |
| chr8 | 42934165 | 42935743 + | TSF |
| chr8 | 42934165 | 42935743 + | TSF |
| chr8 | 42934165 | 42935743 + | TSF |
| chr22 | 47078308 | 47078350 + | TSF |
| chr22 | 47078308 | 47078350 + | TSF |
| chr13 | 114159741 | 114159770 + | TSF |
| chr16 | 78145717 | 78146057 + | TSF |
| chr7 | 23301185 | 23301414 + | TSF |
| chr7 | 23301185 | 23301414 + | TSF |
| chr7 | 23301185 | 23301414 + | TSF |
| chr6 | 65097495 | 65097442 − | TSF |
| chr3 | 190030018 | 190029730 − | TSF |
| chr9 | 130213398 | 130213359 − | TSF |
| chr19 | 53339322 | 53339166 − | TSF |
| chr19 | 53339322 | 53339166 − | TSF |
| chr4 | 87916831 | 87917873 + | TSF |
| chr2 | 131710021 | 131712132 + | TSF |
| chr2 | 131710021 | 131712132 + | TSF |
| chr2 | 131710021 | 131712132 + | TSF |
| chr20 | 3615708 | 3616042 + | TSF |
| chr9 | 5710416 | 5711239 + | TSF |
| chr9 | 5710416 | 5711239 + | TSF |
| chr9 | 5710416 | 5711239 + | TSF |
| chr11 | 101937956 | 101938097 + | TSF |
| chr11 | 101937956 | 101938097 + | TSF |
| chr11 | 60701443 | 60701575 + | TSF |
| chr11 | 60701443 | 60701575 + | TSF |
| chr11 | 60701443 | 60701575 + | TSF |
| chr11 | 71216557 | 71216960 + | TSF |
| chr11 | 71216557 | 71216960 + | TSF |
| chr11 | 71216557 | 71216960 + | TSF |

TABLE 25-continued

Transcript fusion for Head-Neck Squamous Cell Carcinoma HNSC) Coordinates of the fusion sequences for which the donor is the exon.

| | | | | |
|---|---|---|---|---|
| chr11 | 71216557 | 71216960 | + | TSF |
| chr11 | 71216557 | 71216960 | + | TSF |
| chr11 | 71507025 | 71506982 | − | TSF |
| chr11 | 10038326 | 10038049 | − | TSF |
| chr2 | 27609703 | 27609426 | − | TSF |
| chr19 | 15289358 | 15289201 | − | TSF |
| chr19 | 15289358 | 15289201 | − | TSF |
| chr8 | 71625661 | 71625673 | + | TSF |
| chr2 | 192548016 | 192548103 | + | TSF |
| chr2 | 192548016 | 192548103 | + | TSF |
| chr2 | 192548016 | 192548103 | + | TSF |
| chr8 | 104821508 | 104821527 | + | TSF |
| chr19 | 14677944 | 14677945 | + | TSF |
| chr19 | 14677944 | 14677945 | + | TSF |
| chr19 | 14677944 | 14677945 | + | TSF |
| chr19 | 14677944 | 14677945 | + | TSF |
| chr12 | 28624332 | 28624630 | + | TSF |
| chr12 | 28624332 | 28624630 | + | TSF |
| chr12 | 28624332 | 28624630 | + | TSF |
| chr12 | 28624332 | 28624630 | + | TSF |
| chr12 | 28624332 | 28624630 | + | TSF |
| chr12 | 28624332 | 28624630 | + | TSF |
| chr13 | 42456370 | 42455523 | − | TSF |
| chr8 | 123989465 | 123989244 | − | TSF |
| chr8 | 123989465 | 123989244 | − | TSF |
| chr8 | 123989465 | 123989244 | − | TSF |
| chr19 | 49121979 | 49121790 | − | TSF |
| chr18 | 47793455 | 47793319 | − | TSF |
| chr18 | 47793455 | 47793319 | − | TSF |
| chr1 | 33270484 | 33269340 | − | TSF |
| chr16 | 72150929 | 72150229 | − | TSF |
| chr16 | 72150929 | 72150229 | − | TSF |
| chr16 | 72150929 | 72150229 | − | TSF |

TABLE 26

Transcript fusion for Head-Neck Squamous Cell Carcinoma HNSC) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 85% | chr12 | 122430912 | 122431615 | + | chr12 | 122437622 | 122437850 | + | ENST00000288912 | TAF |
| 40% | chr11 | 93468219 | 93468129 | − | chr11 | 93467826 | 93467791; 93467814 | − | ENST00000393259;ENST00000527169 | TAF |
| 40% | chr11 | 93468219 | 93468129 | − | chr11 | 93467826 | 93467791; 93467814 | − | ENST00000393259;ENST00000527169 | TAF |
| 40% | chr5 | 76107394 | 76108135 | + | chr5 | 76128515 | 76129626 | + | ENST00000296677 | TSF |
| 39% | chr12 | 122387836 | 122388242 | + | chr12 | 122389386 | 122389436 | + | ENST00000288912;ENST00000397454 | TSF |
| 39% | chr12 | 122387836 | 122388242 | + | chr12 | 122389386 | 122389436 | + | ENST00000288912;ENST00000397454 | TSF |
| 37% | chr8 | 104389530 | 104389551 | + | chr8 | 104390255 | 104390471 | + | ENST00000330295;ENST00000520337 | TAF |
| 36% | chr4 | 15791827 | 15792541 | + | chr4 | 15818134 | 15818263 | + | ENST00000502843;ENST00000226279 | TAF |
| 36% | chr4 | 15791827 | 15792541 | + | chr4 | 15818134 | 15818263 | + | ENST00000502843;ENST00000226279 | TAF |
| 35% | chr9 | 119603649 | 119602892 | − | chr9 | 119583062 | 119582896 | − | ENST00000373996;ENST00000313400;ENST00000373986;ENST00000361209 | TAF |
| 35% | chr2 | 38983894 | 38983253 | − | chr2 | 38977336 | 38977156 | − | ENST00000313117;ENST000000425778;ENST00000425941;ENST00000446327;ENST00000409276;ENST00000431066;ENST00000443213 | TSF |
| 35% | chr2 | 38983894 | 38983253 | − | chr2 | 38977336 | 38977156 | | ENST00000313117;ENST000000425778;ENST00000425941;ENST00000446327;ENST00000409276;ENST00000431066;ENST00000443213 | TSF |
| 35% | chr2 | 38983894 | 38983253 | − | chr2 | 38977336 | 38977156 | − | ENST00000313117;ENST000000425778;ENST00000425941;ENST00000446327;ENST00000409276;ENST00000431066;ENST00000443213 | TSF |
| 35% | chr2 | 38983894 | 38983253 | − | chr2 | 38977336 | 38977156 | − | ENST00000313117;ENST000000425778;ENST00000425941;ENST000 | TSF |

TABLE 26-continued

Transcript fusion for Head-Neck Squamous Cell Carcinoma HNSC) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 35% | chr2 | 38983894 | 38983253 | − | chr2 | 38977336 | 38977156 | − | 00446327;ENST00000409276;ENST00000431066;ENST00000443213 ENST00000313117;ENST0000042 5778;ENST00000425941;ENST00000446327;ENST00000409276;ENST00000431066;ENST00000443213 | TSF |
| 32% | chr11 | 87906665 | 87906580 | − | chr11 | 87883123 | 87882843 | − | ENST00000243662;ENST00000526372 | TAF |
| 32% | chr12 | 122387836 | 122388242 | + | chr12 | 122392026 | 122392240 | + | ENST00000288912;ENST00000397454 | TSF |
| 32% | chr12 | 122387836 | 122388242 | 1 | chr12 | 122392026 | 122392240 | + | ENST00000288912;ENST00000397454 | TSF |
| 29% | chr7 | 116364854 | 116364901 | + | chr7 | 116371722 | 116371913 | + | ENST00000397752;ENST000003 18493;ENST00000436117 | TAF |
| 29% | chr7 | 116364854 | 116364901 | + | chr7 | 116371722 | 116371913 | + | ENST00000397752;ENST000003 18493;ENST00000436117 | TAF |
| 29% | chr7 | 116364854 | 116364901 | + | chr7 | 116371722 | 116371913 | + | ENST00000397752;ENST000003 18493;ENST00000436117 | TAF |
| 28% | chr3 | 185411133 | 185410965 | − | chr3 | 185410550 | 185410487 | − | ENST00000382199;ENST0000042 1047;ENST00000457616;ENST00000346192 | TAF |
| 28% | chr3 | 185411133 | 185410965 | − | chr3 | 185410550 | 185410487 | − | ENST00000382199;ENST0000042 1047;ENST00000457616;ENST00000346192 | TAF |
| 27% | chr19 | 39347374 | 39346430 | − | chr19 | 39338074 | 39337956 | − | ENST00000221419;ENST00000601449;ENST00000600233;ENST00000601813 | TSF |
| 27% | chr19 | 39347374 | 39346430 | − | chr19 | 39338074 | 39337956 | − | ENST00000221419;ENST00000601449;ENST00000600233;ENST00000601813 | TSF |
| 27% | chr19 | 39347374 | 39346430 | − | chr19 | 39338074 | 39337956 | − | ENST00000221419;ENST00000601449;ENST00000600233;ENST00000601813 | TSF |
| 27% | chr19 | 39347374 | 39346206 | − | chr19 | 39338074 | 39337956 | − | ENST00000221419;ENST00000601449;ENST00000600233;ENST00000601813 | TSF |
| 27% | chr19 | 39347374 | 39346206 | − | chr19 | 39338074 | 39337956 | − | ENST00000221419;ENST00000601449;ENST00000600233;ENST00000601813 | TSF |
| 27% | chr19 | 39347374 | 39346206 | − | chr19 | 39338074 | 39337956 | − | ENST00000221419;ENST00000601449;ENST00000600233;ENST00000601813 | TSF |
| 22% | chr5 | 76107394 | 76108212 | + | chr5 | 76128515 | 76129626 | + | ENST00000296677 | TSF |
| 21% | chr5 | 135398466 | 135398602 | + | chr5 | 135398875 | 135398915; 135398898 | + | ENST00000442011;ENST00000305126;ENST00000514554;ENST00000508076;ENST00000503087 | TAF |
| 21% | chr5 | 135398466 | 135398602 | + | chr5 | 135398875 | 135398915; 135398898 | + | ENST00000442011;ENST00000305126;ENST00000514554;ENST00000508076;ENST00000503087 | TAF |
| 21% | chr6 | 138423138 | 138423021 | − | chr6 | 138417631 | 138417491 | − | ENST00000421351 | TAF |
| 19% | chr19 | 49121994 | 49121817 | − | chr19 | 49121134 | 49121048 | − | ENST00000549920;ENST00000547897;ENST00000084795;ENST00000550645;ENST00000549370;ENST00000549273 | TAF |
| 19% | chr19 | 49121994 | 49121817 | − | chr19 | 49121134 | 49121048 | − | ENST00000549920;ENST00000547897;ENST00000084795;ENST00000550645;ENST00000549370;ENST00000549273 | TAF |
| 19% | chr19 | 49121994 | 49121817 | − | chr19 | 49121134 | 49121048 | − | ENST00000549920;ENST00000547897;ENST00000084795;ENST00000550645;ENST00000549370;ENST00000549273 | TAF |
| 19% | chr19 | 49121994 | 49121817 | − | chr19 | 49121134 | 49121048 | − | ENST00000549920;ENST00000547897;ENST00000084795;ENST00000550645;ENST00000549370;ENST00000549273 | TAF |
| 19% | chr19 | 49121994 | 49121817 | − | chr19 | 49121134 | 49121048 | − | ENST00000549920;ENST00000547897;ENST00000084795;ENST00000550645;ENST00000549370;ENST00000549273 | TAF |
| 19% | chr2 | 38983894 | 38983132 | − | chr2 | 38977336 | 38977156 | − | ENST00000313117;ENST0000042 5778;ENST00000425941;ENST00000446327;ENST00000409276;ENST00000431066;ENST00000443213 | TAF |
| 19% | chr2 | 38983894 | 38983132 | − | chr2 | 38977336 | 38977156 | − | ENST00000313117;ENST0000042 | TAF |

TABLE 26-continued

Transcript fusion for Head-Neck Squamous Cell Carcinoma HNSC) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| | 19% | chr2 | 38983894 | 38983132 | − | chr2 | 38977336 | 38977156 | − | 5778;ENST00000425941;ENST000 00446327;ENST00000409276;ENS T00000431066;ENST00000443213 ENST00000313117;ENST0000042 5778;ENST00000425941;ENST000 00446327;ENST00000409276;ENS T00000431066;ENST00000443213 | TAF |
| | 19% | chr2 | 38983894 | 38983132 | − | chr2 | 38977336 | 38977156 | − | ENST00000313117;ENST0000042 5778;ENST00000425941;ENST000 00446327;ENST00000409276;ENS T00000431066;ENST00000443213 | TAF |
| | 19% | chr2 | 38983894 | 38983132 | − | chr2 | 38977336 | 38977156 | − | ENST00000313117;ENST0000042 5778;ENST00000425941;ENST000 00446327;ENST00000409276;ENS T00000431066;ENST00000443213 | TAF |
| | 18% | chr7 | 56018506 | 56018522 | + | chr7 | 56020872 | 56021011 | + | ENST00000426595 | TSF |
| | 16% | chr11 | 70006969 | 70007088 | + | chr11 | 70007267 | 70007468 | + | ENST00000355303;ENST0000039 8543;ENST00000538023;ENST000 00316296;ENST00000530676;ENS T00000531349;ENST00000531300 | TSF |
| | 16% | chr11 | 70006969 | 70007088 | + | chr11 | 70007267 | 70007468 | + | ENST00000355303;ENST0000039 8543;ENST00000538023;ENST000 00316296;ENST00000530676;ENS T00000531349;ENST00000531300 | TSF |
| | 16% | chr11 | 70006969 | 70007088 | + | chr11 | 70007267 | 70007468 | + | ENST00000355303;ENST0000039 8543;ENST00000538023;ENST000 00316296;ENST00000530676;ENS T00000531349;ENST00000531300 | TSF |
| | 16% | chr15 | 40187476 | 40186733 | − | chr15 | 40099459 | 40099207 | − | ENST00000561100;ENST0000054 3580 | TSF |
| | 15% | chr7 | 134233804 | 134234001 | + | chr7 | 134252910 | 134253077 | + | ENST00000457545;ENST0000042 3958 | TAF |
| | 15% | chr17 | 18390031 | 18390254 | + | chr17 | 18390961 | 18391071 | + | ENST00000581545;ENST0000058 2333;ENST00000328114;ENST000 00412421;ENST00000583322;ENS T00000584941 | TAF |
| | 15% | chr17 | 18390031 | 18390254 | + | chr17 | 18390961 | 18391071 | + | ENST00000581545;ENST0000058 2333;ENST00000328114;ENST000 00412421;ENST00000583322;ENS T00000584941 | TAF |
| | 15% | chr17 | 18390031 | 18390254 | + | chr17 | 18390961 | 18391071 | + | ENST00000581545;ENST0000058 2333;ENST00000328114;ENST000 00412421;ENST00000583322;ENS T00000584941 | TAF |
| | 15% | chr17 | 18390031 | 18390254 | + | chr17 | 18390961 | 18391071 | + | ENST00000581545;ENST0000058 2333;ENST00000328114;ENST000 00412421;ENST00000583322;ENS T00000584941 | TAF |
| | 15% | chr17 | 18390031 | 18390254 | + | chr17 | 18390961 | 18391071 | + | ENST00000581545;ENST0000058 2333;ENST00000328114;ENST000 00412421;ENST00000583322;ENS T00000584941 | TAF |
| | 15% | chr17 | 20360914 | 20360691 | − | chr17 | 20359984 | 20359874 | − | ENST00000423676;ENST0000032 4290 | TAF |
| | 15% | chr17 | 20360914 | 20360691 | − | chr17 | 20359984 | 20359874 | − | ENST00000423676;ENST0000032 4290 | TAF |
| | 15% | chr1 | 6380703 | 6380649 | − | chr1 | 6378638 | 6378552 | − | ENST00000608083;ENST0000037 7842;ENST00000377845;ENST000 00377855;ENST00000377860;ENS T00000418124;ENST00000545482; ENST00000361521;ENST0000047 3466;ENST00000541130 | TAF |
| | 15% | chr1 | 6380703 | 6380649 | − | chr1 | 6378638 | 6378552 | − | ENST00000608083;ENST0000037 7842;ENST00000377845;ENST000 00377855;ENST00000377860;ENS T00000418124;ENST00000545482; ENST00000361521;ENST0000047 3466;ENST00000541130 | TAF |
| | 15% | chr1 | 6380703 | 6380649 | − | chr1 | 6378638 | 6378552 | − | ENST00000608083;ENST0000037 7842;ENST00000377845;ENST000 00377855;ENST00000377860;ENS T00000418124;ENST00000545482 ;ENST00000361521;ENST0000047 3466;ENST00000541130 | TAF |
| | 15% | chr1 | 6380703 | 6380649 | − | chr1 | 6378638 | 6378552 | − | ENST00000608083;ENST0000037 | TAF |

TABLE 26-continued

Transcript fusion for Head-Neck Squamous Cell Carcinoma HNSC) Coordinates of
the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 15% | chr1 | 6380703 | 6380649 | − | chr1 | 6378638 | 6378552 | − | ENST00000608083;ENST0000037 7842;ENST00000377845;ENST000 00377855;ENST00000377860;ENS T00000418124;ENST00000545482; ENST00000361521;ENST0000047 3466;ENST00000541130 | TAF |
| 15% | chr1 | 6380703 | 6380649 | − | chr1 | 6378638 | 6378552 | − | ENST00000608083;ENST0000037 7842;ENST00000377845;ENST000 00377855;ENST00000377860;ENS T00000418124;ENST00000545482; ENST00000361521;ENST0000047 3466;ENST00000541130 | TAF |
| 14% | chr17 | 79214190 | 79214239 | + | chr17 | 79214787 | 79214816; 79214953 | + | ENST00000431388;ENST0000057 6002 | |
| 14% | chr17 | 79214190 | 79214239 | + | chr17 | 79214787 | 79214816; 79214953 | + | ENST00000431388;ENST0000057 6002 | TAF |
| 14% | chr17 | 30771499 | 30771536 | + | chr17 | 30773963 | 30774064 | + | ENST00000261712;ENST0000045 7654;ENST00000579451 | TAF |
| 14% | chr17 | 30771499 | 30771536 | + | chr17 | 30773963 | 30774064 | + | ENST00000261712;ENST0000045 7654;ENST00000579451 | TAF |
| 14% | chr9 | 128362212 | 128362114 | − | chr9 | 128348006 | 128347834 | − | ENST00000373511;ENST0000037 3498;ENST00000350766;ENST000 00265960;ENST00000394060;ENS T00000468896 | TAF |
| 14% | chr9 | 128362212 | 128362114 | − | chr9 | 128348006 | 128347834 | − | ENST00000373511;ENST0000037 3498;ENST00000350766;ENST000 00265960;ENST00000394060;ENS T00000468896 | TAF |
| 14% | chr9 | 128362212 | 128362114 | − | chr9 | 128348006 | 128347834 | − | ENST00000373511;ENST0000037 3498;ENST00000350766;ENST000 00265960;ENST00000394060;ENS T00000468896 | TAF |
| 14% | chr9 | 128362212 | 128362114 | − | chr9 | 128348006 | 128347834 | − | ENST00000373511;ENST0000037 3498;ENST00000350766;ENST000 00265960;ENST00000394060;ENS T00000468896 | TAF |
| 14% | chr9 | 128362212 | 128362114 | − | chr9 | 128348006 | 128347834 | − | ENST00000373511;ENST0000037 3498;ENST00000350766;ENST000 00265960;ENST00000394060;ENS T00000468896 | TAF |
| 14% | chr12 | 6602868 | 6602840 | − | chr12 | 6602138 | 6602028 | − | ENST00000229238 | TAF |
| 14% | chr4 | 89454580 | 89454120 | − | chr4 | 89443180 | 89443039 | − | ENST00000273968 | TAF |
| 13% | chr8 | 82194688 | 82194727 | 1 | chr8 | 82195601 | 82195773 | + | ENST00000297258 | TAF |
| 13% | chr16 | 48451457 | 48450727 | | chr16 | 48396341 | 48395491 | − | ENST00000356721 | TSF |
| 13% | chr2 | 173999600 | 173999766 | + | chr2 | 174034533 | 174034620 | + | ENST00000539448; ENST0000040 9176;ENST00000338983;ENST000 00375213;ENST00000422149 | TSF |
| 13% | chr2 | 173999600 | 173999766 | + | chr2 | 174034533 | 174034620 | + | ENST00000539448;ENST0000040 9176;ENST00000338983;ENST000 00375213;ENST00000422149 | TSF |
| 13% | chr2 | 173999600 | 173999766 | + | chr2 | 174034533 | 174034620 | + | ENST00000539448;ENST0000040 9176;ENST00000338983;ENST000 00375213;ENST00000422149 | TSF |
| 12% | chr12 | 86274449 | 86274547 | + | chr12 | 86276001 | 86276153 | + | ENST00000551529;ENST0000025 6010 | TAF |
| 12% | chr12 | 64687157 | 64687061 | − | chr12 | 64679840 | 64679734 | − | ENST00000543942;ENST0000033 3722 | TAF |
| 12% | chr9 | 119603649 | 119602932 | − | chr9 | 119583062 | 119582896 | − | ENST00000373996; ENST0000031 3400;ENST00000373986;ENST000 00361209 | TAF |
| 12% | chr18 | 9594227 | 9594127 | − | chr18 | 9593872 | 9593766; 9593838 | − | ENST00000400556;ENST0000040 0555;ENST00000584074;ENST000 00581250;ENST00000580745;ENS T00000580182;ENST00000582240; ENST00000581835 | TAF |
| 12% | chr18 | 9594227 | 9594127 | − | chr18 | 9593872 | 9593766; 9593838 | − | ENST00000400556;ENST0000040 0555;ENST00000584074;ENST000 00581250;ENST00000580745;ENS T00000580182;ENST00000582240; ENST00000581835 | TAF |
| 12% | chr18 | 9594227 | 9594127 | − | chr18 | 9593872 | 9593766; 9593838 | − | ENST00000400556;ENST0000040 0555;ENST00000584074;ENST000 00581250;ENST00000580745;ENS T00000580182;ENST00000582240; ENST00000581835 | TAF |
| 12% | chr18 | 9594227 | 9594127 | − | chr18 | 9593872 | 9593766; | − | ENST00000400556;ENST0000040 | TAF |

TABLE 26-continued

Transcript fusion for Head-Neck Squamous Cell Carcinoma HNSC) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
|  |  |  |  |  |  |  | 9593838 |  | 0555;ENST00000584074;ENST000 00581250;ENST00000580745;ENS T00000580182;ENST00000582240; ENST00000581835 |  |
| 12% | chr18 | 9594227 | 9594127 | − | chr18 | 9593872 | 9593766; 9593838 | − | ENST00000400556;ENST0000040 0555;ENST00000584074;ENST000 00581250;ENST00000580745;ENS T00000580182;ENST00000582240; ENST00000581835 | TAF |
| 12% | chr18 | 9594227 | 9594127 | − | chr18 | 9593872 | 9593766; 9593838 | − | ENST00000400556;ENST0000040 0555;ENST00000584074;ENST000 00581250;ENST00000580745;ENS T00000580182;ENST00000582240; ENST00000581835 | TAF |
| 12% | chr18 | 9594227 | 9594127 | − | chr18 | 9593872 | 9593766; 9593838 | − | ENST00000400556;ENST0000040 0555;ENST00000584074;ENST000 00581250;ENST00000580745;ENS T00000580182;ENST00000582240; ENST00000581835 | TAF |
| 11% | chr6 | 138424848 | 138424827 | − | chr6 | 138417631 | 138417491 | − | ENST00000421351 | TAF |
| 11% | chr17 | 39740464 | 39740452 | − | chr17 | 39740173 | 39740012 | − | ENST00000167586 | TAF |
| 11% | chr12 | 14506971 | 14507749 | + | chr12 | 14576843 | 14578407 | + | ENST00000544627 | TSF |
| 10% | chr19 | 39347374 | 39346635 | − | chr19 | 39338074 | 39337956 | − | ENST00000221419;ENST0000060 1449;ENST00000600233;ENST000 00601813 | TAF |
| 10% | chr19 | 39347374 | 39346635 | − | chr19 | 39338074 | 39337956 | − | ENST00000221419;ENST0000060 1449;ENST00000600233;ENST000 00601813 | TAF |
| 10% | chr19 | 39347374 | 39346635 | − | chr19 | 39338074 | 39337956 | − | ENST00000221419;ENST0000060 1449;ENST00000600233;ENST000 00601813 | TAF |
| 10% | chr9 | 119603649 | 119602972 | − | chr9 | 119583062 | 119582896 | − | ENST00000373996;ENST0000031 3400;ENST00000373986;ENST000 00361209 | TSF |
| 10% | chr11 | 60694460 | 60694542 | + | chr11 | 60694676 | 60694890 | + | ENST00000453848; ENST0000000 5286 | TSF |
| 10% | chr11 | 60694460 | 60694542 | + | chr11 | 60694676 | 60694890 | + | ENST00000453848;ENST0000000 5286 | TSF |
| 10% | chr2 | 65243329 | 65243368 | + | chr2 | 65243574 | 65243807 | + | ENST00000234256 | TSF |
| 10% | chr9 | 117824597 | 117824593 | − | chr9 | 117822281 | 117822009 | − | ENST00000350763;ENST0000034 1037;ENST00000423613 | TSF |
| 10% | chr9 | 117824597 | 117824593 | − | chr9 | 117822281 | 117822009 | − | ENST00000350763;ENST0000034 1037;ENST00000423613 | TSF |
| 10% | chr9 | 117824597 | 117824593 | − | chr9 | 117822281 | 117822009 | − | ENST00000350763;ENST0000034 1037;ENST00000423613 | TSF |
| 9% | chr19 | 56811235 | 56811344 | + | chr19 | 56813337 | 56813464 | + | ENST00000588026 | TSF |
| 9% | chr12 | 122430912 | 122432103 | + | chr12 | 122437622 | 122437850 | + | ENST00000288912 | TSF |
| 9% | chr12 | 122430912 | 122431795 | + | chr12 | 122437622 | 122437850 | + | ENST00000288912 | TSF |
| 9% | chr6 | 80022917 | 80022085 | − | chr6 | 79924739 | 79924689 | − | ENST00000275036;ENST0000034 4726 | TSF |
| 9% | chr6 | 80022917 | 80022085 | − | chr6 | 79924739 | 79924689 | − | ENST00000275036;ENST0000034 4726 | TSF |
| 8% | chr17 | 17816540 | 17815566 | − | chr17 | 17810845 | 17810761 | − | ENST00000581396;ENST0000037 9504;ENST00000318094;ENST000 00395739;ENST00000535933;ENS T00000540946;ENST00000542206 | TSF |
| 8% | chr17 | 17816540 | 17815566 | − | chr17 | 17810845 | 17810761 | − | ENST00000581396;ENST0000037 9504;ENST00000318094;ENST000 00395739;ENST00000535933;ENS T00000540946;ENST00000542206 | TSF |
| 8% | chr17 | 17816540 | 17815566 | − | chr17 | 17810845 | 17810761 | − | ENST00000581396;ENST0000037 9504;ENST00000318094;ENST000 00395739;ENST00000535933;ENS T00000540946;ENST00000542206 | TSF |
| 8% | chr17 | 17816540 | 17815566 | − | chr17 | 17810845 | 17810761 | − | ENST00000581396;ENST0000037 9504;ENST00000318094;ENST000 00395739;ENST00000535933;ENS T00000540946;ENST00000542206 | TSF |
| 8% | chr17 | 17816540 | 17815566 | − | chr17 | 17810845 | 17810761 | − | ENST00000581396;ENST0000037 9504;ENST00000318094;ENST000 00395739;ENST00000535933;ENS T00000540946;ENST00000542206 | TSF |
| 8% | chr17 | 17816540 | 17815566 | − | chr17 | 17810845 | 17810761 | − | ENST00000581396;ENST0000037 9504;ENST00000318094;ENST000 00395739;ENS | TSF |

TABLE 26-continued

Transcript fusion for Head-Neck Squamous Cell Carcinoma HNSC) Coordinates of
the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 8% | chr20 | 8624404 | 8625147 | + | chr20 | 8626749 | 8626828 | + | T00000540946;ENST00000542206 ENST00000378641;ENST0000033 8037;ENST00000378637;ENST000 00404098 | ITSF |
| 8% | chr20 | 8624404 | 8625147 | + | chr20 | 8626749 | 8626828 | + | ENST00000378641;ENST0000033 8037;ENST00000378637;ENST000 00404098 | TSF |
| 8% | chr20 | 8624404 | 8625147 | + | chr20 | 8626749 | 8626828 | + | ENST00000378641;ENST0000033 8037;ENST00000378637;ENST000 00404098 | TSF |
| 8% | chr10 | 79700435 | 79700428 | − | chr10 | 79628955 | 79628887 | − | ENST00000372391;ENST0000037 2388;ENST00000468332 | TSF |
| 8% | chr10 | 79700435 | 79700428 | − | chr10 | 79628955 | 79628887 | − | ENST00000372391;ENST0000037 2388;ENST00000468332 | TSF |
| 8% | chr10 | 79700435 | 79700428 | − | chr10 | 79628955 | 79628887 | − | ENST00000372391;ENST0000037 2388;ENST00000468332 | TSF |
| 8% | chr7 | 48039730 | 48039725 | − | chr7 | 48035743 | 48035628 | − | ENST00000453071;ENST0000029 7325;ENST00000412371;ENST000 00412142;ENST00000395572;ENS T00000453192;ENST00000438771 | TSF |
| 8% | chr7 | 48039730 | 48039725 | − | chr7 | 48035743 | 48035628 | − | ENST00000453071;ENST0000029 7325;ENST00000412371;ENST000 00412142;ENST00000395572;ENS T00000453192;ENST00000438771 | TSF |
| 8% | chr7 | 48039730 | 48039725 | − | chr7 | 48035743 | 48035628 | − | ENST00000453071;ENST0000029 7325;ENST00000412371;ENST000 00412142;ENST00000395572;ENS T00000453192;ENST00000438771 | TSF |
| 7% | chr11 | 60934781 | 60933962 | − | chr11 | 60901679 | 60901508 | − | ENST00000301765;ENST0000053 8036 | TSF |
| 7% | chr11 | 60934781 | 60933962 | − | chr11 | 60901679 | 60901508 | − | ENST00000301765;ENST0000053 8036 | TSF |
| 7% | chr12 | 58189709 | 58189746 | + | chr12 | 58189960 | 58190366; 58189980; 58190044 | + | ENST00000454289;ENST0000054 0550;ENST00000323833;ENST000 00350762;ENST00000457189 | TSF |
| 7% | chr12 | 58189709 | 58189746 | + | chr12 | 58189960 | 58190366; 58189980; 58190044 | + | ENST00000454289;ENST0000054 0550;ENST00000323833;ENST000 00350762;ENST00000457189 | TSF |
| 7% | chr12 | 58189709 | 58189746 | + | chr12 | 58189960 | 58190366; 58189980; 58190044 | + | ENST00000454289;ENST0000054 0550;ENST00000323833;ENST000 00350762;ENST00000457189 | TSF |
| 6% | chr3 | 130586141 | 130586877 | + | chr3 | 130649260 | 130649370 | + | ENST00000393221;ENST0000053 3801;ENST00000510168;ENST000 00508532;ENST00000505072;ENS T00000509662;ENST00000328560; ENST00000428331;ENST0000035 9644;ENST00000422190 | TSF |
| 6% | chr3 | 130586141 | 130586877 | + | chr3 | 130649260 | 130649370 | + | ENST00000393221;ENST0000053 3801;ENST00000510168;ENST000 00508532;ENST00000505072;ENS T00000509662;ENST00000328560; ENST00000428331;ENST0000035 9644;ENST00000422190 | TSF |
| 6% | chr3 | 130586141 | 130586877 | + | chr3 | 130649260 | 130649370 | + | ENST00000393221;ENST0000053 3801;ENST00000510168;ENST000 00508532;ENST00000505072;ENS T00000509662;ENST00000328560; ENST00000428331;ENST0000035 9644;ENST00000422190 | TSF |
| 6% | chr3 | 130586141 | 130586877 | + | chr3 | 130649260 | 130649370 | + | ENST00000393221;ENST0000053 3801;ENST00000510168;ENST000 00508532;ENST00000505072;ENS T00000509662;ENST00000328560; ENST00000428331;ENST0000035 9644;ENST00000422190 | TSF |
| 6% | chr3 | 130586141 | 130586877 | + | chr3 | 130649260 | 130649370 | + | ENST00000393221;ENST0000053 3801;ENST00000510168;ENST000 00508532;ENST00000505072;ENS T00000509662;ENST00000328560; ENST00000428331;ENST0000035 9644;ENST00000422190 | TSF |
| 6% | chr3 | 130586141 | 130586877 | + | chr3 | 130649260 | 130649370 | + | ENST00000393221;ENST0000053 3801;ENST00000510168;ENST000 00508532;ENST00000505072;ENS T00000509662;ENST00000328560; | TSF |

TABLE 26-continued

Transcript fusion for Head-Neck Squamous Cell Carcinoma HNSC) Coordinates of
the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 6% | chr3 | 130586141 | 130586877 | + | chr3 | 130649260 | 130649370 | + | ENST00000428331;ENST00000359644;ENST00000422190 ENST00000393221;ENST00000533801;ENST00000510168;ENST00000508532;ENST00000505072;ENST00000509662;ENST00000328560; ENST00000428331;ENST00000359644;ENST00000422190 | TSF |
| 6% | chr12 | 122430912 | 122432282 | + | chr12 | 122437622 | 122437850 | + | ENST00000288912 | TSF |
| 6% | chr3 | 197640178 | 197640160 | – | chr3 | 197639620 | 197639546 | – | ENST00000265239;ENST00000455191 | TSF |
| 6% | chr5 | 52897435; 52897700 | 52897704 | + | chr5 | 52899282 | 52899360 | + | ENST00000502423;ENST00000296684;ENST00000506974;ENST00000506765 | TSF |
| 6% | chr5 | 52897435; 52897700 | 52897704 | + | chr5 | 52899282 | 52899360 | + | ENST00000502423;ENST00000296684;ENST00000506974;ENST00000506765 | TSF |
| 6% | chr5 | 52897435; 52897700 | 52897704 | + | chr5 | 52899282 | 52899360 | + | ENST00000502423; ENST00000296684;ENST00000506974;ENST00000506765 | TSF |
| 6% | chr5 | 52897435; 52897700 | 52897704 | + | chr5 | 52899282 | 52899360 | + | ENST00000502423;ENST00000296684;ENST00000506974;ENST00000506765 | TSF |
| 6% | chr5 | 52897435; 52897700 | 52897704 | + | chr5 | 52899282 | 52899360 | + | ENST00000502423;ENST00000296684;ENST00000506974;ENST00000506765 | TSF |
| 6% | chr5 | 52897435; 52897700 | 52897704 | + | chr5 | 52899282 | 52899360 | + | ENST00000502423;ENST00000296684;ENST00000506974;ENST00000506765 | TSF |
| 6% | chr5 | 52897435; 52897700 | 52897704 | + | chr5 | 52899282 | 52899360 | + | ENST00000502423;ENST00000296684;ENST00000506974;ENST00000506765 | TSF |
| 6% | chr5 | 52897435; 52897700 | 52897704 | + | chr5 | 52899282 | 52899360 | + | ENST00000502423;ENST00000296684;ENST00000506974;ENST00000506765 | TSF |
| 5% | chr12 | 96340433 | 96341255 | + | chr12 | 96346495 | 96346601 | + | ENST00000266736;ENST00000548310 | TSF |
| 5% | chr12 | 96340433 | 96341255 | + | chr12 | 96346495 | 96346601 | + | ENST00000266736;ENST00000548310 | TSF |
| 5% | chr1 | 1562829 | 1562973 | + | chr1 | 1563053 | 1563209 | + | ENST00000520777;ENST00000357210;ENST00000360522;ENST00000378710;ENST00000355826;ENST00000518681;ENST00000505820;ENST00000487053;ENST00000378712;ENST00000504599;ENST00000378708;ENST00000514234 | TSF |
| 5% | chr1 | 1562829 | 1562973 | + | chr1 | 1563053 | 1563209 | + | ENST00000520777;ENST00000357210;ENST00000360522;ENST00000378710;ENST00000355826;ENST00000518681;ENST00000505820;ENST00000487053;ENST00000378712;ENST00000504599;ENST00000378708;ENST00000514234 | TSF |
| 5% | chr1 | 1562829 | 1562973 | + | chr1 | 1563053 | 1563209 | + | ENST00000520777;ENST00000357210;ENST00000360522;ENST00000378710;ENST00000355826;ENST00000518681;ENST00000505820;ENST00000487053;ENST00000378712;ENST00000504599;ENST00000378708;ENST00000514234 | TSF |
| 5% | chr1 | 1562829 | 1562926 | + | chr1 | 1563053 | 1563209 | + | ENST00000520777;ENST00000357210;ENST00000360522;ENST00000378710;ENST00000355826;ENST00000518681;ENST00000505820;ENST00000487053;ENST00000378712;ENST00000504599;ENST00000378708;ENST00000514234 | TSF |
| 5% | chr1 | 1562829 | 1562926 | + | chr1 | 1563053 | 1563209 | + | ENST00000520777;ENST00000357210;ENST00000360522;ENST00000378710;ENST00000355826;ENST00000518681;ENST00000505820;ENST00000487053;ENST00000378712;ENST00000504599;ENST00000378708;ENST00000514234 | TSF |
| 5% | chr1 | 1562829 | 1562926 | + | chr1 | 1563053 | 1563209 | + | ENST00000520777;ENST0000035 | TSF |

TABLE 26-continued

Transcript fusion for Head-Neck Squamous Cell Carcinoma HNSC) Coordinates of
the fusion sequences for which the donor is the TE.

| 1 | 2' | 3' | 4' | 5' | 6' | 7' | 8' | 9' | 10' | 11' |
|---|---|---|---|---|---|---|---|---|---|---|
|  |  |  |  |  |  |  |  |  | 7210;ENST00000360522;ENST000 00378710;ENST00000355826;ENS T00000518681;ENST00000505820; ENST00000487053;ENST0000037 8712;ENST00000504599;ENST000 00378708;ENST00000514234 |  |
| 5% | chr1 | 1562829 | 1562875 | + | chr1 | 1563053 | 1563209 | + | ENST00000520777;ENST0000035 7210;ENST00000360522;ENST000 00378710;ENST00000355826;ENS T00000518681;ENST00000505820; ENST00000487053;ENST0000037 8712;ENST00000504599;ENST000 00378708;ENST00000514234 | TSF |
| 5% | chr1 | 1562829 | 1562875 | + | chr1 | 1563053 | 1563209 | + | ENST00000520777;ENST0000035 7210;ENST00000360522;ENST000 00378710;ENST00000355826;ENS T00000518681;ENST00000505820; ENST00000487053;ENST0000037 8712;ENST00000504599;ENST000 00378708;ENST00000514234 | TSF |
| 5% | chr1 | 1562829 | 1562875 | + | chr1 | 1563053 | 1563209 | + | ENST00000520777;ENST0000035 7210;ENST00000360522;ENST000 00378710;ENST00000355826;ENS T00000518681;ENST00000505820; ENST00000487053;ENST0000037 8712;ENST00000504599;ENST000 00378708;ENST00000514234 | TSF |
| 5% | chr3 | 130586141 | 130586917 | + | chr3 | 130649260 | 130649370 | + | ENST00000393221;ENST0000053 3801;ENST00000510168;ENST000 00508532;ENST00000505072;ENS T00000509662;ENST00000328560; ENST00000428331;ENST0000035 9644; ENST00000422190 | TSF |
| 5% | chr3 | 130586141 | 130586917 | + | chr3 | 130649260 | 130649370 | + | ENST00000393221;ENST0000053 3801;ENST00000510168;ENST000 00508532;ENST00000505072;ENS T00000509662;ENST00000328560; ENST00000428331;ENST0000035 9644; ENST00000422190 | TSF |
| 5% | chr3 | 130586141 | 130586917 | + | chr3 | 130649260 | 130649370 | + | ENST00000393221;ENST0000053 3801;ENST00000510168;ENST000 00508532;ENST00000505072;ENS T00000509662;ENST00000328560; ENST00000428331;ENST0000035 9644; ENST00000422190 | TSF |
| 5% | chr3 | 130586141 | 130586917 | + | chr3 | 130649260 | 130649370 | + | ENST00000393221;ENST0000053 3801;ENST00000510168;ENST000 00508532;ENST00000505072;ENS T00000509662;ENST00000328560; ENST00000428331;ENST0000035 9644; ENST00000422190 | TSF |
| 5% | chr3 | 130586141 | 130586917 | + | chr3 | 130649260 | 130649370 | + | ENST00000393221;ENST0000053 3801;ENST00000510168;ENST000 00508532;ENST00000505072;ENS T00000509662;ENST00000328560; ENST00000428331;ENST0000035 9644; ENST00000422190 | TSF |
| 5% | chr3 | 130586141 | 130586917 | + | chr3 | 130649260 | 130649370 | + | ENST00000393221;ENST0000053 3801;ENST00000510168;ENST000 00508532;ENST00000505072;ENS T00000509662;ENST00000328560; ENST00000428331;ENST0000035 9644; ENST00000422190 | TSF |
| 5% | chr3 | 130586141 | 130586917 | + | chr3 | 130649260 | 130649370 | + | ENST00000393221;ENST0000053 3801;ENST00000510168;ENST000 00508532;ENST00000505072;ENS T00000509662;ENST00000328560; ENST00000428331;ENST0000035 9644; ENST00000422190 | TSF |
| 5% | chr2 | 38983894 | 38983086 | − | chr2 | 38977336 | 38977156 | − | ENST00000313117;ENST0000042 5778;ENST00000425941;ENST000 00446327;ENST00000409276;ENS T00000431066;ENST00000443213 | TSF |
| 5% | chr2 | 38983894 | 38983086 | − | chr2 | 38977336 | 38977156 | − | ENST00000313117;ENST0000042 5778;ENST00000425941;ENST000 | TSF |

TABLE 26-continued

Transcript fusion for Head-Neck Squamous Cell Carcinoma HNSC) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 5% | chr2 | 38983894 | 38983086 | − | chr2 | 38977336 | 38977156 | − | 00446327;ENST00000409276;ENST00000431066;ENST00000443213 ENST00000313117;ENST00000425778;ENST00000425941;ENST00000446327;ENST00000409276;ENST00000431066;ENST00000443213 | TSF |
| 5% | chr2 | 38983894 | 38983086 | − | chr2 | 38977336 | 38977156 | − | ENST00000313117;ENST00000425778;ENST00000425941;ENST00000446327;ENST00000409276;ENST00000431066;ENST00000443213 | TSF |
| 5% | chr2 | 38983894 | 38983086 | − | chr2 | 38977336 | 38977156 | − | ENST00000313117;ENST00000425778;ENST00000425941;ENST00000446327;ENST00000409276;ENST00000431066;ENST00000443213 | TSF |
| 5% | chr7 | 44158417 | 44158351 | − | chr7 | 44157663 | 44157542 | − | ENST00000406581;ENST000002233361;ENST00000452185;ENST00000433715;ENST00000456038;ENST00000418438 | TSF |
| 5% | chr7 | 44158417 | 44158351 | − | chr7 | 44157663 | 44157542 | − | ENST00000406581;ENST000002233361;ENST00000452185;ENST00000433715;ENST00000456038;ENST00000418438 | TSF |
| 5% | chr7 | 44158417 | 44158351 | − | chr7 | 44157663 | 44157542 | − | ENST00000406581;ENST000002233361;ENST00000452185;ENST00000433715;ENST00000456038;ENST00000418438 | TSF |
| 5% | chr7 | 44158417 | 44158351 | − | chr7 | 44157663 | 44157542 | − | ENST00000406581;ENST000002233361;ENST00000452185;ENST00000433715;ENST00000456038;ENST00000418438 | TSF |
| 5% | chr7 | 44158417 | 44158351 | − | chr7 | 44157663 | 44157542 | − | ENST00000406581;ENST000002233361;ENST00000452185;ENST00000433715;ENST00000456038;ENST00000418438 | TSF |
| 5% | chr10 | 99600727 | 99601473 | + | chr10 | 99619215 | 99619340 | + | ENST00000370602 | TSF |
| 5% | chr19 | 35979015 | 35978880 | − | chr19 | 35978661 | 35978614 | − | ENST00000484218;ENST000000338897 | TSF |
| 5% | chr8 | 91107662 | 91105645 | − | chr8 | 91094330 | 91094254 | − | ENST00000265431 | TSF |
| 5% | chr8 | 82194688 | 82194723 | 1 | chr8 | 82195601 | 82195773 | + | ENST00000297258 | TSF |
| 5% | chr14 | 20973494 | 20974255 | + | chr14 | 20978626 | 20979281 | + | ENST00000430083 | TSF |
| 5% | chr16 | 53866877 | 53867152 | + | chr16 | 53878067 | 53878210; 53878156 | + | ENST00000471389;ENST000000464071 | TSF |
| 5% | chr16 | 53866877 | 53867152 | + | chr16 | 53878067 | 53878210; 53878156 | + | ENST00000471389;ENST000000464071 | TSF |
| 5% | chr11 | 66354487 | 66355279 | + | chr11 | 66361113 | 66361185 | + | ENST00000533244;ENST000000530961 | TSF |
| 5% | chr11 | 66354487 | 66355279 | + | chr11 | 66361113 | 66361185 | + | ENST00000533244;ENST000000530961 | TSF |
| 5% | chrX | 138072952 | 138072670 | − | chrX | 137939841 | 137939674 | − | ENST00000370603;ENST000000436198;ENST00000455663;ENST00000448673 | TSF |
| 5% | chrX | 138072952 | 138072670 | − | chrX | 137939841 | 137939674 | − | ENST00000370603;ENST000000436198;ENST00000455663;ENST00000448673 | TSF |
| 5% | chrX | 138072952 | 138072670 | − | chrX | 137939841 | 137939674 | − | ENST00000370603;ENST000000436198;ENST00000455663;ENST00000448673 | TSF |
| 5% | chrX | 138072952 | 138072670 | − | chrX | 137939841 | 137939674 | − | ENST00000370603;ENST000000436198;ENST00000455663;ENST00000448673 | TSF |
| 5% | chr6 | 161637963 | 161637691 | − | chr6 | 161587449 | 161587280; 161587148 | − | ENST00000320285;ENST000003666908;ENST00000436279;ENST00000366905 | TSF |
| 5% | chr6 | 161637963 | 161637691 | − | chr6 | 161587449 | 161587280; 161587148 | − | ENST00000320285;ENST000003666908;ENST00000436279;ENST00000366905 | TSF |
| 5% | chr6 | 161637963 | 161637691 | − | chr6 | 161587449 | 161587280; 161587148 | − | ENST00000320285;ENST000003666908;ENST00000436279;ENST00000366905 | TSF |
| 4% | chr12 | 14506971 | 14507672 | + | chr12 | 14576843 | 14578407 | + | ENST00000544627 | TSF |
| 4% | chr12 | 122387836 | 122388242 | + | chr12 | 122394980 | 122395174 | + | ENST00000288912;ENST000000397454 | TSF |
| 4% | chr12 | 122387836 | 122388242 | + | chr12 | 122394980 | 122395174 | + | ENST00000288912;ENST000000397454 | TSF |
| 4% | chr3 | 48252382 | 48252880 | + | chr3 | 48265844 | 48265951 | + | ENST00000296435;ENST0000057 | TSF |

TABLE 26-continued

Transcript fusion for Head-Neck Squamous Cell Carcinoma HNSC) Coordinates of
the fusion sequences for which the donor is the TE.

| 1 | 2' | 3' | 4' | 5' | 6' | 7' | 8' | 9' | 10' | 11' |
|---|---|---|---|---|---|---|---|---|---|---|
| | | | | | | | | 6243 | |
| 4% | chr1 | 1422590 | 1422685 | + | chr1 | 1423243 | 1423294 | + | ENST00000308647 | TSF |
| 4% | chr12 | 122430912 | 122431578 | + | chr12 | 122439403 | 122439504 | + | ENST00000288912 | TSF |
| 4% | chr19 | 48627094 | 48627044 | − | chr19 | 48626575 | 48626431 | − | ENST00000263274;ENST0000053 6218;ENST00000594759;ENST000 00427526;ENST00000601091 | TSF |
| 4% | chr19 | 48627094 | 48627044 | − | chr19 | 48626575 | 48626431 | − | ENST00000263274;ENST0000053 6218;ENST00000594759;ENST000 00427526;ENST00000601091 | TSF |
| 4% | chr5 | 167685522 | 167685690 | + | chr5 | 167687288 | 167687418 | + | ENST00000518659;ENST0000054 5108;ENST00000519204;ENST000 00520394; ENST00000403607 | TSF |
| 4% | chr1 | 6366296 | 6365480 | − | chr1 | 6355040 | 6354924 | − | ENST00000608083;ENST0000037 7842;ENST00000377845;ENST000 00377855;ENST00000377860;ENS T00000418124;ENST00000545482; ENST00000361521;ENST0000047 3466 | TSF |
| 4% | chr1 | 6366296 | 6365480 | − | chr1 | 6355040 | 6354924 | − | ENST00000608083;ENST0000037 7842;ENST00000377845;ENST000 00377855;ENST00000377860;ENS T00000418124;ENST00000545482; ENST00000361521;ENST0000047 3466 | TSF |
| 4% | chr1 | 6366296 | 6365480 | − | chr1 | 6355040 | 6354924 | − | ENST00000608083;ENST0000037 7842;ENST00000377845;ENST000 00377855;ENST00000377860;ENS T00000418124;ENST00000545482; ENST00000361521;ENST0000047 3466 | TSF |
| 4% | chr1 | 6366296 | 6365480 | − | chr1 | 6355040 | 6354924 | − | ENST00000608083;ENST0000037 7842;ENST00000377845;ENST000 00377855;ENST00000377860;ENS T00000418124;ENST00000545482; ENST00000361521;ENST0000047 3466 | TSF |
| 4% | chr1 | 27143965 | 27144423 | + | chr1 | 27158938 | 27159098 | + | ENST00000374142 | TSF |
| 4% | chr12 | 122430912 | 122431655 | + | chr12 | 122439403 | 122439504 | + | ENST00000288912 | TSF |
| 4% | chr10 | 105819324 | 105819196 | − | chr10 | 105817948 | 105817904 | − | ENST00000353479;ENST0000036 9733 | TSF |
| 4% | chr10 | 105819324 | 105819196 | − | chr10 | 105817948 | 105817904 | − | ENST00000353479;ENST0000036 9733 | TSF |
| 3% | chr17 | 45698288 | 45698367 | + | chr17 | 45699134 | 45699286 | + | ENST00000530173;ENST0000032 2157;ENST00000544660;ENST000 00528565 | TSF |
| 3% | chr14 | 51360331 | 51362440 | + | chr14 | 51368547 | 51368629 | + | ENST00000337334;ENST0000035 3130;ENST00000395752 | TSF |
| 3% | chr22 | 36652278 | 36652346 | + | chr22 | 36653129 | 36653182 | + | ENST00000397278;ENST0000042 2706;ENST00000319136;ENST000 00422471;ENST00000438034;ENS T00000427990;ENST00000397279; ENST00000433768;ENST0000044 0669;ENST00000431184 | TSF |
| 3% | chr22 | 36652278 | 36652346 | + | chr22 | 36653129 | 36653182 | + | ENST00000397278;ENST0000042 2706;ENST00000319136;ENST000 00422471;ENST00000438034;ENS T00000427990;ENST00000397279; ENST00000433768;ENST0000044 0669;ENST00000431184 | TSF |
| 3% | chr22 | 36652278 | 36652346 | + | chr22 | 36653129 | 36653182 | + | ENST00000397278;ENST0000042 2706;ENST00000319136;ENST000 00422471;ENST00000438034;ENS T00000427990;ENST00000397279; ENST00000433768;ENST0000044 0669;ENST00000431184 | TSF |
| 3% | chr22 | 36652278 | 36652346 | + | chr22 | 36653129 | 36653182 | + | ENST00000397278;ENST0000042 2706;ENST00000319136;ENST000 00422471;ENST00000438034;ENS T00000427990;ENST00000397279; ENST00000433768;ENST0000044 0669;ENST00000431184 | TSF |
| 3% | chr22 | 36652278 | 36652346 | + | chr22 | 36653129 | 36653182 | + | ENST00000397278;ENST0000042 2706;ENST00000319136;ENST000 00422471;ENST00000438034;ENS T00000427990;ENST00000397279; | TSF |

TABLE 26-continued

Transcript fusion for Head-Neck Squamous Cell Carcinoma HNSC) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 3% | chr22 | 36652278 | 36652346 | + | chr22 | 36653129 | 36653182 | + | ENST00000433768;ENST0000044 0669;ENST00000431184 ENST00000397278;ENST0000042 2706;ENST00000319136;ENST000 00422471;ENST00000438034;ENS T00000427990;ENST00000397279; ENST00000433768;ENST0000044 0669;ENST00000431184 | TSF |
| 3% | chr7 | 56018506 | 56018522 | + | chr7 | 56022602 | 56022871; 56022865 | + | ENST00000426595;ENST0000028 5298;ENST00000443449 | TSF |
| 3% | chr7 | 56018506 | 56018522 | + | chr7 | 56022602 | 56022871; 56022865 | + | ENST00000426595;ENST0000028 5298;ENST00000443449 | TSF |
| 3% | chr15 | 74004214 | 74004264 | + | chr15 | 74005275 | 74005297 | + | ENST00000318443;ENST0000053 7340;ENST00000318424;ENST000 00564751;ENST00000561176;ENS T00000559073 | TSF |
| 3% | chr1 | 44446234 | 44446286 | + | chr1 | 44446781 | 44447145 | + | ENST00000309519 | TSF |
| 3% | chr1 | 41465686 | 41465756 | + | chr1 | 41466701 | 41466789 | + | ENST00000372621;ENST0000054 1520;ENST00000372616 | TSF |
| 3% | chr15 | 73976790 | 73976801 | + | chr15 | 73994596 | 73994914; 73994934; 73994926; 73994838; 73994671 | + | ENST00000567189;ENST0000031 8443;ENST00000318424;ENST000 00558689;ENST00000560786;ENS T00000561213;ENST00000563584; ENST00000561416;ENST0000056 0995;ENST00000561260;ENST000 00564751 | TSF |
| 3% | chr15 | 73976790 | 73976801 | + | chr15 | 73994596 | 73994914; 73994934; 73994926; 73994838; 73994671 | + | ENST00000567189;ENST0000031 8443;ENST00000318424;ENST000 00558689;ENST00000560786;ENS T00000561213;ENST00000563584; ENST00000561416;ENST0000056 0995;ENST00000561260;ENST000 00564751 | TSF |
| 3% | chr15 | 73976790 | 73976801 | + | chr15 | 73994596 | 73994914; 73994934; 73994926; 73994838; 73994671 | + | ENST00000567189;ENST0000031 8443;ENST00000318424;ENST000 00558689;ENST00000560786;ENS T00000561213;ENST00000563584; ENST00000561416;ENST0000056 0995;ENST00000561260;ENST000 00564751 | TSF |
| 3% | chr15 | 73976790 | 73976801 | + | chr15 | 73994596 | 73994914; 73994934; 73994926; 73994838; 73994671 | + | ENST00000567189;ENST0000031 8443;ENST00000318424;ENST000 00558689;ENST00000560786;ENS T00000561213;ENST00000563584; ENST00000561416;ENST0000056 0995;ENST00000561260;ENST000 00564751 | TSF |
| 3% | chr15 | 73976790 | 73976801 | + | chr15 | 73994596 | 73994914; 73994934; 73994926; 73994838; 73994671 | + | ENST00000567189;ENST0000031 8443;ENST00000318424;ENST000 00558689;ENST00000560786;ENS T00000561213;ENST00000563584; ENST00000561416;ENST0000056 0995;ENST00000561260;ENST000 00564751 | TSF |
| 3% | chr15 | 73976790 | 73976801 | + | chr15 | 73994596 | 73994914; 73994934; 73994926; 73994838; 73994671 | + | ENST00000567189;ENST0000031 8443;ENST00000318424;ENST000 00558689;ENST00000560786;ENS T00000561213; ENST00000563584; ENST00000561416;ENST0000056 0995;ENST00000561260;ENST000 00564751 | TSF |
| 3% | chr15 | 73976790 | 73976801 | + | chr15 | 73994596 | 73994914; 73994934; 73994926; 73994838; 73994671 | + | ENST00000567189;ENST0000031 8443;ENST00000318424;ENST000 00558689;ENST00000560786;ENS T00000561213; ENST00000563584; ENST00000561416;ENST0000056 0995;ENST00000561260;ENST000 00564751 | TSF |
| 3% | chr15 | 73976790 | 73976801 | + | chr15 | 73994596 | 73994914; 73994934; 73994926; 73994838; 73994671 | + | ENST00000567189;ENST0000031 8443;ENST00000318424;ENST000 00558689;ENST00000560786;ENS T00000561213; ENST00000563584; ENST00000561416;ENST0000056 0995;ENST00000561260;ENST000 00564751 | TSF |

TABLE 26-continued

Transcript fusion for Head-Neck Squamous Cell Carcinoma HNSC) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 3% | chr15 | 73976790 | 73976801 | + | chr15 | 73994596 | 73994914; 73994934; 73994926; 73994838; 73994671 | + | ENST00000567189;ENST0000031 8443;ENST00000318424;ENST000 00558689;ENST00000560786;ENS T00000561213; ENST00000563584; ENST00000561416;ENST0000056 0995;ENST00000561260;ENST000 00564751 | TSF |
| 3% | chr22 | 29117574 | 29117506 | − | chr22 | 29115473 | 29115383; 29115458 | − | ENST00000348295;ENST0000038 2566;ENST00000382578;ENST000 00404276;ENST00000328354;ENS T00000405598;ENST00000382580; ENST00000433728;ENST0000044 8511;ENST00000402731;ENST000 00403642;ENST00000439200 | TSF |
| 3% | chr22 | 29117574 | 29117506 | − | chr22 | 29115473 | 29115383; 29115458 | − | ENST00000348295;ENST0000038 2566;ENST00000382578;ENST000 00404276;ENST00000328354;ENS T00000405598;ENST00000382580; ENST00000433728;ENST0000044 8511;ENST00000402731;ENST000 00403642;ENST00000439200 | TSF |
| 3% | chr22 | 29117574 | 29117506 | − | chr22 | 29115473 | 29115383; 29115458 | − | ENST00000348295;ENST0000038 2566;ENST00000382578;ENST000 00404276;ENST00000328354;ENS T00000405598;ENST00000382580; ENST00000433728;ENST0000044 8511;ENST00000402731;ENST000 00403642;ENST00000439200 | TSF |
| 3% | chr22 | 29117574 | 29117506 | − | chr22 | 29115473 | 29115383; 29115458 | − | ENST00000348295;ENST0000038 2566;ENST00000382578;ENST000 00404276;ENST00000328354;ENS T00000405598;ENST00000382580; ENST00000433728;ENST0000044 8511;ENST00000402731;ENST000 00403642;ENST00000439200 | TSF |
| 3% | chr22 | 29117574 | 29117506 | − | chr22 | 29115473 | 29115383; 29115458 | − | ENST00000348295;ENST0000038 2566;ENST00000382578;ENST000 00404276;ENST00000328354;ENS T00000405598;ENST00000382580; ENST00000433728;ENST0000044 8511;ENST00000402731;ENST000 00403642;ENST00000439200 | TSF |
| 3% | chr15 | 83667946 | 83667078 | − | chr15 | 83657580 | 83657392 | − | ENST00000514272 | TSF |
| 3% | chr1 | 156716197 | 156716133 | − | chr1 | 156715165 | 156715089 | − | ENST00000357325;ENST0000053 7739;ENST00000368209;ENST000 00368206 | TSF |
| 3% | chr12 | 6602868 | 6602754 | − | chr12 | 6602138 | 6602028 | − | ENST00000229238 | TSF |
| 3% | chr17 | 39737300 | 39737191 | − | chr17 | 39726472 | 39726390 | − | ENST00000246662 | TSF |
| 3% | chr11 | 66354487 | 66355279 | + | chr11 | 66366587 | 66366724 | + | ENST00000533244;ENST0000053 0961;ENST00000310190 | TSF |
| 3% | chr11 | 66354487 | 66355279 | + | chr11 | 66366587 | 66366724 | + | ENST00000533244;ENST0000053 0961;ENST00000310190 | TSF |
| 3% | chr20 | 10400592 | 10400319 | − | chr20 | 10389451 | 10389276 | − | ENST00000347364; ENST0000039 9054 | TSF |
| 3% | chr22 | 38182207 | 38182899 | + | chr22 | 38206034 | 38206164 | + | ENST00000323205;ENST0000024 8924;ENST00000445195;ENST000 00451984 | TSF |
| 3% | chr22 | 38182207 | 38182899 | + | chr22 | 38206034 | 38206164 | + | ENST00000323205;ENST0000024 8924;ENST00000445195;ENST000 00451984 | TSF |
| 3% | chr22 | 38182207 | 38182899 | + | chr22 | 38206034 | 38206164 | + | ENST00000323205; ENST0000024 8924;ENST00000445195;ENST000 00451984 | TSF |
| 3% | chr17 | 17816540 | 17815655 | − | chr17 | 17810845 | 17810761 | − | ENST00000581396;ENST0000037 9504;ENST00000318094;ENST000 00395739;ENST00000535933;ENS T00000540946;ENST00000542206 | TSF |
| 3% | chr17 | 17816540 | 17815655 | − | chr17 | 17810845 | 17810761 | − | ENST00000581396;ENST0000037 9504;ENST00000318094;ENST000 00395739;ENST00000535933;ENS T00000540946;ENST00000542206 | TSF |
| 3% | chr17 | 17816540 | 17815655 | − | chr17 | 17810845 | 17810761 | − | ENST00000581396;ENST0000037 9504;ENST00000318094;ENST000 00395739;ENST00000535933;ENS T00000540946;ENST00000542206 | TSF |

TABLE 26-continued

Transcript fusion for Head-Neck Squamous Cell Carcinoma HNSC) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 3% | chr17 | 17816540 | 17815655 | – | chr17 | 17810845 | 17810761 | – | ENST00000581396;ENST00000379504;ENST00000318094;ENST00000395739;ENST00000535933;ENST00000540946;ENST00000542206 | TSF |
| 3% | chr17 | 17816540 | 17815655 | – | chr17 | 17810845 | 17810761 | – | ENST00000581396;ENST00000379504;ENST00000318094;ENST00000395739;ENST00000535933;ENST00000540946;ENST00000542206 | TSF |
| 3% | chr17 | 17816540 | 17815655 | – | chr17 | 17810845 | 17810761 | – | ENST00000581396;ENST00000379504;ENST00000318094;ENST00000395739;ENST00000535933;ENST00000540946;ENST00000542206 | TSF |
| 3% | chr14 | 20974370 | 20974386 | + | chr14 | 20978626 | 20979281 | + | ENST00000430083 | TSF |
| 3% | chr17 | 15873243 | 15873282 | + | chr17 | 15877993 | 15878656 | + | ENST00000304222 | TSF |
| 3% | chr20 | 8624404 | 8625224 | + | chr20 | 8626749 | 8626828 | + | ENST00000378641;ENST00000338037;ENST00000378637;ENST00000404098 | TSF |
| 3% | chr20 | 8624404 | 8625224 | + | chr20 | 8626749 | 8626828 | + | ENST00000378641;ENST00000338037;ENST00000378637;ENST00000404098 | TSF |
| 3% | chr20 | 8624404 | 8625224 | + | chr20 | 8626749 | 8626828 | + | ENST00000378641;ENST00000338037;ENST00000378637;ENST00000404098 | TSF |
| 3% | chr1 | 15562769 | 15563257 | + | chr1 | 15578267 | 15578373 | + | ENST00000433640 | TSF |
| 3% | chr15 | 83667946 | 83667078 | – | chr15 | 83660798 | 83660684 | – | ENST00000451195 | TSF |
| 3% | chr17 | 38639751 | 38639593 | – | chr17 | 38638668 | 38638576 | – | ENST00000254051 | TSF |
| 3% | chr1 | 6366296 | 6365322 | – | chr1 | 6355040 | 6354924 | – | ENST00000608083;ENST00000377842;ENST00000377845;ENST00000377855;ENST00000377860;ENST00000418124; ENST00000545482;ENST00000361521;ENST00000473466 | TSF |
| 3% | chr1 | 6366296 | 6365322 | – | chr1 | 6355040 | 6354924 | – | ENST00000608083;ENST00000377842;ENST00000377845;ENST00000377855;ENST00000377860;ENST00000418124;ENST00000545482;ENST00000361521;ENST00000473466 | TSF |
| 3% | chr1 | 6366296 | 6365322 | – | chr1 | 6355040 | 6354924 | – | ENST00000608083;ENST00000377842;ENST00000377845;ENST00000377855;ENST00000377860;ENST00000418124;ENST00000545482;ENST00000361521;ENST00000473466 | TSF |
| 3% | chr1 | 6366296 | 6365322 | – | chr1 | 6355040 | 6354924 | – | ENST00000608083;ENST00000377842;ENST00000377845;ENST00000377855;ENST00000377860;ENST00000418124;ENST00000545482;ENST00000361521;ENST00000473466 | TSF |
| 3% | chrX | 134954053 | 134953756 | – | chrX | 134950187 | 134950078 | – | ENST00000420087;ENST00000463085;ENST00000370724;ENST00000491480 | TSF |
| 3% | chrX | 134954053 | 134953756 | – | chrX | 134950187 | 134950078 | – | ENST00000420087;ENST00000463085;ENST00000370724;ENST00000491480 | TSF |
| 2% | chr10 | 101420120 | 101420239 | + | chr10 | 101421203 | 101421385 | + | ENST00000370489 | TSF |
| 2% | chr14 | 20973494 | 20974295 | + | chr14 | 20978626 | 20979281 | + | ENST00000430083 | TSF |
| 2% | chr3 | 48252382 | 48252840 | + | chr3 | 48265844 | 48265951 | + | ENST00000296435;ENST00000576243 | TSF |
| 2% | chr4 | 15791827 | 15792504 | 1 | chr4 | 15818134 | 15818263 | + | ENST00000502843;ENST00000226279 | TSF |
| 2% | chr4 | 15791827 | 15792504 | + | chr4 | 15818134 | 15818263 | + | ENST00000502843;ENST00000226279 | TSF |
| 2% | chr17 | 39974832 | 39974893 | + | chr17 | 39975462 | 39975651 | + | ENST00000321562 | TSF |
| 2% | chr11 | 66953459 | 66954052 | + | chr11 | 66974981 | 66975159 | + | ENST00000398645;ENST00000529006 | TSF |
| 2% | chr11 | 66953459 | 66954052 | + | chr11 | 66974981 | 66975159 | + | ENST00000398645;ENST00000529006 | TSF |
| 2% | chr19 | 1114930 | 1114676 | – | chr19 | 1114421 | 1114230 | – | ENST00000361757;ENST00000587024;ENST00000438103 | TSF |
| 2% | chr2 | 163165782 | 163165417 | – | chr2 | 163163365 | 163163219 | – | ENST00000263642 | TSF |
| 2% | chr8 | 134314977 | 134314886 | – | chr8 | 134296572 | 134296492 | – | ENST00000520230;ENST00000520943;ENST00000522738 | TSF |
| 2% | chr8 | 134314977 | 134314886 | – | chr8 | 134296572 | 134296492 | – | ENST00000520230;ENST00000520943;ENST00000522738 | TSF |

TABLE 26-continued

Transcript fusion for Head-Neck Squamous Cell Carcinoma HNSC) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 2% | chr8 | 134314977 | 134314886 | − | chr8 | 134296572 | 134296492 | − | ENST00000520230;ENST00000520943;ENST00000522738 | TSF |
| 2% | chrX | 134971303 | 134971006 | − | chrX | 134950187 | 134950078 | − | ENST00000420087;ENST00000463085;ENST00000370724;ENST00000491480 | TSF |
| 2% | chrX | 134971303 | 134971006 | − | chrX | 134950187 | 134950078 | − | ENST00000420087;ENST00000463085;ENST00000370724;ENST00000491480 | TSF |
| 2% | chrX | 134971303 | 134971006 | − | chrX | 134967437 | 134967328 | − | ENST00000491002; ENST00000448053;ENST00000472834 | TSF |
| 2% | chr6 | 117763870 | 117763597 | − | chr6 | 117739669 | 117739625 | − | ENST00000368507;ENST00000368508 | TSF |
| 2% | chr6 | 117763870 | 117763597 | − | chr6 | 117739669 | 117739625 | − | ENST00000368507;ENST00000368508 | TSF |
| 2% | chr19 | 45184732 | 45184798 | + | chr19 | 45185839 | 45185892 | + | ENST00000358777;ENST00000403660 | TSF |
| 2% | chr19 | 45184732 | 45184798 | + | chr19 | 45185839 | 45185892 | + | ENST00000358777;ENST00000403660 | TSF |
| 2% | chr7 | 55477082 | 55477474 | + | chr7 | 55479600 | 55479782 | + | ENST00000254770 | TSF |
| 2% | chrX | 134866155 | 134866452 | + | chrX | 134870023 | 134870132 | + | ENST00000370736;ENST00000471213;ENST00000495729 | TSF |
| 2% | chr7 | 134212336 | 134212386 | + | chr7 | 134215479 | 134215562 | + | ENST00000359579 | TSF |
| 2% | chr17 | 7479605 | 7479718 | + | chr17 | 7479842 | 7480008; 7480010; 7479924 | + | ENST00000582169;ENST00000293831;ENST00000585024;ENST00000583802;ENST00000581544;ENST00000577269;ENST00000584784;ENST00000582746;ENST00000584860;ENST00000581384 | TSF |
| 2% | chr17 | 7479605 | 7479718 | + | chr17 | 7479842 | 7480008; 7480010; 7479924 | + | ENST00000582169;ENST00000293831;ENST00000585024;ENST00000583802;ENST00000581544;ENST00000577269;ENST00000584784;ENST00000582746;ENST00000584860;ENST00000581384 | TSF |
| 2% | chr17 | 7479605 | 7479718 | + | chr17 | 7479842 | 7480008; 7480010; 7479924 | + | ENST00000582169;ENST00000293831;ENST00000585024;ENST00000583802;ENST00000581544;ENST00000577269;ENST00000584784;ENST00000582746;ENST00000584860;ENST00000581384 | TSF |
| 2% | chr17 | 7479605 | 7479718 | + | chr17 | 7479842 | 7480008; 7480010; 7479924 | + | ENST00000582169;ENST00000293831;ENST00000585024;ENST00000583802;ENST00000581544;ENST00000577269;ENST00000584784;ENST00000582746;ENST00000584860;ENST00000581384 | TSF |
| 2% | chr17 | 7479605 | 7479718 | + | chr17 | 7479842 | 7480008; 7480010; 7479924 | + | ENST00000582169;ENST00000293831;ENST00000585024;ENST00000583802;ENST00000581544;ENST00000577269;ENST00000584784;ENST00000582746;ENST00000584860;ENST00000581384 | TSF |
| 2% | chr17 | 7479605 | 7479718 | + | chr17 | 7479842 | 7480008; 7480010; 7479924 | + | ENST00000582169;ENST00000293831;ENST00000585024;ENST00000583802;ENST00000581544;ENST00000577269;ENST00000584784;ENST00000582746;ENST00000584860;ENST00000581384 | TSF |
| 2% | chr17 | 7479605 | 7479718 | + | chr17 | 7479842 | 7480008; 7480010; 7479924 | + | ENST00000582169;ENST00000293831;ENST00000585024;ENST00000583802;ENST00000581544;ENST00000577269;ENST00000584784;ENST00000582746;ENST00000584860;ENST00000581384 | TSF |
| 2% | chr17 | 7479605 | 7479718 | + | chr17 | 7479842 | 7480008; 7480010; 7479924 | + | ENST00000582169;ENST00000293831;ENST00000585024;ENST00000583802;ENST00000581544;ENST00000577269;ENST00000584784;ENST00000582746;ENST00000584860;ENST00000581384 | TSF |
| 2% | chr17 | 7479605 | 7479718 | + | chr17 | 7479842 | 7480008; 7480010; 7479924 | + | ENST00000582169;ENST00000293831;ENST00000585024;ENST00000583802;ENST00000581544;ENST00000577269;ENST00000584784;ENST00000582746;ENST0000058 | TSF |

TABLE 26-continued

Transcript fusion for Head-Neck Squamous Cell Carcinoma HNSC) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 2% | chr17 | 7479605 | 7479718 | + | chr17 | 7479842 | 7480008; 7480010; 7479924 | + | 4860;ENST00000581384 ENST00000582169;ENST00000293831;ENST00000585024;ENST00000583802;ENST00000581544;ENST00000577269;ENST00000584784; ENST00000582746;ENST00000584860;ENST00000581384 | TSF |
| 2% | chr7 | 74480763 | 74480881 | + | chr7 | 74528191 | 74528329 | + | ENST00000356115;ENST00000430511;ENST00000312575;ENST00000423666 | TSF |
| 2% | chr7 | 74480763 | 74480881 | + | chr7 | 74528191 | 74528329 | + | ENST00000356115;ENST00000430511;ENST00000312575;ENST00000423666 | TSF |
| 2% | chr7 | 74480763 | 74480881 | + | chr7 | 74528191 | 74528329 | + | ENST00000356115;ENST00000430511;ENST00000312575;ENST00000423666 | TSF |
| 2% | chrX | 134883429 | 134883726 | + | chrX | 134887292 | 134887401 | + | ENST00000370734;ENST00000485366;ENST00000443882 | TSF |
| 2% | chr7 | 22512874 | 22512791 | − | chr7 | 22459455 | 22459423 | − | ENST00000406890 | TSF |
| 2% | chrX | 134954053 | 134953756 | − | chrX | 134932924 | 134932815 | − | ENST00000487941;ENST000004 4966;ENST00000494421 | TSF |
| 2% | chr11 | 93468219 | 93468129 | − | chr11 | 93466563 | 93466528 | − | ENST00000393259 | TSF |
| 2% | chr7 | 100850556 | 100850506 | − | chr7 | 100850185 | 100850060 | − | ENST00000454310;ENST00000223127 | TSF |
| 2% | chrX | 134936794 | 134936497 | − | chrX | 134932924 | 134932815 | − | ENST00000487941;ENST000004 4966;ENST00000494421 | TSF |
| 2% | chr2 | 143794737 | 143794842 | + | chr2 | 143797997 | 143798227 | + | ENST00000264170;ENST000004 09512 | TSF |
| 2% | chr20 | 60878087 | 60878105 | + | chr20 | 60878775 | 60878837 | + | ENST00000253003 | TSF |
| 2% | chr2 | 28630786 | 28630878 | + | chr2 | 28631626 | 28631733 | + | ENST00000379619;ENST00000264716,ENST00000436647;.ENST00000545753 | TSF |
| 2% | chr2 | 28630786 | 28630878 | + | chr2 | 28631626 | 28631733 | + | ENST00000379619;ENST00000264716,ENST00000436647;.ENST00000545753 | TSF |
| 2% | chr2 | 28630786 | 28630878 | + | chr2 | 28631626 | 28631733 | + | ENST00000379619;ENST00000264716,ENST00000436647;.ENST00000545753 | TSF |
| 2% | chr22 | 24967426 | 24967475 | + | chr22 | 24967884 | 24967945 | + | ENST00000215829;ENST00000404603 | TSF |
| 2% | chr7 | 56020443 | 56020541 | + | chr7 | 56020872 | 56021011 | + | ENST00000426595 | TSF |
| 2% | chr9 | 131902050 | 131902148 | + | chr9 | 131904724 | 131904831; 131905179 | + | ENST00000358994;ENST00000393370;ENST00000337738;ENST00000348141;ENST00000452489;ENST00000357197;ENST00000347048; ENST00000355007;ENST00000417728;ENST00000411917;ENST00000423100;ENST00000524946;ENST000000436883;ENST000004 14510; ENST00000432124;ENST00000435305;ENST00000419582;ENST00000432651;ENST00000435132;ENST000000434095 | TSF |
| 2% | chr9 | 131902050 | 131902148 | + | chr9 | 131904724 | 131904831; 131905179 | + | ENST00000358994;ENST00000393370;ENST00000337738;ENST00000348141;ENST00000452489;ENST00000357197;ENST00000347048; ENST00000355007;ENST00000417728;ENST00000411917;ENST00000423100;ENST00000524946;ENST000000436883;ENST000004 14510; ENST00000432124;ENST00000435305;ENST00000419582;ENST00000432651;ENST00000435132;ENST000000434095 | TSF |
| 2% | chr9 | 131902050 | 131902148 | + | chr9 | 131904724 | 131904831; 131905179 | + | ENST00000358994;ENST00000393370;ENST00000337738;ENST00000348141;ENST00000452489;ENST00000357197;ENST00000347048; ENST00000355007;ENST00000417728;ENST00000411917;ENST00000423100;ENST00000524946;ENST000000436883;ENST000004 14510; ENST00000432124;ENST00000435305;ENST00000419582;ENST0000 | TSF |

TABLE 26-continued

Transcript fusion for Head-Neck Squamous Cell Carcinoma HNSC) Coordinates of
the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 2% | chr9 | 131902050 | 131902148 | + | chr9 | 131904724 | 131904831; 131905179 | + | 00432651;ENST00000435132;ENST000000434095 ENST00000358994;ENST00000393370;ENST00000337738;ENST00000348141;ENST00000452489;ENST00000357197;ENST00000347048; ENST00000355007;ENST00000417728;ENST00000411917;ENST00000423100;ENST00000524946;ENST000000436883;ENST000004 14510; ENST00000432124;ENST00000435305;ENST00000419582;ENST00000432651;ENST00000435132;ENST000000434095 | TSF |
| 2% | chr9 | 131902050 | 131902148 | + | chr9 | 131904724 | 131904831; 131905179 | + | ENST00000358994;ENST00000393370;ENST00000337738;ENST00000348141;ENST00000452489;ENST00000357197;ENST00000347048; ENST00000355007;ENST00000417728;ENST00000411917;ENST00000423100;ENST00000524946;ENST000000436883;ENST000004 14510; ENST00000432124;ENST00000435305;ENST00000419582;ENST00000432651;ENST00000435132;ENST000000434095 | TSF |
| 2% | chr1 | 117473681 | 117473836 | + | chr1 | 117484337 | 117484705 | + | ENST00000393203 | TSF |
| 2% | chrX | 134866155 | 1134866452 | + | chrX | 134887292 | 134887401 | + | ENST00000370734;ENST000000485366,ENST00000443882 | TSF |
| 2% | chr8 | 128749913 | 128749923 | + | chr8 | 128750494 | 128751265 | + | ENST00000377970 | TSF |
| 2% | chr1 | 169819657 | 1169819707 | + | chr1 | 169820958 | 1169821077 | | ENST00000359326;ENST00000286031 | TSF |
| 2% | chr1 | 55517012 | 155517126 | + | chr1 | 55517951 | 55518084 | + | ENST00000302118 | TSF |
| 2% | chr12 | 10104813 | 10105636 | + | chr12 | 10124176 | 10124286 | + | ENST00000355690 | TSF |
| 2% | chrX | 134971303 | 134971006 | − | chrX | 134932924 | 134932815 | − | ENST00000487941;ENST000000434966;ENST00000494421 | TSF |
| 2% | chr20 | 634541 | 634468 | − | chr20 | 1629561 | 629358; 629500 | − | ENST00000381962;ENST000000488788 | TSF |
| 2% | chr20 | 634541 | 634468 | − | chr20 | 1629561 | 629358; 629500 | − | ENST00000381962;ENST000000488788 | TSF |
| 2% | chr8 | 63949410 | 63948932 | − | chr8 | 163948329 | 63948215 | − | ENST00000260118 TSF | |
| 2% | chr15 | 40186558 | 40186430 | − | chr15 | 140099459 | 140099207 | − | ENST00000561100;ENST000000543580 | TSF |
| 2% | chrX | 151410500 | 151410406 | − | chrX | 151393317 | 151393235 | − | ENST00000370314;ENST000000535043 | TSF |
| 2% | chr20 | 10628319 | 10628254 | − | chr20 | 10627751 | 10627587 | − | ENST00000254958;ENST000000423891 | TSF |
| 2% | chr12 | 96302230 | 196301326 | − | chr12 | 96300229 | 96300165 | − | ENST00000344280 | TSF |
| 2% | chr1 | 17371820 | 17371636 | − | chr1 | 17371383 | 17371256 | − | ENST00000375499 | TSF |
| 2% | chr12 | 110306235 | 110306193 | − | chr12 | 110296546 | 110296488 | − | ENST00000318348;ENST000000544393;ENST00000540772;ENST0000000536390;ENST0000053 7066 | TSF |
| 2% | chr12 | 110306235 | 110306193 | − | chr12 | 110296546 | 110296488 | − | ENST00000318348;ENST000000544393;ENST00000540772;ENST0000000536390;ENST0000053 7066 | TSF |
| 2% | chr12 | 110306235 | 110306193 | − | chr12 | 110296546 | 110296488 | − | ENST00000318348;ENST000000544393;ENST00000540772;ENST0000000536390;ENST00000537066 | TSF |
| 2% | chr12 | 110306235 | 110306193 | − | chr12 | 110296546 | 110296488 | − | ENST00000318348;ENST000000544393;ENST00000540772;ENST0000000536390;ENST0000053 7066 | TSF |
| 2% | chr15 | 40186285 | 40186077 | − | chr15 | 140099459 | 140099207 | − | ENST00000561100;ENST000000543580 | TSF |
| 2% | chr2 | 220120254 | 220120037 | − | chr2 | 220116952 | 220116730 | − | ENST00000248437;ENST000000456818;ENST00000425551 | TSF |
| 2% | chr2 | 220120254 | 220120037 | − | chr2 | 220116952 | 220116730 | − | ENST00000248437;ENST000000456818;ENST00000425551 | TSF |
| 2% | chr2 | 220120254 | 220120037 | − | chr2 | 220116952 | 220116730 | − | ENST00000248437;ENST000000456818;ENST00000425551 | TSF |
| 2% | chr22 | 28326858 | 28326682 | − | chr22 | 28310335 | 28310305 | − | ENST00000335272;ENST000000320996;ENST00000455418;ENST00000436663 | TSF |
| 2% | chr22 | 28326858 | 28326682 | − | chr22 | 28310335 | 28310305 | − | ENST00000335272;ENST000000320996;ENST00000455418;ENST00000436663 | TSF |

TABLE 26-continued

Transcript fusion for Head-Neck Squamous Cell Carcinoma HNSC) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 2% | chr22 | 28326858 | 28326682 | − | chr22 | 28310335 | 28310305 | | ENST00000335272;ENST00000320996;ENST00000455418;ENST00000436663 | TSF |
| 2% | chr7 | 99801794 | 199801819 | + | chr | 99802250 | 99802398 | + | ENST00000426455;ENST00000394018;ENST00000317296 | TSF |
| 2% | chr1 | 36637256 | 136637320 | + | chr1 | 36638065 | 36638228; 36638141 | + | ENST00000429533;ENST00000316156,ENST00000373150;ENST00000373151;ENST00000530729 | TSF |
| 2% | chr1 | 36637256 | 136637320 | + | chr1 | 36638065 | 36638228; 36638141 | + | ENST00000429533;ENST00000316156,ENST00000373150;ENST00000373151;ENST00000530729 | TSF |
| 2% | chr1 | 36637256 | 136637320 | + | chr1 | 36638065 | 36638228; 36638141 | + | ENST00000429533;ENST00000316156,ENST00000373150;ENST00000373151;ENST00000530729 | TSF |
| 2% | chr1 | 36637256 | 136637320 | + | chr1 | 36638065 | 36638228; 36638141 | + | ENST00000429533;ENST00000316156,ENST00000373150;ENST00000373151;ENST00000530729 | TSF |
| 2% | chr1 | 36637256 | 136637320 | + | chr1 | 36638065 | 36638228; 36638141 | + | ENST00000429533;ENST00000316156,ENST00000373150;ENST00000373151;ENST00000530729 | TSF |
| 2% | chr19 | 4412258 | 4412399 | + | chr19 | 4418017 | 4418073 | + | ENST00000301280 | TSF |
| 2% | chr9 | 137326382 | 1137326400 | + | chr9 | 137328313 | 137328460 | + | ENST00000481739;ENST00000540193 | TSF |
| 2% | chr9 | 134363954 | 134364268 | + | chr9 | 134366812 | 134366967 | + | ENST00000405995;ENST000003577304;ENST00000458550;ENST00000372249;ENST00000320547 | TSF |
| 2% | chr9 | 134363954 | 134364268 | + | chr9 | 134366812 | 134366967 | + | ENST00000405995;ENST000003577304;ENST00000458550;ENST00000372249;ENST00000320547 | TSF |
| 2% | chr1 | 168348640 | 168349020 | + | chr1 | 168549301 | 168549415 | + | ENST00000367818 | TSF |
| 2% | chr12 | 49659927 | 49660025 | + | chr12 | 49663248 | 49663470; 49663252 | + | ENST00000541364;ENST00000552125;ENST00000301072;ENST00000549183 | TSF |
| 2% | chr12 | 49659927 | 49660025 | + | chr12 | 49663248 | 49663470; 49663252 | + | ENST00000541364;ENST00000552125;ENST00000301072;ENST00000549183 | TSF |
| 2% | chr12 | 49659927 | 49660025 | + | chr12 | 49663248 | 49663470; 49663252 | + | ENST00000541364;ENST00000552125;ENST00000301072;ENST00000549183 | TSF |
| 2% | chr20 | 19966479 | 119966639 | + | chr20 | 119970650 | 119970955 | + | ENST00000255006;ENST00000440354 | TSF |
| 2% | chr1 | 31218846 | 31218765 | − | chr1 | 3121539%6 | 31215303 | − | ENST00000294507 | TSF |
| 2% | chr8 | 91102885 | 191102521 | − | chrs | 91094330 | 91094254 | − | ENST00000265431 | TSF |
| 2% | chr1 | 8924664 | 8924519 | − | chr1 | 8924151 | 8923950 | − | ENST00000234590 | TSF |
| 2% | chr116 | 74833301 | 74833256 | − | chr16 | 74774013 | 74773921 | − | ENST00000219368;ENST000000567683;ENST00000569949 | TSF |
| 2% | chr116 | 74833301 | 74833256 | − | chr16 | 74774013 | 74773921 | − | ENST00000219368;ENST000000567683;ENST00000569949 | TSF |
| 2% | chr116 | 74833301 | 74833256 | − | chr16 | 74774013 | 74773921 | − | ENST00000219368;ENST000000567683;ENST00000569949 | TSF |
| 2% | chr1 | 217698243 | 217697476 | − | chr1 | 217688231 | 217688164 | − | ENST00000366935 | TSF |
| 2% | chr8 | 91108096 | 191107732 | − | chr§ | 91094330 | 91094254 | − | ENST00000265431 | TSF |
| 2% | chr12 | 96302230 | 196301454 | − | chr12 | 96300229 | 96300165 | − | ENST00000344280 | TSF |
| 2% | chr3 | 99883880 | 199884005 | + | chr3 | 99885179 | 99885238 | + | ENST00000421999;ENST000000489081;ENST00000478909;ENST00000497345 | TSF |
| 2% | chr3 | 99883880 | 199884005 | + | chr3 | 99885179 | 99885238 | + | ENST00000421999;ENST000000489081;ENST00000478909;ENST00000497345 | TSF |
| 2% | chr3 | 99883880 | 199884005 | + | chr3 | 99885179 | 99885238 | + | ENST00000421999;ENST000000489081;ENST00000478909;ENST00000497345 | TSF |
| 2% | chr10 | 99600727 | 199601513 | + | chr10 | 199619215 | 99619340 | + | ENST00000370602 | TSF |
| 2% | chr3 | 136680342 | 136680413 | + | chr3 | 136699308 | 1136699434 | + | ENST00000329582 | TSF |
| 2% | chr22 | 43552142 | 43552306 | + | chr22 | 143557058 | 43557196 | + | ENST00000337554;ENST000000428336,ENST00000329563 | TSF |
| 2% | chr22 | 43552142 | 43552306 | + | chr22 | 143557058 | 43557196 | + | ENST00000337554;ENST000000428336,ENST00000329563 | TSF |
| 2% | chr5 | 167653877 | 167654073 | + | chrs | 167654900 | 1167655135 | + | ENST00000518659;ENST00000545108;ENST00000519204;ENST00000520394;ENST00000403607 | TSF |
| 2% | chr11 | 60694460 | 160694539 | + | chr11 | 160694676 | 60694890 | + | ENST00000453848;ENST000000005286 | TSF |
| 2% | chr11 | 60694460 | 160694539 | + | chr11 | 160694676 | 60694890 | + | ENST00000453848;ENST000000005286 | TSF |

TABLE 26-continued

Transcript fusion for Head-Neck Squamous Cell Carcinoma HNSC) Coordinates of
the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 2% | chr19 | 45289567 | 45289633 | + | chr19 | 45293261 | 45293348 | + | ENST00000270279;ENST0000034 1505 | TSF |
| 2% | chr12 | 52908876 | 152908919 | + | chr12 | 52908758 | 52908726 | − | ENST00000252242 | TSF |
| 2% | chr10 | 5057417 | 5057095 | − | chr10 | 5043873 | 5043706 | − | ENST00000380753;ENST0000042 1196;ENST00000407674;ENST0000 00604507;ENST00000455190 | TSF |
| 2% | chr10 | 5057417 | 5057095 | − | chr10 | 5043873 | 5043706 | − | ENST00000380753;ENST0000042 1196;ENST00000407674;ENST0000 00604507;ENST00000455190 | TSF |
| 2% | chr10 | 5057417 | 5057095 | − | chr10 | 5043873 | 5043706 | − | ENST00000380753;ENST0000042 1196;ENST00000407674;ENST0000 00604507;ENST00000455190 | TSF |
| 2% | chr10 | 5057417 | 5057095 | − | chr10 | 5043873 | 5043706 | − | ENST00000380753;ENST0000042 1196;ENST00000407674;ENST0000 00604507;ENST00000455190 | TSF |
| 2% | chr12 | 14670381 | 14670239 | − | chr12 | 14664645 | 14664445 | − | ENST00000240617 | TSF |
| 2% | chr1 | 153431306 | 153431207 | − | chr1 | 153430446 | 153430282 | − | ENST00000368722;ENST0000036 8723 | TSF |
| 2% | chr15 | 101823470 | 101823443 | − | chr15 | 101821987 | 101821929; 101821950 | − | ENST00000254193;ENST0000056 0496 | TSF |
| 2% | chr15 | 101823470 | 101823443 | − | chr15 | 101821987 | 101821929; 101821950 | − | ENST00000254193;ENST0000056 0496 | TSF |
| 2% | chr15 | 40186285 | 40186255 | − | chr15 | 140099459 | 140099207 | − | ENST00000561100;ENST0000054 3580 | TSF |
| 2% | chr22 | 40898710 | 40898220 | − | chr22 | 40859290 | 40859225 | − | ENST00000422851 | TSF |
| 2% | chr15 | 40187476 | 40186657 | − | chr15 | 140099459 | 140099207 | − | ENST00000561100;ENST0000054 3580 | TSF |
| 2% | chr17 | 43537130 | 43536749 | − | chr17 | 43531638 | 43530721 | − | ENST00000430334;ENST0000042 1073 | TSF |
| 2% | chrX | 154534914 | 154534773 | − | chrX | 154528458 | 154528349 | − | ENST00000369449;ENST0000032 1926 | TSF |
| 2% | chrX | 154534914 | 154534773 | − | chrX | 154528458 | 154528349 | − | ENST00000369449;ENST0000032 1926 | TSF |
| 1% | chr3 | 183460031 | 183460733 | + | chr3 | 183465460 | 183465504 | + | ENST00000305135 | TSF |
| 1% | chr20 | 36393263 | 36393294 | + | chr20 | 36393599 | 36393692; 36393614 | + | ENST00000361383;ENST0000044 7935;ENST00000405275;ENST0000 00373473 | TSF |
| 1% | chr20 | 36393263 | 36393294 | + | chr20 | 36393599 | 36393692; 36393614 | + | ENST00000361383;ENST0000044 7935;ENST00000405275;ENST0000 00373473 | TSF |
| 1% | chr1 | 20940040 | 20940086 | + | chr1 | 20940335 | 20940392 | + | ENST00000375071 | TSF |
| 1% | chr19 | 35613389 | 35613502 | + | ch919 | 35613669 | 35613862; 35613743; 35613858 | + | ENST00000406242;ENST0000060 4404;ENST00000435734;ENST0000 00603181;ENST00000604255;ENS T00000344013;ENST00000346446; ENST00000406988;ENST0000060 5550;ENST00000604804;ENST0000 00535103;ENST00000603524;ENS T00000604621;ENST00000605677 | TSF |
| 1% | chr19 | 35613389 | 35613502 | + | chr19 | 35613669 | 35613862; 35613743; 35613858 | + | ENST00000406242;ENST0000060 4404;ENST00000435734;ENST0000 00603181;ENST00000604255;ENS T00000344013;ENST00000346446; ENST00000406988;ENST0000060 5550;ENST00000604804;ENST0000 00535103;ENST00000603524;ENS T00000604621;ENST00000605677 | TSF |
| 1% | chr19 | 35613389 | 35613502 | + | chr19 | 35613669 | 35613862; 35613743; 35613858 | + | ENST00000406242;ENST0000060 4404;ENST00000435734;ENST0000 00603181;ENST00000604255;ENS T00000344013;ENST00000346446; ENST00000406988;ENST0000060 5550;ENST00000604804;ENST0000 00535103;ENST00000603524;ENS T00000604621;ENST00000605677 | TSF |
| 1% | chr19 | 35613389 | 35613502 | + | chr19 | 35613669 | 35613862; 35613743; 35613858 | + | ENST00000406242;ENST0000060 4404;ENST00000435734;ENST0000 00603181;ENST00000604255;ENS T00000344013;ENST00000346446; ENST00000406988;ENST0000060 5550;ENST00000604804;ENST0000 00535103;ENST00000603524;ENS T00000604621;ENST00000605677 | TSF |
| 1% | chr21 | 42801857 | 42802535 | + | chr21 | 42811621 | 42811775 | + | ENST00000398600;ENST0000039 8598;ENST00000455164;ENST0000 | TSF |

TABLE 26-continued

Transcript fusion for Head-Neck Squamous Cell Carcinoma HNSC) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 1% | chr21 | 42801857 | 42802535 | + | chr21 | 42811621 | 42811775 | + | 00424365;ENST00000417963;ENST000000288383<br>ENST00000398600;ENST00000398598;ENST00000455164;ENST0000000424365;ENST00000417963;ENST000000288383 | TSF |
| 1% | chr21 | 42801857 | 42802535 | + | chr21 | 42811621 | 42811775 | + | ENST00000398600;ENST00000398598;ENST00000455164;ENST0000000424365;ENST00000417963;ENST00000288383 | TSF |
| 1% | chr3 | 100461913 | 100462018 | + | chr3 | 100463677 | 100463775 | + | ENST00000418917;ENST000000490574;ENST00000240851;ENST00000476228 | TSF |
| 1% | chr19 | 50174724 | 50174836 | + | chr19 | 50176955 | 50177005; 501770 | + | ENST00000441864;ENST00000024 346785;ENST00000600947;ENST00000598306 | TSF |
| 1% | chr19 | 50174724 | 50174836 | + | chr19 | 50176955 | 50177005; 501770 | + | ENST00000441864;ENST00000024 346785;ENST00000600947;ENST00000598306 | TSF |
| 1% | chr7 | 55464873 | 55464924 | + | chr7 | 55466116 | 55466323 | + | ENST00000254770 | TSF |
| 1% | chr2 | 143763612 | 143763709 | + | chr2 | 143787196 | 143787248 | + | ENST00000264170;ENST00000409512 | TSF |
| 1% | chr8 | 39759879 | 39759967 | + | chr8 | 39775394 | 39775489; 39775448 | + | ENST00000518804;ENST00000519154;ENST00000522495;ENST00000522840;ENST00000518237;ENST00000253513 | TSF |
| 1% | chr8 | 39759879 | 39759967 | + | chr8 | 39775394 | 39775489; 39775448 | + | ENST00000518804;ENST00000519154;ENST00000522495;ENST00000522840;ENST00000518237;ENST00000253513 | TSF |
| 1% | chr8 | 39759879 | 39759967 | + | chr8 | 39775394 | 39775489; 39775448 | + | ENST00000518804;ENST00000519154;ENST00000522495;ENST00000522840;ENST00000518237;ENST00000253513 | TSF |
| 1% | chr8 | 39759879 | 39759967 | + | chr8 | 39775394 | 39775489; 39775448 | + | ENST00000518804;ENST00000519154;ENST00000522495;ENST00000522840;ENST00000518237;ENST00000253513 | TSF |
| 1% | chr8 | 39759879 | 39759967 | + | chr8 | 39775394 | 39775489; 39775448 | + | ENST00000518804;ENST00000519154;ENST00000522495;ENST00000522840;ENST00000518237;ENST00000253513 | TSF |
| 1% | chr17 | 15872860 | 15873143 | + | chr17 | 15877993 | 15878656 | + | ENST00000304222 | TSF |
| 1% | chr9 | 139809866 | 139809928 | + | chr9 | 139810993 | 139811067 | + | ENST00000536468;ENST00000247668;ENST00000359662 | TSF |
| 1% | chr1 | 13922411 | 13922564 | + | chr1 | 13933668 | 13933801 | + | ENST00000294489;ENST00000376057,ENST00000510906;ENST00000509009 | TSF |
| 1% | chr1 | 13922411 | 13922564 | + | chr1 | 13933668 | 13933801 | + | ENST00000294489;ENST00000376057,ENST00000510906;ENST00000509009 | TSF |
| 1% | chr1 | 13922411 | 13922564 | + | chr1 | 13933668 | 13933801 | + | ENST00000294489;ENST00000376057,ENST00000510906;ENST00000509009 | TSF |
| 1% | chr19 | 46194689 | 146194670 | − | chr19 | 46191824 | 46191645 | − | ENST00000342669;ENST000005888301;ENST00000590212 | TSF |
| 1% | chr19 | 46194689 | 146194670 | − | chr19 | 46191824 | 46191645 | − | ENST00000342669;ENST000005888301;ENST00000590212 | TSF |
| 1% | chr12 | 49310439 | 149309695 | − | chr12 | 149297691 | 49297443 | − | ENST00000398092 | TSF |
| 1% | chr22 | 40897378 | 140896995 | − | chr22 | 140859290 | 40859225 | − | ENST00000422851 | TSF |
| 1% | chr2 | 17876171 | 17876059 | − | chr2 | 17865030 | 117864905 | − | ENST00000448223;ENST00000351948;ENST00000381272;ENST00000402989 | TSF |
| 1% | chr16 | 74834658 | 74834274 | − | chr16 | 174774013 | 74773921 | − | ENST00000219368;ENST00000567683;ENST00000569949 | TSF |
| 1% | chr16 | 74834658 | 74834274 | − | chr16 | 174774013 | 74773921 | − | ENST00000219368;ENST00000567683;ENST00000569949 | TSF |
| 1% | chr16 | 74834658 | 74834274 | − | chr16 | 174774013 | 74773921 | − | ENST00000219368;ENST00000567683;ENST00000569949 | TSF |
| 1% | chr22 | 22899971 | 22899965 | − | chr22 | 22893511 | 22893189; 22893185; 22893481; 22893274 | − | ENST00000398743;ENST00000398741;ENST00000543184;ENST00000405655;ENST00000402697;ENST00000439106;ENST00000438888;ENST00000420709;ENST00000406503;ENST00000442481;ENST000 | TSF |

TABLE 26-continued

Transcript fusion for Head-Neck Squamous Cell Carcinoma HNSC) Coordinates of
the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 1% | chr22 | 22899971 | 22899965 | – | chr22 | 22893511 | 22893189; 22893185; 22893481; 22893274 | – | ENST00000398743;ENST00000398741;ENST00000543184;ENST00000405655;ENST00000402697;ENST000000439106;ENST00000438888;ENST00000420709;ENST00000406503;ENST00000442481;ENST00000403441 | |
| 1% | chr22 | 22899971 | 22899965 | – | chr22 | 22893511 | 22893189; 22893185; 22893481; 22893274 | – | ENST00000398743;ENST00000398741;ENST00000543184;ENST00000405655;ENST00000402697;ENST000000439106;ENST00000438888;ENST00000420709;ENST00000406503;ENST00000442481;ENST00000403441 | |
| 1% | chr22 | 22899971 | 22899965 | – | chr22 | 22893511 | 22893189; 22893185; 22893481; 22893274 | – | ENST00000398743;ENST00000398741;ENST00000543184;ENST00000405655;ENST00000402697;ENST000000439106;ENST00000438888;ENST00000420709;ENST00000406503;ENST00000442481;ENST00000403441 | |
| 1% | chr22 | 22899971 | 22899965 | – | chr22 | 22893511 | 22893189; 22893185; 22893481; 22893274 | – | ENST00000398743;ENST00000398741;ENST00000543184;ENST00000405655;ENST00000402697;ENST000000439106;ENST00000438888;ENST00000420709;ENST00000406503;ENST00000442481;ENST00000403441 | TSF |
| 1% | chr22 | 22899971 | 22899965 | – | chr22 | 22893511 | 22893189; 22893185; 22893481; 22893274 | – | ENST00000398743;ENST00000398741;ENST00000543184;ENST00000405655;ENST00000402697;ENST000000439106;ENST00000438888;ENST00000420709;ENST00000406503;ENST00000442481;ENST00000403441 | TSF |
| 1% | chr22 | 22899971 | 22899965 | – | chr22 | 22893511 | 22893189; 22893185; 22893481; 22893274 | – | ENST00000398743;ENST00000398741;ENST00000543184;ENST00000405655;ENST00000402697;ENST000000439106;ENST00000438888;ENST00000420709;ENST00000406503;ENST00000442481;ENST00000403441 | TSF |
| 1% | chr4 | 57560508 | 57559845 | – | chr4 | 57522178 | 57522023; 57522025 | – | ENST00000420433;ENST00000554144;ENST00000508121;ENST00000557328 | TSF |
| 1% | chr4 | 57560508 | 57559845 | – | chr4 | 57522178 | 57522023; 57522025 | – | ENST00000420433;ENST00000554144;ENST00000508121;ENST00000557328 | TSF |
| 1% | chr4 | 57560508 | 57559845 | – | chr4 | 57522178 | 57522023; 57522025 | – | ENST00000420433;ENST00000554144;ENST00000508121;ENST00000557328 | TSF |
| 1% | chr20 | 30060256 | 30059441 | – | chr20 | 30053466 | 30053309 | – | ENST00000317676 | TSF |
| 1% | chr8 | 134271825 | 134271646 | – | chr8 | 134271473 | 134271411; 134271461 | – | ENST00000323851;ENST000005 17599;ENST00000537882;ENST00000414097;ENST00000522476;ENST00000522377;ENST00000520230;ENST00000518480;ENST000005 19228;ENST00000519580;ENST00000522890;ENST00000520943;ENST00000000521544;ENST00000522738 | TSF |
| 1% | chr8 | 134271825 | 134271646 | – | chr8 | 134271473 | 134271411; 134271461 | – | ENST00000323851;ENST000005 17599;ENST00000537882;ENST00000414097;ENST00000522476;ENST00000522377;ENST00000520230;ENST00000518480;ENST000005 19228;ENST00000519580;ENST00000522890;ENST00000520943;ENST00000000521544;ENST00000522738 | TSF |
| 1% | chr8 | 134271825 | 134271646 | – | chr8 | 134271473 | 134271411; 134271461 | – | ENST00000323851;ENST000005 17599;ENST00000537882;ENST00000414097;ENST00000522476;ENST00000522377;ENST00000520230;ENST00000518480;ENST000005 9228;ENST00000519580;ENST0000 | TSF |

TABLE 26-continued

Transcript fusion for Head-Neck Squamous Cell Carcinoma HNSC) Coordinates of
the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 1% | chr8 | 134271825 | 134271646 | − | chr8 | 134271473 | 134271411; 134271461 | − | 00522890;ENST00000520943;ENST00000000521544;ENST00000522738 ENST00000323851;ENST00000517599;ENST00000537882;ENST0000000414097;ENST00000522476;ENST000000522377;ENST00000520230; ENST00000518480;ENST00000519228;ENST00000519580;ENST0000000522890;ENST00000520943;ENST00000000521544;ENST00000522738 | TSF |
| 1% | chr8 | 134271825 | 134271646 | − | chr8 | 134271473 | 134271411; 134271461 | − | ENST00000323851;ENST00000517599;ENST00000537882;ENST0000000414097;ENST00000522476;ENST000000522377;ENST00000520230; ENST00000518480;ENST00000519228;ENST00000519580;ENST0000000522890;ENST00000520943;ENST00000000521544;ENST00000522738 | TSF |
| 1% | chr8 | 134271825 | 134271646 | − | chr8 | 134271473 | 134271411; 134271461 | − | ENST00000323851;ENST00000517599;ENST00000537882;ENST0000000414097;ENST00000522476;ENST000000522377;ENST00000520230; ENST00000518480;ENST00000519228;ENST00000519580;ENST0000000522890;ENST00000520943;ENST00000000521544;ENST00000522738 | TSF |
| 1% | chr8 | 134271825 | 134271646 | − | chr8 | 134271473 | 134271411; 134271461 | − | ENST00000323851;ENST00000517599;ENST00000537882;ENST0000000414097;ENST00000522476;ENST000000522377;ENST00000520230; ENST00000518480;ENST00000519228;ENST00000519580;ENST0000000522890;ENST00000520943;ENST00000000521544;ENST00000522738 | TSF |
| 1% | chr8 | 134271825 | 134271646 | − | chr8 | 134271473 | 134271411; 134271461 | − | ENST00000323851;ENST00000517599;ENST00000537882;ENST0000000414097;ENST00000522476;ENST000000522377;ENST00000520230; ENST00000518480;ENST00000519228;ENST00000519580;ENST0000000522890;ENST00000520943;ENST00000000521544;ENST00000522738 | TSF |
| 1% | chr8 | 134271825 | 134271646 | − | chr8 | 134271473 | 134271411; 134271461 | − | ENST00000323851;ENST00000517599;ENST00000537882;ENST0000000414097;ENST00000522476;ENST000000522377;ENST00000520230; ENST00000518480;ENST00000519228;ENST00000519580;ENST0000000522890;ENST00000520943;ENST00000000521544;ENST00000522738 | TSF |
| 1% | chr8 | 134271825 | 134271646 | − | chr8 | 134271473 | 134271411; 134271461 | − | ENST00000323851;ENST00000517599;ENST00000537882;ENST0000000414097;ENST00000522476;ENST000000522377;ENST00000520230; ENST00000518480;ENST00000519228;ENST00000519580;ENST0000000522890;ENST00000520943;ENST00000000521544;ENST00000522738 | TSF |
| 1% | chr22 | 40898710 | 40898130 | − | chr22 | 40859290 | 40859225 | − | ENST00000422851 | TSF |
| 1% | chr20 | 8624404 | 8625264 | + | chr20 | 8626749 | 8626828 | + | ENST00000378641;ENST00000338037;ENST00000378637;ENST00000404098 | TSF |
| 1% | chr20 | 8624404 | 8625264 | + | chr20 | 8626749 | 8626828 | + | ENST00000378641;ENST00000338037;ENST00000378637;ENST00000404098 | TSF |
| 1% | chr20 | 8624404 | 8625264 | + | chr20 | 8626749 | 8626828 | + | ENST00000378641;ENST00000338037;ENST00000378637;ENST00000404098 | TSF |
| 1% | chr20 | 110606 | 110697 | + | chr20 | 126056 | 126333 | + | ENST00000382398 | TSF |
| 1% | chr5 | 79371074 | 79371193 | + | chr5 | 79372678 | 79372871 | + | ENST00000350881;ENST000000511733 | TSF |
| 1% | chr20 | 8624404 | 8625184 | + | chr20 | 8626749 | 8626828 | + | ENST00000378641;ENST00000338037;ENST00000378637;ENST00000404098 | TSF |
| 1% | chr20 | 8624404 | 8625184 | + | chr20 | 8626749 | 8626828 | + | ENST00000378641;ENST0000033 | TSF |

TABLE 26-continued

Transcript fusion for Head-Neck Squamous Cell Carcinoma HNSC) Coordinates of
the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 1% | chr20 | 8624404 | 8625184 | + | chr20 | 8626749 | 8626828 | + | 8037;ENST00000378637;ENST0000 00404098 ENST00000378641;ENST0000033 8037;ENST00000378637;ENST0000 00404098 | TSF |
| 1% | chr9 | 137248112 | 137248203 | + | chr9 | 137293478 | 137293728 | + | ENST00000481739 | TSF |
| 1% | chr8 | 71625721 | 71625811 | + | chr8 | 71646031 | 71646659 | + | ENST00000408926;ENST0000052 0030 | TSF |
| 1% | chr3 | 48252382 | 48252800 | + | chr3 | 48265844 | 48265951 | + | ENST00000296435;ENST0000057 6243 | TSF |
| 1% | chr19 | 17421511 | 17421655 | + | chr19 | 17424832 | 17424912 | + | ENST00000593466;ENST0000035 9866,ENST00000596582 | TSF |
| 1% | chr3 | 126729058 | 126729222 | + | chr3 | 126730801 | 126731001 | + | ENST00000251772;ENST0000039 3409 | TSF |
| 1% | chr1 | 165854440 | 165854616 | + | chr1 | 165859441 | 165859600 | + | ENST00000367879;ENST0000037 2212 | TSF |
| 1% | chr1 | 165854440 | 165854616 | + | chr1 | 165859441 | 165859600 | + | ENST00000367879;ENST0000037 2212 | TSF |
| 1% | chr8 0337 | 104389530 | 104389536 | + | chr8 | 104390255 | 104390471 | + | ENST00000330295;ENST0000052 | TSF |
| 1% | chr3 | 48096672 | 48097516 | + | chr3 | 48265844 | 48265951 | + | ENST00000296435;ENST0000057 6243 | TSF |
| 1% | chr12 | 97286062 | 97286334 | + | chr12 | 97303530 | 97303673 | + | ENST00000554226;ENST0000055 7644 | TSF |
| 1% | chr12 | 97286062 | 97286334 | + | chr12 | 97303530 | 97303673 | + | ENST00000554226;ENST0000055 7644 | TSF |
| 1% | chr1 | 45988716 | 45988450 | − | chr1 | 45981479 | 45981326 | − | ENST00000262746;ENST0000031 9248;ENST00000447184;ENST0000 00424390 | TSF |
| 1% | chr1 | 45988716 | 45988450 | − | chr1 | 45981479 | 45981326 | − | ENST00000262746;ENST0000031 9248;ENST00000447184;ENST0000 00424390 | TSF |
| 1% | chr9 | 123165858 | 123165617 | − | chr9 | 123165349 | 123165084 | − | ENST00000359309;ENST0000036 0822;ENST00000349780;ENST000 00360190;ENST00000416449;ENS T000000425647 | TSF |
| 1% | chr1 | 209819885 | 209819875 | − | chr1 | 209811993 | 209811879 | − | ENST00000356082;ENST0000039 1911;ENST00000367030;ENST0000 00415782 | TSF |
| 1% | chr1 | 209819885 | 209819875 | − | chr1 | 209811993 | 209811879 | − | ENST00000356082;ENST0000039 1911;ENST00000367030;ENST0000 00415782 | TSF |
| 1% | chr3 | 115829645 | 115827368 | − | chr3 | 115805403 | 115805171 | − | ENST00000490035;ENST0000033 3617;ENST00000539563;ENST0000 00474851 | TSF |
| 1% | chr3 | 115829645 | 115827368 | − | chr3 | 115805403 | 115805171 | − | ENST00000490035;ENST0000033 3617;ENST00000539563;ENST0000 00474851 | TSF |
| 1% | chr3 | 115829645 | 115827368 | − | chr3 | 115805403 | 115805171 | − | ENST00000490035;ENST0000033 3617;ENST00000539563;ENST0000 00474851 | TSF |
| 1% | chr12 | 58023123 | 58023062 | − | chr12 | 58022929 | 58022831; 58022905 | − | ENST00000341156;ENST0000041 8555;ENST00000552798;ENST0000 00549391 | TSF |
| 1% | chr12 | 58023123 | 58023062 | − | chr12 | 58022929 | 58022831; 58022905 | − | ENST00000341156;ENST0000041 8555;ENST00000552798;ENST0000 00549391 | TSF |
| 1% | chr2 | 163164568 | 163164512 | − | chr2 | 163163365 | 163163219 | − | ENST00000263642 | TSF |
| 1% | chr3 | 113450271 | 113449590 | − | chr3 | 113442939 | 113442806; 113442828 | − | ENST00000240922;ENST0000047 7813;ENST00000497255;ENST000 00481432;ENST00000493900;ENS T000000478020 | TSF |
| 1% | chr3 | 113450271 | 113449590 | − | chr3 | 113442939 | 113442806; 113442828 | − | ENST00000240922;ENST0000047 7813;ENST00000497255;ENST000 00481432;ENST00000493900;ENS T000000478020 | TSF |
| 1% | chr3 | 113450271 | 113449590 | − | chr3 | 113442939 | 113442806; 113442828 | − | ENST00000240922;ENST0000047 7813;ENST00000497255;ENST000 00481432;ENST00000493900;ENS T000000478020 | TSF |
| 1% | chr3 | 113450271 | 113449590 | − | chr3 | 113442939 | 113442806; 113442828 | − | ENST00000240922;ENST0000047 7813;ENST00000497255;ENST000 00481432;ENST00000493900;ENS T000000478020 | TSF |
| 1% | chr3 | 113450271 | 113449590 | − | chr3 | 113442939 | 113442806; − | | ENST00000240922;ENST0000047 | TSF |

TABLE 26-continued

Transcript fusion for Head-Neck Squamous Cell Carcinoma HNSC) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| | | | | | | 113442828 | | 7813;ENST00000497255;ENST0000 00481432;ENST00000493900;ENS T000000478020 | |
| 1% | chrX | 154534914 | 154534817 | − | chrX | 154528458 | 154528349 | − | ENST00000369449;ENST0000032 1926 | TSF |
| 1% | chrX | 154534914 | 154534817 | − | chrX | 154528458 | 154528349 | − | ENST00000369449;ENST0000032 1926 | TSF |
| 1% | chr2 | 211161174 | 211161144 | − | chr2 | 211159142 | 211158969 | − | ENST00000341685;ENST0000035 2451 | TSF |
| 1% | chr2 | 163040340 | 163040253 | − | chr2 | 163039978 | 163039924 | − | ENST00000188790;ENST0000044 3424 | TSF |
| 1% | chr10 | 27051731 | 27051669 | − | chr10 | 27048164 | 27047991 | − | ENST00000376170;ENST0000035 9188:ENST00000376142:ENST0000 00376139;ENST00000376160;ENS T00000376166:ENST00000376138; ENST00000346832:ENST0000035 5394;ENST00000376134:ENST0000 00376140 | TSF |
| 1% | chr10 | 27051731 | 27051669 | − | chr10 | 27048164 | 27047991 | − | ENST00000376170;ENST0000035 9188:ENST00000376142:ENST0000 00376139;ENST00000376160;ENS T00000376166:ENST00000376138; ENST00000346832:ENST0000035 5394;ENST00000376134:ENST0000 00376140 | TSF |
| 1% | chr17 | 39815837 | 39815667 | − | chr17 | 39776996 | 39776911 | − | ENST00000311208;ENST0000054 0235 | TSF |
| 1% | chr20 | 30058231 | 30057772 | − | chr20 | 30053466 | 30053309 | − | ENST00000317676 | TSF |
| 1% | chr11 | 118146787 | 118146719 | − | chr11 | 118133812 | 118133646 | − | ENST00000278937:ENST0000043 8295 | TSF |

TABLE 27

Transcript fusion for Kidney Chromophobe (KICH) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 91% | chr5 | 169532962 | 169533535 | + | ENST00000306268;ENST00000449804 | chr5 | 169533921 | 169533956 | + | TAF |
| 59% | chr19 | 50984141 | 50984234 | + | ENST00000334976;ENST00000376918;ENST00000598 585 | chr19 | 51009025 | 51009080 | + | TAF |
| 53% | chr20 | 30451784 | 30451710 | − | ENST00000278979;ENST00000375966;ENST00000339 738;ENST00000428829 | chr20 | 30450876 | 30450767 | − | TSF |
| 53% | chr20 | 30451784 | 30451710 | − | ENST00000278979;ENST00000375966;ENST00000339 738;ENST00000428829 | chr20 | 30450876 | 30450767 | − | TSF |
| 53% | chr20 | 30451784 | 30451710 | − | ENST00000278979;ENST00000375966;ENST00000339 738;ENST00000428829 | chr20 | 30450876 | 30450767 | − | TSF |
| 47% | chr1 | 156352539 | 156352660 | + | ENST00000451864;ENST00000255013;ENST00000368 246;ENST00000400992;ENST00000368249 | chr1 | 156354102 | 156354192 | + | TAF |
| 47% | chr1 | 156352539 | 156352660 | + | ENST00000451864;ENST00000255013;ENST00000368 246;ENST00000400992;ENST00000368249 | chr1 | 156354102 | 156354192 | + | TAF |
| 47% | chr1 | 156352539 | 156352660 | + | ENST00000451864;ENST00000255013;ENST00000368 246;ENST00000400992;ENST00000368249 | chr1 | 156354102 | 156354192 | + | TAF |
| 47% | chr1 | 156352539 | 156352660 | + | ENST00000451864;ENST00000255013;ENST00000368 246;ENST00000400992;ENST00000368249 | chr1 | 156354102 | 156354192 | + | TAF |
| 42% | chr3 | 195456519 | 195456610 | + | ENST00000447234;ENST00000320736;ENST00000436 408;ENST00000445522;ENST00000423938 | chr3 | 195462062 | 195462761 | + | TAF |
| 42% | chr3 | 195456519 | 195456610 | + | ENST00000447234;ENST00000320736;ENST00000436 408;ENST00000445522;ENST00000423938 | chr3 | 195462062 | 195462761 | + | TAF |
| 42% | chr3 | 195456519 | 195456610 | + | ENST00000447234;ENST00000320736;ENST00000436 408;ENST00000445522;ENST00000423938 | chr3 | 195462062 | 195462761 | + | TAF |
| 42% | chr3 | 195456519 | 195456610 | + | ENST00000447234;ENST00000320736;ENST00000436 408;ENST00000445522;ENST00000423938 | chr3 | 195462062 | 195462761 | + | TAF |
| 41% | chr17 | 80656472 | 80656331 | − | ENST00000571995;ENST00000538809 | chr17 | 80634662 | 80634498 | − | TSF |
| 36% | chr5 | 59481425 | 59481384 | − | ENST00000502484;ENST00000546160;ENST00000509 368;ENST00000505507;ENST00000514552;ENST0000 0515835 | chr5 | 59300173 | 59300093 | − | TAF |
| 35% | chr8 | 6735379 | 6735319 | − | ENST00000297439 | chr8 | 6734600 | 6734532 | − | TAF |
| 32% | chr7 | 71142196 | 71142291 | + | ENST00000333538 | chr7 | 71169493 | 71170639 | + | TSF |
| 30% | chr20 | 30451784 | 30451710 | − | ENST00000278979;ENST00000375966;ENST00000339 738;ENST00000428829 | chr20 | 30450952 | 30450767 | − | TSF |
| 30% | chr20 | 30451784 | 30451710 | − | ENST00000278979;ENST00000375966;ENST00000339 | chr20 | 30450952 | 30450767 | − | TSF |

TABLE 27-continued

Transcript fusion for Kidney Chromophobe (KICH) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 30% | chr20 | 30451784 | 30451710 | − | 738;ENST00000428829 ENST00000278979;ENST00000375966;ENST00000339 738;ENST00000428829 | chr20 | 30450952 | 30450767 | − | TSF |
| 29% | chr5 | 41794180; 41794161 | 41794105 | − | ENST00000196371;ENST00000512084;ENST00000510 634;ENST00000509987 | chr5 | 41764599 | 41764486 | − | TAF |
| 29% | chr5 | 41794180; 41794161 | 41794105 | − | ENST00000196371;ENST00000512084;ENST00000510 634;ENST00000509987 | chr5 | 41764599 | 41764486 | − | TAF |
| 29% | chr5 | 41794180; 41794161 | 41794105 | − | ENST00000196371;ENST00000512084;ENST00000510 634;ENST00000509987 | chr5 | 41764599 | 41764486 | − | TAF |
| 29% | chr3 | 58355158 | 58355205 | + | ENST00000356151;ENST00000302779;ENST00000383 715;ENST00000484288;ENST00000479241;ENST0000 0477308;ENST00000491164 | chr3 | 58363636 | 58364153 | + | TSF |
| 29% | chr3 | 58355158 | 58355205 | + | ENST00000356151;ENST00000302779;ENST00000383 715;ENST00000484288;ENST00000479241;ENST0000 0477308;ENST00000491164 | chr3 | 58363636 | 58364153 | + | TSF |
| 29% | chr3 | 58355158 | 58355205 | + | ENST00000356151;ENST00000302779;ENST00000383 715;ENST00000484288;ENST00000479241;ENST0000 0477308;ENST00000491164 | chr3 | 58363636 | 58364153 | + | TSF |
| 29% | chr6 | 163735859 | 163735979 | + | ENST00000337019;ENST00000366889;ENST00000366 888 | chr6 | 163742647 | 163743208 | + | TSF |
| 29% | chr6 | 163735859 | 163735979 | + | ENST00000337019;ENST00000366889;ENST00000366 888 | chr6 | 163742647 | 163743208 | + | TSF |
| 26% | chr16 | 4409386 | 4409297 | − | ENST00000572467;ENST00000251166;ENST00000539 968;ENST00000537233;ENST00000574025;ENST0000 0576637 | chr16 | 4409070 | 4408945 | − | TAF |
| 26% | chr16 | 4409386 | 4409297 | − | ENST00000572467;ENST00000251166;ENST00000539 968;ENST00000537233;ENST00000574025;ENST0000 0576637 | chr16 | 4409070 | 4408945 | − | TAF |
| 26% | chr16 | 4409386 | 4409297 | − | ENST00000572467;ENST00000251166;ENST00000539 968;ENST00000537233;ENST00000574025;ENST0000 0576637 | chr16 | 4409070 | 4408945 | − | TAF |
| 26% | chr16 | 4409386 | 4409297 | − | ENST00000572467;ENST00000251166;ENST00000539 968;ENST00000537233;ENST00000574025;ENST0000 0576637 | chr16 | 4409070 | 4408945 | − | TAF |
| 26% | chr16 | 4409386 | 4409297 | − | ENST00000572467;ENST00000251166;ENST00000539 968;ENST00000537233;ENST00000574025;ENST0000 0576637 | chr16 | 4409070 | 4408945 | − | TAF |
| 26% | chr10 | 84718705 | 84718831 | + | ENST00000372141;ENST00000404547;ENST00000372 142;ENST00000404576;ENST00000556918;ENST0000 0537893;ENST00000545131 | chr10 | 84720295 | 84720298 | + | TSF |
| 26% | chr10 | 84718705 | 84718831 | + | ENST00000372141;ENST00000404547;ENST00000372 142;ENST00000404576;ENST00000556918;ENST0000 0537893;ENST00000545131 | chr10 | 84720295 | 84720298 | + | TSF |
| 26% | chr10 | 84718705 | 84718831 | + | ENST00000372141;ENST00000404547;ENST00000372 142;ENST00000404576;ENST00000556918;ENST0000 0537893;ENST00000545131 | chr10 | 84720295 | 84720298 | + | TSF |
| 26% | chr10 | 84718705 | 84718831 | + | ENST00000372141;ENST00000404547;ENST00000372 142;ENST00000404576;ENST00000556918;ENST0000 0537893;ENST00000545131 | chr10 | 84720295 | 84720298 | + | TSF |
| 26% | chr10 | 84718705 | 84718831 | + | ENST00000372141;ENST00000404547;ENST00000372 142;ENST00000404576;ENST00000556918;ENST0000 0537893;ENST00000545131 | chr10 | 84720295 | 84720298 | + | TSF |
| 24% | chr19 | 3114942 | 3115070 | + | ENST00000078429;ENST00000587636 | chr19 | 3115258 | 3115402 | + | TSF |
| 24% | chr19 | 3114942 | 3115070 | + | ENST00000078429;ENST00000587636 | chr19 | 3115258 | 3115402 | + | TSF |
| 24% | chr12 | 15087927 | 15087790 | − | ENST00000266397 | chr12 | 15086263 | 15086233 | − | TSF |
| 21% | chr16 | 21987488 | 21987564 | + | ENST00000268379;ENST00000561553 | chr16 | 21987742 | 21987854 | + | TAF |
| 21% | chr3 | 42610538 | 42610357 | − | ENST00000423701;ENST00000273156;ENST00000417 572;ENST00000449617;ENST00000264454;ENST0000 0456515;ENST00000383750;ENST00000450981;ENST 00000445388;ENST00000454141;ENST00000416880;E NST00000420163 | chr3 | 42605472 | 42605463 | − | TAF |
| 21% | chr19 | 23556639 | 23556544 | − | ENST00000599743;ENST00000300619 | chr19 | 23491899 | 23491588 | − | TSF |
| 20% | chrX | 119575749 | 119575585 | − | ENST00000434600;ENST00000538785;ENST00000200 639;ENST00000486593;ENST00000371335;ENST0000 0540603 | chrX | 119567897 | 119567790 | − | TAF |
| 20% | chrX | 119575749 | 119575585 | − | ENST00000434600;ENST00000538785;ENST00000200 639;ENST00000486593;ENST00000371335;ENST0000 0540603 | chrX | 119567897 | 119567790 | − | TAF |
| 20% | chrX | 119575749 | 119575585 | − | ENST00000434600;ENST00000538785;ENST00000200 639;ENST00000486593;ENST00000371335;ENST0000 0540603 | chrX | 119567897 | 119567790 | − | TAF |
| 20% | chrX | 119575749 | 119575585 | − | ENST00000434600;ENST00000538785;ENST00000200 639;ENST00000486593;ENST00000371335;ENST0000 0540603 | chrX | 119567897 | 119567790 | − | TAF |
| 20% | chr1 | 156352539 | 156352660 | + | ENST00000451864;ENST00000255013;ENST00000368 | chr1 | 156354082 | 156354192 | + | TSF |

TABLE 27-continued

Transcript fusion for Kidney Chromophobe (KICH) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 20% | chr1 | 156352539 | 156352660 | + | 246;ENST00000400992;ENST00000368249 ENST00000451864;ENST00000255013;ENST00000368 246;ENST00000400992;ENST00000368249 | chr1 | 156354082 | 156354192 | + | TSF |
| 20% | chr1 | 156352539 | 156352660 | + | ENST00000451864;ENST00000255013;ENST00000368 246;ENST00000400992;ENST00000368249 | chr1 | 156354082 | 156354192 | + | TSF |
| 20% | chr1 | 156352539 | 156352660 | + | ENST00000451864;ENST00000255013;ENST00000368 246;ENST00000400992;ENST00000368249 | chr1 | 156354082 | 156354192 | + | TSF |
| 17% | chr14 | 96703445 | 96703518 | + | ENST00000554311;ENST00000306005;ENST00000553 811 | chr14 | 96712418 | 96712440 | + | TAF |
| 17% | chr5 | 169532962 | 169533535 | + | ENST00000306268; ENST00000449804 | chr5 | 169560172 | 169560283 | + | TSF |
| 17% | chr2 | 71163085 | 71163202 | + | ENST00000234396;ENST00000432367;ENST00000412 314 | chr2 | 71168794 | 71168842 | + | TSF |
| 15% | chr22 | 37209799 | 37209690 | − | ENST00000417718;ENST00000216200;ENST00000406 910;ENST00000404171;ENST00000443735 | chr22 | 37186448 | 37186392 | − | TSF |
| 15% | chr22 | 37209799 | 37209690 | − | ENST00000417718;ENST00000216200;ENST00000406 910;ENST00000404171;ENST00000443735 | chr22 | 37186448 | 37186392 | − | TSF |
| 15% | chr22 | 37209799 | 37209690 | − | ENST00000417718;ENST00000216200;ENST00000406 910;ENST00000404171;ENST00000443735 | chr22 | 37186448 | 37186392 | − | TSF |
| 14% | chr3 | 122103113 | 122103146 | + | ENST00000477892;ENST00000469967 | chr3 | 122112280 | 122112741 | + | TAF |
| 14% | chr21 | 42622679 | 42622828 | + | ENST00000328735;ENST00000330333 | chr21 | 42628809 | 42628810 | + | TAF |
| 14% | chr12 | 56120579 | 56120484 | − | ENST00000548898;ENST00000552067;ENST00000420 846;ENST00000548160;ENST00000546939;ENST0000 0552692;ENST00000549117;ENST00000257857;ENST 00000552754;ENST00000550776;ENST00000552164;E NST00000551173 | chr12 | 56120394 | 56120116 | − | TAF |
| 14% | chr12 | 56120579 | 56120484 | − | ENST00000548898;ENST00000552067;ENST00000420 846;ENST00000548160;ENST00000546939;ENST0000 0552692;ENST00000549117;ENST00000257857;ENST 00000552754;ENST00000550776;ENST00000552164;E NST00000551173 | chr12 | 56120394 | 56120116 | − | TAF |
| 14% | chr12 | 56120579 | 56120484 | − | ENST00000548898;ENST00000552067;ENST00000420 846;ENST00000548160;ENST00000546939;ENST0000 0552692;ENST00000549117;ENST00000257857;ENST 00000552754;ENST00000550776;ENST00000552164;E NST00000551173 | chr12 | 56120394 | 56120116 | − | TAF |
| 14% | chr12 | 56120579 | 56120484 | − | ENST00000548898;ENST00000552067;ENST00000420 846;ENST00000548160;ENST00000546939;ENST0000 0552692;ENST00000549117;ENST00000257857;ENST 00000552754;ENST00000550776;ENST00000552164;E NST00000551173 | chr12 | 56120394 | 56120116 | − | TAF |
| 14% | chr9 | 114538255 | 114538071 | − | ENST00000374287;ENST00000318737;ENST00000374 283 | chr9 | 114535173 | 114532046 | − | TSF |
| 14% | chr9 | 114538255 | 114538071 | − | ENST00000374287;ENST00000318737;ENST00000374 283 | chr9 | 114535173 | 114532046 | − | TSF |
| 12% | chr3 | 49715006 | 49715066 | + | ENST00000296456;ENST00000442186;ENST00000438 011 | chr3 | 49715773 | 49715877 | + | TAF |
| 12% | chr3 | 49715006 | 49715066 | + | ENST00000296456;ENST00000442186;ENST00000438 011 | chr3 | 49715773 | 49715877 | + | TAF |
| 12% | chr4 | 38104620 | 38104778 | + | ENST00000508802;ENST00000261439 | chr4 | 38107699 | 38107796 | + | TAF |
| 12% | chr4 | 38104620 | 38104778 | + | ENST00000508802;ENST00000261439 | chr4 | 38107699 | 38107796 | + | TAF |
| 12% | chr5 | 147207691 | 147207585 | − | ENST00000296695;ENST00000510027 | chr5 | 147185494 | 147185375 | − | TAF |
| 12% | chr6 | 46867820 | 46867766 | − | ENST00000283296;ENST00000362015;ENST00000456 426;ENST00000265417 | chr6 | 46856509 | 46856439 | − | TAF |
| 12% | chr20 | 32247538; 32247356 | 32247303 | − | ENST00000246190;ENST00000375238;ENST00000480 994 | chr20 | 32246861 | 32246725 | − | TAF |
| 12% | chr20 | 32247538; 32247356 | 32247303 | − | ENST00000246190;ENST00000375238;ENST00000480 994 | chr20 | 32246861 | 32246725 | − | TAF |
| 12% | chr20 | 32247538; 32247356 | 32247303 | − | ENST00000246190;ENST00000375238;ENST00000480 994 | chr20 | 32246861 | 32246725 | − | TAF |
| 12% | chr13 | 52351257 | 52351196 | − | ENST00000444610;ENST00000218981;ENST00000280 056 | chr13 | 52350661 | 52350338 | − | TAF |
| 12% | chr13 | 52351257 | 52351196 | − | ENST00000444610;ENST00000218981;ENST00000280 056 | chr13 | 52350661 | 52350338 | − | TAF |
| 12% | chr7 | 117254667 | 117254767 | + | ENST00000003084;ENST00000454343;ENST00000426 809;ENST00000468795 | chr7 | 117258279 | 117258298 | + | TSF |
| 12% | chr7 | 117254667 | 117254767 | + | ENST00000003084;ENST00000454343;ENST00000426 809;ENST00000468795 | chr7 | 117258279 | 117258298 | + | TSF |
| 12% | chr7 | 117254667 | 117254767 | + | ENST00000003084;ENST00000454343;ENST00000426 809;ENST00000468795 | chr7 | 117258279 | 117258298 | + | TSF |
| 12% | chr7 | 117254667 | 117254767 | + | ENST00000003084;ENST00000454343;ENST00000426 809;ENST00000468795 | chr7 | 117258279 | 117258298 | + | TSF |
| 12% | chr20 | 49458303 | 49458437 | + | ENST00000358791;ENST00000371608;ENST00000609 336 | chr20 | 49468479 | 49468517 | + | TSF |
| 12% | chr20 | 49458303 | 49458437 | + | ENST00000358791;ENST00000371608;ENST00000609 336 | chr20 | 49468479 | 49468517 | + | TSF |

TABLE 27-continued

Transcript fusion for Kidney Chromophobe (KICH) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 11% | chr21 | 42629085 | 42629253 | + | ENST00000330333;ENST00000347667 | chr21 | 42635352 | 42635428 | + | TAF |
| 11% | chr21 | 42629085 | 42629253 | + | ENST00000330333;ENST00000347667 | chr21 | 42635352 | 42635428 | + | TAF |
| 11% | chr8 | 87111208 | 87111337 | + | ENST00000523635;ENST00000285393 | chr8 | 87144159 | 87144425 | + | TAF |
| 11% | chr8 | 87125938 | 87126109 | + | ENST00000285393 | chr8 | 87144167 | 87144425 | + | TAF |
| 11% | chr1 | 11718793 | 11718928 | + | ENST00000251546;ENST00000376770;ENST00000376768;ENST00000251547;ENST00000376760;ENST00000376762;ENST00000475435;ENST00000471895 | chr1 | 11719303 | 11719464 | + | TAF |
| 11% | chr1 | 11718793 | 11718928 | + | ENST00000251546;ENST00000376770;ENST00000376768;ENST00000251547;ENST00000376760;ENST00000376762;ENST00000475435;ENST00000471895 | chr1 | 11719303 | 11719464 | + | TAF |
| 11% | chr1 | 11718793 | 11718928 | + | ENST00000251546;ENST00000376770;ENST00000376768;ENST00000251547;ENST00000376760;ENST00000376762;ENST00000475435;ENST00000471895 | chr1 | 11719303 | 11719464 | + | TAF |
| 11% | chr1 | 11718793 | 11718928 | + | ENST00000251546;ENST00000376770;ENST00000376768;ENST00000251547;ENST00000376760;ENST00000376762;ENST00000475435;ENST00000471895 | chr1 | 11719303 | 11719464 | + | TAF |
| 11% | chr1 | 11718793 | 11718928 | + | ENST00000251546;ENST00000376770;ENST00000376768;ENST00000251547;ENST00000376760;ENST00000376762;ENST00000475435;ENST00000471895 | chr1 | 11719303 | 11719464 | + | TAF |
| 11% | chr19 | 5680497 | 5680469 | − | ENST00000309324;ENST00000587589 | chr19 | 5680194 | 5680187 | − | TAF |
| 11% | chr5 | 74984990 | 74984837 | − | ENST00000428202;ENST00000514838;ENST00000380475;ENST00000510798;ENST00000446329 | chr5 | 74983153 | 74982863 | − | TAF |
| 11% | chr5 | 74984990 | 74984837 | − | ENST00000428202;ENST00000514838;ENST00000380475;ENST00000510798;ENST00000446329 | chr5 | 74983153 | 74982863 | − | TAF |
| 11% | chr5 | 74984990 | 74984837 | − | ENST00000428202;ENST00000514838;ENST00000380475;ENST00000510798;ENST00000446329 | chr5 | 74983153 | 74982863 | − | TAF |
| 11% | chr5 | 74984990 | 74984837 | − | ENST00000428202;ENST00000514838;ENST00000380475;ENST00000510798;ENST00000446329 | chr5 | 74983153 | 74982863 | − | TAF |
| 9% | chr9 | 98766802 | 98766983 | + | ENST00000407474;ENST00000320486 | chr9 | 98801158 | 98801481 | + | TSF |
| 9% | chr9 | 98766802 | 98766983 | + | ENST00000407474;ENST00000320486 | chr9 | 98801158 | 98801481 | + | TSF |
| 9% | chr16 | 81990300 | 81990484 | + | ENST00000359376 | chr16 | 81995581 | 81995772 | + | TSF |
| 9% | chr8 | 42924698; 42924750 | 42924802 | + | ENST00000534420;ENST00000302279;ENST00000533998;ENST00000342116;ENST00000531266;ENST00000525699;ENST00000529687;ENST00000533336 | chr8 | 42925245 | 42925476 | + | TSF |
| 9% | chr8 | 42924698; 42924750 | 42924802 | + | ENST00000534420;ENST00000302279;ENST00000533998;ENST00000342116;ENST00000531266;ENST00000525699;ENST00000529687;ENST00000533336 | chr8 | 42925245 | 42925476 | + | TSF |
| 9% | chr8 | 42924698; 42924750 | 42924802 | + | ENST00000534420;ENST00000302279;ENST00000533998;ENST00000342116;ENST00000531266;ENST00000525699;ENST00000529687;ENST00000533336 | chr8 | 42925245 | 42925476 | + | TSF |
| 9% | chr8 | 42924698; 42924750 | 42924802 | + | ENST00000534420;ENST00000302279;ENST00000533998;ENST00000342116;ENST00000531266;ENST00000525699;ENST00000529687;ENST00000533336 | chr8 | 42925245 | 42925476 | + | TSF |
| 9% | chr8 | 42924698; 42924750 | 42924802 | + | ENST00000534420;ENST00000302279;ENST00000533998;ENST00000342116;ENST00000531266;ENST00000525699;ENST00000529687;ENST00000533336 | chr8 | 42925245 | 42925476 | + | TSF |
| 9% | chr8 | 42924698; 42924750 | 42924802 | + | ENST00000534420;ENST00000302279;ENST00000533998;ENST00000342116;ENST00000531266;ENST00000525699;ENST00000529687;ENST00000533336 | chr8 | 42925245 | 42925476 | + | TSF |
| 9% | chr11 | 72416935 | 72416850 | − | ENST00000359373; ENST00000455638; ENST00000393605;ENST00000334211;ENST00000393609;ENST00000426523;ENST00000429686 | chr11 | 72415938 | 72415877 | − | TSF |
| 9% | chr11 | 72416935 | 72416850 | − | ENST00000359373;ENST00000455638;ENST00000393605;ENST00000334211;ENST00000393609;ENST00000426523;ENST00000429686 | chr11 | 72415938 | 72415877 | − | TSF |
| 9% | chr1 | 72416935 | 72416850 | − | ENST00000359373;ENST00000455638;ENST00000393605;ENST00000334211;ENST00000393609;ENST00000426523;ENST00000429686 | chr11 | 72415938 | 72415877 | − | TSF |
| 9% | chr7 | 137080443 | 137080344 | − | ENST00000453654;ENST00000288490;ENST00000424189;ENST00000446122 | chr7 | 137053199 | 137053024 | − | TSF |
| 9% | chr7 | 137080443 | 137080344 | − | ENST00000453654; ENST00000288490;ENST00000424189;ENST00000446122 | chr7 | 137053199 | 137053024 | − | TSF |
| 9% | chr7 | 137080443 | 137080344 | − | ENST00000453654;ENST00000288490;ENST00000424189;ENST00000446122 | chr7 | 137053199 | 137053024 | − | TSF |
| 9% | chr7 | 137080443 | 137080344 | − | ENST00000453654; ENST00000288490;ENST00000424189;ENST00000446122 | chr7 | 137053199 | 137053024 | − | TSF |

TABLE 28

Transcript fusion for Kidney Chromophobe (KICH) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 88% | chr20 | 30454037 | 30453945 | – | chr20 | 30452805 | 30452756 | – | ENST00000278979;ENST00000375966;ENST00000339738;ENST00000428829 | TAF |
| 88% | chr20 | 30454037 | 30453945 | – | chr20 | 30452805 | 30452756 | – | ENST00000278979;ENST00000375966;ENST00000339738;ENST00000428829 | TAF |
| 88% | chr20 | 30454037 | 30453945 | | chr20 | 30452805 | 30452756 | – | ENST00000278979;ENST00000375966;ENST00000339738;ENST00000428829 | TAF |
| 85% | chr5 | 156399385 | 156399254 | – | chr5 | 156381767 | 156381426 | – | ENST00000274532;ENST00000407087 | TAF |
| 85% | chr5 | 156399385 | 156399254 | – | chr5 | 156381767 | 156381426 | – | ENST00000274532;ENST00000407087 | TAF |
| 71% | chr4 | 10533364 | 10533137 | – | chr4 | 10527546 | 10527465 | | ENST00000226951 | TSF |
| 68% | chr21 | 42609094 | 42609191 | + | chr21 | 42609440 | 42609656 | + | ENST00000328735;ENST00000330333;ENST00000347667 | TSF |
| 68% | chr21 | 42609094 | 42609191 | + | chr21 | 42609440 | 42609656 | + | ENST00000328735;ENST00000330333;ENST00000347667 | TSF |
| 68% | chr21 | 42609094 | 42609191 | + | chr21 | 42609440 | 42609656 | + | ENST00000328735;ENST00000330333;ENST00000347667 | TSF |
| 68% | chr1 | 156337404 | 156337862 | + | chr1 | 156339110 | 156339227 | + | ENST00000537040;ENST00000544720;ENST00000368246;ENST00000368247;ENST00000368249;ENST00000446171;ENST00000368245 | TSF |
| 68% | chr1 | 156337404 | 156337862 | + | chr1 | 156339110 | 156339227 | + | ENST00000537040;ENST00000544720;ENST00000368246;ENST00000368247;ENST00000368249;ENST00000446171;ENST00000368245 | TSF |
| 68% | chr1 | 156337404 | 156337862 | + | chr1 | 156339110 | 156339227 | + | ENST00000537040;ENST00000544720;ENST00000368246;ENST00000368247;ENST00000368249;ENST00000446171;ENST00000368245 | TSF |
| 68% | chr1 | 156337404 | 156337862 | + | chr1 | 156339110 | 156339227 | + | ENST00000537040;ENST00000544720;ENST00000368246;ENST00000368247;ENST00000368249;ENST00000446171;ENST00000368245 | TSF |
| 68% | chr1 | 156337404 | 156337862 | + | chr1 | 156339110 | 156339227 | + | ENST00000537040;ENST00000544720;ENST00000368246;ENST00000368247;ENST00000368249;ENST00000446171;ENST00000368245 | TSF |
| 61% | chr4 | 95982945 | 95983246 | + | chr4 | 96025559 | 96025718 | + | ENST00000440890 | TAF |
| 61% | chr3 | 195444683 | 195445067 | + | chr3 | 195451551 | 195453443; 195452030 | + | ENST00000447234;ENST00000320736;ENST00000436408 | TAF |
| 61% | chr3 | 195444683 | 195445067 | + | chr3 | 195451551 | 195453443; 195452030 | + | ENST00000447234;ENST00000320736;ENST00000436408 | TAF |
| 61% | chr3 | 195444683 | 195445067 | + | chr3 | 195451551 | 195453443; 195452030 | + | ENST00000447234;ENST00000320736;ENST00000436408 | TAF |
| 61% | chr8 | 39710096 | 39709866 | – | chr8 | 39694731 | 39694655 | – | ENST00000347580;ENST00000379853;ENST00000265708;ENST00000521880 | TAF |
| 61% | chr8 | 39710096 | 39709866 | – | chr8 | 39694731 | 39694655 | – | ENST00000347580;ENST00000379853;ENST00000265708;ENST00000521880 | TAF |
| 61% | chr8 | 39710096 | 39709866 | – | chr8 | 39694731 | 39694655 | – | ENST00000347580;ENST00000379853;ENST00000265708;ENST00000521880 | TAF |
| 61% | chr8 | 39710096 | 39709866 | – | chr8 | 39694731 | 39694655 | – | ENST00000347580;ENST00000379853;ENST00000265708;ENST00000521880 | TAF |
| 58% | chr19 | 3726315 | 3726414 | + | chr19 | 3728422 | 3728478 | + | ENST00000589378;ENST00000262968;ENST00000587686 | TAF |
| 58% | chr19 | 3726315 | 3726414 | + | chr19 | 3728422 | 3728478 | + | ENST00000589378;ENST00000262968;ENST00000587686 | TAF |
| 52% | chr9 | 130732697 | 130732597 | – | chr9 | 130716204 | 130716084 | – | ENST00000373095 | TSF |
| 52% | chr17 | 30185561 | 30185499 | – | chr17 | 30183884 | 30183818 | – | ENST00000302362;ENST00000378634;ENST00000496655 | TSF |
| 52% | chr17 | 30185561 | 30185499 | – | chr17 | 30183884 | 30183818 | | ENST00000302362;ENST00000378634;ENST00000496655 | TSF |
| 50% | chr12 | 15812051 | 15811892 | – | chr12 | 15811519 | 15811431 | | ENST00000543523;ENST00000281172;ENST00000543612;ENST00000540613;ENST00000542903 | TSF |
| 47% | chr3 | 58363388 | 58363791 | + | chr3 | 58368241 | 58368427; 58368405 | + | ENST00000356151;ENST00000302779;ENST00000383716;ENST00000463280;ENST00000383715;ENST00000484288;ENST00000479241;ENST00000477308;ENST00000491164 | TAF |
| 47% | chr3 | 58363388 | 58363791 | + | chr3 | 58368241 | 58368427; 58368405 | + | ENST00000356151;ENST00000302779;ENST00000383716;ENST00000463280;ENST00000383715;ENST00000484288;ENST00000479241;ENST00000477308;ENST00000491164 | TAF |
| 47% | chr3 | 58363388 | 58363791 | + | chr3 | 58368241 | 58368427; 58368405 | + | ENST00000356151;ENST00000302779;ENST00000383716;ENST00000463280;ENST00000383715;ENST00000484288;ENST00000 | TAF |

TABLE 28-continued

Transcript fusion for Kidney Chromophobe (KICH) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 47% | chr3 | 58363388 | 58363791 | + | chr3 | 58368241 | 58368427; 58368405 | + | 479241;ENST00000477308;ENST00000491164<br>ENST00000356151;ENST00000302779;ENST00000383716;ENST00000463280;ENST00000383715;ENST00000484288;ENST00000479241;ENST00000477308;ENST00000491164 | TAF |
| 47% | chr3 | 58363388 | 58363791 | + | chr3 | 58368241 | 58368427; 58368405 | + | ENST00000356151;ENST00000302779;ENST00000383716;ENST00000463280;ENST00000383715;ENST00000484288;ENST00000479241;ENST00000477308;ENST00000491164 | TAF |
| 45% | chr7 | 137617767 | 137617650 | − | chr7 | 137613112 | 137612896 | − | ENST00000330387;ENST00000456390;ENST00000452463 | TAF |
| 45% | chr7 | 137617767 | 137617650 | − | chr7 | 137613112 | 137612896 | − | ENST00000330387;ENST00000456390;ENST00000452463 | TAF |
| 45% | chr7 | 137617767 | 137617650 | − | chr7 | 137613112 | 137612896 | − | ENST00000330387;ENST00000456390;ENST00000452463 | TAF |
| 45% | chrX | 119449588 | 119449552 | − | chrX | 119438346 | 119438204 | − | ENST00000309720;ENST00000371369;ENST00000440464;ENST00000519908 | TSF |
| 45% | chrX | 119449588 | 119449552 | − | chrX | 119438346 | 119438204 | − | ENST00000309720;ENST00000371369;ENST00000440464; ENST00000519908 | TSF |
| 45% | chrX | 119449588 | 119449552 | − | chrX | 119438346 | 119438204 | − | ENST00000309720;ENST00000371369;ENST00000440464;ENST00000519908 | TSF |
| 45% | chrX | 119449588 | 119449552 | − | chrX | 119438346 | 119438204 | − | ENST00000309720;ENST00000371369;ENST00000440464;ENST00000519908 | TSF |
| 42% | chr21 | 42597177 | 42597622 | + | chr21 | 42598193 | 42598281 | + | ENST00000328735;ENST00000330333;ENST00000347667 | TAF |
| 42% | chr21 | 42597177 | 42597622 | + | chr21 | 42598193 | 42598281 | + | ENST00000328735;ENST00000330333;ENST00000347667 | TAF |
| 42% | chr21 | 42597177 | 42597622 | + | chr21 | 42598193 | 42598281 | + | ENST00000328735;ENST00000330333;ENST00000347667 | TAF |
| 42% | chr4 | 6959398 | 6959457 | + | chr4 | 6969031 | 6969151 | + | ENST00000448507;ENST00000409757;ENST00000410031 | TSF |
| 41% | chrX | 119449588 | 119449548 | − | chrX | 119438346 | 119438204 | − | ENST00000309720;ENST00000371369;ENST00000440464;ENST00000519908 | TSF |
| 41% | chrX | 119449588 | 119449548 | − | chrX | 119438346 | 119438204 | − | ENST00000309720;ENST00000371369;ENST00000440464;ENST00000519908 | TSF |
| 41% | chrX | 119449588 | 119449548 | − | chrX | 119438346 | 119438204 | − | ENST00000309720;ENST00000371369;ENST00000440464;ENST00000519908 | TSF |
| 41% | chrX | 119449588 | 119449548 | − | chrX | 119438346 | 119438204 | − | ENST00000309720;ENST00000371369;ENST00000440464;ENST00000519908 | TSF |
| 39% | chr20 | 33850895 | 33851310 | + | chr20 | 33851594 | 33851755 | + | ENST00000246186 | TAF |
| 38% | chr21 | 42609094 | 42609159 | + | chr21 | 42609440 | 42609656 | + | ENST00000328735;ENST00000330333;ENST00000347667 | TAF |
| 38% | chr21 | 42609094 | 42609159 | + | chr21 | 42609440 | 42609656 | + | ENST00000328735;ENST00000330333;ENST00000347667 | TAF |
| 38% | chr21 | 42609094 | 42609159 | + | chr21 | 42609440 | 42609656 | + | ENST00000328735;ENST00000330333;ENST00000347667 | TAF |
| 36% | chr12 | 55223983 | 55224840 | + | chr12 | 55248900 | 55248941 | + | ENST00000546809;ENST00000308796 | TAF |
| 35% | chr8 | 27947459 | 27947920 | + | chr8 | 27954736 | 27954835 | + | ENST00000256398;ENST00000523687;ENST00000518112 | TAF |
| 35% | chr8 | 27947459 | 27947920 | + | chr8 | 27954736 | 27954835 | + | ENST00000256398;ENST00000523687;ENST00000518112 | TAF |
| 35% | chr4 | 146643833 | 146644154 | + | chr4 | 146648063 | 146648121 | + | ENST00000438731;ENST00000511965 | TSF |
| 33% | chr14 | 24105943 | 24105981 | + | chr14 | 24112361 | 24112428 | + | ENST00000432832;ENST00000250383;ENST00000344777;ENST00000557535;ENST00000553600 | TAF |
| 33% | chr14 | 24105943 | 24105981 | + | chr14 | 24112361 | 24112428 | + | ENST00000432832;ENST00000250383;ENST00000344777;ENST00000557535;ENST00000553600 | TAF |
| 33% | chr14 | 24105943 | 24105981 | + | chr14 | 24112361 | 24112428 | + | ENST00000432832;ENST00000250383;ENST00000344777;ENST00000557535;ENST00000553600 | TAF |
| 33% | chr14 | 24105943 | 24105981 | + | chr14 | 24112361 | 24112428 | + | ENST00000432832;ENST00000250383;ENST00000344777;ENST00000557535;ENST00000553600 | TAF |
| 30% | chr8 | 27947459 | 27947849 | + | chr8 | 27954736 | 27954835 | + | ENST00000256398;ENST00000523687;ENST00000518112 | TAF |
| 30% | chr8 | 27947459 | 27947849 | + | chr8 | 27954736 | 27954835 | + | ENST00000256398;ENST00000523687;ENST00000518112 | TAF |
| 30% | chr4 | 71846253 | 71846787 | + | chr4 | 71847697 | 71847774 | + | ENST00000309395;ENST00000396051 | TAF |

TABLE 28-continued

Transcript fusion for Kidney Chromophobe (KICH) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 30% | chr19 | 51340308 | 51340387 | + | chr19 | 51359496 | 51359655 | + | ENST00000326003;ENST00000422986;ENST00000597483;ENST00000593997;ENST00000595392;ENST00000595952;ENST00000360617;ENST00000598145 | TAF |
| 30% | chr19 | 51340308 | 51340387 | + | chr19 | 51359496 | 51359655 | + | ENST00000326003;ENST00000422986;ENST00000597483;ENST00000593997;ENST00000595392;ENST00000595952;ENST00000360617;ENST00000598145 | TAF |
| 30% | chr19 | 51340308 | 51340387 | + | chr19 | 51359496 | 51359655 | + | ENST00000326003;ENST00000422986;ENST00000597483;ENST00000593997;ENST00000595392;ENST00000595952;ENST00000360617;ENST00000598145 | TAF |
| 30% | chr19 | 51340308 | 51340387 | + | chr19 | 51359496 | 51359655 | + | ENST00000326003;ENST00000422986;ENST00000597483;ENST00000593997;ENST00000595392;ENST00000595952;ENST00000360617;ENST00000598145 | TAF |
| 30% | chr19 | 51340308 | 51340387 | + | chr19 | 51359496 | 51359655 | + | ENST00000326003;ENST00000422986;ENST00000597483;ENST00000593997;ENST00000595392;ENST00000595952;ENST00000360617;ENST00000598145 | TAF |
| 30% | chr19 | 51340308 | 51340387 | + | chr19 | 51359496 | 51359655 | + | ENST00000326003;ENST00000422986;ENST00000597483;ENST00000593997;ENST00000595392;ENST00000595952;ENST00000360617;ENST00000598145 | TAF |
| 30% | chr19 | 51340308 | 51340387 | + | chr19 | 51359496 | 51359655 | + | ENST00000326003;ENST00000422986;ENST00000597483;ENST00000593997;ENST00000595392;ENST00000595952;ENST00000360617;ENST00000598145 | TAF |
| 30% | chr19 | 51340308 | 51340387 | + | chr19 | 51359496 | 51359655 | + | ENST00000326003;ENST00000422986;ENST00000597483;ENST00000593997;ENST00000595392;ENST00000595952;ENST00000360617;ENST00000598145 | TAF |
| 30% | chr3 | 195447345 | 195447395 | + | chr3 | 195451551 | 195453443; 195452030 | + | ENST00000447234;ENST00000320736;ENST00000436408 | TSF |
| 30% | chr3 | 195447345 | 195447395 | + | chr3 | 195451551 | 195453443; 195452030 | + | ENST00000447234;ENST00000320736;ENST00000436408 | TSF |
| 30% | chr3 | 195447345 | 195447395 | + | chr3 | 195451551 | 195453443; 195452030 | + | ENST00000447234;ENST00000320736;ENST00000436408 | TSF |
| 29% | chr15 | 80469525 | 80469529 | + | chr15 | 80469879 | 80469925 | + | ENST00000407106;ENST00000261755;ENST00000561421;ENST00000539156;ENST00000561353 | TAF |
| 29% | chr15 | 80469525 | 80469529 | + | chr15 | 80469879 | 80469925 | + | ENST00000407106;ENST00000261755;ENST00000561421;ENST00000539156;ENST00000561353 | TAF |
| 26% | chr10 | 4986182 | 4986466 | + | chr10 | 5008202 | 5008273 | + | ENST00000434459;ENST00000380872;ENST00000442997;ENST00000380859 | TAF |
| 26% | chr10 | 4986182 | 4986466 | + | chr10 | 5008202 | 5008273 | + | ENST00000434459;ENST00000380872;ENST00000442997;ENST00000380859 | TAF |
| 26% | chr10 | 4986182 | 4986466 | + | chr10 | 5008202 | 5008273 | + | ENST00000434459;ENST00000380872;ENST00000442997;ENST00000380859 | TAF |
| 26% | chr22 | 37211553 | 37211547 | − | chr22 | 37211279 | 37211147 | − | ENST00000417718;ENST00000216200;ENST00000406910;ENST00000443735 | TSF |
| 26% | chr22 | 37211553 | 37211547 | − | chr22 | 37211279 | 37211147 | − | ENST00000417718;ENST00000216200;ENST00000406910;ENST00000443735 | TSF |
| 26% | chr22 | 37211553 | 37211547 | − | chr22 | 37211279 | 37211147 | − | ENST00000417718;ENST00000216200;ENST00000406910;ENST00000443735 | TSF |
| 24% | chr14 | 24105943 | 24105981 | + | chr14 | 24109003 | 24109104 | + | ENST00000432832;ENST00000250383;ENST00000344777;ENST00000557535;ENST00000553600 | TAF |
| 24% | chr14 | 24105943 | 24105981 | + | chr14 | 24109003 | 24109104 | + | ENST00000432832;ENST00000250383;ENST00000344777;ENST00000557535;ENST00000553600 | TAF |
| 24% | chr14 | 24105943 | 24105981 | + | chr14 | 24109003 | 24109104 | + | ENST00000432832;ENST00000250383;ENST00000344777;ENST00000557535;ENST00000553600 | TAF |
| 24% | chr14 | 24105943 | 24105981 | + | chr14 | 24109003 | 24109104 | + | ENST00000432832;ENST00000250383;ENST00000344777;ENST00000557535;ENST00000553600 | TAF |
| 24% | chr14 | 24105943 | 24105981 | + | chr14 | 24109003 | 24109104 | + | ENST00000432832;ENST00000250383;ENST00000344777;ENST00000557535;ENST00000553600 | TAF |
| 24% | chr1 | 71328082 | 71327988 | − | chr1 | 71318542 | 71318522 | − | ENST00000370932;ENST00000460330 | TAF |
| 24% | chr15 | 63638414 | 63638317 | − | chr15 | 63637818 | 63637676 | − | ENST00000178638;ENST00000344366;ENST00000422263 | TAF |
| 24% | chr15 | 63638414 | 63638317 | − | chr15 | 63637818 | 63637676 | − | ENST00000178638;ENST00000344366;ENST | TAF |

TABLE 28-continued

Transcript fusion for Kidney Chromophobe (KICH) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 23% | chr15 | 78443636 | 78443886 | + | chr15 | 78447555 | 78447617 | + | T00000422263 ENST00000299518;ENST00000558933;ENST00000558554;ENST00000560667;ENST00000561279;ENST00000560396;ENST00000559865;ENST00000558509;ENST00000559803;ENST00000559106 | TAF |
| 23% | chr15 | 78443636 | 78443886 | + | chr15 | 78447555 | 78447617 | + | ENST00000299518;ENST00000558933;ENST00000558554;ENST00000560667;ENST00000561279;ENST00000560396;ENST00000559865;ENST00000558509;ENST00000559803;ENST00000559106 | TAF |
| 23% | chr15 | 78443636 | 78443886 | + | chr15 | 78447555 | 78447617 | + | ENST00000299518;ENST00000558933;ENST00000558554;ENST00000560667;ENST00000561279;ENST00000560396;ENST00000559865;ENST00000558509;ENST00000559803;ENST00000559106 | TAF |
| 23% | chr15 | 78443636 | 78443886 | + | chr15 | 78447555 | 78447617 | + | ENST00000299518;ENST00000558933;ENST00000558554;ENST00000560667;ENST00000561279;ENST00000560396;ENST00000559865;ENST00000558509;ENST00000559803;ENST00000559106 | TAF |
| 23% | chr15 | 78443636 | 78443886 | + | chr15 | 78447555 | 78447617 | + | ENST00000299518;ENST00000558933;ENST00000558554;ENST00000560667;ENST00000561279;ENST00000560396;ENST00000559865;ENST00000558509;ENST00000559803;ENST00000559106 | TAF |
| 23% | chr15 | 78443636 | 78443886 | + | chr15 | 78447555 | 78447617 | + | ENST00000299518;ENST00000558933;ENST00000558554;ENST00000560667;ENST00000561279;ENST00000560396;ENST00000559865;ENST00000558509;ENST00000559803;ENST00000559106 | TAF |
| 23% | chr2 | 71190941 | 71191014 | + | chr2 | 71191568 | 71191672 | + | ENST00000234396;ENST00000412314 | TAF |
| 23% | chr9 | 114575337 | 114575283 | − | chr9 | 114548315 | 114548192 | − | ENST00000374283 | TSF |
| 23% | chr14 | 67820507 | 67820416 | − | chr14 | 67819757 | 67819640 | − | ENST00000554087;ENST00000555474;ENST00000216442;ENST00000554236;ENST00000556058;ENST00000555012 | TSF |
| 23% | chr14 | 67820507 | 67820416 | − | chr14 | 67819757 | 67819640 | − | ENST00000554087;ENST00000555474;ENST00000216442;ENST00000554236;ENST00000556058;ENST00000555012 | TSF |
| 23% | chr14 | 67820507 | 67820416 | − | chr14 | 67819757 | 67819640 | − | ENST00000554087;ENST00000555474;ENST00000216442;ENST00000554236;ENST00000556058;ENST00000555012 | TSF |
| 23% | chr14 | 67820507 | 67820416 | − | chr14 | 67819757 | 67819640 | − | ENST00000554087;ENST00000555474;ENST00000216442;ENST00000554236;ENST00000556058;ENST00000555012 | TSF |
| 23% | chr14 | 67820507 | 67820416 | − | chr14 | 67819757 | 67819640 | − | ENST00000554087;ENST00000555474;ENST00000216442;ENST00000554236;ENST00000556058;ENST00000555012 | TSF |
| 21% | chr2 | 191111350 | 191111301 | − | chr2 | 191110938 | 191110880 | + | ENST00000392332;ENST00000359678;ENST00000410045;ENST00000416732;ENST00000409820 | TAF |
| 21% | chr2 | 191111350 | 191111301 | − | chr2 | 191110938 | 191110880 | − | ENST00000392332;ENST00000359678;ENST00000410045;ENST00000416732;ENST00000409820 | TAF |
| 21% | chr2 | 191111350 | 191111301 | − | chr2 | 191110938 | 191110880 | − | ENST00000392332;ENST00000359678;ENST00000410045;ENST00000416732;ENST00000409820 | TAF |
| 21% | chr2 | 191111350 | 191111301 | − | chr2 | 191110938 | 191110880 | − | ENST00000392332;ENST00000359678;ENST00000410045;ENST00000416732;ENST00000409820 | TAF |
| 21% | chr12 | 123070929 | 123070983 | + | chr12 | 123071248 | 123071304 | + | ENST00000333479 | TSF |
| 21% | chr10 | 4990318 | 4992053 | + | chr10 | 5008202 | 5008273 | + | ENST00000434459;ENST00000380872;ENST00000442997;ENST00000380859 | TSF |
| 21% | chr10 | 4990318 | 4992053 | + | chr10 | 5008202 | 5008273 | + | ENST00000434459;ENST00000380872;ENST00000442997;ENST00000380859 | TSF |
| 21% | chr10 | 4990318 | 4992053 | + | chr10 | 5008202 | 5008273 | + | ENST00000434459;ENST00000380872;ENST00000442997;ENST00000380859 | TSF |
| 20% | chr11 | 126273341 | 126273381 | + | chr11 | 126275991 | 126276045 | + | ENST00000534733 | TAF |
| 20% | chr8 | 87144142 | 87144238 | + | chr8 | 87151686 | 87151864 | + | ENST00000285393 | TAF |
| 20% | chr10 | 4986182 | 4986466 | + | chr10 | 5008196 | 5008273 | + | ENST00000434459;ENST00000380872;ENST00000380859 | TAF |
| 20% | chr10 | 4986182 | 4986466 | + | chr10 | 5008196 | 5008273 | − | ENST00000434459;ENST00000380872;ENST00000380859 | TAF |
| 20% | chr5 | 59300404 | 59300101 | − | chr5 | 59284544 | 59284315; 59284344; | − | ENST00000502484;ENST00000546160;ENST00000505507;ENST00000514552 | TAF |

TABLE 28-continued

Transcript fusion for Kidney Chromophobe (KICH) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 20% | chr5 | 59300404 | 59300101 | − | chr5 | 59284544 | 59284363 59284315; 59284344; 59284363 | − | ENST00000502484;ENST00000546160;ENST00000505507;ENST00000514552 | TAF |
| 20% | chr5 | 59300404 | 59300101 | − | chr5 | 59284544 | 59284363 59284315; 59284344; 59284363 | − | ENST00000502484;ENST00000546160;ENST00000505507;ENST00000514552 | TAF |
| 20% | chr3 | 43499158 | 43498855 | − | chr3 | 43474219 | 43474103 | − | ENST00000292246;ENST00000350459;ENST00000396091;ENST00000451430;ENST00000448045 | TSF |
| 18% | chr4 | 91640179 | 91640523 | + | chr4 | 91645065 | 91645142 | + | ENST00000509176;ENST00000432775;ENST00000333691;ENST00000513522 | TAF |
| 18% | chr4 | 91640179 | 91640523 | + | chr4 | 91645065 | 91645142 | + | ENST00000509176;ENST00000432775;ENST00000333691;ENST00000513522 | TAF |
| 18% | chr4 | 91640179 | 91640523 | + | chr4 | 91645065 | 91645142 | + | ENST00000509176;ENST00000432775;ENST00000333691;ENST00000513522 | TAF |
| 18% | chr3 | 98482258 | 98482283 | + | chr3 | 98487274 | 98487373 | + | ENST00000492254 | TAF |
| 18% | chr3 | 45018144 | 45018242 | + | chr3 | 45030632 | 45030733 | + | ENST00000265564 | TAF |
| 18% | chrX | 107370259 | 107370324 | + | chrX | 107372011 | 107372082 | + | ENST00000345734;ENST00000372232;ENST00000343524 | TAF |
| 18% | chrX | 107370259 | 107370324 | + | chrX | 107372011 | 107372082 | + | ENST00000345734;ENST00000372232;ENST00000343524 | TAF |
| 18% | chrX | 107370259 | 107370324 | + | chrX | 107372011 | 107372082 | + | ENST00000345734;ENST00000372232;ENST00000343524 | TAF |
| 18% | chr13 | 22253799 | 22254080 | + | chr13 | 22255181 | 22255284 | + | ENST00000382353 | TAF |
| 18% | chr20 | 30451567 | 30451427 | − | chr20 | 30450545 | 30450374 | − | ENST00000278979;ENST00000375966;ENST00000339738 | TSF |
| 18% | chr20 | 30451567 | 30451427 | − | chr20 | 30450545 | 30450374 | − | ENST00000278979;ENST00000375966;ENST00000339738 | TSF |
| 17% | chr5 | 80552027 | 80552252 | + | chr5 | 80553552 | 80553675 | + | ENST00000254035;ENST00000437669;ENST00000424301 | TAF |
| 17% | chr9 | 139611399 | 139611665 | + | chr9 | 139612029 | 139612163 | + | ENST00000371692 | TAF |
| 17% | chr10 | 99667221 | 99666955 | − | chr10 | 99664571 | 99664426 | − | ENST00000413387;ENST00000370597;ENST00000298819;ENST00000309155;ENST00000370591 | TAF |
| 17% | chr10 | 99667221 | 99666955 | − | chr10 | 99664571 | 99664426 | − | ENST00000413387;ENST00000370597;ENST00000298819;ENST00000309155;ENST00000370591 | TAF |
| 17% | chr10 | 99667221 | 99666955 | − | chr10 | 99664571 | 99664426 | − | ENST00000413387;ENST00000370597;ENST00000298819;ENST00000309155;ENST00000370591 | TAF |
| 17% | chr19 | 7895176 | 7895267 | + | chr19 | 7911468 | 7911565 | + | ENST00000270530;ENST00000538904 | TSF |
| 17% | chr19 | 7895176 | 7895267 | + | chr19 | 7911468 | 7911565 | + | ENST00000270530;ENST00000538904 | TSF |
| 15% | chr16 | 21966083 | 21966183 | + | chr16 | 21968556 | 21968639 | + | ENST00000268379;ENST00000565464;ENST00000561553;ENST00000563898;ENST00000564095 | TAF |
| 15% | chr16 | 21966083 | 21966183 | + | chr16 | 21968556 | 21968639 | + | ENST00000268379;ENST00000565464;ENST00000561553;ENST00000563898;ENST00000564095 | TAF |
| 15% | chr16 | 21966083 | 21966183 | + | chr16 | 21968556 | 21968639 | + | ENST00000268379;ENST00000565464;ENST00000561553;ENST00000563898;ENST00000564095 | TAF |
| 15% | chr16 | 21966083 | 21966183 | + | chr16 | 21968556 | 21968639 | + | ENST00000268379;ENST00000565464;ENST00000561553;ENST00000563898;ENST00000564095 | TAF |
| 15% | chr16 | 21966083 | 21966183 | + | chr16 | 21968556 | 21968639 | + | ENST00000268379;ENST00000565464;ENST00000561553;ENST00000563898;ENST00000564095 | TAF |
| 15% | chr12 | 52444147 | 52444325 | + | chr12 | 52448111 | 52448430; 52448988; 52448981 | + | ENST00000548977;ENST00000360284;ENST00000546842;ENST00000545748;ENST00000550082 | TAF |
| 15% | chr12 | 52444147 | 52444325 | + | chr12 | 52448111 | 52448430; 52448988; 52448981 | + | ENST00000548977;ENST00000360284;ENST00000546842;ENST00000545748;ENST00000550082 | TAF |
| 15% | chr12 | 52444147 | 52444325 | + | chr12 | 52448111 | 52448430; 52448988; 52448981 | + | ENST00000548977;ENST00000360284;ENST00000546842;ENST00000545748;ENST00000550082 | TAF |
| 15% | chr11 | 107998616 | 107998706 | + | chr11 | 108004547 | 108004664 | + | ENST00000265838;ENST00000299355;ENST00000531813 | TAF |
| 15% | chr11 | 107998616 | 107998706 | + | chr11 | 108004547 | 108004664 | + | ENST00000265838;ENST00000299355;ENST00000531813 | TAF |
| 15% | chr11 | 107998616 | 107998706 | + | chr11 | 108004547 | 108004664 | + | ENST00000265838;ENST00000299355;ENST00000531813 | TAF |
| 15% | chr11 | 117694170 | 117694041 | − | chr11 | 117693432 | 117693394 | − | ENST00000532119;ENST00000528014;ENST00000292079;ENST00000260287;ENST00 | TAF |

TABLE 28-continued

Transcript fusion for Kidney Chromophobe (KICH) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 15% | chr11 | 117694170 | 117694041 | − | chr11 | 117693432 | 117693394 | − | 000532984 ENST00000532119;ENST00000528014;ENST00000292079;ENST00000260287;ENST00000532984 | TAF |
| 15% | chr7 | 8267515 | 8267268 | − | chr7 | 8261028 | 8260905 | − | ENST00000402384; ENST00000406470;ENST00000265577;ENST00000396675;ENST00000339809;ENST00000401396;ENST00000422063;ENST00000407906;ENST00000317367;ENST00000447326;ENST00000430867 | TAF |
| 15% | chr7 | 8267515 | 8267268 | − | chr7 | 8261028 | 8260905 | − | ENST00000402384;ENST00000406470;ENST00000265577;ENST00000396675;ENST00000339809;ENST00000401396;ENST00000422063;ENST00000407906;ENST00000317367;ENST00000447326;ENST00000430867 | TAF |
| 15% | chr7 | 8267515 | 8267268 | − | chr7 | 8261028 | 8260905 | − | ENST00000402384;ENST00000406470;ENST00000265577;ENST00000396675;ENST00000339809;ENST00000401396;ENST00000422063;ENST00000407906;ENST00000317367;ENST00000447326;ENST00000430867 | TAF |
| 15% | chr7 | 8267515 | 8267268 | − | chr7 | 8261028 | 8260905 | − | ENST00000402384;ENST00000406470;ENST00000265577;ENST00000396675;ENST00000339809;ENST00000401396;ENST00000422063;ENST00000407906;ENST00000317367;ENST00000447326;ENST00000430867 | TAF |
| 15% | chr7 | 8267515 | 8267268 | − | chr7 | 8261028 | 8260905 | − | ENST00000402384;ENST00000406470;ENST00000265577;ENST00000396675;ENST00000339809;ENST00000401396;ENST00000422063;ENST00000407906;ENST00000317367;ENST00000447326;ENST00000430867 | TAF |
| 15% | chr7 | 8267515 | 8267268 | − | chr7 | 8261028 | 8260905 | − | ENST00000402384;ENST00000406470;ENST00000265577;ENST00000396675;ENST00000339809;ENST00000401396;ENST00000422063;ENST00000407906;ENST00000317367;ENST00000447326;ENST00000430867 | TAF |
| 15% | chr7 | 8267515 | 8267268 | − | chr7 | 8261028 | 8260905 | − | ENST00000402384;ENST00000406470;ENST00000265577;ENST00000396675;ENST00000339809;ENST00000401396;ENST00000422063;ENST00000407906;ENST00000317367;ENST00000447326;ENST00000430867 | TAF |
| 15% | chr11 | 77673812 | 77673716 | − | chr11 | 77672184 | 77672150; 77671999 | − | ENST00000433818;ENST00000534064;ENST00000529807 | TSF |
| 15% | chr11 | 77673812 | 77673716 | − | chr11 | 77672184 | 77672150; 77671999 | − | ENST00000433818;ENST00000534064;ENST00000529807 | TSF |
| 15% | chr11 | 77673812 | 77673716 | − | chr11 | 77672184 | 77672150; 77671999 | − | ENST00000433818;ENST00000534064;ENST00000529807 | TSF |
| 15% | chr15 | 63650282 | 63650004 | − | chr15 | 63638908 | 63638729 | − | ENST00000178638;ENST00000344366 | TSF |
| 15% | chr15 | 63650282 | 63650004 | − | chr15 | 63638908 | 63638729 | − | ENST00000178638;ENST00000344366 | TSF |
| 15% | chr22 | 37211553 | 37211536 | − | chr22 | 37211279 | 37211147 | − | ENST00000417718;ENST00000216200;ENST00000406910;ENST00000443735 | TSF |
| 15% | chr22 | 37211553 | 37211536 | − | chr22 | 37211279 | 37211147 | − | ENST00000417718;ENST00000216200;ENST00000406910;ENST00000443735 | TSF |
| 15% | chr22 | 37211553 | 37211536 | − | chr22 | 37211279 | 37211147 | − | ENST00000417718;ENST00000216200;ENST00000406910;ENST00000443735 | TSF |
| 14% | chr3 | 58365254 | 58365321 | + | chr3 | 58368241 | 58368427; 58368405 | + | ENST00000356151;ENST00000302779;ENST00000383716;ENST00000463280;ENST00000383715;ENST00000484288;ENST00000479241;ENST00000477308;ENST00000491164 | TAF |
| 14% | chr3 | 58365254 | 58365321 | + | chr3 | 58368241 | 58368427; 58368405 | + | ENST00000356151;ENST00000302779;ENST00000383716;ENST00000463280;ENST00000383715;ENST00000484288;ENST00000479241;ENST00000477308;ENST00000491164 | TAF |
| 14% | chr3 | 58365254 | 58365321 | + | chr3 | 58368241 | 58368427; 58368405 | + | ENST00000356151;ENST00000302779;ENST00000383716;ENST00000463280;ENST00000383715;ENST00000484288;ENST00000479241;ENST00000477308;ENST00000491164 | TAF |
| 14% | chr3 | 58365254 | 58365321 | + | chr3 | 58368241 | 58368427; 58368405 | + | ENST00000356151;ENST00000302779;ENST00000383716;ENST00000463280;ENST00000383715;ENST00000484288;ENST00000479241;ENST00000477308;ENST00000491164 | TAF |
| 14% | chr3 | 58365254 | 58365321 | + | chr3 | 58368241 | 58368427; 58368405 | + | ENST00000356151;ENST00000302779;ENST00000383716;ENST00000463280;ENST00000 | TAF |

TABLE 28-continued

Transcript fusion for Kidney Chromophobe (KICH) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| | | | | | | | | | 000383715;ENST00000484288;ENST00000479241;ENST00000477308;ENST00000491164 | |
| 14% | chr1 | 236534342 | 236534395 | + | chr1 | 236572516 | 236572574 | + | ENST00000334232;ENST00000359362 | TAF |
| 14% | chr3 | 45030340 | 45030346 | + | chr3 | 45030632 | 45030733 | + | ENST00000265564 | TAF |
| 14% | chr7 | 150938296 | 150938250 | − | chr7 | 150937608 | 150937511 | − | ENST00000262188;ENST00000392811;ENST00000356800 | TAF |
| 14% | chr4 | 491211 | 490916 | − | chr4 | 466490 | 466364 | − | ENST00000515578;ENST00000506646;ENST00000505900 | TAF |
| 14% | chr4 | 491211 | 490916 | − | chr4 | 466490 | 466364 | − | ENST00000515578;ENST00000506646;ENST00000505900 | TAF |
| 14% | chr4 | 491211 | 490916 | − | chr4 | 466490 | 466364 | − | ENST00000515578;ENST00000506646;ENST00000505900 | TAF |
| 14% | chr14 | 78042174 | 78042075 | − | chr14 | 78036851 | 78036727 | − | ENST00000216484;ENST00000554901 | TAF |
| 14% | chr14 | 78042174 | 78042075 | − | chr14 | 78036851 | 78036727 | − | ENST00000216484;ENST00000554901 | TAF |
| 14% | chr10 | 4986182 | 4986518 | + | chr10 | 5008106 | 5008273 | + | ENST00000434459;ENST00000380872;ENST00000380859 | TSF |
| 14% | chr10 | 4986182 | 4986518 | + | chr10 | 5008106 | 5008273 | + | ENST00000434459;ENST00000380872;ENST00000380859 | TSF |
| 14% | chr4 | 10533364 | 10533137 | − | chr4 | 10529718 | 10529700 | − | ENST00000226951 | TSF |
| 12% | chr2 | 47552899 | 47553008 | + | chr2 | 47600602 | 47600709 | + | ENST00000405271;ENST00000456133;ENST00000263735;ENST00000419334 | TAF |
| 12% | chr2 | 47552899 | 47553008 | + | chr2 | 47600602 | 47600709 | + | ENST00000405271;ENST00000456133;ENST00000263735;ENST00000419334 | TAF |
| 12% | chr19 | 1600051 | 1599987 | − | chr19 | 1599559 | 1599439 | − | ENST00000585937;ENST00000591899;ENST00000589880;ENST00000585671 | TAF |
| 12% | chr8 | 39710096 | 39709999 | − | chr8 | 39694731 | 39694655 | − | ENST00000347580;ENST00000379853;ENST00000265708;ENST00000521880 | TAF |
| 12% | chr8 | 39710096 | 39709999 | − | chr8 | 39694731 | 39694655 | − | ENST00000347580;ENST00000379853;ENST00000265708;ENST00000521880 | TAF |
| 12% | chr8 | 39710096 | 39709999 | − | chr8 | 39694731 | 39694655 | − | ENST00000347580;ENST00000379853;ENST00000265708;ENST00000521880 | TAF |
| 12% | chr8 | 39710096 | 39709999 | − | chr8 | 39694731 | 39694655 | − | ENST00000347580;ENST00000379853;ENST00000265708;ENST00000521880 | TAF |
| 12% | chr14 | 70466641 | 70466673 | + | chr14 | 70477471 | 70477663 | + | ENST00000361956;ENST00000381280 | TSF |
| 12% | chr14 | 70466641 | 70466673 | + | chr14 | 70477471 | 70477663 | + | ENST00000361956;ENST00000381280 | TSF |
| 12% | chr10 | 4990318 | 4992053 | + | chr10 | 5008196 | 5008273 | + | ENST00000434459;ENST00000380872;ENST00000380859 | TSF |
| 12% | chr10 | 4990318 | 4992053 | + | chr10 | 5008196 | 5008273 | + | ENST00000434459;ENST00000380872;ENST00000380859 | TSF |
| 12% | chr12 | 15087626 | 15087625 | − | chr12 | 15073982 | 15073866 | − | ENST00000266397;ENST00000540097 | TSF |
| 12% | chr6 | 129918031 | 129917934 | − | chr6 | 129905257 | 129905133 | − | ENST00000368149 | TSF |
| 11% | chr14 | 24107624 | 24107626 | + | chr14 | 24108388 | 24108565 | + | ENST00000432832;ENST00000250383;ENST00000344777 | TAF |
| 11% | chr14 | 24107624 | 24107626 | + | chr14 | 24108388 | 24108565 | + | ENST00000432832;ENST00000250383;ENST00000344777 | TAF |
| 11% | chr14 | 24107624 | 24107626 | + | chr14 | 24108388 | 24108565 | + | ENST00000432832;ENST00000250383;ENST00000344777 | TAF |
| 11% | chr15 | 69682891 | 69682983 | + | chr15 | 69689807 | 69689903 | + | ENST00000395407;ENST00000561153;ENST00000340965 | TAF |
| 11% | chr10 | 4990318 | 4992053 | + | chr10 | 5009119 | 5009235 | + | ENST00000434459;ENST00000380872;ENST00000442997;ENST00000380859 | TAF |
| 11% | chr10 | 4990318 | 4992053 | + | chr10 | 5009119 | 5009235 | + | ENST00000434459;ENST00000380872;ENST00000442997;ENST00000380859 | TAF |
| 11% | chr10 | 4990318 | 4992053 | + | chr10 | 5009119 | 5009235 | + | ENST00000434459;ENST00000380872;ENST00000442997;ENST00000380859 | TAF |
| 11% | chr7 | 27687049 | 27686771 | − | chr7 | 27672045 | 27671955; 27672036 | − | ENST00000265395;ENST00000428288;ENST00000425715 | TAF |
| 11% | chr7 | 27687049 | 27686771 | − | chr7 | 27672045 | 27671955; 27672036 | − | ENST00000265395;ENST00000428288;ENST00000425715 | TAF |
| 11% | chr7 | 27687049 | 27686771 | − | chr7 | 27672045 | 27671955; 27672036 | − | ENST00000265395;ENST00000428288;ENST00000425715 | TAF |
| 11% | chr10 | 101185022 | 101184972 | − | chr10 | 101180562 | 101180381 | − | ENST00000370508;ENST00000543866 | TAF |
| 11% | chr11 | 72412362 | 72412165 | − | chr11 | 72410597 | 72410462 | − | ENST00000359373;ENST00000455638;ENST00000393605;ENST00000334211;ENST00000393609;ENST00000426523;ENST00000429686;ENST00000427971;ENST00000452383 | TAF |
| 11% | chr11 | 72412362 | 72412165 | − | chr11 | 72410597 | 72410462 | − | ENST00000359373;ENST00000455638;ENST00000393605;ENST00000334211;ENST00000393609;ENST00000426523;ENST00000429686;ENST00000427971;ENST00000452383 | TAF |
| 11% | chr11 | 72412362 | 72412165 | − | chr11 | 72410597 | 72410462 | − | ENST00000359373;ENST00000455638;ENST00000393605;ENST00000334211;ENST00 | TAF |

TABLE 28-continued

Transcript fusion for Kidney Chromophobe (KICH) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 11% | chr11 | 72412362 | 72412165 | – | chr11 | 72410597 | 72410462 | – | 000393609;ENST00000426523;ENST00000429686;ENST00000427971;ENST00000452383 ENST00000359373;ENST00000455638;ENST00000393605;ENST00000334211;ENST00000393609;ENST00000426523;ENST00000429686;ENST00000427971;ENST00000452383 | TAF |
| 11% | chr9 | 35846065 | 35846070 | + | chr9 | 35846255 | 35846378 | + | ENST00000377996;ENST00000439587;ENST00000377991;ENST00000377988 | TSF |
| 11% | chr9 | 35846065 | 35846070 | + | chr9 | 35846255 | 35846378 | + | ENST00000377996;ENST00000439587;ENST00000377991;ENST00000377988 | TSF |
| 11% | chr18 | 29076431 | 29076818 | + | chr18 | 29098202 | 29098237 | + | ENST00000261590;ENST00000585206 | TSF |
| 11% | chr18 | 29076431 | 29076818 | + | chr18 | 29098202 | 29098237 | + | ENST00000261590;ENST00000585206 | TSF |
| 11% | chr14 | 58545088 | 58544802 | – | chr14 | 58478868 | 58478837 |   | ENST00000267485 | TSF |
| 11% | chr20 | 30457064 | 30457004 | – | chr20 | 30454956 | 30454874 | – | ENST00000278979;ENST00000375966;ENST00000339738;ENST00000428829 | TSF |
| 11% | chr20 | 30457064 | 30457004 | – | chr20 | 30454956 | 30454874 | – | ENST00000278979;ENST00000375966;ENST00000339738;ENST00000428829 | TSF |
| 11% | chr20 | 30457064 | 30457004 | – | chr20 | 30454956 | 30454874 | – | ENST00000278979;ENST00000375966;ENST00000339738;ENST00000428829 | TSF |
| 9% | chr4 | 68436241 | 68436356 | + | chr4 | 68436802 | 68436873 | + | ENST00000265404;ENST00000396225 | TSF |
| 9% | chr19 | 1232978 | 1232910 | – | chr19 | 1231274 | 1230892; 1231100 | – | ENST00000590083;ENST00000382477;ENST00000215376 | TSF |
| 9% | chr19 | 1232978 | 1232910 | – | chr19 | 1231274 | 1230892; 1231100 | – | ENST00000590083;ENST00000382477;ENST00000215376 | TSF |
| 9% | chr | 80022917 | 80022085 | – | chr6 | 79924739 | 79924689 | – | ENST00000275036;ENST00000344726 | TSF |
| 9% | chr6 | 80022917 | 80022085 | – | chr6 | 79924739 | 79924689 | – | ENST00000275036;ENST00000344726 | TSF |
| 9% | chr4 | 10546721 | 10546658 | – | chr4 | 10543904 | 10543879 | – | ENST00000226951;ENST00000442825;ENST00000507719 | TSF |
| 9% | chr4 | 10546721 | 10546658 | – | chr4 | 10543904 | 10543879 | – | ENST00000226951;ENST00000442825;ENST00000507719 | TSF |
| 9% | chr4 | 10546721 | 10546658 | – | chr4 | 10543904 | 10543879 | – | ENST00000226951;ENST00000442825;ENST00000507719 | TSF |
| 9% | chrX | 119449588 | 119449552 | – | chrX | 119438268 | 119438204 | – | ENST00000309720;ENST00000371369;ENST00000440464;ENST00000519908 | TSF |
| 9% | chrX | 119449588 | 119449552 | – | chrX | 119438268 | 119438204 | – | ENST00000309720;ENST00000371369;ENST00000440464; ENST00000519908 | TSF |
| 9% | chrX | 119449588 | 119449552 | – | chrX | 119438268 | 119438204 | – | ENST00000309720;ENST00000371369;ENST00000440464;ENST00000519908 | TSF |
| 9% | chr> | 119449588 | 119449552 | – | chrX | 119438268 | 119438204 | – | ENST00000309720;ENST00000371369;ENST00000440464; ENST00000519908 | TSF |

TABLE 29

Transcript fusion for Kidney Renal Clear Cell Carcinoma (KICH) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 53% | chr1 | 60370730 | 60370543 | – | ENST00000371204 | chr1 | 60370188 | 60370144 | – | TAF |
| 47% | chr10 | 14709690 | 14709633 | – | ENST00000181796;ENST00000487335 | chr10 | 14664173 | 14664120 | – | TAF |
| 41% | chr3 | 122658317 | 122658272 | – | ENST00000357599;ENST00000475244;ENST000001 95173;ENST00000451055;ENST00000393583 | chr3 | 122652101 | 122651901 | – | TAF |
| 41% | chr3 | 122658317 | 122658272 | – | ENST00000357599;ENST00000475244;ENST000001 95173;ENST00000451055;ENST00000393583 | chr3 | 122652101 | 122651901 | – | TAF |
| 36% | chr5 | 156464372 | 156464258 | – | ENST00000522693;ENST00000523175;ENST0000033 9252;ENST00000425854;ENST00000544197 | chr5 | 156429918 | 156429891 | – | TSF |
| 29% | chr15 | 85467216 | 85467341 | + | ENST00000538177;ENST00000537216;ENST0000053 7624;ENST00000286749;ENST00000537703;ENST00000394573 | chr15 | 85472528 | 85472791 | + | TAF |
| 29% | chr15 | 85467216 | 85467341 | + | ENST00000538177;ENST00000537216;ENST0000053 7624;ENST00000286749;ENST00000537703;ENST00000394573 | chr15 | 85472528 | 85472791 | + | TAF |
| 27% | chr6 | 25849692; 25849622 | 25849602 | – | ENST00000481949;ENST00000505420;ENST0000039 7060;ENST00000361703;ENST00000360657 | chr6 | 25847464 | 25847164 | – | TAF |
| 27% | chr6 | 25849692; 25849622 | 25849602 | – | ENST00000481949;ENST00000505420;ENST0000039 7060;ENST00000361703;ENST00000360657 | chr6 | 25847464 | 25847164 | + | TAF |
| 27% | chr6 | 25849692; 25849622 | 25849602 | – | ENST00000481949;ENST00000505420;ENST0000039 7060;ENST00000361703;ENST00000360657 | chr6 | 25847464 | 25847164 | + | TAF |

TABLE 29-continued

Transcript fusion for Kidney Renal Clear Cell Carcinoma (KICH) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 27% | chr6 | 25849692; 25849622 | 25849602 | − | ENST00000481949;ENST00000505420;ENST00000397060;ENST00000361703;ENST00000360657 | chr6 | 25847464 | 25847164 | − | TAF |
| 19% | chr5 | 177657100; 177657074 | 177656941 | − | ENST00000308158;ENST00000510913;ENST00000323594;ENST00000476170 | chr5 | 177656721 | 177656690 | − | TAF |
| 19% | chr5 | 177657100; 177657074 | 177656941 | − | ENST00000308158;ENST00000510913;ENST00000323594;ENST00000476170 | chr5 | 177656721 | 177656690 | − | TAF |
| 19% | chr5 | 177657100; 177657074 | 177656941 | − | ENST00000308158;ENST00000510913;ENST00000323594;ENST00000476170 | chr5 | 177656721 | 177656690 | − | TAF |
| 19% | chr5 | 147649636 | 147649705 | + | ENST00000512953;ENST00000398450 | chr5 | 147650360 | 147650640 | + | TAF |
| 18% | chr5 | 147649636 | 147649705 | + | ENST00000512953;ENST00000398450 | chr5 | 147650500 | 147650640 | + | TAF |
| 18% | chr7 | 27582719 | 27582586 | − | ENST00000265395;ENST00000425715 | chr7 | 27581374 | 27579272 | − | TAF |
| 18% | chr7 | 27582719 | 27582586 | − | ENST00000265395;ENST00000425715 | chr7 | 27581374 | 27579272 | | TAF |
| 18% | chr5 | 1409240 | 1409141 | − | ENST00000270349;ENST00000453492 | chr5 | 1406873 | 1406748 | − | TSF |
| 17% | chr5 | 147281336 | 147281192 | − | ENST00000318315;ENST00000515291 | chr5 | 147260657 | 147260560 | − | TAF |
| 14% | chr19 | 39433391 | 39433350 | − | ENST00000448145;ENST00000599996;ENST00000292852;ENST00000595329 | chr19 | 39432008 | 39431967 | − | TAF |
| 14% | chr19 | 39433391 | 39433350 | − | ENST00000448145;ENST00000599996;ENST00000292852;ENST00000595329 | chr19 | 39432008 | 39431967 | − | TAF |
| 14% | chr19 | 39433391 | 39433350 | − | ENST00000448145;ENST00000599996;ENST00000292852;ENST00000595329 | chr19 | 39432008 | 39431967 | − | TAF |
| 13% | chr2 | 27320371 | 27320517 | + | ENST00000260599;ENST00000260598;ENST00000429697 | chr2 | 27321791 | 27321916 | + | TAF |
| 13% | chr2 | 27320371 | 27320517 | + | ENST00000260599;ENST00000260598;ENST00000429697 | chr2 | 27321791 | 27321916 | + | TAF |
| 13% | chr2 | 27320371 | 27320517 | + | ENST00000260599;ENST00000260598;ENST00000429697 | chr2 | 27321791 | 27321916 | + | TAF |
| 13% | chr5 | 147281336 | 147281192 | − | ENST00000318315;ENST00000515291 | chr5 | 147230105 | 147229718 | − | TSF |
| 12% | chrX | 152730513 | 152730446 | − | ENST00000370211;ENST00000370212;ENST00000370210 | chrX | 152728559 | 152728505 | − | TAF |
| 12% | chrX | 152730513 | 152730446 | − | ENST00000370211;ENST00000370212;ENST00000370210 | chrX | 152728559 | 152728505 | − | TAF |
| 12% | chr10 | 17061982 | 17061832 | − | ENST00000377833 | chr10 | 17054170 | 17053931 | − | TAF |
| 12% | chr19 | 39435744 | 39435609 | − | ENST00000448145;ENST00000599996;ENST00000292852;ENST00000595329;ENST00000599598 | chr19 | 39434842 | 39434530 | − | TAF |
| 12% | chr19 | 39435744 | 39435609 | − | ENST00000448145;ENST00000599996;ENST00000292852;ENST00000595329;ENST00000599598 | chr19 | 39434842 | 39434530 | − | TAF |
| 12% | chr19 | 39435744 | 39435609 | − | ENST00000448145;ENST00000599996;ENST00000292852;ENST00000595329;ENST00000599598 | chr19 | 39434842 | 39434530 | − | TAF |
| 12% | chr19 | 39435744 | 39435609 | − | ENST00000448145;ENST00000599996;ENST00000292852;ENST00000595329;ENST00000599598 | chr19 | 39434842 | 39434530 | − | TAF |
| 12% | chr4 | 25759228 | 25759156 | − | ENST00000399878;ENST00000264868;ENST00000502949;ENST00000510448 | chr4 | 25723603 | 25723555 | − | TSF |
| 12% | chr4 | 25759228 | 25759156 | − | ENST00000399878;ENST00000264868;ENST00000502949;ENST00000510448 | chr4 | 25723603 | 25723555 | − | TSF |
| 12% | chr4 | 25759228 | 25759156 | − | ENST00000399878;ENST00000264868;ENST00000502949;ENST00000510448 | chr4 | 25723603 | 25723555 | − | TSF |
| 12% | chr4 | 25759228 | 25759156 | − | ENST00000399878;ENST00000264868;ENST00000502949;ENST00000510448 | chr4 | 25723603 | 25723555 | − | TSF |
| 10% | chr6 | 36762426 | 36762367 | − | ENST00000244751 | chr6 | 36760223 | 36760189 | − | TAF |
| 10% | chr16 | 1728314 | 1728357 | + | ENST00000248098;ENST00000562684;ENST00000561516;ENST00000566742;ENST00000566925;ENST00000569765 | chr16 | 1729780 | 1730066 | + | TAF |
| 10% | chr5 | 121405863 | 121405748 | − | ENST00000231004 | chr5 | 121403052 | 121403016 | + | TSF |
| 8% | chr6 | 25691284 | 25691352 | + | ENST00000377961 | chr6 | 25718996 | 25719185 | + | TSF |
| 6% | chr3 | 48716169 | 48715997 | − | ENST00000341520;ENST00000416649;ENST00000294129;ENST00000413374 | chr3 | 48702393 | 48702198 | − | TSF |
| 6% | chr3 | 48716169 | 48715997 | − | ENST00000341520;ENST00000416649;ENST00000294129;ENST00000413374 | chr3 | 48702393 | 48702198 | − | TSF |
| 6% | chr3 | 48716169 | 48715997 | − | ENST00000341520;ENST00000416649;ENST00000294129;ENST00000413374 | chr3 | 48702393 | 48702198 | − | TSF |
| 5% | chr17 | 25934940 | 25935036 | + | ENST00000509603;ENST00000319524;ENST00000268763;ENST00000398988;ENST00000398982 | chr17 | 25936150 | 25936175 | + | TSF |
| 5% | chr17 | 25934940 | 25935036 | + | ENST00000509603;ENST00000319524;ENST00000268763;ENST00000398988;ENST00000398982 | chr17 | 25936150 | 25936175 | + | TSF |
| 5% | chr17 | 25934940 | 25935036 | + | ENST00000509603;ENST00000319524;ENST00000268763;ENST00000398988;ENST00000398982 | chr17 | 25936150 | 25936175 | + | TSF |

TABLE 29-continued

Transcript fusion for Kidney Renal Clear Cell Carcinoma (KICH) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 5% | chr17 | 25934940 | 25935036 | + | 68763;ENST00000398988;ENST00000398982 ENST00000509603;ENST00000319524;ENST000002 68763;ENST00000398988;ENST00000398982 | chr17 | 25936150 | 25936175 | + | TSF |
| 5% | chr17 | 18880167 | 18880302 | + | ENST00000317977;ENST00000395642;ENST000003 95647;ENST00000417251;ENST00000395643;ENST0 0000395645 | chr17 | 18897052 | 18897057 | + | TSF |
| 5% | chr17 | 18880167 | 18880302 | + | ENST00000317977;ENST00000395642;ENST000003 95647;ENST00000417251;ENST00000395643;ENST0 0000395645 | chr17 | 18897052 | 18897057 | + | TSF |
| 5% | chr17 | 18880167 | 18880302 | + | ENST00000317977;ENST00000395642;ENST000003 95647;ENST00000417251;ENST00000395643;ENST0 0000395645 | chr17 | 18897052 | 18897057 | + | TSF |
| 5% | chr5 | 147649636 | 147649705 | + | ENST00000512953;ENST00000398450 | chr5 | 147650327 | 147650640 | + | TSF |
| 4% | chr6 | 167352496 | 167352383 | − | ENST00000507747;ENST00000366855;ENST000005 08775;ENST00000476238;ENST00000478180 | chr6 | 167351170 | 167351130 | − | TSF |
| 4% | chr6 | 167352496 | 167352383 | − | ENST00000507747;ENST00000366855;ENST000005 08775;ENST00000476238;ENST00000478180 | chr6 | 167351170 | 167351130 | + | TSF |
| 4% | chr6 | 167352496 | 167352383 | − | ENST00000507747;ENST00000366855;ENST000005 08775;ENST00000476238;ENST00000478180 | chr6 | 167351170 | 167351130 | − | TSF |
| 4% | chr12 | 28636985 | 28637098 | + | ENST00000539107;ENST00000545336;ENST000003 81256;ENST00000381259;ENST00000306172;ENST0 0000535212;ENST00000542801 | chr12 | 28732785 | 28732895 | + | TSF |
| 4% | chr12 | 28636985 | 28637098 | + | ENST00000539107;ENST00000545336;ENST000003 81256;ENST00000381259;ENST00000306172;ENST0 0000535212;ENST00000542801 | chr12 | 28732785 | 28732895 | + | TSF |
| 4% | chr12 | 28636985 | 28637098 | + | ENST00000539107;ENST00000545336;ENST000003 81256;ENST00000381259;ENST00000306172;ENST0 0000535212;ENST00000542801 | chr12 | 28732785 | 28732895 | + | TSF |
| 4% | chr12 | 28636985 | 28637098 | + | ENST00000539107;ENST00000545336;ENST000003 81256;ENST00000381259;ENST00000306172;ENST0 0000535212;ENST00000542801 | chr12 | 28732785 | 28732895 | + | TSF |
| 4% | chr12 | 28636985 | 28637098 | + | ENST00000539107;ENST00000545336;ENST000003 81256;ENST00000381259;ENST00000306172;ENST0 0000535212;ENST00000542801 | chr12 | 28732785 | 28732895 | + | TSF |
| 4% | chr18 | 32650166; 32650159 | 32650286 | + | ENST00000591734;ENST00000413393;ENST000005 87359;ENST00000436190;ENST00000588349;ENST0 0000300249;ENST00000588910;ENST00000589699 | chr18 | 32670836 | 32671096 | + | TSF |
| 4% | chr18 | 32650166; 32650159 | 32650286 | + | ENST00000591734;ENST00000413393;ENST000005 87359;ENST00000436190;ENST00000588349;ENST0 0000300249;ENST00000588910;ENST00000589699 | chr18 | 32670836 | 32671096 | + | TSF |
| 4% | chr18 | 32650166; 32650159 | 32650286 | + | ENST00000591734;ENST00000413393;ENST000005 87359;ENST00000436190;ENST00000588349;ENST0 0000300249;ENST00000588910;ENST00000589699 | chr18 | 32670836 | 32671096 | + | TSF |
| 3% | chr11 | 58480322; 58480359 | 58480233 | − | ENST00000586098;ENST00000344743;ENST000005 29732;ENST00000278400 | chr11 | 58467960 | 58463759 | + | TSF |
| 3% | chr11 | 58480322; 58480359 | 58480233 | − | ENST00000586098;ENST00000344743;ENST000005 29732;ENST00000278400 | chr11 | 58467960 | 58463759 | − | TSF |
| 2% | chr12 | 58024115 | 58023935 | − | ENST00000341156;ENST00000418555;ENST000005 52798;ENST00000549391;ENST00000449184;ENST0 0000550764;ENST00000552350;ENST00000548888 | chr12 | 58023079 | 58022983 | − | TSF |
| 2% | chr12 | 58024115 | 58023935 | − | ENST00000341156;ENST00000418555;ENST000005 52798;ENST00000549391;ENST00000449184;ENST0 0000550764;ENST00000552350;ENST00000548888 | chr12 | 58023079 | 58022983 | + | TSF |
| 2% | chr12 | 58024115 | 58023935 | − | ENST00000341156;ENST00000418555;ENST000005 52798;ENST00000549391;ENST00000449184;ENST0 0000550764;ENST00000552350;ENST00000548888 | chr12 | 58023079 | 58022983 | − | TSF |
| 2% | chr12 | 58024115 | 58023935 | − | ENST00000341156;ENST00000418555;ENST000005 52798;ENST00000549391;ENST00000449184;ENST0 0000550764;ENST00000552350;ENST00000548888 | chr12 | 58023079 | 58022983 | + | TSF |
| 2% | chr7 | 55270210 | 55270401 | + | ENST00000455089 | chr7 | 55272949 | 55272949 | + | TSF |
| 2% | chr2 | 214228800 | 214228869 | + | ENST00000331683;ENST00000413312;ENST000002 72898;ENST00000447990;ENST00000374309 | chr2 | 214233538 | 214233723 | + | TSF |
| 2% | chr2 | 214228800 | 214228869 | + | ENST00000331683;ENST00000413312;ENST000002 72898;ENST00000447990;ENST00000374309 | chr2 | 214233538 | 214233723 | + | TSF |
| 2% | chr2 | 214228800 | 214228869 | + | ENST00000331683;ENST00000413312;ENST000002 72898;ENST00000447990;ENST00000374309 | chr2 | 214233538 | 214233723 | + | TSF |
| 2% | chr15 | 85478552 | 85478749 | + | ENST00000537216;ENST00000537624;ENST000002 86749;ENST00000394573 | chr15 | 85494311 | 85494404 | + | TSF |
| 2% | chr1 | 2492063 | 2492153 | + | ENST00000426449;ENST00000434817;ENST000004 35221;ENST00000451778;ENST00000409119;ENST0 0000355716 | chr1 | 2508457 | 2508463 | + | TSF |
| 2% | chr4 | 25759228 | 25759156 | − | ENST00000399878;ENST00000264868;ENST000005 02949;ENST00000510448 | chr4 | 25732727 | 25732722 | − | TSF |

TABLE 29-continued

Transcript fusion for Kidney Renal Clear Cell Carcinoma (KICH) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 2% | chr4 | 25759228 | 25759156 | − | ENST00000399878;ENST00000264868;ENST00000502949;ENST00000510448 | chr4 | 25732727 | 25732722 | − | TSF |
| 2% | chr4 | 25759228 | 25759156 | − | ENST00000399878;ENST00000264868;ENST00000502949;ENST00000510448 | chr4 | 25732727 | 25732722 | − | TSF |
| 2% | chr4 | 25759228 | 25759156 | − | ENST00000399878;ENST00000264868;ENST00000502949;ENST00000510448 | chr4 | 25732727 | 25732722 | − | TSF |
| 2% | chr3 | 145788954 | 145788829 | − | ENST00000461497;ENST00000282903;ENST00000360060;ENST00000494950 | chr3 | 145784472 | 145784175 | + | TSF |
| 2% | chr3 | 145788954 | 145788829 | − | ENST00000461497;ENST00000282903;ENST00000360060;ENST00000494950 | chr3 | 145784472 | 145784175 | − | TSF |
| 2% | chr3 | 145788954 | 145788829 | − | ENST00000461497;ENST00000282903;ENST00000360060;ENST00000494950 | chr3 | 145784472 | 145784175 | − | TSF |
| 2% | chr3 | 145788954 | 145788829 | − | ENST00000461497;ENST00000282903;ENST00000360060;ENST00000494950 | chr3 | 145784472 | 145784175 | − | TSF |
| 2% | chr3 | 145788954 | 145788829 | − | ENST00000461497;ENST00000282903;ENST00000360060;ENST00000494950 | chr3 | 145784468 | 145784175 | − | TSF |
| 2% | chr3 | 145788954 | 145788829 | − | ENST00000461497;ENST00000282903;ENST00000360060;ENST00000494950 | chr3 | 145784468 | 145784175 | − | TSF |
| 2% | chr3 | 145788954 | 145788829 | − | ENST00000461497;ENST00000282903;ENST00000360060;ENST00000494950 | chr3 | 145784468 | 145784175 | − | TSF |
| 2% | chr3 | 145788954 | 145788829 | − | ENST00000461497;ENST00000282903;ENST00000360060;ENST00000494950 | chr3 | 145784468 | 145784175 | − | TSF |
| 2% | chr3 | 194325174; 194325170 | 194325016 | − | ENST00000392432;ENST00000273580;ENST00000432352;ENST00000381975;ENST00000347147;ENST00000473092;ENST00000452358 | chr3 | 194296178 | 194295847 | − | TSF |
| 2% | chr3 | 194325174; 194325170 | 194325016 | − | ENST00000392432;ENST00000273580;ENST00000432352;ENST00000381975;ENST00000347147;ENST00000473092;ENST00000452358 | chr3 | 194296178 | 194295847 | − | TSF |
| 2% | chr3 | 194325174; 194325170 | 194325016 | − | ENST00000392432;ENST00000273580;ENST00000432352;ENST00000381975;ENST00000347147;ENST00000473092;ENST00000452358 | chr3 | 194296178 | 194295847 | − | TSF |
| 2% | chr3 | 194325174; 194325170 | 194325016 | − | ENST00000392432;ENST00000273580;ENST00000432352;ENST00000381975;ENST00000347147;ENST00000473092;ENST00000452358 | chr3 | 194296178 | 194295847 | − | TSF |
| 2% | chr3 | 194325174; 194325170 | 194325016 | − | ENST00000392432;ENST00000273580;ENST00000432352;ENST00000381975;ENST00000347147;ENST00000473092;ENST00000452358 | chr3 | 194296178 | 194295847 | − | TSF |
| 2% | chr10 | 3177928 | 3178030 | + | ENST00000381125;ENST00000381075;ENST00000381072;ENST00000433193 | chr10 | 3202810 | 3202810 | + | TSF |
| 2% | chr10 | 3177928 | 3178030 | + | ENST00000381125;ENST00000381075;ENST00000381072;ENST00000433193 | chr10 | 3202810 | 3202810 | + | TSF |
| 2% | chr10 | 3177928 | 3178030 | + | ENST00000381125;ENST00000381075;ENST00000381072;ENST00000433193 | chr10 | 3202810 | 3202810 | + | TSF |
| 2% | chr10 | 3177928 | 3178030 | + | ENST00000381125;ENST00000381075;ENST00000381072;ENST00000433193 | chr10 | 3202810 | 3202810 | + | TSF |
| 2% | chr2 | 110671988 | 110672054 | + | ENST00000553749 | chr2 | 110672249 | 110672374 | + | TSF |
| 2% | chr11 | 27147201 | 27147367 | + | ENST00000529202;ENST00000263182;ENST00000528583;ENST00000525090 | chr11 | 27153068 | 27153143 | + | TSF |
| 2% | chr3 | 98600611; 98600498 | 98600384 | − | ENST00000326840;ENST00000326857;ENST00000449482 | chr3 | 98586282 | 98584565 | − | TSF |
| 2% | chr3 | 98600611; 98600498 | 98600384 | − | ENST00000326840;ENST00000326857;ENST00000449482 | chr3 | 98586282 | 98584565 | − | TSF |
| 2% | chr4 | 25759228 | 25759156 | − | ENST00000399878;ENST00000264868;ENST00000502949;ENST00000510448 | chr4 | 25716488 | 25716212 | − | TSF |
| 2% | chr4 | 25759228 | 25759156 | − | ENST00000399878;ENST00000264868;ENST00000502949;ENST00000510448 | chr4 | 25716488 | 25716212 | − | TSF |
| 2% | chr4 | 25759228 | 25759156 | − | ENST00000399878;ENST00000264868;ENST00000502949;ENST00000510448 | chr4 | 25716488 | 25716212 | − | TSF |
| 2% | chr4 | 25759228 | 25759156 | − | ENST00000399878;ENST00000264868;ENST00000502949;ENST00000510448 | chr4 | 25716488 | 25716212 | − | TSF |
| 2% | chr22 | 47071365 | 47071449 | + | ENST00000406902;ENST00000361034;ENST00000408031 | chr22 | 47078308 | 47078350 | + | TSF |
| 2% | chr22 | 47071365 | 47071449 | 1 | ENST00000406902;ENST00000361034;ENST00000408031 | chr22 | 47078308 | 47078350 | + | TSF |
| 2% | chr10 | 64416156 | 64416246 | + | ENST00000410046;ENST00000395251 | chr10 | 64417763 | 64418650 | + | TSF |
| 2% | chr10 | 64416156 | 64416246 | + | ENST00000410046;ENST00000395251 | chr10 | 64417763 | 64418650 | + | TSF |
| 2% | chr16 | 20492144 | 20492243 | + | ENST00000417235;ENST00000536134;ENST00000573854;ENST00000219054;ENST00000575690;ENST00000396104 | chr16 | 20492741 | 20493191 | + | TSF |
| 2% | chr16 | 20492144 | 20492243 | + | ENST00000417235;ENST00000536134;ENST00000573854;ENST00000219054;ENST00000575690;ENST00000396104 | chr16 | 20492741 | 20493191 | + | TSF |

TABLE 29-continued

Transcript fusion for Kidney Renal Clear Cell Carcinoma (KICH) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 2% | chr16 | 20492144 | 20492243 | + | ENST00000417235;ENST00000536134;ENST000005 73854;ENST00000219054;ENST00000575690;ENST0 0000396104 | chr16 | 20492741 | 20493191 | + | TSF |
| 2% | chr17 | 36288631 | 36288740 | + | ENST00000327454;ENST00000378174;ENST000005 05415;ENST00000539424 | chr17 | 36289142 | 36289609 | + | TSF |
| 2% | chr17 | 36288631 | 36288740 | + | ENST00000327454;ENST00000378174;ENST000005 05415;ENST00000539424 | chr17 | 36289142 | 36289609 | + | TSF |
| 2% | chr6 | 25691284 | 25691352 | + | ENST00000377961 | chr6 | 25737488 | 25737845 | + | TSF |
| 2% | chr7 | 151573705 | 151573592 | − | ENST00000287878;ENST00000488258 | chr7 | 151532195 | 151531867 | − | TSF |
| 2% | chr18 | 56182313 | 56182225 | − | ENST00000361673 | chr18 | 56171854 | 56171790 | − | TSF |
| 2% | chr19 | 23556639 | 23556544 | − | ENST00000599743;ENST00000300619 | chr19 | 23491899 | 23491588 | − | TSF |
| 2% | chr12 | 56742407 | 56742313 | − | ENST00000314128;ENST00000557235 | chr12 | 56740986 | 56740975 | − | TSF |
| 2% | chr12 | 56742407 | 56742313 | − | ENST00000314128;ENST00000557235 | chr12 | 56740986 | 56740975 | − | TSF |
| 2% | chr2 | 111214673 | 111214607 | − | ENST00000603767;ENST00000447537 | chr2 | 111214412 | 111214287 | − | TSF |
| 1% | chr15 | 85487987 | 85488098 | + | ENST00000538177;ENST00000537624;ENST000002 86749;ENST00000394573 | chr15 | 85494311 | 85494404 | + | TSF |
| 1% | chr15 | 85487987 | 85488098 | + | ENST00000538177;ENST00000537624;ENST000002 86749;ENST00000394573 | chr15 | 85494311 | 85494404 | + | TSF |
| 1% | chr18 | 72179683 | 72179767 | + | ENST00000324262;ENST00000579847;ENST000005 83785;ENST00000324301;ENST00000579624 | chr18 | 72180493 | 72180593 | + | TSF |
| 1% | chr18 | 72179683 | 72179767 | + | ENST00000324262;ENST00000579847;ENST000005 83785;ENST00000324301;ENST00000579624 | chr18 | 72180493 | 72180593 | + | TSF |
| 1% | chr18 | 72179683 | 72179767 | + | ENST00000324262;ENST00000579847;ENST000005 83785;ENST00000324301;ENST00000579624 | chr18 | 72180493 | 72180593 | + | TSF |
| 1% | chr6 | 25851105 | 25850987 | − | ENST00000397060;ENST00000361703;ENST000003 60657 | chr6 | 25836733 | 25836517 | − | TSF |
| 1% | chr6 | 25851105 | 25850987 | − | ENST00000397060;ENST00000361703;ENST000003 60657 | chr6 | 25836733 | 25836517 | − | TSF |
| 1% | chr19 | 39435744 | 39435609 | − | ENST00000448145;ENST00000599996;ENST000002 92852;ENST00000595329;ENST00000599598 | chr19 | 39435141 | 39434931 | − | TSF |
| 1% | chr19 | 39435744 | 39435609 | − | ENST00000448145;ENST00000599996;ENST000002 92852;ENST00000595329;ENST00000599598 | chr19 | 39435141 | 39434931 | − | TSF |
| 1% | chr19 | 39435744 | 39435609 | − | ENST00000448145;ENST00000599996;ENST000002 92852;ENST00000595329;ENST00000599598 | chr19 | 39435141 | 39434931 | − | TSF |
| 1% | chr19 | 39435744 | 39435609 | − | ENST00000448145;ENST00000599996;ENST000002 92852;ENST00000595329;ENST00000599598 | chr19 | 39435141 | 39434931 | − | TSF |
| 1% | chr3 | 132322171 | 132322073 | − | ENST00000355458;ENST00000264990;ENST000005 45291;ENST00000510100 | chr3 | 132321769 | 132321649 | − | TSF |
| 1% | chr3 | 132322171 | 132322073 | − | ENST00000355458;ENST00000264990;ENST000005 45291;ENST00000510100 | chr3 | 132321769 | 132321649 | − | TSF |
| 1% | chr3 | 132322171 | 132322073 | − | ENST00000355458;ENST00000264990;ENST000005 45291;ENST00000510100 | chr3 | 132321769 | 132321649 | − | TSF |
| 1% | chr17 | 36343995 | 36343886 | − | ENST00000518551;ENST00000354664;ENST000003 39023;ENST00000519532;ENST00000537432 | chr17 | 36343484 | 36343017 | − | TSF |
| 1% | chr17 | 36343995 | 36343886 | − | ENST00000518551;ENST00000354664;ENST000003 39023;ENST00000519532;ENST00000537432 | chr17 | 36343484 | 36343017 | − | TSF |
| 1% | chr17 | 80656472 | 80656331 | − | ENST00000571995;ENST00000538809 | chr17 | 80634662 | 80634498 | − | TSF |
| 1% | chr1 | 163172625 | 163172582 | − | ENST00000313961;ENST00000530507;ENST000005 31476 | chr1 | 163138964 | 163138652 | − | TSF |
| 1% | chr17 | 19470409 | 19470541 | + | ENST00000571335;ENST00000436810;ENST000004 57293;ENST00000270570;ENST00000395585 | chr17 | 19482057 | 19482370 | + | TSF |
| 1% | chr17 | 19470409 | 19470541 | + | ENST00000571335;ENST00000436810;ENST000004 57293;ENST00000270570;ENST00000395585 | chr17 | 19482057 | 19482370 | + | TSF |
| 1% | chr17 | 19470409 | 19470541 | + | ENST00000571335;ENST00000436810;ENST000004 57293;ENST00000270570;ENST00000395585 | chr17 | 19482057 | 19482370 | + | TSF |
| 1% | chr1 | 59811919 | 59812070 | + | ENST00000413489;ENST00000371218;ENST000003 03721;ENST00000430447 | chr1 | 59840819 | 59840959 | + | TSF |
| 1% | chr16 | 3118181 | 3118240 | + | ENST00000325568;ENST00000534507;ENST000005 31965;ENST00000396887;ENST00000526464;ENST0 0000440815;ENST00000529550;ENST00000551122;E NST00000525643;ENST00000548807;ENST00000528 163;ENST00000530890;ENST00000444393;ENST000 00533097;ENST00000008180;ENST00000396890;EN ST00000525228;ENST00000548652;ENST000005253 77;ENST00000530538;ENST00000549213;ENST0000 0552936;ENST00000548476;ENST00000552664;ENS T00000552356;ENST00000551513;ENST0000038221 | chr16 | 3135449 | 3135770 | + | TSF |

TABLE 29-continued

Transcript fusion for Kidney Renal Clear Cell Carcinoma (KICH) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 1% | chr16 | 3118181 | 3118240 | + | ENST00000325568;ENST00000534507;ENST00000531965;ENST00000396887;ENST00000526464;ENST00000440815;ENST00000529550;ENST00000551122;ENST00000525643;ENST00000548807;ENST00000528163;ENST00000530890;ENST00000444393;ENST00000533097;ENST00000008180;ENST00000396890;ENST00000525228;ENST00000548652;ENST00000525377;ENST00000530538;ENST00000549213;ENST00000552936;ENST00000548476;ENST00000552664;ENST00000552356;ENST00000551513;ENST00000382213 | chr16 | 3135449 | 3135770 | + | TSF |
| 1% | chr16 | 3118181 | 3118240 | + | ENST00000325568;ENST00000534507;ENST00000531965;ENST00000396887;ENST00000526464;ENST00000440815;ENST00000529550;ENST00000551122;ENST00000525643;ENST00000548807;ENST00000528163;ENST00000530890;ENST00000444393;ENST00000533097;ENST00000008180;ENST00000396890;ENST00000525228;ENST00000548652;ENST00000525377;ENST00000530538;ENST00000549213;ENST00000552936;ENST00000548476;ENST00000552664;ENST00000552356;ENST00000551513;ENST00000382213 | chr16 | 3135449 | 3135770 | + | TSF |
| 1% | chr16 | 3118181 | 3118240 | + | ENST00000325568;ENST00000534507;ENST00000531965;ENST00000396887;ENST00000526464;ENST00000440815;ENST00000529550;ENST00000551122;ENST00000525643;ENST00000548807;ENST00000528163;ENST00000530890;ENST00000444393;ENST00000533097;ENST00000008180;ENST00000396890;ENST00000525228;ENST00000548652;ENST00000525377;ENST00000530538;ENST00000549213;ENST00000552936;ENST00000548476;ENST00000552664;ENST00000552356;ENST00000551513;ENST00000382213 | chr16 | 3135449 | 3135770 | + | TSF |
| 1% | chr16 | 3118181 | 3118240 | + | ENST00000325568;ENST00000534507;ENST00000531965;ENST00000396887;ENST00000526464;ENST00000440815;ENST00000529550;ENST00000551122;ENST00000525643;ENST00000548807;ENST00000528163;ENST00000530890;ENST00000444393;ENST00000533097;ENST00000008180;ENST00000396890;ENST00000525228;ENST00000548652;ENST00000525377;ENST00000530538;ENST00000549213;ENST00000552936;ENST00000548476;ENST00000552664;ENST00000552356;ENST00000551513;ENST00000382213 | chr16 | 3135449 | 3135770 | + | TSF |
| 1% | chr16 | 3118181 | 3118240 | + | ENST00000325568;ENST00000534507;ENST00000531965;ENST00000396887;ENST00000526464;ENST00000440815;ENST00000529550;ENST00000551122;ENST00000525643;ENST00000548807;ENST00000528163;ENST00000530890;ENST00000444393;ENST00000533097;ENST00000008180;ENST00000396890;ENST00000525228;ENST00000548652;ENST00000525377;ENST00000530538;ENST00000549213;ENST00000552936;ENST00000548476;ENST00000552664;ENST00000552356;ENST00000551513;ENST00000382213 | chr16 | 3135449 | 3135770 | + | TSF |
| 1% | chr16 | 3118181 | 3118240 | + | ENST00000325568;ENST00000534507;ENST00000531965;ENST00000396887;ENST00000526464;ENST00000440815;ENST00000529550;ENST00000551122;ENST00000525643;ENST00000548807;ENST00000528163;ENST00000530890;ENST00000444393;ENST00000533097;ENST00000008180;ENST00000396890;ENST00000525228;ENST00000548652;ENST00000525377;ENST00000530538;ENST00000549213;ENST00000552936;ENST00000548476;ENST00000552664;ENST00000552356;ENST00000551513;ENST00000382213 | chr16 | 3135449 | 3135770 | + | TSF |
| 1% | chr16 | 3118181 | 3118240 | + | ENST00000325568;ENST00000534507;ENST00000531965;ENST00000396887;ENST00000526464;ENST00000440815;ENST00000529550;ENST00000551122;ENST00000525643;ENST00000548807;ENST00000528163;ENST00000530890;ENST00000444393;ENST00000533097;ENST00000008180;ENST00000396890;ENST00000525228;ENST00000548652;ENST00000525377;ENST00000530538;ENST00000549213;ENST0000 | chr16 | 3135449 | 3135770 | + | TSF |

TABLE 29-continued

Transcript fusion for Kidney Renal Clear Cell Carcinoma (KICH) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
|   |   |   |   |   | 0552936;ENST00000548476;ENST00000552664;ENST00000552356;ENST00000551513;ENST00000382213 |   |   |   |   |   |
| 1% | chr10 | 124172436 | 124172561 | + | ENST00000368990;ENST00000368988;ENST00000368989;ENST00000538022;ENST00000392799;ENST00000433307 | chr10 | 124173949 | 124175132 | + | TSF |
| 1% | chr20 | 61300282 | 61300430 | + | ENST00000217159;ENST00000370507;ENST00000451793 | chr20 | 61301309 | 61301456 | + | TSF |
| 1% | chr20 | 61300282 | 61300430 | + | ENST00000217159;ENST00000370507;ENST00000451793 | chr20 | 61301309 | 61301456 | + | TSF |
| 1% | chr8 | 26265743 | 26265892 | + | ENST00000380629;ENST00000523949;ENST00000523515;ENST00000520409;ENST00000518611 | chr8 | 26317396 | 26317454 | + | TSF |
| 1% | chr8 | 26265743 | 26265892 | + | ENST00000380629;ENST00000523949;ENST00000523515;ENST00000520409;ENST00000518611 | chr8 | 26317396 | 26317454 | + | TSF |
| 1% | chr8 | 26265743 | 26265892 | + | ENST00000380629;ENST00000523949;ENST00000523515;ENST00000520409;ENST00000518611 | chr8 | 26317396 | 26317454 | + | TSF |
| 1% | chr9 | 125054028 | 125054119 | + | ENST00000297908;ENST00000344641;ENST00000373723;ENST00000373729;ENST00000394315 | chr9 | 125068067 | 125068171 | + | TSF |
| 1% | chr9 | 125054028 | 125054119 | + | ENST00000297908;ENST00000344641;ENST00000373723;ENST00000373729;ENST00000394315 | chr | 125068067 | 125068171 | + | TSF |
| 1% | chr9 | 125054028 | 125054119 | + | ENST00000297908;ENST00000344641;ENST00000373723;ENST00000373729;ENST00000394315 | chr9 | 125068067 | 125068171 | + | TSF |
| 1% | chr12 | 28605411; 28605475 | 28605587 | + | ENST00000536154;ENST00000539107;ENST00000545336;ENST00000381256;ENST00000381259;ENST00000306172;ENST00000535212;ENST00000542801 | chr12 | 28624332 | 28624630 | + | TSF |
| 1% | chr12 | 28605411; 28605475 | 28605587 | + | ENST00000536154;ENST00000539107;ENST00000545336;ENST00000381256;ENST00000381259;ENST00000306172;ENST00000535212;ENST00000542801 | chr12 | 28624332 | 28624630 | + | TSF |
| 1% | chr12 | 28605411; 28605475 | 28605587 | + | ENST00000536154;ENST00000539107;ENST00000545336;ENST00000381256;ENST00000381259;ENST00000306172;ENST00000535212;ENST00000542801 | chr12 | 28624332 | 28624630 | + | TSF |
| 1% | chr12 | 28605411; 28605475 | 28605587 | + | ENST00000536154;ENST00000539107;ENST00000545336;ENST00000381256;ENST00000381259;ENST00000306172;ENST00000535212;ENST00000542801 | chr12 | 28624332 | 28624630 | + | TSF |
| 1% | chr12 | 28605411; 28605475 | 28605587 | + | ENST00000536154;ENST00000539107;ENST00000545336;ENST00000381256;ENST00000381259;ENST00000306172;ENST00000535212;ENST00000542801 | chr12 | 28624332 | 28624630 | + | TSF |
| 1% | chr12 | 28605411; 28605475 | 28605587 | + | ENST00000536154;ENST00000539107;ENST00000545336;ENST00000381256;ENST00000381259;ENST00000306172;ENST00000535212;ENST00000542801 | chr12 | 28624332 | 28624630 | + | TSF |
| 1% | chr5 | 54993786 | 54993674 | − | ENST00000396865;ENST00000539768;ENST00000318672;ENST00000508124;ENST00000511233;ENST00000503891;ENST00000513993;ENST00000505563;ENST00000506624;ENST00000507109 | chr5 | 54993040 | 54992544 | − | TSF |
| 1% | chr6 | 25861939 | 25861852 | − | ENST00000397060;ENST00000361703;ENST00000360657 | chr6 | 25836733 | 25836517 | − | TSF |
| 1% | chr6 | 25861939 | 25861852 | − | ENST00000397060;ENST00000361703;ENST00000360657 | chr6 | 25836733 | 25836517 | − | TSF |

TABLE 30

Transcript fusion for Kidney Renal Clear Cell Carcinoma (KICH) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 62% | chr1 | 46797740 | 46797497 | − | chr1 | 46764042 | 46763956 | − | ENST00000343304 | TAF |
| 53% | chr5 | 1407127 | 1406781 | − | chr5 | 1406403 | 1406303 | − | ENST00000270349; ENST00000453492 | TAF |
| 45% | chr4 | 69814157 | 69813728 | − | chr4 | 69811168 | 69811024 | − | ENST00000251566; ENST00000503012 | TAF |
| 45% | chr4 | 69814157 | 69813728 | − | chr4 | 69811168 | 69811024 | − | ENST00000251566; ENST00000503012 | TAF |
| 43% | chr9 | 19118990 | 19118890 | − | chr9 | 19118453 | 19118319 | − | ENST00000411567; ENST00000276914 | TAF |
| 35% | chr6 | 31154067 | 31153803 | − | chr6 | 31133824 | 31133704 | − | ENST00000259915 | TAF |
| 35% | chr10 | 124091515 | 124091773 | + | chr10 | 124091951 | 124092028 | + | ENST00000368994; ENST00000260723 | TAF |
| 29% | chr5 | 176950300 | 176950160 | − | chr5 | 176949072 | 176948976 | − | ENST00000514747; ENST00000329540; ENST00000443375; ENST00000524677 | TAF |
| 29% | chr4 | 111471988 | 111472030 | + | chr4 | 111474471 | 111474611 | + | ENST00000265162 | TAF |
| 24% | chr5 | 176950016 | 176949956 | − | chr5 | 176949072 | 176948976 | − | ENST00000514747; ENST00000329540; ENST00000443375; ENST00000524677 | TAF |
| 23% | chr9 | 75695610 | 75695283 | − | chr | 75555168 | 75555064 | − | ENST00000297785; ENST00000376939; ENST00000419959; ENST00000446946 | TAF |
| 23% | chr9 | 75695610 | 75695283 | − | chr9 | 75555168 | 75555064 | − | ENST00000297785; ENST00000376939; ENST00000419959; ENST00000446946 | TAF |

TABLE 30-continued

Transcript fusion for Kidney Renal Clear Cell Carcinoma (KICH) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 23% | chr9 | 75695610 | 75695283 | − | chr9 | 75555168 | 75555064 | − | ENST00000297785; ENST00000376939; ENST00000419959; ENST00000446946 | TAF |
| 23% | chr9 | 75695610 | 75695283 | − | chr9 | 75555168 | 75555064 | − | ENST00000297785; ENST00000376939; ENST00000419959; ENST00000446946 | TAF |
| 23% | chr8 | 30356797 | 30356857 | + | chr8 | 30361803 | 30361953 | + | ENST00000538486; ENST00000397323; ENST00000339877; ENST00000320203; ENST00000287771; ENST00000517860; ENST00000519359; ENST00000522694 | TSF |
| 23% | chr8 | 30356797 | 30356857 | + | chr8 | 30361803 | 30361953 | + | ENST00000538486; ENST00000397323; ENST00000339877; ENST00000320203; ENST00000287771; ENST00000517860; ENST00000519359; ENST00000522694 | TSF |
| 23% | chr8 | 30356797 | 30356857 | + | chr8 | 30361803 | 30361953 | + | ENST00000538486; ENST00000397323; ENST00000339877; ENST00000320203; ENST00000287771; ENST00000517860; ENST00000519359; ENST00000522694 | TSF |
| 23% | chr8 | 30356797 | 30356857 | + | chr8 | 30361803 | 30361953 | + | ENST00000538486; ENST00000397323; ENST00000339877; ENST00000320203; ENST00000287771; ENST00000517860; ENST00000519359; ENST00000522694 | TSF |
| 23% | chr8 | 30356797 | 30356857 | + | chr8 | 30361803 | 30361953 | + | ENST00000538486; ENST00000397323; ENST00000339877; ENST00000320203; ENST00000287771; ENST00000517860; ENST00000519359; ENST00000522694 | TSF |
| 23% | chr8 | 30356797 | 30356857 | + | chr8 | 30361803 | 30361953 | + | ENST00000538486; ENST00000397323; ENST00000339877; ENST00000320203; ENST00000287771; ENST00000517860; ENST00000519359; ENST00000522694 | TSF |
| 23% | chr8 | 30356797 | 30356857 | + | chr8 | 30361803 | 30361953 | + | ENST00000538486; ENST00000397323; ENST00000339877; ENST00000320203; ENST00000287771; ENST00000517860; ENST00000519359; ENST00000522694 | TSF |
| 21% | chr10 | 3122429 | 3122494 | + | chr10 | 3124580 | 3124653 | + | ENST00000381125; ENST00000381075 | TAF |
| 21% | chr10 | 3122429 | 3122494 | + | chr10 | 3124580 | 3124653 | + | ENST00000381125; ENST00000381075 | TAF |
| 20% | chr10 | 90305421 | 90305214 | − | chr10 | 90122482 | 90122309 | − | ENST00000371947; ENST00000437752; ENST00000331772 | TAF |
| 20% | chr10 | 90305421 | 90305214 | − | chr10 | 90122482 | 90122309 | − | ENST00000371947; ENST00000437752; ENST00000331772 | TAF |
| 20% | chr3 | 195444683 | 195445067 | + | chr3 | 195451551 | 195453443; 195452030 | + | ENST00000447234; ENST00000320736; ENST00000436408 | TAF |
| 20% | chr3 | 195444683 | 195445067 | + | chr3 | 195451551 | 195453443; 195452030 | + | ENST00000447234; ENST00000320736; ENST00000436408 | TAF |
| 20% | chr3 | 195444683 | 195445067 | + | chr3 | 195451551 | 195453443; 195452030 | + | ENST00000447234; ENST00000320736; ENST00000436408 | TAF |
| 20% | chr8 | 28226049 | 28225966 | − | chr8 | 28218659 | 28218493 | − | ENST00000521548 | TSF |
| 20% | chr10 | 3133726 | 3133857 | + | chr10 | 3141467 | 3141544 | + | ENST00000607886; ENST00000381125; ENST00000381075; ENST00000407806 | TSF |
| 20% | chr10 | 3133726 | 3133857 | + | chr10 | 3141467 | 3141544 | + | ENST00000607886; ENST00000381125; ENST00000381075; ENST00000407806 | TSF |
| 20% | chr10 | 3133726 | 3133857 | + | chr10 | 3141467 | 3141544 | + | ENST00000607886; ENST00000381125; ENST00000381075; ENST00000407806 | TSF |
| 20% | chr10 | 3133726 | 3133857 | + | chr10 | 3141467 | 3141544 | + | ENST00000607886; ENST00000381125; ENST00000381075; ENST00000407806 | TSF |
| 18% | chr8 | 72937377 | 72937669 | + | chr8 | 72964774 | 72964806 | + | ENST00000524152; ENST00000519068 | TAF |
| 16% | chr2 | 162903347 | 162903212 | − | chr2 | 162902122 | 162902042 | − | ENST00000360534; ENST00000434918 | TAF |
| 16% | chr2 | 162903347 | 162903212 | − | chr2 | 162902122 | 162902042 | − | ENST00000360534; ENST00000434918 | TAF |
| 16% | chr5 | 135398466 | 135398602 | + | chr5 | 135398875 | 135398915; 135398898 | + | ENST00000442011; ENST00000305126; ENST00000514554; ENST00000508076; ENST00000503087 | TAF |
| 16% | chr5 | 135398466 | 135398602 | + | chr5 | 135398875 | 135398915; 135398898 | + | ENST00000442011; ENST00000305126; ENST00000514554; ENST00000508076; ENST00000503087 | TAF |
| 16% | chr10 | 90305421 | 90305146 | − | chr10 | 90122482 | 90122309 | − | ENST00000371947; ENST00000437752; ENST00000331772 | TAF |
| 16% | chr10 | 90305421 | 90305146 | − | chr10 | 90122482 | 90122309 | − | ENST00000371947; ENST00000437752; ENST00000331772 | TAF |
| 16% | chr6 | 123083025 | 123083103 | + | chr6 | 123101436 | 123101608 | + | ENST00000368444; ENST00000356535 | TSF |
| 16% | chr6 | 123083025 | 123083103 | + | chr6 | 123101436 | 123101608 | + | ENST00000368444; ENST00000356535 | TSF |
| 15% | chr6 | 123101055 | 123101091 | + | chr6 | 123101436 | 123101608 | + | ENST00000368444; ENST00000356535 | TSF |
| 15% | chr6 | 123101055 | 123101091 | + | chr6 | 123101436 | 123101608 | + | ENST00000368444; ENST00000356535 | TSF |
| 14% | chr3 | 122863450 | 122863676 | + | chr3 | 122864369 | 122864384; 122864439 | + | ENST00000489923; ENST00000316218 | TAF |
| 14% | chr3 | 122863450 | 122863676 | + | chr3 | 122864369 | 122864384; | + | ENST00000489923; ENST00000316218 | TAF |

TABLE 30-continued

Transcript fusion for Kidney Renal Clear Cell Carcinoma (KICH) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 14% | chr9 | 131002678 | 131002811 | + | chr9 | 122864439 131004511 | 131004624 | + | ENST00000475805; ENST00000341179; ENST00000372923; ENST00000393594; ENST00000486160 | TAF |
| 14% | chr9 | 131002678 | 131002811 | + | chr9 | 131004511 | 131004624 | + | ENST00000475805; ENST00000341179; ENST00000372923; ENST00000393594; ENST00000486160 | TAF |
| 14% | chr5 | 172281405 | 172281729 | + | chr5 | 172315702 | 172315763 | + | ENST00000393784; ENST00000520326; ENST00000520642; ENST00000523291 | TAF |
| 14% | chr5 | 172281405 | 172281729 | + | chr5 | 172315702 | 172315763 | + | ENST00000393784; ENST00000520326; ENST00000520642; ENST00000523291 | TAF |
| 14% | chr5 | 172281405 | 172281729 | + | chr5 | 172315702 | 172315763 | + | ENST00000393784; ENST00000520326; ENST00000520642; ENST00000523291 | TAF |
| 14% | chr5 | 172281405 | 172281729 | + | chr5 | 172315702 | 172315763 | + | ENST00000393784; ENST00000520326; ENST00000520642; ENST00000523291 | TAF |
| 14% | chr1 | 236326774 | 236327054 | + | chr1 | 236332006 | 236332055 | + | ENST00000366592; ENST00000454895 | TSF |
| 14% | chr1 | 236326774 | 236327054 | + | chr1 | 236332006 | 236332055 | + | ENST00000366592; ENST00000454895 | TSF |
| 12% | chr15 | 85472494 | 85472633 | + | chr15 | 85478257 | 85478425 | + | ENST00000537216; ENST00000537624; ENST00000286749; ENST00000394573 | TAF |
| 12% | chr15 | 85472494 | 85472633 | + | chr15 | 85478257 | 85478425 | + | ENST00000537216; ENST00000537624; ENST00000286749; ENST00000394573 | TAF |
| 12% | chr15 | 85472494 | 85472633 | + | chr15 | 85478257 | 85478425 | + | ENST00000537216; ENST00000537624; ENST00000286749; ENST00000394573 | TAF |
| 12% | chr9 | 19120331 | 19120171 | − | chr9 | 19119829 | 19119782; 19119648 | − | ENST00000411567; ENST00000276914 | TSF |
| 12% | chr9 | 19120331 | 19120171 | − | chr9 | 19119829 | 19119782; 19119648 | − | ENST00000411567; ENST00000276914 | TSF |
| 11% | chr2 | 218764168 | 218764162 | − | chr2 | 218762692 | 218762521; 218762518 | − | ENST00000446903; ENST00000413554; ENST00000310858; ENST00000423413 | TAF |
| 11% | chr2 | 218764168 | 218764162 | − | chr2 | 218762692 | 218762521; 218762518 | − | ENST00000446903; ENST00000413554; ENST00000310858; ENST00000423413 | TAF |
| 11% | chr2 | 218764168 | 218764162 | − | chr2 | 218762692 | 218762521; 218762518 | − | ENST00000446903; ENST00000413554; ENST00000310858; ENST00000423413 | TAF |
| 11% | chr2 | 218764168 | 218764162 | − | chr2 | 218762692 | 218762521; 218762518 | − | ENST00000446903; ENST00000413554; ENST00000310858; ENST00000423413 | TAF |
| 11% | chr11 | 114177915 | 114178747 | + | chr11 | 114182767 | 114183199 | + | ENST00000535401; ENST00000299964 | TAF |
| 11% | chr4 | 187060473 | 187060762 | + | chr4 | 187070327 | 187070437 | + | ENST00000356371 | TSF |
| 10% | chr2 | 201253013 | 201253278 | + | chr2 | 201253946 | 201254006 | + | ENST00000409755; ENST00000409151 | TAF |
| 10% | chr8 | 22271215 | 22271219 | + | chr8 | 22272293 | 22272415 | + | ENST00000359741; ENST00000240095; ENST00000381237; ENST00000289952; ENST00000517370 | TAF |
| 10% | chr8 | 22271215 | 22271219 | + | chr8 | 22272293 | 22272415 | + | ENST00000359741; ENST00000240095; ENST00000381237; ENST00000289952; ENST00000517370 | TAF |
| 10% | chr8 | 22271215 | 22271219 | + | chr8 | 22272293 | 22272415 | + | ENST00000359741; ENST00000240095; ENST00000381237; ENST00000289952; ENST00000517370 | TAF |
| 10% | chr1 | 9128508 | 9128439 | − | chr1 | 9118309 | 9118211 | − | ENST00000377424; ENST00000377414; ENST00000484798; ENST00000474145; ENST00000479813; ENST00000486632; ENST00000487835; ENST00000464985; ENST00000473209 | TAF |
| 10% | chr1 | 9128508 | 9128439 | − | chr1 | 9118309 | 9118211 | − | ENST00000377424; ENST00000377414; ENST00000484798; ENST00000474145; ENST00000479813; ENST00000486632; ENST00000487835; ENST00000464985; ENST00000473209 | TAF |
| 10% | chr1 | 9128508 | 9128439 | − | chr1 | 9118309 | 9118211 | − | ENST00000377424; ENST00000377414; ENST00000484798; ENST00000474145; ENST00000479813; ENST00000486632; ENST00000487835; ENST00000464985; ENST00000473209 | TAF |
| 10% | chr1 | 9128508 | 9128439 | − | chr1 | 9118309 | 9118211 | − | ENST00000377424; ENST00000377414; ENST00000484798; ENST00000474145; ENST00000479813; ENST00000486632; ENST00000487835; ENST00000464985; ENST00000473209 | TAF |
| 10% | chr1 | 9128508 | 9128439 | − | chr1 | 9118309 | 9118211 | − | ENST00000377424; ENST00000377414; ENST00000484798; ENST00000474145; ENST00000479813; | TAF |

TABLE 30-continued

Transcript fusion for Kidney Renal Clear Cell Carcinoma (KICH) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 9% | chr7 | 50763323 | 50763289 | − | chr7 | 50742355 | 50742133 | − | ENST00000486632; ENST00000487835; ENST00000464985; ENST00000473209 ENST00000439599; ENST00000398812; ENST00000403097; ENST00000357271; ENST00000401949; ENST00000439044 | TSF |
| 9% | chr7 | 50763323 | 50763289 | − | chr7 | 50742355 | 50742133 | − | ENST00000439599; ENST00000398812; ENST00000403097; ENST00000357271; ENST00000401949; ENST00000439044 | TSF |
| 9% | chr7 | 50763323 | 50763289 | − | chr7 | 50742355 | 50742133 | − | ENST00000439599; ENST00000398812; ENST00000403097; ENST00000357271; ENST00000401949; ENST00000439044 | TSF |
| 9% | chr17 | 39976225 | 39976301 | + | chr17 | 39976521 | 39976713 | + | ENST00000321562; ENST00000455106; ENST00000544340 | TSF |
| 9% | chr4 | 111332609 | 111332609 | + | chr4 | 111409697 | 111409838 | + | ENST00000265162 | TSF |
| 9% | chr3 | 182757105 | 182757101 | − | chr3 | 182756923 | 182756814 | − | ENST00000265594; ENST00000492597; ENST00000497959; ENST00000539926; ENST00000476176 | TSF |
| 9% | chr3 | 182757105 | 182757101 | − | chr3 | 182756923 | 182756814 | − | ENST00000265594; ENST00000492597; ENST00000497959; ENST00000539926; ENST00000476176 | TSF |
| 9% | chr3 | 182757105 | 182757101 | − | chr3 | 182756923 | 182756814 | − | ENST00000265594; ENST00000492597; ENST00000497959; ENST00000539926; ENST00000476176 | TSF |
| 9% | chr3 | 182757105 | 182757101 | − | chr3 | 182756923 | 182756814 | − | ENST00000265594; ENST00000492597; ENST00000497959; ENST00000539926; ENST00000476176 | TSF |
| 7% | chr5 | 31298457 | 31298554 | + | chr5 | 31299571 | 31299738 | + | ENST00000514738; ENST00000265071 | TSF |
| 7% | chr5 | 31298457 | 31298554 | + | chr5 | 31299571 | 31299738 | + | ENST00000514738; ENST00000265071 | TSF |
| 7% | chr10 | 124091515 | 124091773 | + | chr10 | 124094396 | 124094494 | + | ENST00000368994; ENST00000260723 | TSF |
| 7% | chr17 | 39974832 | 39974893 | + | chr17 | 39975462 | 39975651 | + | ENST00000321562 | TSF |
| 7% | chr6 | 123097008 | 123097454 | + | chr6 | 123101436 | 123101608 | + | ENST00000368444; ENST00000356535 | TSF |
| 7% | chr6 | 123097008 | 123097454 | + | chr6 | 123101436 | 123101608 | + | ENST00000368444; ENST00000356535 | TSF |
| 6% | chr16 | 53780019 | 53780292 | + | chr16 | 53844052 | 53844129 | + | ENST00000471389; ENST00000464071 | TSF |
| 6% | chr16 | 53780019 | 53780292 | + | chr16 | 53844052 | 53844129 | + | ENST00000471389; ENST00000464071 | TSF |
| 6% | chr19 | 8438007 | 8438075 | + | chr19 | 8438589 | 8438770 | + | ENST00000301455; ENST00000541807; ENST00000393962; ENST00000593998 | TSF |
| 6% | chrX | 123618682 | 123617816 | − | chrX | 123615814 | 123615582 | − | ENST00000371130; ENST00000422452 | TSF |
| 6% | chr5 | 54280783 | 54280736 | − | chr5 | 54277974 | 54277825 | − | ENST00000381405 | TSF |
| 6% | chr6 | 26370093 | 26370250 | + | chr6 | 26370550 | 26370831; 26370588 | + | ENST00000532865; ENST00000530653; ENST00000527422; ENST00000356386; ENST0000396934; ENST00000377708; ENST00000396948; ENST00000508906 | TSF |
| 6% | chr6 | 26370093 | 26370250 | + | chr6 | 26370550 | 26370831; 26370588 | + | ENST00000532865; ENST00000530653; ENST00000527422; ENST00000356386; ENST00000396934; ENST00000377708; ENST00000396948; ENST00000508906 | TSF |
| 6% | chr6 | 26370093 | 26370250 | + | chr6 | 26370550 | 26370831; 26370588 | + | ENST00000532865; ENST00000530653; ENST00000527422; ENST00000356386; ENST00000396934; ENST00000377708; ENST00000396948; ENST00000508906 | TSF |
| 6% | chr11 | 74751425 | 74751690 | + | chr11 | 74873700 | 74873830 | + | ENST00000289575 | TSF |
| 6% | chr7 | 126136473 | 126136413 | − | chr7 | 126086426 | 126086180; 126086130 | − | ENST00000444921; ENST00000339582; ENST00000358373; ENST00000472701 | TSF |
| 6% | chr7 | 126136473 | 126136413 | − | chr7 | 126086426 | 126086180; 126086130 | − | ENST00000444921; ENST00000339582; ENST00000358373; ENST00000472701 | TSF |
| 5% | chr12 | 58023123 | 58023062 | − | chr12 | 58022929 | 58022831; 58022905 | − | ENST00000341156; ENST00000418555; ENST00000552798; ENST00000549391 | TSF |
| 5% | chr12 | 58023123 | 58023062 | − | chr12 | 58022929 | 58022831; 58022905 | − | ENST00000341156; ENST00000418555; ENST00000552798; ENST00000549391 | TSF |
| 5% | chr12 | 28565851 | 28565871 | + | chr12 | 28603094 | 28603186 | + | ENST00000540794; ENST00000539107; ENST00000536442; ENST00000545336; ENST00000545737; ENST00000381256; ENST00000381259; ENST00000306172 | TSF |
| 5% | chr12 | 28565851 | 28565871 | + | chr12 | 28603094 | 28603186 | + | ENST00000540794; ENST00000539107; ENST00000536442; ENST00000545336; ENST00000545737; ENST00000381256; ENST00000381259; ENST00000306172 | TSF |
| 5% | chr12 | 28565851 | 28565871 | + | chr12 | 28603094 | 28603186 | + | ENST00000540794; ENST00000539107; ENST00000536442; ENST00000545336; ENST00000545737; ENST00000381256; ENST00000381259; ENST00000306172 | TSF |
| 5% | chr12 | 28565851 | 28565871 | + | chr12 | 28603094 | 28603186 | + | ENST00000540794; ENST00000539107; | TSF |

TABLE 30-continued

Transcript fusion for Kidney Renal Clear Cell Carcinoma (KICH) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
|  |  |  |  |  |  |  |  |  | ENST00000536442; ENST00000545336; ENST00000545737; ENST00000381256; ENST00000381259; ENST00000306172 |  |
| 5% | chr1 | 12002791 | 12002835 | + | chr1 | 12008033 | 12008124 | + | ENST00000449038; ENST00000376369; ENST00000429000; ENST00000196061 | TSF |
| 5% | chr1 | 12002791 | 12002835 | + | chr1 | 12008033 | 12008124 | + | ENST00000449038; ENST00000376369; ENST00000429000; ENST00000196061 | TSF |
| 5% | chr1 | 12002791 | 12002835 | + | chr1 | 12008033 | 12008124 | + | ENST00000449038; ENST00000376369; ENST00000429000; ENST00000196061 | TSF |
| 5% | chr5 | 177187536 | 177187438 | − | chr5 | 177175700 | 177175642; 177175700 | − | ENST00000515787; ENST00000503845; ENST00000504518 | TSF |
| 5% | chr5 | 177187536 | 177187438 | − | chr5 | 177175700 | 177175642; 177175700 | − | ENST00000515787; ENST00000503845; ENST00000504518 | TSF |
| 5% | chr5 | 177187536 | 177187438 | − | chr5 | 177175700 | 177175642; 177175700 | − | ENST00000515787; ENST00000503845; ENST00000504518 | TSF |
| 5% | chr2 | 26947307 | 26947428 | + | chr2 | 26950535 | 26951436 | + | ENST00000302909 | TSF |
| 5% | chr3 | 187088030 | 187088050 | + | chr3 | 187088576 | 187089161 | + | ENST00000259030 | TSF |
| 4% | chr5 | 177450235 | 177450333 | + | chr5 | 177462097 | 177462155 | + | ENST00000511856; ENST00000511189 | TSF |
| 4% | chr5 | 177450235 | 177450333 | + | chr5 | 177462097 | 177462155 | + | ENST00000511856; ENST00000511189 | TSF |
| 4% | chr4 | 22601350 | 22601612 | + | chr4 | 22737604 | 22737831 | + | ENST00000508166; ENST00000503442 | TSF |
| 4% | chr4 | 22601350 | 22601612 | + | chr4 | 22737604 | 22737831 | + | ENST00000508166; ENST00000503442 | TSF |
| 4% | chr16 | 84676629 | 84676456 | − | chr16 | 84623868 | 84623711 | − | ENST00000262428 | TSF |
| 4% | chr9 | 19118990 | 19118815 | − | chr9 | 19118453 | 19118319 | − | ENST00000411567; ENST00000276914 | TSF |
| 4% | chr13 | 114503037 | 114503038 | + | chr13 | 114503800 | 114503885 | + | ENST00000375353 | TSF |
| 4% | chr4 | 69919044 | 69920610 | + | chr4 | 69964258 | 69964406 | + | ENST00000305231; ENST00000508661 | TSF |
| 4% | chr4 | 69919044 | 69920610 | + | chr4 | 69964258 | 69964406 | + | ENST00000305231; ENST00000508661 | TSF |
| 4% | chr17 | 80812047 | 80812141 | + | chr17 | 80828100 | 80828256 | + | ENST00000355528; ENST00000397466; ENST00000539345 | TSF |
| 4% | chr17 | 80812047 | 80812141 | + | chr17 | 80828100 | 80828256 | + | ENST00000355528; ENST00000397466; ENST00000539345 | TSF |
| 4% | chr17 | 80812047 | 80812141 | + | chr17 | 80828100 | 80828256 | + | ENST00000355528; ENST00000397466; ENST00000539345 | TSF |
| 4% | chr5 | 175504615 | 175504713 | + | chr5 | 175516466 | 175516524 | + | ENST00000253490 | TSF |
| 4% | chr1 | 162768504 | 162768725 | + | chr1 | 162769533 | 162769727 | + | ENST00000367917; ENST00000254521 | TSF |
| 4% | chr1 | 162768504 | 162768725 | + | chr1 | 162769533 | 162769727 | + | ENST00000367917; ENST00000254521 | TSF |
| 4% | chr1 | 59980221 | 59980497 | + | chr1 | 60019796 | 60019899 | + | ENST00000371218; ENST00000303721; ENST00000430447; ENST00000371212 | TSF |
| 4% | chr1 | 59980221 | 59980497 | + | chr1 | 60019796 | 60019899 | + | ENST00000371218; ENST00000303721; ENST00000430447; ENST00000371212 | TSF |
| 4% | chr1 | 59980221 | 59980497 | + | chr1 | 60019796 | 60019899 | + | ENST00000371218; ENST00000303721; ENST00000430447; ENST00000371212 | TSF |
| 3% | chr3 | 187087097 | 187087144 | + | chr3 | 187088576 | 187089161 | + | ENST00000259030 | TSF |
| 3% | chr19 | 35551883 | 35551974 | + | chr19 | 35556154 | 35556249 | + | ENST00000262626; ENST00000392226; ENST00000597419 | TSF |
| 3% | chr2 | 201327365 | 201327459 | + | chr2 | 201332013 | 201332122; 201332101 | + | ENST00000409718; ENST00000358677; ENST00000409988; ENST00000409385; ENST00000451764; ENST00000360760; ENST00000409140; ENST00000409397; ENST00000409755; ENST00000409151; ENST00000438761 | TSF |
| 3% | chr2 | 201327365 | 201327459 | + | chr2 | 201332013 | 201332122; 201332101 | + | ENST00000409718; ENST00000358677; ENST00000409988; ENST00000409385; ENST00000451764; ENST00000360760; ENST00000409140; ENST00000409397; ENST00000409755; ENST00000409151; ENST00000438761 | TSF |
| 3% | chr2 | 201327365 | 201327459 | + | chr2 | 201332013 | 201332122; 201332101 | + | ENST00000409718; ENST00000358677; ENST00000409988; ENST00000409385; ENST00000451764; ENST00000360760; ENST00000409140; ENST00000409397; ENST00000409755; ENST00000409151; ENST00000438761 | TSF |
| 3% | chr14 | 34409875 | 34409759 | − | chr14 | 34400421 | 34400302 | − | ENST00000250457; ENST00000553215; ENST00000487915 | TSF |
| 3% | chr14 | 34409875 | 34409759 | − | chr14 | 34400421 | 34400302 | − | ENST00000250457; ENST00000553215; ENST00000487915 | TSF |
| 3% | chr6 | 31152226 | 31150660 | − | chr6 | 31133824 | 31133704 | − | ENST00000259915 | TSF |
| 3% | chr12 | 58023123 | 58023062 | − | chr12 | 58022686 | 58022496; 58022484 | − | ENST00000341156; ENST00000418555; ENST00000449184 | TSF |
| 3% | chr12 | 58023123 | 58023062 | − | chr12 | 58022686 | 58022496; 58022484 | − | ENST00000341156; ENST00000418555; ENST00000449184 | TSF |
| 3% | chr1 | 60384788 | 60384761 | − | chr1 | 60381772 | 60381610 | − | ENST00000371204 | TSF |
| 3% | chr1 | 60374334 | 60374278 | − | chr1 | 60373599 | 60373458 | − | ENST00000371204 | TSF |
| 3% | chr1 | 163139462 | 163138881 | − | chr1 | 163138158 | 163138048 | − | ENST00000313961; ENST00000367903; | TSF |

TABLE 30-continued

Transcript fusion for Kidney Renal Clear Cell Carcinoma (KICH) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 3% | chr1 | 163139462 | 163138881 | − | chr1 | 163138158 | 163138048 | − | ENST00000530507 ENST00000313961; ENST00000367903; ENST00000530507 | TSF |
| 3% | chr11 | 114171770 | 114171954 | + | chr11 | 114182767 | 114183199 | + | ENST00000535401; ENST0000299964 | TSF |
| 3% | chr5 | 156483240 | 156483190 | − | chr5 | 156482544 | 156482212 | − | ENST00000522693; ENST00000523175; ENST00000339252; ENST00000425854; ENST00000544197; ENST00000518745 | TSF |
| 3% | chr5 | 156483240 | 156483190 | − | chr5 | 156482544 | 156482212 | − | ENST00000522693; ENST00000523175; ENST00000339252; ENST00000425854; ENST00000544197; ENST00000518745 | TSF |
| 3% | chr5 | 156483240 | 156483190 | − | chr5 | 156482544 | 156482212 | − | ENST00000522693; ENST00000523175; ENST00000339252; ENST00000425854; ENST00000544197; ENST00000518745 | TSF |
| 3% | chr1 | 85845282 | 85845264 | − | chr1 | 85824530 | 85824431 | − | ENST00000284031; ENST00000539042; ENST00000426972; ENST00000542148 | TSF |
| 3% | chr5 | 1408454 | 1408358 | − | chr5 | 1406403 | 1406303 | − | ENST00000270349; ENST00000453492 | TSF |
| 3% | chr1 | 8924664 | 8924519 | − | chr1 | 8924151 | 8923950 | − | ENST00000234590 | TSF |
| 3% | chr5 | 176950016 | 176949947 | − | chr5 | 176949072 | 176948976 | − | ENST00000514747; ENST00000329540; ENST00000443375; ENST00000524677 | TSF |
| 2% | chr9 | 35678063 | 35678160 | + | chr9 | 35679182 | 35679339 | + | ENST00000378357 | TSF |
| 2% | chr16 | 20463435 | 20463788 | + | chr16 | 20476839 | 20476978; 20477049; 20477015 | + | ENST00000576361; ENST00000424070; ENST00000573854; ENST00000219054; ENST00000575690; ENST00000574692; ENST00000571894; ENST00000396104 | TSF |
| 2% | chr16 | 20463435 | 20463788 | + | chr16 | 20476839 | 20476978; 20477049; 20477015 | + | ENST00000576361; ENST00000424070; ENST00000573854; ENST00000219054; ENST00000575690; ENST00000574692; ENST00000571894; ENST00000396104 | TSF |
| 2% | chr16 | 20463435 | 20463788 | + | chr16 | 20476839 | 20476978; 20477049; 20477015 | + | ENST00000576361; ENST00000424070; ENST00000573854; ENST00000219054; ENST00000575690; ENST00000574692; ENST00000571894; ENST00000396104 | TSF |
| 2% | chr16 | 20463435 | 20463788 | + | chr16 | 20476839 | 20476978; 20477049; 20477015 | + | ENST00000576361; ENST00000424070; ENST00000573854; ENST00000219054; ENST00000575690; ENST00000574692; ENST00000571894; ENST00000396104 | TSF |
| 2% | chr1 | 161177275 | 161177330 | + | chr1 | 161178983 | 161179103 | + | ENST00000367993; ENST00000392179; ENST00000476409 | TSF |
| 2% | chr1 | 161177275 | 161177330 | + | chr1 | 161178983 | 161179103 | + | ENST00000367993; ENST00000392179; ENST00000476409 | TSF |
| 2% | chr1 | 161177275 | 161177330 | + | chr1 | 161178983 | 161179103 | + | ENST00000367993; ENST00000392179; ENST00000476409 | TSF |
| 2% | chr7 | 139441888 | 139441762 | − | chr7 | 139416814 | 139415731 | − | ENST00000406875; ENST00000428878; ENST00000342645 | TSF |
| 2% | chr7 | 139441888 | 139441762 | − | chr7 | 139416814 | 139415731 | − | ENST00000406875; ENST00000428878; ENST00000342645 | TSF |
| 2% | chr7 | 139441888 | 139441762 | − | chr7 | 139416814 | 139415731 | − | ENST00000406875; ENST00000428878; ENST00000342645 | TSF |
| 2% | chr2 | 31156138 | 31156092 | − | chr2 | 31155060 | 31154934 | − | ENST00000324589; ENST00000349752; ENST00000406653; ENST00000356174; ENST00000420311; ENST00000430167 | TSF |
| 2% | chr2 | 31156138 | 31156092 | − | chr2 | 31155060 | 31154934 | − | ENST00000324589; ENST00000349752; ENST00000406653; ENST00000356174; ENST00000420311; ENST00000430167 | TSF |
| 2% | chr6 | 167367994 | 167367904 | − | chr6 | 167366036 | 167365976 | − | ENST00000507747; ENST00000508775; ENST00000421787; ENST00000476238; ENST00000028008; ENST00000478180 | TSF |
| 2% | chr6 | 167367994 | 167367904 | − | chr6 | 167366036 | 167365976 | − | ENST00000507747; ENST00000508775; ENST00000421787; ENST00000476238; ENST00000028008; ENST00000478180 | TSF |
| 2% | chr6 | 167367994 | 167367904 | − | chr6 | 167366036 | 167365976 | − | ENST00000507747; ENST00000508775; ENST00000421787; ENST00000476238; ENST00000028008; ENST00000478180 | TSF |
| 2% | chr6 | 167367994 | 167367904 | | chr6 | 167366036 | 167365976 | − | ENST00000507747; ENST00000508775; ENST00000421787; ENST00000476238; ENST00000028008; ENST00000478180 | TSF |
| 2% | chr6 | 167367994 | 167367904 | − | chr6 | 167366036 | 167365976 | − | ENST00000507747; ENST00000508775; ENST00000421787; ENST00000476238; ENST00000028008; ENST00000478180 | TSF |
| 2% | chr12 | 15812051 | 15811892 | − | chr12 | 15811519 | 15811431 | − | ENST00000543523; ENST00000281172; ENST00000543612; ENST00000540613; ENST00000542903 | TSF |
| 2% | chr2 | 210938033 | 210937924 | − | chr2 | 210908828 | 210908663; 210908637 | − | ENST00000281772; ENST00000418791; ENST00000457374; ENST00000452086; ENST00000428655 | TSF |

TABLE 30-continued

Transcript fusion for Kidney Renal Clear Cell Carcinoma (KICH) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 2% | chr2 | 210938033 | 210937924 | − | chr2 | 210908828 | 210908663; 210908637 | − | ENST00000281772; ENST00000418791; ENST00000457374; ENST00000452086; ENST00000428655 | TSF |
| 2% | chr2 | 210938033 | 210937924 | − | chr2 | 210908828 | 210908663; 210908637 | − | ENST00000281772; ENST00000418791; ENST00000457374; ENST00000452086; ENST00000428655 | TSF |
| 2% | chr2 | 210938033 | 210937924 | − | chr2 | 210908828 | 210908663; 210908637 | − | ENST00000281772; ENST00000418791; ENST00000457374; ENST00000452086; ENST00000428655 | TSF |
| 2% | chr12 | 28378695 | 28378794 | + | chr12 | 28458582 | 28458727; 28458739 | + | ENST00000538586; ENST00000539107; ENST00000536442; ENST00000545336; ENST00000543534; ENST00000543809; ENST00000545737; ENST00000381256; ENST00000381259; ENST00000306172 | TSF |
| 2% | chr12 | 28378695 | 28378794 | + | chr12 | 28458582 | 28458727; 28458739 | + | ENST00000538586; ENST00000539107; ENST00000536442; ENST00000545336; ENST00000543534; ENST00000543809; ENST00000545737; ENST00000381256; ENST00000381259; ENST00000306172 | TSF |
| 2% | chr12 | 28378695 | 28378794 | + | chr12 | 28458582 | 28458727; 28458739 | + | ENST00000538586; ENST00000539107; ENST00000536442; ENST00000545336; ENST00000543534; ENST00000543809; ENST00000545737; ENST00000381256; ENST00000381259; ENST00000306172 | TSF |
| 2% | chr12 | 28378695 | 28378794 | + | chr12 | 28458582 | 28458727; 28458739 | + | ENST00000538586; ENST00000539107; ENST00000536442; ENST00000545336; ENST00000543534; ENST00000543809; ENST00000545737; ENST00000381256; ENST00000381259; ENST00000306172 | TSF |
| 2% | chr12 | 28378695 | 28378794 | + | chr12 | 28458582 | 28458727; 28458739 | + | ENST00000538586; ENST00000539107; ENST00000536442; ENST00000545336; ENST00000543534; ENST00000543809; ENST00000545737; ENST00000381256; ENST00000381259; ENST00000306172 | TSF |
| 2% | chr12 | 28378695 | 28378794 | + | chr12 | 28458582 | 28458727; 28458739 | + | ENST00000538586; ENST00000539107; ENST00000536442; ENST00000545336; ENST00000543534; ENST00000543809; ENST00000545737; ENST00000381256; ENST00000381259; ENST00000306172 | TSF |
| 2% | chr9 | 127110792 | 127110909 | + | chr9 | 127113116 | 127113226 | + | ENST00000540326; ENST00000373603; ENST00000373600; ENST00000320246; ENST00000545174; ENST00000394199; ENST00000546191; ENST00000539416 | TSF |
| 2% | chr19 | 18506969 | 18506886 | − | chr19 | 18502935 | 18502797 | − | ENST00000339007; ENST00000595840 | TSF |
| 2% | chr21 | 42609094 | 42609191 | + | chr21 | 42609440 | 42609656 | + | ENST00000328735; ENST00000330333; ENST00000347667 | TSF |
| 2% | chr21 | 42609094 | 42609191 | + | chr21 | 42609440 | 42609656 | + | ENST00000328735; ENST00000330333; ENST00000347667 | TSF |
| 2% | chr21 | 42609094 | 42609191 | + | chr21 | 42609440 | 42609656 | + | ENST00000328735; ENST00000330333; ENST00000347667 | TSF |
| 2% | chr4 | 52913536 | 52913266 | − | chr4 | 52899806 | 52899597 | − | ENST00000381431; ENST00000506357; ENST00000514133 | TSF |
| 2% | chr4 | 52913536 | 52913266 | − | chr4 | 52899806 | 52899597 | − | ENST00000381431; ENST00000506357; ENST00000514133 | TSF |
| 2% | chrX | 119449588 | 119449548 | − | chrX | 119438346 | 119438204 | − | ENST00000309720; ENST00000371369; ENST00000440464; ENST00000519908 | TSF |
| 2% | chrX | 119449588 | 119449548 | − | chrX | 119438346 | 119438204 | − | ENST00000309720; ENST00000371369; ENST00000440464; ENST00000519908 | TSF |
| 2% | chrX | 119449588 | 119449548 | − | chrX | 119438346 | 119438204 | − | ENST00000309720; ENST00000371369; ENST00000440464; ENST00000519908 | TSF |
| 2% | chrX | 119449588 | 119449548 | − | chrX | 119438346 | 119438204 | − | ENST00000309720; ENST00000371369; ENST00000440464; ENST00000519908 | TSF |

TABLE 30-continued

Transcript fusion for Kidney Renal Clear Cell Carcinoma (KICH) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 2% | chr6 | 125440425 | 125440534 | + | chr6 | 125541224 | 125541339 | + | ENST00000304877; ENST00000534000; ENST00000368402; ENST00000368388; ENST00000527711; ENST00000528193 | TSF |
| 2% | chr6 | 125440425 | 125440534 | + | chr6 | 125541224 | 125541339 | + | ENST00000304877; ENST00000534000; ENST00000368402; ENST00000368388; ENST00000527711; ENST00000528193 | TSF |
| 2% | chr6 | 125440425 | 125440534 | + | chr6 | 125541224 | 125541339 | + | ENST00000304877; ENST00000534000; ENST00000368402; ENST00000368388; ENST00000527711; ENST00000528193 | TSF |
| 2% | chr6 | 125440425 | 125440534 | + | chr6 | 125541224 | 125541339 | + | ENST00000304877; ENST00000534000; ENST00000368402; ENST00000368388; ENST00000527711; ENST00000528193 | TSF |
| 2% | chr6 | 125440425 | 125440534 | + | chr6 | 125541224 | 125541339 | + | ENST00000304877; ENST00000534000; ENST00000368402; ENST00000368388; ENST00000527711; ENST00000528193 | TSF |
| 2% | chr6 | 125440425 | 125440534 | + | chr6 | 125541224 | 125541339 | + | ENST00000304877; ENST00000534000; ENST00000368402; ENST00000368388; ENST00000527711; ENST00000528193 | TSF |
| 2% | chr4 | 6959398 | 6959457 | + | chr4 | 6969031 | 6969151 | + | ENST00000448507; ENST00000409757; ENST00000410031 | TSF |
| 2% | chr2 | 71895365 | 71895374 | + | chr2 | 71895884 | 71895972 | + | ENST00000409582; ENST00000409762; ENST00000413539; ENST00000429174; ENST00000258104; ENST00000394120; ENST00000409366; ENST00000409651; ENST00000409744; ENST00000410020; ENST00000410041 | TSF |
| 2% | chr8 | 39778739 | 39778956 | + | chr8 | 39780071 | 39780173; 39780170; 39780150 | + | ENST00000519154; ENST00000522495; ENST00000518237; ENST00000253513 | TSF |
| 2% | chr8 | 39778739 | 39778956 | + | chr8 | 39780071 | 39780173; 39780170; 39780150 | + | ENST00000519154; ENST00000522495; ENST00000518237; ENST00000253513 | TSF |
| 2% | chr8 | 39778739 | 39778956 | + | chr8 | 39780071 | 39780173; 39780170; 39780150 | + | ENST00000519154; ENST00000522495; ENST00000518237; ENST00000253513 | TSF |
| 2% | chr2 | 132237131 | 132237231 | + | chr2 | 132237642 | 132238322 | + | ENST00000321253 | TSF |
| 2% | chr1 | 156337404 | 156337862 | + | chr1 | 156339110 | 156339227 | + | ENST00000537040; ENST00000544720; ENST00000368246; ENST00000368247; ENST00000368249; ENST00000446171; ENST00000368245 | TSF |
| 2% | chr1 | 156337404 | 156337862 | + | chr1 | 156339110 | 156339227 | + | ENST00000537040; ENST00000544720; ENST00000368246; ENST00000368247; ENST00000368249; ENST00000446171; ENST00000368245 | TSF |
| 2% | chr1 | 156337404 | 156337862 | + | chr1 | 156339110 | 156339227 | + | ENST00000537040; ENST00000544720; ENST00000368246; ENST00000368247; ENST00000368249; ENST00000446171; ENST00000368245 | TSF |
| 2% | chr1 | 156337404 | 156337862 | + | chr1 | 156339110 | 156339227 | + | ENST00000537040; ENST00000544720; ENST00000368246; ENST00000368247; ENST00000368249; ENST00000446171; ENST00000368245 | TSF |
| 2% | chr1 | 156337404 | 156337862 | + | chr1 | 156339110 | 156339227 | + | ENST00000537040; ENST00000544720; ENST00000368246; ENST00000368247; ENST00000368249; ENST00000446171; ENST00000368245 | TSF |
| 2% | chr4 | 10533364 | 10533137 | − | chr4 | 10527546 | 10527465 | − | ENST00000226951 | TSF |
| 2% | chr3 | 122652679 | 122652013 | − | chr3 | 122647905 | 122647843 | − | ENST00000357599; ENST00000475244; ENST00000195173; ENST00000451055; ENST00000393583 | TSF |
| 2% | chr3 | 122652679 | 122652013 | − | chr3 | 122647905 | 122647843 | − | ENST00000357599; ENST00000475244; ENST00000195173; ENST00000451055; ENST00000393583 | TSF |
| 2% | chr3 | 122652679 | 122652013 | − | chr3 | 122647905 | 122647843 | − | ENST00000357599; ENST00000475244; ENST00000195173; ENST00000451055; ENST00000393583 | TSF |
| 2% | chr3 | 122652679 | 122652013 | − | chr3 | 122647905 | 122647843 | − | ENST00000357599; ENST00000475244; ENST00000195173; ENST00000451055; ENST00000393583 | TSF |
| 2% | chr4 | 10546721 | 10546658 | − | chr4 | 10543904 | 10543879 | − | ENST00000226951; ENST00000442825; ENST00000507719 | TSF |
| 2% | chr4 | 10546721 | 10546658 | − | chr4 | 10543904 | 10543879 | − | ENST00000226951; ENST00000442825; ENST00000507719 | TSF |
| 2% | chr4 | 10546721 | 10546658 | − | chr4 | 10543904 | 10543879 | − | ENST00000226951; ENST00000442825; ENST00000507719 | TSF |

TABLE 30-continued

Transcript fusion for Kidney Renal Clear Cell Carcinoma (KICH) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 2% | chrX | 119449588 | 119449552 | − | chrX | 119438346 | 119438204 | − | ENST00000309720; ENST00000371369; ENST00000440464; ENST00000519908 | TSF |
| 2% | chrX | 119449588 | 119449552 | − | chrX | 119438346 | 119438204 | − | ENST00000309720; ENST00000371369; ENST00000440464; ENST00000519908 | TSF |
| 2% | chrX | 119449588 | 119449552 | − | chrX | 119438346 | 119438204 | − | ENST00000309720; ENST00000371369; ENST00000440464; ENST00000519908 | TSF |
| 2% | chrX | 119449588 | 119449552 | − | chrX | 119438346 | 119438204 | − | ENST00000309720; ENST00000371369; ENST00000440464; ENST00000519908 | TSF |
| 2% | chr10 | 124173941 | 124174189 | + | chr10 | 124175375 | 124175518 | + | ENST00000368990; ENST00000368988; ENST00000368989; ENST00000538022; ENST00000392799; ENST00000433307 | TSF |
| 2% | chr10 | 124173941 | 124174189 | + | chr10 | 124175375 | 124175518 | + | ENST00000368990; ENST00000368988; ENST00000368989; ENST00000538022; ENST00000392799; ENST00000433307 | TSF |
| 2% | chr10 | 124173941 | 124174189 | + | chr10 | 124175375 | 124175518 | + | ENST00000368990; ENST00000368988; ENST00000368989; ENST00000538022; ENST00000392799; ENST00000433307 | TSF |
| 2% | chr16 | 4702240 | 4702316 | + | chr16 | 4702679 | 4702825 | + | ENST00000591895; ENST00000262370; ENST00000415496; ENST00000536343; ENST00000587747; ENST00000399577; ENST00000588994; ENST00000586183; ENST00000590790; ENST00000593224 | TSF |
| 2% | chr16 | 4702240 | 4702316 | + | chr16 | 4702679 | 4702825 | + | ENST00000591895; ENST00000262370; ENST00000415496; ENST00000536343; ENST00000587747; ENST00000399577; ENST00000588994; ENST00000586183; ENST00000590790; ENST00000593224 | TSF |
| 2% | chr16 | 4702240 | 4702316 | + | chr16 | 4702679 | 4702825 | + | ENST00000591895; ENST00000262370; ENST00000415496; ENST00000536343; ENST00000587747; ENST00000399577; ENST00000588994; ENST00000586183; ENST00000590790; ENST00000593224 | TSF |
| 2% | chr16 | 4702240 | 4702316 | + | chr16 | 4702679 | 4702825 | + | ENST00000591895; ENST00000262370; ENST00000415496; ENST00000536343; ENST00000587747; ENST00000399577; ENST00000588994; ENST00000586183; ENST00000590790; ENST00000593224 | TSF |
| 2% | chr16 | 4702240 | 4702316 | + | chr16 | 4702679 | 4702825 | + | ENST00000591895; ENST00000262370; ENST00000415496; ENST00000536343; ENST00000587747; ENST00000399577; ENST00000588994; ENST00000586183; ENST00000590790; ENST00000593224 | TSF |
| 2% | chr16 | 4702240 | 4702316 | + | chr16 | 4702679 | 4702825 | + | ENST00000591895; ENST00000262370; ENST00000415496; ENST00000536343; ENST00000587747; ENST00000399577; ENST00000588994; ENST00000586183; ENST00000590790; ENST00000593224 | TSF |
| 2% | chr16 | 4702240 | 4702316 | + | chr16 | 4702679 | 4702825 | + | ENST00000591895; ENST00000262370; ENST00000415496; ENST00000536343; ENST00000587747; ENST00000399577; ENST00000588994; ENST00000586183; ENST00000590790; ENST00000593224 | TSF |
| 2% | chr16 | 4702240 | 4702316 | + | chr16 | 4702679 | 4702825 | + | ENST00000591895; ENST00000262370; ENST00000415496; ENST00000536343; ENST00000587747; ENST00000399577; ENST00000588994; ENST00000586183; ENST00000590790; ENST00000593224 | TSF |
| 2% | chr16 | 4702240 | 4702316 | + | chr16 | 4702679 | 4702825 | + | ENST00000591895; ENST00000262370; ENST00000415496; ENST00000536343; ENST00000587747; ENST00000399577; ENST00000588994; | TSF |

TABLE 30-continued

Transcript fusion for Kidney Renal Clear Cell Carcinoma (KICH) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| | | | | | | | | | ENST00000586183; ENST00000590790; ENST00000593224 | |
| 2% | chr7 | 33006587 | 33006627 | + | chr7 | 33014229 | 33014374 | + | ENST00000242209; ENST00000538336 | TSF |
| 2% | chr9 | 131902050 | 131902148 | + | chr9 | 131904724 | 131904831; 131905179 | + | ENST00000358994; ENST00000393370; ENST00000337738; ENST00000348141; ENST00000452489; ENST00000357197; ENST00000347048; ENST00000355007; ENST00000417728; ENST00000411917; ENST00000423100; ENST00000524946; ENST00000436883; ENST00000414510; ENST00000432124; ENST00000435305; ENST00000419582; ENST00000432651; ENST00000435132; ENST00000434095 | TSF |
| 2% | chr9 | 131902050 | 131902148 | + | chr9 | 131904724 | 131904831; 131905179 | + | ENST00000358994; ENST00000393370; ENST00000337738; ENST00000348141; ENST00000452489; ENST00000357197; ENST00000347048; ENST00000355007; ENST00000417728; ENST00000411917; ENST00000423100; ENST00000524946; ENST00000436883; ENST00000414510; ENST00000432124; ENST00000435305; ENST00000419582; ENST00000432651; ENST00000435132; ENST00000434095 | TSF |
| 2% | chr9 | 131902050 | 131902148 | + | chr9 | 131904724 | 131904831; 131905179 | + | ENST00000358994; ENST00000393370; ENST00000337738; ENST00000348141; ENST00000452489; ENST00000357197; ENST00000347048; ENST00000355007; ENST00000417728; ENST00000411917; ENST00000423100; ENST00000524946; ENST00000436883; ENST00000414510; ENST00000432124; ENST00000435305; ENST00000419582; ENST00000432651; ENST00000435132; ENST00000434095 | TSF |
| 2% | chr9 | 131902050 | 131902148 | + | chr9 | 131904724 | 131904831; 131905179 | + | ENST00000358994; ENST00000393370; ENST00000337738; ENST00000348141; ENST00000452489; ENST00000357197; ENST00000347048; ENST00000355007; ENST00000417728; ENST00000411917; ENST00000423100; ENST00000524946; ENST00000436883; ENST00000414510; ENST00000432124; ENST00000435305; ENST00000419582; ENST00000432651; ENST00000435132; ENST00000434095 | TSF |
| 2% | chr9 | 131902050 | 131902148 | + | chr9 | 131904724 | 131904831; 131905179 | + | ENST00000358994; ENST00000393370; ENST00000337738; ENST00000348141; ENST00000452489; ENST00000357197; ENST00000347048; ENST00000355007; ENST00000417728; ENST00000411917; ENST00000423100; ENST00000524946; ENST00000436883; ENST00000414510; ENST00000432124; ENST00000435305; ENST00000419582; ENST00000432651; ENST00000435132; ENST00000434095 | TSF |
| 2% | chr4 | 111332609 | 111332609 | + | chr4 | 111397768 | 111398214 | + | ENST00000265162 | TSF |
| 2% | chr1 | 60391887 | 60391853 | − | chr1 | 60381772 | 60381610 | − | ENST00000371204 | TSF |
| 2% | chr6 | 25865287 | 25864286 | − | chr6 | 25862672 | 25862461 | − | ENST00000397060; ENST00000361703; ENST00000360657; ENST00000506105; ENST00000449356 | TSF |
| 2% | chr6 | 25865287 | 25864286 | − | chr6 | 25862672 | 25862461 | − | ENST00000397060; ENST00000361703; ENST00000360657; ENST00000506105; ENST00000449356 | TSF |
| 2% | chr6 | 25865287 | 25864286 | − | chr6 | 25862672 | 25862461 | − | ENST00000397060; ENST00000361703; ENST00000360657; ENST00000506105; ENST00000449356 | TSF |
| 2% | chr7 | 120447469 | 120447344 | − | chr7 | 120446746 | 120446603 | − | ENST00000222747; ENST00000415871 | TSF |
| 2% | chr1 | 161519332 | 161519206 | − | chr1 | 161518821 | 161518801 | − | ENST00000367969; ENST00000443193; ENST00000436743; ENST00000367967; ENST00000426740; ENST00000442336 | TSF |
| 2% | chr1 | 161519332 | 161519206 | − | chr1 | 161518821 | 161518801 | − | ENST00000367969; ENST00000443193; ENST00000436743; ENST00000367967; ENST00000426740; ENST00000442336 | TSF |

TABLE 30-continued

Transcript fusion for Kidney Renal Clear Cell Carcinoma (KICH) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 2% | chr1 | 161519332 | 161519206 | − | chr1 | 161518821 | 161518801 | − | ENST00000367969; ENST00000443193; ENST00000436743; ENST00000367967; ENST00000426740; ENST00000442336 | TSF |
| 2% | chr16 | 4702240 | 4702295 | + | chr16 | 4702679 | 4702825 | + | ENST00000591895; ENST00000262370; ENST00000415496; ENST00000536343; ENST00000587747; ENST00000399577; ENST00000588994; ENST00000586183; ENST00000590790; ENST00000593224 | TSF |
| 2% | chr16 | 4702240 | 4702295 | + | chr16 | 4702679 | 4702825 | + | ENST00000591895; ENST00000262370; ENST00000415496; ENST00000536343; ENST00000587747; ENST00000399577; ENST00000588994; ENST00000586183; ENST00000590790; ENST00000593224 | TSF |
| 2% | chr16 | 4702240 | 4702295 | + | chr16 | 4702679 | 4702825 | + | ENST00000591895; ENST00000262370; ENST00000415496; ENST00000536343; ENST00000587747; ENST00000399577; ENST00000588994; ENST00000586183; ENST00000590790; ENST00000593224 | TSF |
| 2% | chr16 | 4702240 | 4702295 | + | chr16 | 4702679 | 4702825 | + | ENST00000591895; ENST00000262370; ENST00000415496; ENST00000536343; ENST00000587747; ENST00000399577; ENST00000588994; ENST00000586183; ENST00000590790; ENST00000593224 | TSF |
| 2% | chr16 | 4702240 | 4702295 | + | chr16 | 4702679 | 4702825 | + | ENST00000591895; ENST00000262370; ENST00000415496; ENST00000536343; ENST00000587747; ENST00000399577; ENST00000588994; ENST00000586183; ENST00000590790; ENST00000593224 | TSF |
| 2% | chr16 | 4702240 | 4702295 | + | chr16 | 4702679 | 4702825 | + | ENST00000591895; ENST00000262370; ENST00000415496; ENST00000536343; ENST00000587747; ENST00000399577; ENST00000588994; ENST00000586183; ENST00000590790; ENST00000593224 | TSF |
| 2% | chr16 | 4702240 | 4702295 | + | chr16 | 4702679 | 4702825 | + | ENST00000591895; ENST00000262370; ENST00000415496; ENST00000536343; ENST00000587747; ENST00000399577; ENST00000588994; ENST00000586183; ENST00000590790; ENST00000593224 | TSF |
| 2% | chr16 | 4702240 | 4702295 | + | chr16 | 4702679 | 4702825 | + | ENST00000591895; ENST00000262370; ENST00000415496; ENST00000536343; ENST00000587747; ENST00000399577; ENST00000588994; ENST00000586183; ENST00000590790; ENST00000593224 | TSF |
| 2% | chr16 | 4702240 | 4702295 | + | chr16 | 4702679 | 4702825 | + | ENST00000591895; ENST00000262370; ENST00000415496; ENST00000536343; ENST00000587747; ENST00000399577; ENST00000588994; ENST00000586183; ENST00000590790; ENST00000593224 | TSF |
| 2% | chr12 | 123070929 | 123070983 | + | chr12 | 123071248 | 123071304 | + | ENST00000333479 | TSF |
| 2% | chr16 | 30057952 | 30057991 | + | chr16 | 30078595 | 30078687; 30078611; 30078654 | + | ENST00000338110; ENST00000395248; ENST00000566897; ENST00000568435; ENST00000562168; ENST00000569545; ENST00000563060; ENST00000412304; ENST00000563987; ENST00000564546; ENST00000564595; ENST00000569798; ENST00000395240; ENST00000566846; ENST00000562679 | TSF |
| 2% | chr16 | 30057952 | 30057991 | + | chr16 | 30078595 | 30078687; 30078611; 30078654 | + | ENST00000338110; ENST00000395248; ENST00000566897; ENST00000568435; ENST00000562168; | TSF |

TABLE 30-continued

Transcript fusion for Kidney Renal Clear Cell Carcinoma (KICH) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| | | | | | | | | | ENST00000569545; ENST00000563060; ENST00000412304; ENST00000563987; ENST00000564546; ENST00000564595; ENST00000569798; ENST00000395240; ENST00000566846; ENST00000562679 | |
| 2% | chr16 | 30057952 | 30057991 | + | chr16 | 30078595 | 30078687; 30078611; 30078654 | + | ENST00000338110; ENST00000395248; ENST00000566897; ENST00000568435; ENST00000562168; ENST00000569545; ENST00000563060; ENST00000412304; ENST00000563987; ENST00000564546; ENST00000564595; ENST00000569798; ENST00000395240; ENST00000566846; ENST00000562679 | TSF |
| 2% | chr16 | 30057952 | 30057991 | + | chr16 | 30078595 | 30078687; 30078611; 30078654 | + | ENST00000338110; ENST00000395248; ENST00000566897; ENST00000568435; ENST00000562168; ENST00000569545; ENST00000563060; ENST00000412304; ENST00000563987; ENST00000564546; ENST00000564595; ENST00000569798; ENST00000395240; ENST00000566846; ENST00000562679 | TSF |
| 2% | chr16 | 30057952 | 30057991 | + | chr16 | 30078595 | 30078687; 30078611; 30078654 | + | ENST00000338110; ENST00000395248; ENST00000566897; ENST00000568435; ENST00000562168; ENST00000569545; ENST00000563060; ENST00000412304; ENST00000563987; ENST00000564546; ENST00000564595; ENST00000569798; ENST00000395240; ENST00000566846; ENST00000562679 | TSF |
| 2% | chr16 | 30057952 | 30057991 | + | chr16 | 30078595 | 30078687; 30078611; 30078654 | + | ENST00000338110; ENST00000395248; ENST00000566897; ENST00000568435; ENST00000562168; ENST00000569545; ENST00000563060; ENST00000412304; ENST00000563987; ENST00000564546; ENST00000564595; ENST00000569798; ENST00000395240; ENST00000566846; ENST00000562679 | TSF |
| 2% | chr16 | 30057952 | 30057991 | + | chr16 | 30078595 | 30078687; 30078611; 30078654 | + | ENST00000338110; ENST00000395248; ENST00000566897; ENST00000568435; ENST00000562168; ENST00000569545; ENST00000563060; ENST00000412304; ENST00000563987; ENST00000564546; ENST00000564595; ENST00000569798; ENST00000395240; ENST00000566846; ENST00000562679 | TSF |
| 2% | chr16 | 30057952 | 30057991 | + | chr16 | 30078595 | 30078687; 30078611; 30078654 | + | ENST00000338110; ENST00000395248; ENST00000566897; ENST00000568435; ENST00000562168; ENST00000569545; ENST00000563060; ENST00000412304; ENST00000563987; ENST00000564546; ENST00000564595; ENST00000569798; ENST00000395240; ENST00000566846; ENST00000562679 | TSF |
| 2% | chr18 | 668506 | 668576 | + | chr18 | 669072 | 669173 | + | ENST00000323274; ENST00000323250 | TSF |
| 2% | chr8 | 104389530 | 104389536 | + | chr8 | 104390255 | 104390471 | + | ENST00000330295; ENST00000520337 | TSF |
| 2% | chr4 | 22715811 | 22716168 | + | chr4 | 22737604 | 22737831 | + | ENST00000508166; ENST00000503442 | TSF |
| 2% | chr4 | 22715811 | 22716168 | + | chr4 | 22737604 | 22737831 | + | ENST00000508166; ENST00000503442 | TSF |
| 2% | chr20 | 389765 | 390021 | + | chr20 | 390525 | 390669 | + | ENST00000411647; ENST00000382214; ENST00000356286; ENST00000415942; ENST00000475269 | TSF |
| 2% | chr20 | 389765 | 390021 | + | chr20 | 390525 | 390669 | + | ENST00000411647; ENST00000382214; ENST00000356286; ENST00000415942; ENST00000475269 | TSF |
| 2% | chr20 | 389765 | 390021 | + | chr20 | 390525 | 390669 | + | ENST00000411647; ENST00000382214; ENST00000356286; ENST00000415942; ENST00000475269 | TSF |
| 2% | chr20 | 389765 | 390021 | + | chr20 | 390525 | 390669 | + | ENST00000411647; ENST00000382214; ENST00000356286; ENST00000415942; | TSF |

TABLE 30-continued

Transcript fusion for Kidney Renal Clear Cell Carcinoma (KICH) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 2% | chr20 | 389765 | 390021 | + | chr20 | 390525 | 390669 | + | ENST00000475269 ENST00000411647; ENST00000382214; ENST00000356286; ENST00000415942; ENST00000475269 | TSF |
| 2% | chr19 | 1114930 | 1114676 | − | chr19 | 1114421 | 1114230 | − | ENST00000361757; ENST00000587024; ENST00000438103 | TSF |
| 2% | chr15 | 63668307 | 63668160 | − | chr15 | 63667877 | 63667857 | − | ENST00000178638; ENST00000344366; ENST00000422263 | TSF |
| 2% | chr15 | 63668307 | 63668160 | − | chr15 | 63667877 | 63667857 | − | ENST00000178638; ENST00000344366; ENST00000422263 | TSF |
| 2% | chr15 | 63668307 | 63668160 | − | chr15 | 63667877 | 63667857 | − | ENST00000178638; ENST00000344366; ENST00000422263 | TSF |
| 2% | chr20 | 10628319 | 10628254 | − | chr20 | 10627751 | 10627587 | − | ENST00000254958; ENST00000423891 | TSF |
| 2% | chr1 | 42660454 | 42660441 | − | chr1 | 42657390 | 42656974; 42657077 | − | ENST00000372572; ENST00000372573; ENST00000361346; ENST00000361776; ENST00000545068; ENST00000445886 | TSF |
| 2% | chr1 | 42660454 | 42660441 | − | chr1 | 42657390 | 42656974; 42657077 | − | ENST00000372572; ENST00000372573; ENST00000361346; ENST00000361776; ENST00000545068; ENST00000445886 | TSF |
| 2% | chr4 | 122175026 | 122174730 | − | chr4 | 122137655 | 122137570 | − | ENST00000509841 | TSF |
| 1% | chr8 | 24354477 | 24354747 | + | chr8 | 24356749 | 24356829 | + | ENST00000175238; ENST00000380789; ENST00000520720 | TSF |
| 1% | chr8 | 24354477 | 24354747 | + | chr8 | 24356749 | 24356829 | + | ENST00000175238; ENST00000380789; ENST00000520720 | TSF |
| 1% | chr8 | 24354477 | 24354747 | + | chr8 | 24356749 | 24356829 | + | ENST00000175238; ENST00000380789; ENST00000520720 | TSF |
| 1% | chr12 | 28378695 | 28378794 | + | chr12 | 28544237 | 28544344 | + | ENST00000540794; ENST00000536442; ENST00000545336; ENST00000543809; ENST00000545737; ENST00000381259; ENST00000306172 | TSF |
| 1% | chr12 | 28378695 | 28378794 | + | chr12 | 28544237 | 28544344 | + | ENST00000540794; ENST00000536442; ENST00000545336; ENST00000543809; ENST00000545737; ENST00000381259; ENST00000306172 | TSF |
| 1% | chr12 | 28378695 | 28378794 | + | chr12 | 28544237 | 28544344 | + | ENST00000540794; ENST00000536442; ENST00000545336; ENST00000543809; ENST00000545737; ENST00000381259; ENST00000306172 | TSF |
| 1% | chr12 | 28378695 | 28378794 | + | chr12 | 28544237 | 28544344 | + | ENST00000540794; ENST00000536442; ENST00000545336; ENST00000543809; ENST00000545737; ENST00000381259; ENST00000306172 | TSF |
| 1% | chr12 | 28378695 | 28378794 | + | chr12 | 28544237 | 28544344 | + | ENST00000540794; ENST00000536442; ENST00000545336; ENST00000543809; ENST00000545737; ENST00000381259; ENST00000306172 | TSF |
| 1% | chr22 | 25020098 | 25020113 | + | chr22 | 25023399 | 25023586; 25023457 | + | ENST00000248923; ENST00000412658; ENST00000400382; ENST00000400383; ENST00000400380; ENST00000406383; ENST00000425895 | TSF |
| 1% | chr22 | 25020098 | 25020113 | + | chr22 | 25023399 | 25023586; 25023457 | + | ENST00000248923; ENST00000412658; ENST00000400382; ENST00000400383; ENST00000400380; ENST00000406383; ENST00000425895 | TSF |
| 1% | chr22 | 25020098 | 25020113 | + | chr22 | 25023399 | 25023586; 25023457 | + | ENST00000248923; ENST00000412658; ENST00000400382; ENST00000400383; ENST00000400380; ENST00000406383; ENST00000425895 | TSF |
| 1% | chr15 | 85469743 | 85469889 | + | chr15 | 85478257 | 85478425 | + | ENST00000537216; ENST00000537624; ENST00000286749; ENST00000394573 | TSF |
| 1% | chr15 | 85469743 | 85469889 | + | chr15 | 85478257 | 85478425 | + | ENST00000537216; ENST00000537624; ENST00000286749; ENST00000394573 | TSF |
| 1% | chr15 | 85469743 | 85469889 | + | chr15 | 85478257 | 85478425 | + | ENST00000537216; ENST00000537624; ENST00000286749; ENST00000394573 | TSF |
| 1% | chr13 | 102181928 | 102182187 | + | chr13 | 102220050 | 102220196 | + | ENST00000376180; ENST00000376162 | TSF |
| 1% | chr7 | 76921651 | 76921792 | + | chr7 | 76922269 | 76922517 | + | ENST00000285871; ENST00000431197 | TSF |
| 1% | chr7 | 98448201 | 98448151 | − | chr7 | 98446318 | 98446206 | − | ENST00000416379; ENST00000339375; ENST00000450876; ENST00000345589; ENST00000546258 | TSF |
| 1% | chr7 | 98448201 | 98448151 | − | chr7 | 98446318 | 98446206 | − | ENST00000416379; ENST00000339375; ENST00000450876; ENST00000345589; ENST00000546258 | TSF |
| 1% | chrX | 152937975 | 152937874 | − | chrX | 152937655 | 152937581; 152937592; 152937597 | − | ENST00000340888; ENST00000370150; ENST00000393831; ENST00000370142; ENST00000370145; | TSF |

TABLE 30-continued

Transcript fusion for Kidney Renal Clear Cell Carcinoma (KICH) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 1% | chrX | 152937975 | 152937874 | − | chrX | 152937655 | 152937581; 152937592; 152937597 | − | ENST00000447676; ENST00000439087; ENST00000433470; ENST00000422811; ENST00000411968; ENST00000418241; ENST00000434652 ENST00000340888; ENST00000370150; ENST00000393831; ENST00000370142; ENST00000370145; | TSF |
| 1% | chrX | 152937975 | 152937874 | − | chrX | 152937655 | 152937581; 152937592; 152937597 | − | ENST00000447676; ENST00000439087; ENST00000433470; ENST00000422811; ENST00000411968; ENST00000418241; ENST00000434652 ENST00000340888; ENST00000370150; ENST00000393831; ENST00000370142; ENST00000370145; | TSF |
| 1% | chrX | 152937975 | 152937874 | − | chrX | 152937655 | 152937581; 152937592; 152937597 | − | ENST00000447676; ENST00000439087; ENST00000433470; ENST00000422811; ENST00000411968; ENST00000418241; ENST00000434652 ENST00000340888; ENST00000370150; ENST00000393831; ENST00000370142; ENST00000370145; | TSF |
| 1% | chrX | 152937975 | 152937874 | − | chrX | 152937655 | 152937581; 152937592; 152937597 | − | ENST00000340888; ENST00000370150; ENST00000393831; ENST00000370142; ENST00000370145; ENST00000447676; ENST00000439087; ENST00000433470; ENST00000422811; ENST00000411968; ENST00000418241; ENST00000434652 | TSF |
| 1% | chrX | 152937975 | 152937874 | − | chrX | 152937655 | 152937581; 152937592; 152937597 | − | ENST00000340888; ENST00000370150; ENST00000393831; ENST00000370142; ENST00000370145; ENST00000447676; ENST00000439087; ENST00000433470; ENST00000422811; ENST00000411968; ENST00000418241; ENST00000434652 | TSF |
| 1% | chrX | 152937975 | 152937874 | − | chrX | 152937655 | 152937581; 152937592; 152937597 | − | ENST00000340888; ENST00000370150; ENST00000393831; ENST00000370142; ENST00000370145; ENST00000447676; ENST00000439087; ENST00000433470; ENST00000422811; ENST00000411968; ENST00000418241; ENST00000434652 | TSF |
| 1% | chr5 | 121403097 | 121403017 | − | chr5 | 121402444 | 121402438 | − | ENST00000231004 | TSF |
| 1% | chr7 | 102146992 | 102146893 | − | chr7 | 102143691 | 102143610 | − | ENST00000541662; ENST00000465829; ENST00000306682 | TSF |
| 1% | chr7 | 102146992 | 102146893 | − | chr7 | 102143691 | 102143610 | − | ENST00000541662; ENST00000465829; ENST00000306682 | TSF |
| 1% | chr17 | 8713706 | 8713434 | − | chr17 | 8707471 | 8707359 | − | ENST00000311434 | TSF |
| 1% | chr1 | 205496165 | 205496185 | + | chr1 | 205496922 | 205497045; 205497001; 205496953 | + | ENST00000429964; ENST00000506784; ENST00000360066; ENST00000478560; ENST00000419301 | TSF |
| 1% | chr1 | 205496165 | 205496185 | + | chr1 | 205496922 | 205497045; 205497001; 205496953 | + | ENST00000429964; ENST00000506784; ENST00000360066; ENST00000478560; ENST00000419301 | TSF |
| 1% | chr1 | 205496165 | 205496185 | + | chr1 | 205496922 | 205497045; 205497001; 205496953 | + | ENST00000429964; ENST00000506784; ENST00000360066; ENST00000478560; ENST00000419301 | TSI |
| 1% | chr10 | 64280004 | 64280356 | + | chr10 | 64382863 | 64383010 | + | ENST00000410046 | TSF |
| 1% | chr3 | 195447345 | 195447395 | + | chr3 | 195451551 | 195453443; 195452030 | + | ENST00000447234; ENST00000320736; ENST00000436408 | TSF |
| 1% | chr3 | 195447345 | 195447395 | + | chr3 | 195451551 | 195453443; 195452030 | + | ENST00000447234; ENST00000320736; ENST00000436408 | TSF |
| 1% | chr3 | 195447345 | 195447395 | + | chr3 | 195451551 | 195453443; 195452030 | + | ENST00000447234; ENST00000320736; ENST00000436408 | TSF |
| 1% | chr1 | 101189453 | 101189853 | + | chr1 | 101190180 | 101190446 | + | ENST00000370119; ENST00000347652; ENST00000294728; ENST00000370115 | TSF |
| 1% | chr1 | 101189453 | 101189853 | + | chr1 | 101190180 | 101190446 | + | ENST00000370119; ENST00000347652; ENST00000294728; ENST00000370115 | TSF |
| 1% | chr1 | 101189453 | 101189853 | + | chr1 | 101190180 | 101190446 | + | ENST00000370119; ENST00000347652; ENST00000294728; ENST00000370115 | TSF |
| 1% | chr9 | 127083090 | 127083134 | + | chr9 | 127083738 | 127083848 | + | ENST00000540326; ENST00000373603; | TSF |

TABLE 30-continued

Transcript fusion for Kidney Renal Clear Cell Carcinoma (KICH) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 1% | chr9 | 127083090 | 127083134 | + | chr9 | 127083738 | 127083848 | + | ENST00000540326; ENST00000373603; ENST00000373600; ENST00000320246; ENST00000545174; ENST00000444973; ENST00000454453; ENST00000373596; ENST00000425237; ENST00000423785; ENST00000394199; ENST00000546191; ENST00000422297; ENST00000539416; ENST00000447379 | TSF |
| 1% | chr9 | 127083090 | 127083134 | + | chr9 | 127083738 | 127083848 | + | ENST00000540326; ENST00000373603; ENST00000373600; ENST00000320246; ENST00000545174; ENST00000444973; ENST00000454453; ENST00000373596; ENST00000425237; ENST00000423785; ENST00000394199; ENST00000546191; ENST00000422297; ENST00000539416; ENST00000447379 | TSP |
| 1% | chr9 | 127083090 | 127083134 | + | chr9 | 127083738 | 127083848 | + | ENST00000540326; ENST00000373603; ENST00000373600; ENST00000320246; ENST00000545174; ENST00000444973; ENST00000454453; ENST00000373596; ENST00000425237; ENST00000423785; ENST00000394199; ENST00000546191; ENST00000422297; ENST00000539416; ENST00000447379 | TSF |
| 1% | chr9 | 127083090 | 127083134 | + | chr9 | 127083738 | 127083848 | + | ENST00000540326; ENST00000373603; ENST00000373600; ENST00000320246; ENST00000545174; ENST00000444973; ENST00000454453; ENST00000373596; ENST00000425237; ENST00000423785; ENST00000394199; ENST00000546191; ENST00000422297; ENST00000539416; ENST00000447379 | TSF |
| 1% | chr9 | 127083090 | 127083134 | + | chr9 | 127083738 | 127083848 | + | ENST00000540326; ENST00000373603; ENST00000373600; ENST00000320246; ENST00000545174; ENST00000444973; ENST00000454453; ENST00000373596; ENST00000425237; ENST00000423785; ENST00000394199; ENST00000546191; ENST00000422297; ENST00000539416; ENST00000447379 | TSF |
| 1% | chr9 | 127083090 | 127083134 | + | chr9 | 127083738 | 127083848 | + | ENST00000540326; ENST00000373603; ENST00000373600; ENST00000320246; ENST00000545174; ENST00000444973; ENST00000454453; ENST00000373596; ENST00000425237; ENST00000423785; ENST00000394199; ENST00000546191; ENST00000422297; ENST00000539416; ENST00000447379 | TSF |
| 1% | chr9 | 127083090 | 127083134 | + | chr9 | 127083738 | 127083848 | + | ENST00000540326; ENST00000373603; ENST00000373600; ENST00000320246; ENST00000545174; ENST00000444973; ENST00000454453; ENST00000373596; ENST00000425237; ENST00000423785; ENST00000394199; ENST00000546191; ENST00000422297; ENST00000539416; ENST00000447379 | TSF |
| 1% | chr2 | 85823332 | 85823377 | + | chr2 | 85823642 | 85823772 | + | ENST00000441634; ENST00000306368; ENST00000414390; ENST00000443647; ENST00000456023 | TSF |
| 1% | chr2 | 85823332 | 85823377 | + | chr2 | 85823642 | 85823772 | + | ENST00000441634; ENST00000306368; | TSF |

TABLE 30-continued

Transcript fusion for Kidney Renal Clear Cell Carcinoma (KICH) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 1% | chr2 | 85823332 | 85823377 | + | chr2 | 85823642 | 85823772 | + | ENST00000414390; ENST00000443647; ENST00000456023 ENST00000441634; ENST00000306368; ENST00000414390; ENST00000443647; ENST00000456023 | TSF |
| 1% | chr2 | 85823332 | 85823377 | + | chr2 | 85823642 | 85823772 | + | ENST00000441634; ENST00000306368; ENST00000414390; ENST00000443647; ENST00000456023 | TSF |
| 1% | chr2 | 85823332 | 85823377 | + | chr2 | 85823642 | 85823772 | + | ENST00000441634; ENST00000306368; ENST00000414390; ENST00000443647; ENST00000456023 | TSF |
| 1% | chr17 | 3401396 | 3401426 | + | chr17 | 3402185 | 3402382 | + | ENST00000456349; ENST00000263080 | TSF |
| 1% | chr5 | 179021483 | 179021552 | + | chr5 | 179021867 | 179021964; 179021899 | + | ENST00000319449; ENST00000437570; ENST00000393438; ENST00000508609; ENST00000502434 | TSF |
| 1% | chr5 | 179021483 | 179021552 | + | chr5 | 179021867 | 179021964; 179021899 | + | ENST00000319449; ENST00000437570; ENST00000393438; ENST00000508609; ENST00000502434 | TSF |
| 1% | chr5 | 179021483 | 179021552 | + | chr5 | 179021867 | 179021964; 179021899 | + | ENST00000319449; ENST00000437570; ENST00000393438; ENST00000508609; ENST00000502434 | TSF |
| 1% | chr16 | 4708255 | 4708353 | + | chr16 | 4714710 | 4714776 | + | ENST00000262370; ENST00000415496; ENST00000536343; ENST00000587747; ENST00000399577; ENST00000588994; ENST00000586183; ENST00000590790 | TSF |
| 1% | chr16 | 4708255 | 4708353 | + | chr16 | 4714710 | 4714776 | + | ENST00000262370; ENST00000415496; ENST00000536343; ENST00000587747; ENST00000399577; ENST00000588994; ENST00000586183; ENST00000590790 | TSF |
| 1% | chr16 | 4708255 | 4708353 | + | chr16 | 4714710 | 4714776 | + | ENST00000262370; ENST00000415496; ENST00000536343; ENST00000587747; ENST00000399577; ENST00000588994; ENST00000586183; ENST00000590790 | TSF |
| 1% | chr16 | 4708255 | 4708353 | + | chr16 | 4714710 | 4714776 | + | ENST00000262370; ENST00000415496; ENST00000536343; ENST00000587747; ENST00000399577; ENST00000588994; ENST00000586183; ENST00000590790 | TSF |
| 1% | chr16 | 4708255 | 4708353 | + | chr16 | 4714710 | 4714776 | + | ENST00000262370; ENST00000415496; ENST00000536343; ENST00000587747; ENST00000399577; ENST00000588994; ENST00000586183; ENST00000590790 | TSF |
| 1% | chr16 | 4708255 | 4708353 | + | chr16 | 4714710 | 4714776 | + | ENST00000262370; ENST00000415496; ENST00000536343; ENST00000587747; ENST00000399577; ENST00000588994; ENST00000586183; ENST00000590790 | TSF |
| 1% | chr16 | 4708255 | 4708353 | + | chr16 | 4714710 | 4714776 | + | ENST00000262370; ENST00000415496; ENST00000536343; ENST00000587747; ENST00000399577; ENST00000588994; ENST00000586183; ENST00000590790 | TSF |
| 1% | chr2 | 28191829 | 28192099 | + | chr2 | 28210860 | 28210954 | + | ENST00000436924; ENST00000344773; ENST00000379624; ENST00000342045; ENST00000361704; ENST00000379632; ENST00000379629; ENST00000604932 | TSF |
| 1% | chr2 | 28191829 | 28192099 | + | chr2 | 28210860 | 28210954 | + | ENST00000436924; ENST00000344773; ENST00000379624; ENST00000342045; ENST00000361704; ENST00000379632; ENST00000379629; ENST00000604932 | TSF |
| 1% | chr2 | 28191829 | 28192099 | + | chr2 | 28210860 | 28210954 | + | ENST00000436924; ENST00000344773; ENST00000379624; ENST00000342045; ENST00000361704; | TSF |

TABLE 30-continued

Transcript fusion for Kidney Renal Clear Cell Carcinoma (KICH) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 1% | chr2 | 28191829 | 28192099 | + | chr2 | 28210860 | 28210954 | + | ENST00000379632; ENST00000379629; ENST00000604932 ENST00000436924; ENST00000344773; ENST00000379624; ENST00000342045; ENST00000361704; | TSF |
| 1% | chr2 | 28191829 | 28192099 | + | chr2 | 28210860 | 28210954 | + | ENST00000379632; ENST00000379629; ENST00000604932 ENST00000436924; ENST00000344773; ENST00000379624; ENST00000342045; ENST00000361704; | TSF |
| 1% | chr2 | 28191829 | 28192099 | + | chr2 | 28210860 | 28210954 | + | ENST00000379632; ENST00000379629; ENST00000604932 ENST00000436924; ENST00000344773; ENST00000379624; ENST00000342045; ENST00000361704; | TSF |
| 1% | chr1 | 101189453 | 101189677 | + | chr1 | 101190180 | 101190446 | + | ENST00000370119; ENST00000347652; ENST00000294728; ENST00000370115 | TSF |
| 1% | chr1 | 101189453 | 101189677 | + | chr1 | 101190180 | 101190446 | + | ENST00000370119; ENST00000347652; ENST00000294728; ENST00000370115 | TSF |
| 1% | chr1 | 101189453 | 101189677 | + | chr1 | 101190180 | 101190446 | + | ENST00000370119; ENST00000347652; ENST00000294728; ENST00000370115 | TSF |
| 1% | chr17 | 13442614 | 13442384 | − | chr17 | 13400135 | 13399514 | − | ENST00000284110 | TSF |
| 1% | chr20 | 48328930 | 48328898 | − | chr20 | 48273239 | 48273105 | − | ENST00000371711 | TSF |
| 1% | chr1 | 48256717 | 48256707 | − | chr1 | 48244216 | 48244126 | − | ENST00000606738 | TSF |
| 1% | chr17 | 30185561 | 30185499 | − | chr17 | 30183884 | 30183818 | − | ENST00000302362; ENST00000378634; ENST00000496655 | TSF |
| 1% | chr17 | 30185561 | 30185499 | − | chr17 | 30183884 | 30183818 | − | ENST00000302362; ENST00000378634; ENST00000496655 | TSF |
| 1% | chr | 206288369 | 206288105 | − | chr1 | 206243250 | 206243150 | − | ENST00000331555 | TSF |
| 1% | chr9 | 130732697 | 130732597 | − | chr9 | 130716204 | 130716084 | − | ENST00000373095 | TSF |
| 1% | chr3 | 59842786 | 59842708 | − | chr3 | 59738047 | 59737952 | − | ENST00000476844; ENST00000492590; ENST00000468189; ENST00000341848 | TSF |
| 1% | chr16 | 20587097 | 20586744 | − | chr16 | 20570769 | 20570559; 20570593; 20570630 | − | ENST00000329697; ENST00000565232; ENST00000567001; ENST00000569327; ENST00000414188; ENST00000566384; ENST00000569344 | TSF |
| 1% | chr16 | 20587097 | 20586744 | − | chr16 | 20570769 | 20570559; 20570593; 20570630 | − | ENST00000329697; ENST00000565232; ENST00000567001; ENST00000569327; ENST00000414188; ENST00000566384; ENST00000569344 | TSF |
| 1% | chr16 | 20587097 | 20586744 | − | chr16 | 20570769 | 20570559; 20570593; 20570630 | − | ENST00000329697; ENST00000565232; ENST00000567001; ENST00000569327; ENST00000414188; ENST00000566384; ENST00000569344 | TSF |
| 1% | chr16 | 20587097 | 20586744 | − | chr16 | 20570769 | 20570559; 20570593; 20570630 | − | ENST00000329697; ENST00000565232; ENST00000567001; ENST00000569327; ENST00000414188; ENST00000566384; ENST00000569344 | TSF |
| 1% | chr7 | 50723014 | 50722961 | − | chr7 | 50694675 | 50694519 | − | ENST00000398810; ENST00000439599; ENST00000398812; ENST00000335866; ENST00000402578; ENST00000403097; ENST00000406641; ENST00000357271; ENST00000407526; ENST00000401949; ENST00000402497 | TSF |
| 1% | chr7 | 50723014 | 50722961 | − | chr7 | 50694675 | 50694519 | − | ENST00000398810; ENST00000439599; ENST00000398812; ENST00000335866; ENST00000402578; ENST00000403097; ENST00000406641; ENST00000357271; ENST00000407526; ENST00000401949; ENST00000402497 | TSF |
| 1% | chr7 | 102246155 | 102246056 | − | chr7 | 102242852 | 102242771 | − | ENST00000262940; ENST00000461209; ENST00000449970; ENST00000462172; ENST00000522801; ENST00000520042; ENST00000521076 | TSF |
| 1% | chr7 | 102246155 | 102246056 | − | chr7 | 102242852 | 102242771 | − | ENST00000262940; ENST00000461209; ENST00000449970; ENST00000462172; ENST00000522801; ENST00000520042; ENST00000521076 | TSF |
| 1% | chr7 | 102246155 | 102246056 | − | chr7 | 102242852 | 102242771 | − | ENST00000262940; ENST00000461209; ENST00000449970; ENST00000462172; ENST00000522801; ENST00000520042; ENST00000521076 | TSF |
| 1% | chr7 | 102246155 | 102246056 | − | chr7 | 102242852 | 102242771 | − | ENST00000262940; ENST00000461209; | TSF |

TABLE 30-continued

Transcript fusion for Kidney Renal Clear Cell Carcinoma (KICH) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 1% | chr1 | 60406096 | 60405910 | – | chr1 | 60381772 | 60381610 | – | ENST00000449970; ENST00000462172; ENST00000522801; ENST00000520042; ENST00000521076 ENST00000371204 | TSF |
| 1% | chr3 | 133881128 | 133880716 | – | chr3 | 133878217 | 133878081 | – | ENST00000460933; ENST00000296084; ENST00000427044 | TSF |
| 1% | chr8 | 95431039 | 95430884 | – | chr8 | 95423543 | 95423349; 95423528; 95423520; 95423471 | – | ENST00000336148; ENST00000517506; ENST00000463267; ENST00000518998; ENST00000523839 | TSF |
| 1% | chr8 | 95431039 | 95430884 | – | chr8 | 95423543 | 95423349; 95423528; 95423520; 95423471 | – | ENST00000336148; ENST00000517506; ENST00000463267; ENST00000518998; ENST00000523839 | TSF |
| 1% | chr8 | 95431039 | 95430884 | – | chr8 | 95423543 | 95423349; 95423528; 95423520; 95423471 | – | ENST00000336148; ENST00000517506; ENST00000463267; ENST00000518998; ENST00000523839 | TSF |
| 1% | chr8 | 95431039 | 95430884 | – | chr8 | 95423543 | 95423349; 95423528; 95423520; 95423471 | – | ENST00000336148; ENST00000517506; ENST00000463267; ENST00000518998; ENST00000523839 | TSF |
| 1% | chr2 | 170206045 | 170205691 | – | chr2 | 170177394 | 170177287 | – | ENST00000263816; ENST00000443831 | TSF |
| 1% | chr2 | 170206045 | 170205691 | – | chr2 | 170177394 | 170177287 | – | ENST00000263816; ENST00000443831 | TSF |
| 1% | chr12 | 7277801 | 7277662 | – | chr12 | 7277326 | 7277225 | – | ENST00000266560 | TSF |
| 1% | chr3 | 132377006 | 132376938 | – | chr3 | 132363740 | 132363641 | – | ENST00000355458; ENST00000264990; ENST00000485198; ENST00000481970 | TSF |
| 1% | chr3 | 132377006 | 132376938 | – | chr3 | 132363740 | 132363641 | – | ENST00000355458; ENST00000264990; ENST00000485198; ENST00000481970 | TSF |
| 1% | chr3 | 132377006 | 132376938 | – | chr3 | 132363740 | 132363641 | – | ENST00000355458; ENST00000264990; ENST00000485198; ENST00000481970 | TSF |
| 1% | chr3 | 132377006 | 132376938 | – | chr3 | 132363740 | 132363641 | – | ENST00000355458; ENST00000264990; ENST00000485198; ENST00000481970 | TSF |
| 1% | chr17 | 8715603 | 8715333 | – | chr17 | 8707471 | 8707359 | – | ENST00000311434 | TSF |

TABLE 31

Transcript fusion for Cervical Kidney renal papillary cell carcinoma (KIRP) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 54% | chr19 | 50984141 | 50984234 | + | ENST00000334976; ENST00000376918; ENST00000598585 | chr19 | 51009025 | 51009080 | + | TAF |
| 41% | chr9 | 131002264 | 131002275 | + | ENST00000475805; ENST00000341179; ENST00000372923; ENST00000393594; ENST00000486160 | chr9 | 131002706 | 131002973 | + | TAF |
| 41% | chr9 | 131002264 | 131002275 | + | ENST00000475805; ENST00000341179; ENST00000372923; ENST00000393594; ENST00000486160 | chr9 | 131002706 | 131002973 | + | TAF |
| 41% | chr5 | 156464372 | 156464258 | – | ENST00000522693; ENST00000523175; ENST00000339252; ENST00000425854; ENST00000544197 | chr5 | 156429918 | 156429891 | – | TSF |
| 27% | chr7 | 27582719 | 27582586 | – | ENST00000265395; ENST00000425715 | chr7 | 27581374 | 27579272 | – | TAF |
| 27% | chr7 | 27582719 | 27582586 | – | ENST00000265395; ENST00000425715 | chr7 | 27581374 | 27579272 | – | TAF |
| 23% | chr4 | 25759228 | 25759156 | – | ENST00000399878; ENST00000264868; ENST00000502949; ENST00000510448 | chr4 | 25723603 | 25723555 | – | TSF |
| 23% | chr4 | 25759228 | 25759156 | – | ENST00000399878; ENST00000264868; ENST00000502949; ENST00000510448 | chr4 | 25723603 | 25723555 | – | TSF |
| 23% | chr4 | 25759228 | 25759156 | – | ENST00000399878; ENST00000264868; ENST00000502949; ENST00000510448 | chr4 | 25723603 | 25723555 | – | TSF |
| 23% | chr4 | 25759228 | 25759156 | – | ENST00000399878; ENST00000264868; ENST00000502949; ENST00000510448 | chr4 | 25723603 | 25723555 | – | TSF |
| 22% | chr19 | 3544937 | 3544807 | – | ENST00000389395; ENST00000398558; ENST00000588918; ENST00000355415; ENST00000589063 | chr19 | 3538708 | 3538306 | – | TAF |
| 22% | chr19 | 3544937 | 3544807 | – | ENST00000389395; ENST00000398558; ENST00000588918; ENST00000355415; ENST00000589063 | chr19 | 3538708 | 3538306 | – | TAF |
| 22% | chr19 | 3544937 | 3544807 | – | ENST00000389395; ENST00000398558; ENST00000588918; ENST00000355415; ENST00000589063 | chr19 | 3538708 | 3538306 | – | TAF |

TABLE 31-continued

Transcript fusion for Cervical Kidney renal papillary cell carcinoma (KIRP)
Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 21% | chr6 | 25849692; 25849622 | 25849602 | − | ENST00000481949; ENST00000505420; ENST00000397060; ENST00000361703; ENST00000360657 | chr6 | 25847464 | 25847164 | − | TAF |
| 21% | chr6 | 25849692; 25849622 | 25849602 | − | ENST00000481949; ENST00000505420; ENST00000397060; ENST00000361703; ENST00000360657 | chr6 | 25847464 | 25847164 | − | TAF |
| 21% | chr6 | 25849692; 25849622 | 25849602 | − | ENST00000481949; ENST00000505420; ENST00000397060; ENST00000361703; ENST00000360657 | chr6 | 25847464 | 25847164 | − | TAF |
| 21% | chr6 | 25849692; 25849622 | 25849602 | − | ENST00000481949; ENST00000505420; ENST00000397060; ENST00000361703; ENST00000360657 | chr6 | 25847464 | 25847164 | − | TAF |
| 19% | chr9 | 131002007 | 131002058 | + | ENST00000475805; ENST00000341179; ENST00000372923; ENST00000393594; ENST00000486160 | chr9 | 131002706 | 131002973 | + | TSF |
| 19% | chr9 | 131002007 | 131002058 | + | ENST00000475805; ENST00000341179; ENST00000372923; ENST00000393594; ENST00000486160 | chr9 | 131002706 | 131002973 | + | TSF |
| 18% | chrX | 152730513 | 152730446 | − | ENST00000370211; ENST00000370212; ENST00000370210 | chrX | 152728559 | 152728505 | − | TAF |
| 18% | chrX | 152730513 | 152730446 | − | ENST00000370211; ENST00000370212; ENST00000370210 | chrX | 152728559 | 152728505 | − | TAF |
| 14% | chr20 | 53092486 | 53092551 | + | ENST00000262593 | chr20 | 53111339 | 53111426 | + | TAF |
| 13% | chr15 | 58724232 | 58724319 | + | ENST00000356113; ENST00000414170; ENST00000299022; ENST00000433326 | chr15 | 58787321 | 58787441 | + | TAF |
| 13% | chr1 | 171252283 | 171252355 | + | ENST00000367750; ENST00000402921; ENST00000354841 | chr1 | 171253062 | 171253076 | + | TAF |
| 13% | chr1 | 171252283 | 171252355 | + | ENST00000367750; ENST00000402921; ENST00000354841 | chr1 | 171253062 | 171253076 | + | TAF |
| 13% | chr10 | 5040939 | 5040817 | − | ENST00000380753; ENST00000421196; ENST00000407674; ENST00000604507 | chr10 | 5002427 | 5002117 | − | TAF |
| 13% | chr10 | 5040939 | 5040817 | − | ENST00000380753; ENST00000421196; ENST00000407674; ENST00000604507 | chr10 | 5002427 | 5002117 | − | TAF |
| 13% | chr11 | 2940537 | 2940637 | + | ENST00000347936; ENST00000312221; ENST00000449793; ENST00000380574 | chr11 | 2940968 | 2941017 | + | TAF |
| 13% | chr11 | 2940537 | 2940637 | + | ENST00000347936; ENST00000312221; ENST00000449793; ENST00000380574 | chr11 | 2940968 | 2941017 | + | TAF |
| 12% | chr17 | 43215280; 43215290 | 43215355 | + | ENST00000431281; ENST00000591859; ENST00000586346; ENST00000398322; ENST00000592162; ENST00000376955; ENST00000321854 | chr17 | 43215643 | 43215745 | + | TAF |
| 12% | chr17 | 43215280; 43215290 | 43215355 | + | ENST00000431281; ENST00000591859; ENST00000586346; ENST00000398322; ENST00000592162; ENST00000376955; ENST00000321854 | chr17 | 43215643 | 43215745 | + | TAF |
| 12% | chr17 | 43215280; 43215290 | 43215355 | + | ENST00000431281; ENST00000591859; ENST00000586346; ENST00000398322; ENST00000592162; ENST00000376955; ENST00000321854 | chr17 | 43215643 | 43215745 | + | TAF |
| 11% | chr7 | 1037440 | 1037282 | − | ENST00000357429; ENST00000397100; ENST00000397098; ENST00000412051; ENST00000444428; ENST00000491163 | chr7 | 1018697 | 1018446 | − | TAF |
| 11% | chr7 | 1037440 | 1037282 | − | ENST00000357429; ENST00000397100; ENST00000397098; ENST00000412051; ENST00000444428; ENST00000491163 | chr7 | 1018697 | 1018446 | − | TAF |
| 11% | chr7 | 1037440 | 1037282 | − | ENST00000357429; ENST00000397100; ENST00000397098; ENST00000412051; ENST00000444428; ENST00000491163 | chr7 | 1018697 | 1018446 | − | TAF |
| 11% | chr4 | 25759228 | 25759156 | − | ENST00000399878; ENST00000264868; ENST00000502949; ENST00000510448 | chr4 | 25716488 | 25716212 | − | TSF |
| 11% | chr4 | 25759228 | 25759156 | − | ENST00000399878; ENST00000264868; ENST00000502949; ENST00000510448 | chr4 | 25716488 | 25716212 | − | TSF |
| 11% | chr4 | 25759228 | 25759156 | − | ENST00000399878; ENST00000264868; ENST00000502949; ENST00000510448 | chr4 | 25716488 | 25716212 | − | TSF |
| 11% | chr4 | 25759228 | 25759156 | − | ENST00000399878; ENST00000264868; ENST00000502949; ENST00000510448 | chr4 | 25716488 | 25716212 | − | TSF |
| 10% | chr9 | 71155730 | 71155453 | − | ENST00000377311 | chr9 | 71141327 | 71141315 | − | TSF |
| 7% | chr7 | 151810331; 151810330 | 151810483 | + | ENST00000430044; ENST00000452146; ENST00000434507; ENST00000320311; ENST00000431940 | chr7 | 151813950 | 151814077 | + | TSF |
| 7% | chr7 | 151810331; 151810330 | 151810483 | + | ENST00000430044; ENST00000452146; ENST00000434507; ENST00000320311; ENST00000431940 | chr7 | 151813950 | 151814077 | + | TSF |
| 7% | chr7 | 151810331; 151810330 | 151810483 | + | ENST00000430044; ENST00000452146; ENST00000434507; ENST00000320311; | chr7 | 151813950 | 151814077 | + | TSF |

TABLE 31-continued

Transcript fusion for Cervical Kidney renal papillary cell carcinoma (KIRP)
Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 6% | chr9 | 125054028 | 125054119 | + | ENST00000431940 ENST00000297908; ENST00000344641; ENST00000373723; ENST00000373729; ENST00000394315 | chr9 | 125068067 | 125068171 | + | TSF |
| 6% | chr9 | 125054028 | 125054119 | + | ENST00000297908; ENST00000344641; ENST00000373723; ENST00000373729; ENST00000394315 | chr9 | 125068067 | 125068171 | + | TSF |
| 6% | chr9 | 125054028 | 125054119 | + | ENST00000297908; ENST00000344641; ENST00000373723; ENST00000373729; ENST00000394315 | chr9 | 125068067 | 125068171 | + | TSF |
| 4% | chr17 | 19470409 | 19470541 | + | ENST00000571335; ENST00000436810; ENST00000457293; ENST00000270570; ENST00000395585 | chr17 | 19482057 | 19482370 | + | TSF |
| 4% | chr17 | 19470409 | 19470541 | + | ENST00000571335; ENST00000436810; ENST00000457293; ENST00000270570; ENST00000395585 | chr17 | 19482057 | 19482370 | + | TSF |
| 4% | chr17 | 19470409 | 19470541 | + | ENST00000571335; ENST00000436810; ENST00000457293; ENST00000270570; ENST00000395585 | chr17 | 19482057 | 19482370 | + | TSF |
| 4% | chr20 | 43752906 | 43752748 | − | ENST00000372785 | chr20 | 43744893 | 43744813 | − | TSF |
| 4% | chr9 | 131004511 | 131004624 | + | ENST00000475805; ENST00000341179; ENST00000372923; ENST00000393594; ENST00000486160 | chr9 | 131004898 | 131005047 | + | TSF |
| 4% | chr9 | 131004511 | 131004624 | + | ENST00000475805; ENST00000341179; ENST00000372923; ENST00000393594; ENST00000486160 | chr9 | 131004898 | 131005047 | + | TSF |
| 4% | chr22 | 23955517 | 23955476 | − | ENST00000317749 | chr22 | 23925665 | 23925612 | − | TSF |
| 4% | chr3 | 98600611; 98600498 | 98600384 | − | ENST00000326840; ENST00000326857; ENST00000449482 | chr3 | 98586282 | 98584565 | − | TSF |
| 4% | chr3 | 98600611; 98600498 | 98600384 | − | ENST00000326840; ENST00000326857; ENST00000449482 | chr3 | 98586282 | 98584565 | − | TSF |
| 4% | chr17 | 45473200 | 45473343 | + | ENST00000331493; ENST00000517484; ENST00000523842 | chr17 | 45474435 | 45476216 | + | TSF |
| 4% | chr17 | 45473200 | 45473343 | + | ENST00000331493; ENST00000517484; ENST00000523842 | chr17 | 45474435 | 45476216 | + | TSF |
| 4% | chr17 | 45473200 | 45473343 | + | ENST00000331493; ENST00000517484; ENST00000523842 | chr17 | 45474435 | 45476216 | + | TSF |
| 4% | chr17 | 36288631 | 36288740 | + | ENST00000327454; ENST00000378174; ENST00000505415; ENST00000539424 | chr17 | 36289142 | 36289609 | + | TSF |
| 4% | chr17 | 36288631 | 36288740 | + | ENST00000327454; ENST00000378174; ENST00000505415; ENST00000539424 | chr17 | 36289142 | 36289609 | + | TSF |
| 4% | chr2 | 28352138 | 28352247 | + | ENST00000344773; ENST00000379624; ENST00000342045; ENST00000361704; ENST00000379632; ENST00000379629 | chr2 | 28362015 | 28362218 | + | TSF |
| 3% | chr19 | 3869015; 3869013 | 3868963 | − | ENST00000262961; ENST00000438164; ENST00000587212; ENST00000586578; ENST00000439086 | chr19 | 3855694 | 3855445 | − | TSF |
| 3% | chr19 | 3869015; 3869013 | 3868963 | − | ENST00000262961; ENST00000438164; ENST00000587212; ENST00000586578; ENST00000439086 | chr19 | 3855694 | 3855445 | − | TSF |
| 3% | chr16 | 30783410 | 30783511 | + | ENST00000324685; ENST00000402121; ENST00000563683; ENST00000357890 | chr16 | 30785136 | 30785155 | + | TSF |
| 3% | chr16 | 30783410 | 30783511 | + | ENST00000324685; ENST00000402121; ENST00000563683; ENST00000357890 | chr16 | 30785136 | 30785155 | + | TSF |
| 3% | chr16 | 30783410 | 30783511 | + | ENST00000324685; ENST00000402121; ENST00000563683; ENST00000357890 | chr16 | 30785136 | 30785155 | + | TSF |
| 3% | chr16 | 30783410 | 30783511 | + | ENST00000324685; ENST00000402121; ENST00000563683; ENST00000357890 | chr16 | 30785136 | 30785155 | + | TSF |
| 3% | chr17 | 19605987 | 19605918 | − | ENST00000325411; ENST00000350657 | chr17 | 19600213 | 19600058 | − | TSF |
| 3% | chr17 | 19605987 | 19605918 | − | ENST00000325411; ENST00000350657 | chr17 | 19600213 | 19600058 | − | TSF |
| 3% | chr17 | 36343995 | 36343886 | − | ENST00000518551; ENST00000354664; ENST00000339023; ENST00000519532; ENST00000537432 | chr17 | 36343484 | 36343017 | − | TSF |
| 3% | chr17 | 36343995 | 36343886 | − | ENST00000518551; ENST00000354664; ENST00000339023; ENST00000519532; ENST00000537432 | chr17 | 36343484 | 36343017 | − | TSF |
| 2% | chr14 | 73733431 | 73733539 | + | ENST00000427855; ENST00000340738; ENST00000554301; ENST00000555445 | chr14 | 73734835 | 73734859 | + | TSF |
| 2% | chr14 | 73733431 | 73733539 | + | ENST00000427855; ENST00000340738; ENST00000554301; ENST00000555445 | chr14 | 73734835 | 73734859 | + | TSF |
| 2% | chr14 | 73733431 | 73733539 | + | ENST00000427855; ENST00000340738; ENST00000554301; ENST00000555445 | chr14 | 73734835 | 73734859 | + | TSF |
| 2% | chr11 | 59562845 | 59562955 | + | ENST00000300150; ENST00000337979; ENST00000529177; ENST00000530221 | chr11 | 59605243 | 59605700 | + | TSF |
| 2% | chr11 | 59562845 | 59562955 | + | ENST00000300150; ENST00000337979 | chr11 | 59605243 | 59605700 | + | TSF |

TABLE 31-continued

Transcript fusion for Cervical Kidney renal papillary cell carcinoma (KIRP)
Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 2% | chr11 | 59562845 | 59562955 | + | ENST00000529177; ENST00000530221 ENST00000300150; ENST00000337979; | chr11 | 59605243 | 59605700 | + | TSF |
| 2% | chr1 | 2492063 | 2492153 | + | ENST00000529177; ENST00000530221 ENST00000426449; ENST00000434817; ENST00000435221; ENST00000451778; ENST00000409119; ENST00000355716 | chr1 | 2508457 | 2508463 | + | TSF |
| 2% | chr11 | 118882859 | 118882964 | + | ENST00000334418 | chr11 | 118884956 | 118885003 | + | TSF |
| 2% | chr17 | 45473200 | 45473343 | + | ENST00000331493; ENST00000517484; ENST00000523842 | chr17 | 45474497 | 45476216 | + | TSF |
| 2% | chr17 | 45473200 | 45473343 | + | ENST00000331493; ENST00000517484; ENST00000523842 | chr17 | 45474497 | 45476216 | + | TSF |
| 2% | chr17 | 45473200 | 45473343 | + | ENST00000331493; ENST00000517484; ENST00000523842 | chr17 | 45474497 | 45476216 | + | TSF |
| 2% | chr7 | 93516743; 93516667 | 93516573 | − | ENST00000222543; ENST00000451238 | chr7 | 93492029 | 93491711 | − | TSF |
| 2% | chr7 | 93516743; 93516667 | 93516573 | − | ENST00000222543; ENST00000451238 | chr7 | 93492029 | 93491711 | − | TSF |
| 2% | chr16 | 29913136; 29912293 | 29913241 | + | ENST00000563177; ENST00000483405; ENST00000308748; ENST00000414952; ENST00000566693 | chr16 | 29915825 | 29915953 | + | TSF |
| 2% | chr16 | 29913136; 29912293 | 29913241 | + | ENST00000563177; ENST00000483405; ENST00000308748; ENST00000414952; ENST00000566693 | chr16 | 29915825 | 29915953 | + | TSF |
| 2% | chr8 | 42924698; 42924750 | 42924802 | + | ENST00000534420; ENST00000302279; ENST00000533998; ENST00000342116; ENST00000531266; ENST00000525699; ENST00000529687; ENST00000533336 | chr8 | 42925245 | 42925476 | + | TSF |
| 2% | chr8 | 42924698; 42924750 | 42924802 | + | ENST00000534420; ENST00000302279; ENST00000533998; ENST00000342116; ENST00000531266; ENST00000525699; ENST00000529687; ENST00000533336 | chr8 | 42925245 | 42925476 | + | TSF |
| 2% | chr8 | 42924698; 42924750 | 42924802 | + | ENST00000534420; ENST00000302279; ENST00000533998; ENST00000342116; ENST00000531266; ENST00000525699; ENST00000529687; ENST00000533336 | chr8 | 42925245 | 42925476 | + | TSF |
| 2% | chr8 | 42924698; 42924750 | 42924802 | + | ENST00000534420; ENST00000302279; ENST00000533998; ENST00000342116; ENST00000531266; ENST00000525699; ENST00000529687; ENST00000533336 | chr8 | 42925245 | 42925476 | + | TSF |
| 2% | chr8 | 42924698; 42924750 | 42924802 | + | ENST00000534420; ENST00000302279; ENST00000533998; ENST00000342116; ENST00000531266; ENST00000525699; ENST00000529687; ENST00000533336 | chr8 | 42925245 | 42925476 | + | TSF |
| 2% | chr8 | 42924698; 42924750 | 42924802 | + | ENST00000534420; ENST00000302279; ENST00000533998; ENST00000342116; ENST00000531266; ENST00000525699; ENST00000529687; ENST00000533336 | chr8 | 42925245 | 42925476 | + | TSF |
| 2% | chr15 | 58724232 | 58724319 | + | ENST00000356113; ENST00000414170; ENST00000299022; ENST00000433326 | chr15 | 58748060 | 58748095 | + | TSF |
| 2% | chr8 | 63502273 | 63502353 | + | ENST00000523211; ENST00000328472 | chr8 | 63546747 | 63547118 | + | TSF |
| 2% | chr17 | 62479116 | 62479036 | − | ENST00000539111; ENST00000581355 | chr17 | 62478351 | 62478214 | − | TSF |
| 2% | chr17 | 62479116 | 62479036 | − | ENST00000539111; ENST00000581355 | chr17 | 62478351 | 62478214 | − | TSF |

TABLE 32

Transcript fusion for Cervical Kidney renal papillary cell carcinoma (KIRP) Coordinates of the fusion sequences for which the donor is the TE.

| 1' | 2' | 3' | 4' | 5' | 6' | 7' | 8' | 9' | 10' | 11' |
|---|---|---|---|---|---|---|---|---|---|---|
| 53% | chr9 | 131002678 | 131002811 | + | chr9 | 131004511 | 131004624 | + | ENST00000475805; ENST00000341179; ENST00000372923; ENST00000393594; ENST00000486160 | TAF |
| 53% | chr9 | 131002678 | 131002811 | + | chr | 131004511 | 131004624 | + | ENST00000475805; ENST00000341179; ENST00000372923; ENST00000393594; ENST00000486160 | TAF |
| 40% | chr4 | 69814157 | 69813728 | − | chr4 | 69811168 | 69811024 | − | ENST00000251566; ENST00000503012 | TAF |
| 40% | chr4 | 69814157 | 69813728 | − | chr4 | 69811168 | 69811024 | − | ENST00000251566; ENST00000503012 | TAF |
| 37% | chr5 | 34006954 | 34006922 | − | chr5 | 34006004 | 34005861 | − | ENST00000335606; ENST00000382072; ENST00000382079; ENST00000506639; ENST00000382085; ENST00000502637; ENST00000441713; ENS T00000426255; ENST00000512079; | TAF |

TABLE 32-continued

Transcript fusion for Cervical Kidney renal papillary cell carcinoma (KIRP) Coordinates of the fusion sequences for which the donor is the TE.

| 1' | 2' | 3' | 4' | 5 | 6' | 7' | 8' | 9' | 10' | 11' |
|---|---|---|---|---|---|---|---|---|---|---|
| 37% | chr5 | 34006954 | 34006922 | − | chr5 | 34006004 | 34005861 | − | ENST00000382068 ENST00000335606; ENST00000382072; ENST00000382079; ENST00000506639; ENST00000382085; ENST00000502637; ENST00000441713; ENST00000426255; ENST00000512079; ENST00000382068 | TAF |
| 37% | chr5 | 34006954 | 34006922 | − | chr5 | 34006004 | 34005861 | − | ENST00000335606; ENST00000382072; ENST00000382079; ENST00000506639; ENST00000382085; ENST00000502637; ENST00000441713; ENS T00000426255; ENST00000512079; ENST00000382068 | TAF |
| 37% | chr5 | 34006954 | 34006922 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TAF |
| 37% | chr5 | 34006954 | 34006922 | − | chr5 | 34006004 | 34005861 | − | ENST00000335606; ENST00000382072; ENST00000382079; ENST00000506639; ENST00000382085; ENST00000502637; ENST00000441713; ENS T00000426255; ENST00000512079; ENST00000382068 | TAF |
| 37% | chr5 | 34006954 | 34006922 | − | chr5 | 34006004 | 34005861 | − | ENST00000335606; ENST00000382072; ENST00000382079; ENST00000506639; ENST00000382085; ENST00000502637; ENST00000441713; ENS T00000426255; ENST00000512079; ENST00000382068 | TAF |
| 37% | chr5 | 34006954 | 34006922 | − | chr5 | 34006004 | 34005861 | − | ENST00000335606; ENST00000382072; ENST00000382079; ENST00000506639; ENST00000382085; ENST00000502637; ENST00000441713; ENS T00000426255; ENST00000512079; ENST00000382068 | TAF |
| 37% | chr5 | 34006954 | 34006922 | − | chr5 | 34006004 | 34005861 | − | ENST00000335606; ENST00000382072; ENST00000382079; ENST00000506639; ENST00000382085; ENST00000502637; ENST00000441713; ENS T00000426255; ENST00000512079; ENST00000382068 | TAF |
| 37% | chr5 | 34006954 | 34006922 | − | chr5 | 34006004 | 34005861 | − | ENST00000335606; ENST00000382072; ENST00000382079; ENST00000506639; ENST00000382085; ENST00000502637; ENST00000441713; ENS T00000426255; ENST00000512079; ENST00000382068 | TAF |
| 34% | chr6 | 31154067 | 31153803 | − | chr6 | 31133824 | 31133704 | − | ENST00000259915 | TAF |
| 32% | chr17 | 79214190 | 79214239 | + | chr17 | 79214787 | 79214816; 79214953 | + | ENST00000431388; ENST00000576002 | TAF |
| 32% | chr17 | 79214190 | 79214239 | + | chr17 | 79214787 | 79214816; 79214953 | + | ENST00000431388; ENST00000576002 | TAF |
| 29% | chr1 | 46797740 | 46797497 | − | chr1 | 46764042 | 46763956 | − | ENST00000343304 | TAF |
| 28% | chr7 | 150938296 | 150938250 | − | chr7 | 150937608 | 150937511 | − | ENST00000262188; ENST00000392811; ENST00000356800 | TAF |
| 28% | chr8 | 30395124 | 30395240 | + | chr8 | 30402011 | 30402141; 30402288; 30402073 | + | ENST00000397323; ENST00000339877; ENST00000320203; ENST00000287771; ENST00000517860; ENST00000520161; ENST00000523115; ENS T00000519647; ENST00000520191; ENST00000522694 | TAF |
| 28% | chr8 | 30395124 | 30395240 | + | chr8 | 30402011 | 30402141; 30402288; 30402073 | + | ENST00000397323; ENST00000339877; ENST00000320203; ENST00000287771; ENST00000517860; ENST00000520161; ENST00000523115; ENST00000519647; ENST00000520191; ENST00000522694 | TAF |
| 28% | chr8 | 30395124 | 30395240 | + | chr8 | 30402011 | 30402141; 30402288; 30402073 | + | ENST00000397323; ENST00000339877; ENST00000320203; ENST00000287771; ENST00000517860; ENST00000520161; ENST00000523115; ENS T00000519647; ENST00000520191; ENST00000522694 | TAF |
| 28% | chr8 | 30395124 | 30395240 | + | chr8 | 30402011 | 30402141; 30402288; 30402073 | + | ENST00000397323; ENST00000339877; ENST00000320203; ENST00000287771; ENST00000517860; ENST00000520161; ENST00000523115; ENS T00000519647; ENST00000520191; ENST00000522694 | TAF |
| 28% | chr8 | 30395124 | 30395240 | + | chr8 | 30402011 | 30402141; 30402288; 30402073 | + | ENST00000397323; ENST00000339877; ENST00000320203; ENST00000287771; ENST00000517860; ENST00000520161; ENST00000523115; ENS T00000519647; ENST00000520191; ENST00000522694 | TAF |
| 28% | chr8 | 30395124 | 30395240 | + | chr8 | 30402011 | 30402141; 30402288; 30402073 | + | ENST00000397323; ENST00000339877; ENST00000320203; ENST00000287771; ENST00000517860; ENST00000520161; ENST00000523115; ENS T00000519647; ENST00000520191; ENST00000522694 | TAF |
| 27% | chr10 | 60376682 | 60376727 | + | chr10 | 60380615 | 60380661 | + | ENST00000373886 | TAF |
| 24% | chr17 | 48164136 | 48164357 | + | chr17 | 48165108 | 48165233 | + | ENST00000320031; ENST00000007722 | TAF |
| 24% | chr17 | 48164136 | 48164357 | + | chr17 | 48165108 | 48165233 | + | ENST00000320031; ENST00000007722 | TAF |
| 24% | chr16 | 29915789 | 29915910 | + | chr16 | 29916173 | 29916286 | + | ENST00000563177; ENST00000483405; ENST00000308748; ENST00000414952; ENST00000566693 | TAF |
| 24% | chr16 | 29915789 | 29915910 | + | chr16 | 29916173 | 29916286 | + | ENST00000563177; ENST00000483405; ENST00000308748; ENST00000414952; ENST00000566693 | TAF |
| 23% | chr14 | 102691697 | 102691432 | − | chr14 | 102691131 | 102691116 | − | ENST00000559838 | TAF |
| 22% | chr19 | 55558521 | 55558473 | − | chr19 | 55556677 | 55556442 | − | ENST00000415061; ENST00000396247 | TAF |
| 21% | chr5 | 176950300 | 176950160 | − | chr5 | 176949072 | 176948976 | − | ENST00000514747; ENST00000329540; ENST00000443375; ENST00000524677 | TAF |
| 18% | chr2 | 201253013 | 201253278 | + | chr2 | 201253946 | 201254006 | + | ENST00000409755; ENST00000409151 | TAF |

TABLE 32-continued

Transcript fusion for Cervical Kidney renal papillary cell carcinoma (KIRP) Coordinates of the fusion sequences for which the donor is the TE.

| 1' | 2' | 3' | 4' | 5 | 6' | 7' | 8' | 9' | 10' | 11' |
|---|---|---|---|---|---|---|---|---|---|---|
| 18% | chr8 | 15274514 | 15274814 | + | chr8 | 15480589 | 15480758 | + | ENST00000382020; ENST00000515859; ENST00000506802; ENST00000510836; ENST00000509380; ENST00000503731; ENST00000511783 | TAF |
| 18% | chr8 | 15274514 | 15274814 | + | chr8 | 15480589 | 15480758 | + | ENST00000382020; ENST00000515859; ENST00000506802; ENST00000510836; ENST00000509380; ENST00000503731; ENST00000511783 | TAF |
| 18% | chr8 | 15274514 | 15274814 | + | chr8 | 15480589 | 15480758 | + | ENST00000382020; ENST00000515859; ENST00000506802; ENST00000510836; ENST00000509380; ENST00000503731; ENST00000511783 | TAF |
| 18% | chr8 | 15274514 | 15274814 | + | chr8 | 15480589 | 15480758 | + | ENST00000382020; ENST00000515859; ENST00000506802; ENST00000510836; ENST00000509380; ENST00000503731; ENST00000511783 | TAF |
| 18% | chr8 | 15274514 | 15274814 | + | chr8 | 15480589 | 15480758 | + | ENST00000382020; ENST00000515859; ENST00000506802; ENST00000510836; ENST00000509380; ENST00000503731; ENST00000511783 | TAF |
| 17% | chr10 | 90305421 | 90305214 | − | chr10 | 90122482 | 90122309 | − | ENST00000371947; ENST00000437752; ENST00000331772 | TAF |
| 17% | chr10 | 90305421 | 90305214 | − | chr10 | 90122482 | 90122309 | − | ENST00000371947; ENST00000437752; ENST00000331772 | TAF |
| 16% | chr8 | 30356797 | 30356857 | + | chr8 | 30361803 | 30361953 | + | ENST00000538486; ENST00000397323; ENST00000339877; ENST00000320203; ENST00000287771; ENST00000517860; ENST00000519359; ENST00000522694 | TSF |
| 16% | chr8 | 30356797 | 30356857 | + | chr8 | 30361803 | 30361953 | + | ENST00000538486; ENST00000397323; ENST00000339877; ENST00000320203; ENST00000287771; ENST00000517860; ENST00000519359; ENST00000522694 | TSF |
| 16% | chr8 | 30356797 | 30356857 | + | chr8 | 30361803 | 30361953 | + | ENST00000538486; ENST00000397323; ENST00000339877; ENST00000320203; ENST00000287771; ENST00000517860; ENST00000519359; ENST00000522694 | TSF |
| 16% | chr8 | 30356797 | 30356857 | + | chr8 | 30361803 | 30361953 | + | ENST00000538486; ENST00000397323; ENST00000339877; ENST00000320203; ENST00000287771; ENST00000517860; ENST00000519359; ENST00000522694 | TSF |
| 16% | chr8 | 30356797 | 30356857 | + | chr8 | 30361803 | 30361953 | + | ENST00000538486; ENST00000397323; ENST00000339877; ENST00000320203; ENST00000287771; ENST00000517860; ENST00000519359; ENST00000522694 | TSF |
| 16% | chr8 | 30356797 | 30356857 | + | chr8 | 30361803 | 30361953 | + | ENST00000538486; ENST00000397323; ENST00000339877; ENST00000320203; ENST00000287771; ENST00000517860; ENST00000519359; ENST00000522694 | TSF |
| 15% | chr10 | 100147690 | 100147622 | − | chr10 | 100147064 | 100146958 | − | ENST00000370575 | TAF |
| 15% | chr6 | 111995513 | 111995484 | − | chr6 | 111983150 | 111982942 | − | ENST00000368682; ENST00000354650; ENST00000229471; ENST00000368667; ENST00000368678; ENST00000538466; ENST00000229470; ENST00000356013 | TSF |
| 14% | chr5 | 176950016 | 176949956 | − | chr5 | 176949072 | 176948976 | − | ENST00000514747; ENST00000329540; ENST00000443375; ENST00000524677 | TAF |
| 14% | chr4 | 5788948 | 5789351 | + | chr4 | 5795335 | 5795444 | + | ENST00000264956; ENST00000382674 | TAF |
| 14% | chr10 | 90305421 | 90305146 | − | chr10 | 90122482 | 90122309 | − | ENST00000371947; ENST00000437752; ENST00000331772 | TAF |
| 14% | chr10 | 90305421 | 90305146 | − | chr10 | 90122482 | 90122309 | − | ENST00000371947; ENST00000437752; ENST00000331772 | TAF |
| 14% | chr7 | 74158449 | 74158566 | + | chr7 | 74159097 | 74159280 | + | ENST00000324896; ENST00000346152; ENST00000353920; ENST00000416070 | TAF |
| 14% | chr1 | 206288369 | 206288105 | − | chr1 | 206243250 | 206243150 | − | ENST00000331555 | TSF |
| 13% | chr19 | 55559415 | 55559414 | − | chr19 | 55558856 | 55558755 | − | ENST00000415061; ENST00000396247 | TAF |
| 12% | chr10 | 120902016 | 120901765 | − | chr10 | 120900831 | 120900754 | − | ENST00000355697; ENST00000330036 | TAF |
| 12% | chr20 | 33850895 | 33851310 | + | chr20 | 33851594 | 33851755 | + | ENST00000246186 | TAF |
| 12% | chrX | 129264697 | 129264593 | − | chrX | 129264141 | 129263945 | − | ENST00000440263; ENST00000460436; ENST00000346424; ENST00000319908; ENST00000287295 | TAF |
| 12% | chr19 | 1114930 | 1114676 | − | chr19 | 1114421 | 1114230 | − | ENST00000361757; ENST00000587024; ENST00000438103 | TSF |
| 12% | chr16 | 20463435 | 20463788 | + | chr16 | 20476839 | 20476978; 20477049; 20477015 | + | ENST00000576361; ENST00000424070; ENST00000573854; ENST00000219054; ENST00000575690; ENST00000574692; ENST00000571894; ENST00000396104 | TSF |
| 12% | chr16 | 20463435 | 20463788 | + | chr16 | 20476839 | 20476978; 20477049; 20477015 | + | ENST00000576361; ENST00000424070; ENST00000573854; ENST00000219054; ENST00000575690; ENST00000574692; ENST00000571894; ENST00000396104 | TSF |
| 12% | chr16 | 20463435 | 20463788 | + | chr16 | 20476839 | 20476978; 20477049; 20477015 | + | ENST00000576361; ENST00000424070; ENST00000573854; ENST00000219054; ENST00000575690; ENST00000574692; ENST00000571894; ENST00000396104 | TSF |
| 12% | chr16 | 20463435 | 20463788 | + | chr16 | 20476839 | 20476978; 20477049; 20477015 | + | ENST00000576361; ENST00000424070; ENST00000573854; ENST00000219054; ENST00000575690; ENST00000574692; ENST00000571894; ENST00000396104 | TSF |
| 11% | chrX | 2178048 | 2177670 | − | chrX | 2161271 | 2161064; 2161103 | − | ENST00000334651; ENST00000412516 | TAF |
| 11% | chrX | 2178048 | 2177670 | − | chrX | 2161271 | 2161064; 2161103 | − | ENST00000334651; ENST00000412516 | TAF |
| 11% | chr17 | 62480131 | 62480081 | − | chr17 | 62479116 | 62479036 | − | ENST00000539111; ENST00000581355 | TAF |
| 11% | chr17 | 62480131 | 62480081 | − | chr17 | 62479116 | 62479036 | − | ENST00000539111; ENST00000581355 | TAF |
| 11% | chr16 | 20474655 | 20474981 | + | chr16 | 20476839 | 20476978; 20477049; | + | ENST00000576361; ENST00000424070; ENST00000573854; ENST00000219054; ENST00000575690; ENST00000574692; | TAF |

TABLE 32-continued

Transcript fusion for Cervical Kidney renal papillary cell carcinoma (KIRP) Coordinates of the fusion sequences for which the donor is the TE.

| 1' | 2' | 3' | 4' | 5 | 6' | 7' | 8' | 9' | 10' | 11' |
|---|---|---|---|---|---|---|---|---|---|---|
| 11% | chr16 | 20474655 | 20474981 | + | chr16 | 20476839 | 20477015 20476978; 20477049; 20477015 | + | ENST00000571894; ENS T00000396104 ENST00000576361; ENST00000424070; ENST00000573854; ENST00000219054; ENST00000575690; ENST00000574692; | TAF |
| 11% | chr16 | 20474655 | 20474981 | + | chr16 | 20476839 | 20477015 20476978; 20477049; 20477015 | + | ENST00000571894; ENS T00000396104 ENST00000576361; ENST00000424070; ENST00000573854; ENST00000219054; ENST00000575690; ENST00000574692; | TAF |
| 11% | chr16 | 20474655 | 20474981 | + | chr16 | 20476839 | 20477015 20476978; 20477049; 20477015 | + | ENST00000571894; ENS T00000396104 ENST00000576361; ENST00000424070; ENST00000573854; ENST00000219054; ENST00000575690; ENST00000574692; | TAF |
| 11% | chr16 | 89649823 | 89649851 | + | chr16 | 89650105 | 89650179 | + | ENST00000268720; ENST00000319518 | TSF |
| 9% | chr6 | 125440425 | 125440534 | + | chr6 | 125541224 | 125541339 | + | ENST00000304877; ENST00000534000; ENST00000368402; ENST00000368388; ENST00000527711; ENST00000528193 | TSF |
| 9% | chr6 | 125440425 | 125440534 | + | chr6 | 125541224 | 125541339 | + | ENST00000304877; ENST00000534000; ENST00000368402; ENST00000368388; ENST00000527711; ENST00000528193 | TSF |
| 9% | chr6 | 125440425 | 125440534 | + | chr6 | 125541224 | 125541339 | + | ENST00000304877; ENST00000534000; ENST00000368402; ENST00000368388; ENST00000527711; ENST00000528193 | TSF |
| 9% | chr6 | 125440425 | 125440534 | + | chr6 | 125541224 | 125541339 | + | ENST00000304877; ENST00000534000; ENST00000368402; ENST00000368388; ENST00000527711; ENST00000528193 | TSF |
| 9% | chr6 | 125440425 | 125440534 | + | chr6 | 125541224 | 125541339 | + | ENST00000304877; ENST00000534000; ENST00000368402; ENST00000368388; ENST00000527711; ENST00000528193 | TSF |
| 9% | chr6 | 125440425 | 125440534 | + | chr6 | 125541224 | 125541339 | + | ENST00000304877; ENST00000534000; ENST00000368402; ENST00000368388; ENST00000527711; ENST00000528193 | TSF |
| 8% | chr3 | 159455523 | 159455690 | + | chr3 | 159482232 | 159482251; 159482927; 159482401; 159482495; 159482300; 159482888 | + | ENST00000471575; ENST00000476809; ENST00000485419; ENST00000483486; ENST000000481715; ENST00000488898; ENST00000337808; ENST00000412423 | TSF |
| 8% | chr3 | 159455523 | 159455690 | + | chr3 | 159482232 | 159482251; 159482927; 159482401; 159482495; 159482300; 159482888 | + | ENST00000471575; ENST00000476809; ENST00000485419; ENST00000483486; ENST00000481715; ENST00000488898; ENST00000337808; ENST00000412423 | TSF |
| 8% | chr3 | 159455523 | 159455690 | + | chr3 | 159482232 | 159482251; 159482927; 159482401; 159482495; 159482300; 159482888 | + | ENST00000471575; ENST00000476809; ENST00000485419; ENST00000483486; ENST00000481715; ENST00000488898; ENST00000337808; ENST00000412423 | TSF |
| 8% | chr3 | 159455523 | 159455690 | + | chr3 | 159482232 | 159482251; 159482927; 159482401; 159482495; 159482300; 159482888 | + | ENST00000471575; ENST00000476809; ENST00000485419; ENST00000483486; ENST00000481715; ENST00000488898; ENST00000337808; ENST00000412423 | TSF |
| 8% | chr3 | 159455523 | 159455690 | + | chr3 | 159482232 | 159482251; 159482927; 159482401; 159482495; 159482300; 159482888 | + | ENST00000471575; ENST00000476809; ENST00000485419; ENST00000483486; ENST00000481715; ENST00000488898; ENST00000337808; ENST00000412423 | TSF |
| 8% | chr3 | 159455523 | 159455690 | + | chr3 | 159482232 | 159482251; 159482927; 159482401; 159482495; 159482300; 159482888 | + | ENST00000471575; ENST00000476809; ENST00000485419; ENST00000483486; ENST00000481715; ENST00000488898; ENST00000337808; ENST00000412423 | TSF |
| 7% | chr4 | 22601350 | 22601612 | + | chr4 | 22737604 | 22737831 | + | ENST00000508166; ENST00000503442 | TSF |
| 7% | chr4 | 22601350 | 22601612 | + | chr4 | 22737604 | 22737831 | + | ENST00000508166; ENST00000503442 | TSF |
| 6% | chr7 | 100850556 | 100850506 | − | chr7 | 100850185 | 100850060 | − | ENST00000454310; ENST00000223127 | TSF |
| 5% | chr8 | 24354477 | 24354747 | + | chr8 | 24356749 | 24356829 | + | ENST00000175238; ENST00000380789; ENST00000520720 | TSF |
| 5% | chr8 | 24354477 | 24354747 | + | chr8 | 24356749 | 24356829 | + | ENST00000175238; ENST00000380789; ENST00000520720 | TSF |
| 5% | chr8 | 24354477 | 24354747 | + | chr8 | 24356749 | 24356829 | + | ENST00000175238; ENST00000380789; ENST00000520720 | TSF |
| 5% | chr1 | 236326774 | 236327054 | + | chr1 | 236332006 | 236332055 | + | ENST00000366592; ENST00000454895 | TSF |
| 5% | chr1 | 236326774 | 236327054 | + | chr1 | 236332006 | 236332055 | + | ENST00000366592; ENST00000454895 | TSF |
| 5% | chr22 | 23978396 | 23978123 | − | chr22 | 23974160 | 23974003 | − | ENST00000317749 | TSF |
| 5% | chr6 | 51817315 | 51817226 | − | chr6 | 51799120 | 51798908 | − | ENST00000371117; ENST00000340994 | TSF |
| 5% | chr6 | 51817315 | 51817226 | − | chr6 | 51799120 | 51798908 | − | ENST00000371117; ENST00000340994 | TSF |
| 5% | chr5 | 31298457 | 31298554 | + | chr5 | 31299571 | 31299738 | + | ENST00000514738; ENST00000265071 | TSF |
| 5% | chr5 | 31298457 | 31298554 | + | chr5 | 31299571 | 31299738 | + | ENST00000514738; ENST00000265071 | TSF |
| 5% | chr4 | 69919044 | 69920610 | + | chr4 | 69964258 | 69964406 | + | ENST00000305231; ENST00000508661 | TSF |
| 5% | chr4 | 69919044 | 69920610 | + | chr4 | 69964258 | 69964406 | + | ENST00000305231; ENST00000508661 | TSF |
| 4% | chr1 | 25125118 | 25125844 | + | chr1 | 25140585 | 25140710 | + | ENST00000374379; ENST00000488683 | TSF |
| 4% | chr3 | 1442010 | 1442077 | + | chr3 | 1443117 | 1443229 | + | ENST00000446702; ENST00000539053; ENST00000350110 | TSF |

TABLE 32-continued

Transcript fusion for Cervical Kidney renal papillary cell carcinoma (KIRP) Coordinates of the fusion sequences for which the donor is the TE.

| 1' | 2' | 3' | 4' | 5 | 6' | 7' | 8' | 9' | 10' | 11' |
|---|---|---|---|---|---|---|---|---|---|---|
| 4% | chr20 | 48328930 | 48328898 | − | chr20 | 48273239 | 48273105 | − | ENST00000371711 | TSF |
| 4% | chr10 | 3133726 | 3133857 | + | chr10 | 3141467 | 3141544 | + | ENST00000607886; ENST00000381125; ENST00000381075; ENST00000407806 | TSF |
| 4% | chr10 | 3133726 | 3133857 | + | chr10 | 3141467 | 3141544 | + | ENST00000607886; ENST00000381125; ENST00000381075; ENST00000407806 | TSF |
| 4% | chr10 | 3133726 | 3133857 | + | chr10 | 3141467 | 3141544 | + | ENST00000607886; ENST00000381125; ENST00000381075; ENST00000407806 | TSF |
| 4% | chr10 | 3133726 | 3133857 | + | chr10 | 3141467 | 3141544 | + | ENST00000607886; ENST00000381125; ENST00000381075; ENST00000407806 | TSF |
| 4% | chr7 | 107598095 | 107598030 | − | chr7 | 107596075 | 107595912 | − | ENST00000393561; ENST00000222399 | TSF |
| 4% | chr2 | 43963431 | 43963670 | + | chr2 | 43965480 | 43965659 | + | ENST00000282406 | TSF |
| 4% | chr1 | 48256717 | 48256707 | − | chr1 | 48244216 | 48244126 | − | ENST00000606738 | TSF |
| 4% | chr3 | 182757105 | 182757101 | − | chr3 | 182756923 | 182756814 | − | ENST00000265594; ENST00000492597; ENST00000497959; ENST00000539926; ENST00000476176 | TSF |
| 4% | chr3 | 182757105 | 182757101 | − | chr3 | 182756923 | 182756814 | − | ENST00000265594; ENST00000492597; ENST00000497959; ENST00000539926; ENST00000476176 | TSF |
| 4% | chr3 | 182757105 | 182757101 | − | chr3 | 182756923 | 182756814 | − | ENST00000265594; ENST00000492597; ENST00000497959; ENST00000539926; ENST00000476176 | TSF |
| 4% | chr3 | 182757105 | 182757101 | − | chr3 | 182756923 | 182756814 | − | ENST00000265594; ENST00000492597; ENST00000497959; ENST00000539926; ENST00000476176 | TSF |
| 3% | chr16 | 20474655 | 20474796 | + | chr16 | 20476839 | 20476978; 20477049; 20477015 | + | ENST00000576361; ENST00000424070; ENST00000573854; ENST00000219054; ENST0000057590; ENST00000574692; ENST00000571894; ENST00000396104 | TSF |
| 3% | chr16 | 20474655 | 20474796 | + | chr16 | 20476839 | 20476978; 20477049; 20477015 | + | ENST00000576361; ENST00000424070; ENST00000573854; ENST00000219054; ENST0000057590; ENST00000574692; ENST00000571894; ENST00000396104 | TSF |
| 3% | chr16 | 20474655 | 20474796 | + | chr16 | 20476839 | 20476978; 20477049; 20477015 | + | ENST00000576361; ENST00000424070; ENST00000573854; ENST00000219054; ENST0000057590; ENST00000574692; ENST00000571894; ENST00000396104 | TSF |
| 3% | chr16 | 20474655 | 20474796 | + | chr16 | 20476839 | 20476978; 20477049; 20477015 | + | ENST00000576361; ENST00000424070; ENST00000573854; ENST00000219054; ENST0000057590; ENST00000574692; ENST00000571894; ENST00000396104 | TSF |
| 3% | chr5 | 34006954 | 34006915 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TSF |
| 3% | chr5 | 34006954 | 34006915 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TSF |
| 3% | chr5 | 34006954 | 34006915 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TSF |
| 3% | chr5 | 34006954 | 34006915 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TSF |
| 3% | chr5 | 34006954 | 34006915 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TSF |
| 3% | chr5 | 34006954 | 34006915 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TSF |
| 3% | chr5 | 34006954 | 34006915 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TSF |
| 3% | chr5 | 34006954 | 34006915 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TSF |
| 3% | chr22 | 25020098 | 25020113 | + | chr22 | 25023399 | 25023586; 25023457 | + | ENST00000248923; ENST00000412658; ENST00000400382; ENST00000400383; ENST0000040080; ENST00000406383; ENST0000425895 | TSF |
| 3% | chr22 | 25020098 | 25020113 | + | chr22 | 25023399 | 25023586; 25023457 | + | ENST00000248923; ENST00000412658; ENST00000400382; ENST00000400383; ENST0000040080; ENST00000406383; ENST0000425895 | TSF |
| 3% | chr22 | 25020098 | 25020113 | + | chr22 | 25023399 | 25023586; 25023457 | + | ENST00000248923; ENST00000412658; ENST00000400382; ENST00000400383; ENST0000040080; ENST00000406383; | TSF |

TABLE 32-continued

Transcript fusion for Cervical Kidney renal papillary cell carcinoma (KIRP) Coordinates of the fusion sequences for which the donor is the TE.

| 1' | 2' | 3' | 4' | 5 | 6' | 7' | 8' | 9' | 10' | 11' |
|---|---|---|---|---|---|---|---|---|---|---|
| | | | | | | | | | ENST00000425895 | |
| 3% | chr16 | 20587097 | 20586744 | − | chr16 | 20570769 | 20570559; 20570593; 20570630 | − | ENST00000329697; ENST00000565232; ENST00000567001; ENST00000569327; ENST00000414188; ENST00000566384; ENST00000569344 | TSF |
| 3% | chr16 | 20587097 | 20586744 | − | chr16 | 20570769 | 20570559; 20570593; 20570630 | − | ENST00000329697; ENST00000565232; ENST00000567001; ENST00000569327; ENST00000414188; ENST00000566384; ENST00000569344 | TSF |
| 3% | chr16 | 20587097 | 20586744 | − | chr16 | 20570769 | 20570559; 20570593; 20570630 | − | ENST00000329697; ENST00000565232; ENST00000567001; ENST00000569327; ENST00000414188; ENST00000566384; ENST00000569344 | TSF |
| 3% | chr16 | 20587097 | 20586744 | − | chr16 | 20570769 | 20570559; 20570593; 20570630 | − | ENST00000329697; ENST00000565232; ENST00000567001; ENST00000569327; ENST00000414188; ENST00000566384; ENST00000569344 | TSF |
| 3% | chr7 | 23290404 | 23290481 | + | chr7 | 23292926 | 23293078 | + | ENST00000258733; ENST00000381990; ENST00000409458; ENST00000453162 | TSF |
| 3% | chr7 | 23290404 | 23290481 | + | chr7 | 23292926 | 23293078 | + | ENST00000258733; ENST00000381990; ENST00000409458; ENST00000453162 | TSF |
| 3% | chr7 | 23290404 | 23290481 | + | chr7 | 23292926 | 23293078 | + | ENST00000258733; ENST00000381990; ENST00000409458; ENST00000453162 | TSF |
| 3% | chr7 | 23290404 | 23290481 | + | chr7 | 23292926 | 23293078 | + | ENST00000258733; ENST00000381990; ENST00000409458; ENST00000453162 | TSF |
| 3% | chr19 | 50174724 | 50174836 | + | chr19 | 50176955 | 50177005; 50177034 | + | ENST00000441864; ENST00000246785; ENST00000600947; ENST00000598306 | TSF |
| 3% | chr19 | 50174724 | 50174836 | + | chr19 | 50176955 | 50177005; 50177034 | + | ENST00000441864; ENST00000246785; ENST00000600947; ENST00000598306 | TSF |
| 3% | chr20 | 45138455 | 45138244 | − | chr20 | 45133379 | 45133253 | − | ENST00000593880; ENST00000347606 | TSF |
| 3% | chr20 | 45138455 | 45138244 | − | chr20 | 45133379 | 45133253 | − | ENST00000593880; ENST00000347606 | TSF |
| 3% | chr4 | 52913536 | 52913266 | − | chr4 | 52899806 | 52899597 | − | ENST00000381431; ENST00000506357; ENST00000514133 | TSF |
| 3% | chr4 | 52913536 | 52913266 | − | chr4 | 52899806 | 52899597 | − | ENST00000381431; ENST00000506357; ENST00000514133 | TSF |
| 3% | chr6 | 80022917 | 80022085 | − | chr6 | 79924739 | 79924689 | − | ENST00000275036; ENST00000344726 | TSF |
| 3% | chr6 | 80022917 | 80022085 | − | chr6 | 79924739 | 79924689 | − | ENST00000275036; ENST00000344726 | TSF |
| 3% | chr3 | 98586295 | 98586135 | − | chr3 | 98568442 | 98568305; 98568232 | − | ENST00000326840; ENST00000326857; ENST00000449482 | TSF |
| 3% | chr3 | 98586295 | 98586135 | − | chr3 | 98568442 | 98568305; 98568232 | − | ENST00000326840; ENST00000326857; ENST00000449482 | TSF |
| 3% | chr3 | 98586295 | 98586135 | − | chr3 | 98568442 | 98568305; 98568232 | − | ENST00000326840; ENST00000326857; ENST00000449482 | TSF |
| 2% | chr16 | 4708255 | 4708353 | + | chr16 | 4714710 | 4714776 | + | ENST00000262370; ENST00000415496; ENST00000536343; ENST00000587747; ENST00000399577; ENST00000588994; ENST00000586183; ENST00000590790 | TSF |
| 2% | chr16 | 4708255 | 4708353 | + | chr16 | 4714710 | 4714776 | + | ENST00000262370; ENST00000415496; ENST00000536343; ENST00000587747; ENST00000399577; ENST00000588994; ENST00000586183; ENST00000590790 | TSF |
| 2% | chr16 | 4708255 | 4708353 | + | chr16 | 4714710 | 4714776 | + | ENST00000262370; ENST00000415496; ENST00000536343; ENST00000587747; ENST00000399577; ENST00000588994; ENST00000586183; ENST00000590790 | TSF |
| 2% | chr16 | 4708255 | 4708353 | + | chr16 | 4714710 | 4714776 | + | ENST00000262370; ENST00000415496; ENST00000536343; ENST00000587747; ENST00000399577; ENST00000588994; ENST00000586183; ENST00000590790 | TSF |
| 2% | chr16 | 4708255 | 4708353 | + | chr16 | 4714710 | 4714776 | + | ENST00000262370; ENST00000415496; ENST00000536343; ENST00000587747; ENST00000399577; ENST00000588994; ENST00000586183; ENST00000590790 | TSF |
| 2% | chr16 | 4708255 | 4708353 | + | chr16 | 4714710 | 4714776 | + | ENST00000262370; ENST00000415496; ENST00000536343; ENST00000587747; ENST00000399577; ENST00000588994; ENST00000586183; ENST00000590790 | TSF |
| 2% | chr16 | 4708255 | 4708353 | + | chr16 | 4714710 | 4714776 | + | ENST00000262370; ENST00000415496; ENST00000536343; ENST00000587747; ENST00000399577; ENST00000588994; ENST00000586183; ENST00000590790 | TSF |
| 2% | chr16 | 4708255 | 4708353 | + | chr16 | 4714710 | 4714776 | + | ENST00000262370; ENST00000415496; ENST00000536343; ENST00000587747; ENST00000399577; ENST00000588994; ENST00000586183; ENST00000590790 | TSF |
| 2% | chr1 | 48271615 | 48271527 | − | chr1 | 48267291 | 48267145 | − | ENST00000606738 | TSF |
| 2% | chr5 | 156483240 | 156483190 | − | chr5 | 156482544 | 156482212 | − | ENST00000522693; ENST00000523175; ENST00000339252; ENST00000425854; ENST00000544197; ENST00000518745 | TSF |
| 2% | chr5 | 156483240 | 156483190 | − | chr5 | 156482544 | 156482212 | − | ENST00000522693; ENST00000523175; ENST00000339252; ENST00000425854; ENST00000544197; ENST00000518745 | TSF |
| 2% | chr5 | 156483240 | 156483190 | − | chr5 | 156482544 | 156482212 | − | ENST00000522693; ENST00000523175; ENST00000339252; ENST00000425854; ENST00000544197; ENST00000518745 | TSF |
| 2% | chr4 | 187060473 | 187060762 | + | chr4 | 187070327 | 187070437 | + | ENST00000356371 | TSF |
| 2% | chr12 | 112169907 | 112169999 | + | chr12 | 112171727 | 112171872; 112171851 | + | ENST00000392636; ENST00000549590; ENST00000455480; ENST00000313698; ENST00000552706 | TSF |
| 2% | chr12 | 112169907 | 112169999 | + | chr12 | 112171727 | 112171872; 112171851 | + | ENST00000392636; ENST00000549590; ENST00000455480; ENST00000313698; ENST00000552706 | TSF |
| 2% | chr12 | 112169907 | 112169999 | + | chr12 | 112171727 | 112171872; 112171851 | + | ENST00000392636; ENST00000549590; ENST00000455480; ENST00000313698; ENST00000552706 | TSF |
| 2% | chr12 | 112169907 | 112169999 | + | chr12 | 112171727 | 112171872; | + | ENST00000392636; ENST00000549590; ENST00000455480; | TSF |

TABLE 32-continued

Transcript fusion for Cervical Kidney renal papillary cell carcinoma (KIRP) Coordinates of the fusion sequences for which the donor is the TE.

| 1' | 2' | 3' | 4' | 5 | 6' | 7' | 8' | 9' | 10' | 11' |
|---|---|---|---|---|---|---|---|---|---|---|
|  |  |  |  |  |  |  | 112171851 | | ENST00000313698; ENST00000552706 | |
| 2% | chr20 | 34710617 | 34710669 | + | chr20 | 34761806 | 34761876 | + | ENST00000406771; ENST00000452261; ENST00000447825; ENST00000427533; ENST00000338074; ENST00000373941 | TSF |
| 2% | chr20 | 34710617 | 34710669 | + | chr20 | 34761806 | 34761876 | + | ENST00000406771; ENST00000452261; ENST00000447825; ENST00000427533; ENST00000338074; ENST00000373941 | TSF |
| 2% | chr20 | 34710617 | 34710669 | + | chr20 | 34761806 | 34761876 | + | ENST00000406771; ENST00000452261; ENST00000447825; ENST00000427533; ENST00000338074; ENST00000373941 | TSF |
| 2% | chr20 | 34710617 | 34710669 | + | chr20 | 34761806 | 34761876 | + | ENST00000406771; ENST00000452261; ENST00000447825; ENST00000427533; ENST00000338074; ENST00000373941 | TSF |
| 2% | chr20 | 34710617 | 34710669 | + | chr20 | 34761806 | 34761876 | + | ENST00000406771; ENST00000452261; ENST00000447825; ENST00000427533; ENST00000338074; ENST00000373941 | TSF |
| 2% | chr20 | 34710617 | 34710669 | + | chr20 | 34761806 | 34761876 | + | ENST00000406771; ENST00000452261; ENST00000447825; ENST00000427533; ENST00000338074; ENST00000373941 | TSF |
| 2% | chr7 | 107568061 | 107568012 | − | chr7 | 107566804 | 107566628 | − | ENST00000393561; ENST00000222399 | TSF |
| 2% | chr2 | 210938033 | 210937924 | − | chr2 | 210908828 | 210908663; 210908637 | − | ENST00000281772; ENST00000418791; ENST00000457374; ENST00000452086; ENST00000428655 | TSF |
| 2% | chr2 | 210938033 | 210937924 | − | chr2 | 210908828 | 210908663; 210908637 | − | ENST00000281772; ENST00000418791; ENST00000457374; ENST00000452086; ENST00000428655 | TSF |
| 2% | chr2 | 210938033 | 210937924 | − | chr2 | 210908828 | 210908663; 210908637 | − | ENST00000281772; ENST00000418791; ENST00000457374; ENST00000452086; ENST00000428655 | TSF |
| 2% | chr2 | 210938033 | 210937924 | − | chr2 | 210908828 | 210908663; 210908637 | − | ENST00000281772; ENST00000418791; ENST00000457374; ENST00000452086; ENST00000428655 | TSF |

TABLE 33

Transcript fusion for Low Grade Glioma (LGG) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 98% | chr17 | 40812657 | 40812725 | + | ENST00000251412 | chr17 | 40813219 | 40813265 | + | TAF |
| 92% | chr11 | 73589824 | 73589864 | + | ENST00000310571 | chr11 | 73598085 | 73598225 | + | TAF |
| 90% | chrX | 64743587; 64743497 | 64743440 | − | ENST00000374807; ENST00000374811; ENST00000374804; ENST00000469091 | chrX | 64742373 | 64741630 | − | TAF |
| 90% | chrX | 64743587; 64743497 | 64743440 | − | ENST00000374807; ENST00000374811; ENST00000374804; ENST00000469091 | chrX | 64742373 | 64741630 | − | TAF |
| 90% | chrX | 64743587; 64743497 | 64743440 | − | ENST00000374807; ENST00000374811; ENST00000374804; ENST00000469091 | chrX | 64742373 | 64741630 | − | TAF |
| 90% | chrX | 64743587; 64743497 | 64743440 | − | ENST00000374807; ENST00000374811; ENST00000374804; ENST00000469091 | chrX | 64742373 | 64741630 | − | TAF |
| 81% | chr5 | 146460699; 146460671 | 146460622 | − | ENST00000504198; ENST00000394409 | chr5 | 146414803 | 146414648 |  | TAF |
| 81% | chr5 | 146460699; 146460671 | 146460622 | − | ENST00000504198; ENST00000394409 | chr5 | 146414803 | 146414648 |  | TAF |
| 80% | chr6 | 36762426 | 36762367 | − | ENST00000244751 | chr6 | 36760223 | 36760189 | − | TAF |
| 77% | chr19 | 39390161 | 39390146 | − | ENST00000249396; ENST00000358931; ENST00000443898 | chr19 | 39389554 | 39389434 | − | TAF |
| 51% | chr17 | 63173850 | 63173921 | + | ENST00000584234; ENST00000262406 | chr17 | 63176114 | 63176128 | + | TAF |
| 40% | chr11 | 73589824 | 73589864 | + | ENST00000310571 | chr11 | 73598076 | 73598225 | + | TAF |
| 39% | chr5 | 146435301; 146435306 | 146435228 | − | ENST00000394414; ENST00000336640; ENST00000522831; ENST00000515880; ENST00000512011 | chr5 | 146414803 | 146414648 | − | TAF |
| 39% | chr5 | 146435301; 146435306 | 146435228 | − | ENST00000394414; ENST00000336640; ENST00000522831; ENST00000515880; ENST00000512011 | chr5 | 146414803 | 146414648 | − | TAF |
| 38% | chr7 | 99821698 | 99821505 | − | ENST00000436886 | chr7 | 99810756 | 99810604 | − | TAF |
| 35% | chr1 | 1237426 | 1237368 | − | ENST00000354700; ENST00000353662 | chr1 | 1236310 | 1236145 | − | TAF |
| 35% | chr1 | 1237426 | 1237368 | − | ENST00000354700; ENST00000353662 | chr1 | 1236310 | 1236145 | − | TAF |
| 29% | chr14 | 77606081 | 77605556 | − | ENST00000319374 | chr14 | 77602889 | 77602820 | − | TAF |
| 28% | chr3 | 33636460 | 33636443 | − | ENST00000468888; ENST00000399362; ENST00000307312; ENST00000359576; ENST00000480013; ENST00000461133 | chr3 | 33635629 | 33635332 | − | TAF |
| 28% | chr3 | 33636460 | 33636443 | − | ENST00000468888; ENST00000399362; ENST00000307312; ENST00000359576; ENST00000480013; ENST00000461133 | chr3 | 33635629 | 33635332 | − | TAF |
| 28% | chr3 | 33636460 | 33636443 | − | ENST00000468888; ENST00000399362; ENST00000307312; ENST00000359576; ENST00000480013; ENST00000461133 | chr3 | 33635629 | 33635332 | − | TAF |
| 28% | chr3 | 33636460 | 33636443 | − | ENST00000468888; ENST00000399362; ENST00000307312; ENST00000359576; ENST00000480013; ENST00000461133 | chr3 | 33635629 | 33635332 | − | TAF |
| 28% | chr6 | 36762426 | 36762367 | − | ENST00000244751 | chr6 | 36760220 | 36760189 | − | TAF |
| 25% | chr11 | 61197619 | 61197654 | + | ENST00000542794; ENST00000541135; ENST00000301761; ENST00000542074; | chr11 | 61240217 | 61240660 | + | TAF |

TABLE 33-continued

Transcript fusion for Low Grade Glioma (LGG) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
|  |  |  |  |  | ENST00000534878; ENST00000359614; ENST00000537782; ENST00000538594; ENST00000544801; ENST00000536250; ENST00000543265 |  |  |  |  |  |
| 25% | chr19 | 1235564 | 1235500 | − | ENST00000590083; ENST00000382477; ENST00000215376; ENST00000589260 | chr19 | 1235389 | 1235290 | − | TAF |
| 25% | chr19 | 1235564 | 1235500 | − | ENST00000590083; ENST00000382477; ENST00000215376; ENST00000589260 | chr19 | 1235389 | 1235290 | − | TAF |
| 25% | chr3 | 125271523 | 125271025 | − | ENST00000296220 | chr3 | 125268456 | 125268341 | − | TAF |
| 22% | chr18 | 72250797 | 72250944 | + | ENST00000358821; ENST00000582365 | chr18 | 72256555 | 72256578 | + | TAF |
| 22% | chr18 | 72250797 | 72250944 | + | ENST00000358821; ENST00000582365 | chr18 | 72256555 | 72256578 | + | TAF |
| 18% | chr4 | 134084132 | 134084437 | + | ENST00000264360 | chr4 | 134129231 | 134129518 | + | TAF |
| 17% | chr9 | 131002264 | 131002275 | + | ENST00000475805; ENST00000341179; ENST00000372923; ENST00000393594; ENST00000486160 | chr9 | 131002706 | 131002973 | + | TAF |
| 17% | chr9 | 131002264 | 131002275 | + | ENST00000475805; ENST00000341179; ENST00000372923; ENST00000393594; ENST00000486160 | chr9 | 131002706 | 131002973 | + | TAF |
| 17% | chr3 | 9476508; 9476512 | 9476566 | + | ENST00000450326; ENST00000402198; ENST00000402466; ENST00000406341; ENST00000407969; ENST00000442373; ENST00000302463 | chr3 | 9476688 | 9476952 | + | TAF |
| 17% | chr3 | 9476508; 9476512 | 9476566 | + | ENST00000450326; ENST00000402198; ENST00000402466; ENST00000406341; ENST00000407969; ENST00000442373; ENST00000302463 | chr3 | 9476688 | 9476952 | + | TAF |
| 17% | chr3 | 9476508; 9476512 | 9476566 | + | ENST00000450326; ENST00000402198; ENST00000402466; ENST00000406341; ENST00000407969; ENST00000442373; ENST00000302463 | chr3 | 9476688 | 9476952 | + | TAF |
| 16% | chr16 | 4409386 | 4409297 | − | ENST00000572467; ENST00000251166; ENST00000539968; ENST00000537233; ENST00000574025; ENST00000576637 | chr16 | 4409070 | 4408945 | − | TAF |
| 16% | chr16 | 4409386 | 4409297 | − | ENST00000572467; ENST00000251166; ENST00000539968; ENST00000537233; ENST00000574025; ENST00000576637 | chr16 | 4409070 | 4408945 | − | TAF |
| 16% | chr16 | 4409386 | 4409297 | − | ENST00000572467; ENST00000251166; ENST00000539968; ENST00000537233; ENST00000574025; ENST00000576637 | chr16 | 4409070 | 4408945 | − | TAF |
| 16% | chr16 | 4409386 | 4409297 | − | ENST00000572467; ENST00000251166; ENST00000539968; ENST00000537233; ENST00000574025; ENST00000576637 | chr16 | 4409070 | 4408945 | − | TAF |
| 16% | chr16| | 4409386 | 4409297 | − | ENST00000572467; ENST00000251166; ENST00000539968; ENST00000537233; ENST00000574025; ENST00000576637 | chr16 | 4409070 | 4408945 | − | TAF |
| 16% | chrX | 49054298 | 49054174 | − | ENST00000263233; ENST00000479808; ENST00000469389; ENST00000466635 | chrX | 49053735 | 49053463 | − | TSF |
| 15% | chr1 | 60370730 | 60370543 | − | ENST00000371204 | chr1 | 60370188 | 60370144 | − | TAF |
| 15% | chr1 | 160012322 | 160011624 | − | ENST00000368089 | chr1 | 159969284 | 159968914 | − | TSF |
| 14% | chr9 | 139872031 | 139872144 | + | ENST00000224167; ENST00000457950; ENST00000371625; ENST00000371623; ENST00000471521 | chr9 | 139873283 | 139873345 | + | TAF |
| 14% | chr19 | 44129402 | 44129230 | − | ENST00000222374 | chr19 | 44129055 | 44128921 | − | TAF |
| 14% | chr9 | 100308467 | 100308623 | + | ENST00000395211; ENST00000259365 | chr9 | 100309531 | 100309681 | + | TAF |
| 14% | chr4 | 159620139 | 159620282 | + | ENST00000511912; ENST00000307738 | chr4 | 159622027 | 159622060 | + | TSF |
| 14% | chr4 | 159620139 | 159620282 | + | ENST00000511912; ENST00000307738 | chr4 | 159622027 | 159622060 | + | TSF |
| 13% | chr1 | 99380476 | 99380342 | − | ENST00000263177 | chr1 | 99378537 | 99378478 | − | TSF |
| 13% | chr9 | 98766802 | 98766983 | + | ENST00000407474; ENST00000320486 | chr9 | 98801158 | 98801481 | + | TSF |
| 13% | chr9 | 98766802 | 98766983 | + | ENST00000407474; ENST00000320486 | chr9 | 98801158 | 98801481 | + | TSF |
| 13% | chr2 | 230377652 | 230377499 | − | ENST00000341772 | chr2 | 230370969 | 230370811 | − | TSF |
| 12% | chr2 | 85991114 | 85991305 | + | ENST00000306279 | chr2 | 86045431 | 86045447 | + | TAF |
| 12% | chr19 | 6444312 | 6444162 | − | ENST00000598704; ENST00000595810; ENST00000598908; ENST00000264088; ENST00000601322; ENST00000301454; ENST00000593600; ENST00000414491; ENST00000600682; ENST00000334510 | chr19 | 6436479 | 6436108 | − | TAF |
| 12% | chr19 | 6444312 | 6444162 | − | ENST00000598704; ENST00000595810; ENST00000598908; ENST00000264088; ENST00000601322; ENST00000301454; ENST00000593600; ENST00000414491; ENST00000600682; ENST00000334510 | chr19 | 6436479 | 6436108 | − | TAF |
| 12% | chr19 | 6444312 | 6444162 | − | ENST00000598704; ENST00000595810; ENST00000598908; ENST00000264088; ENST00000601322; ENST00000301454; ENST00000593600; ENST00000414491; ENST00000600682; ENST00000334510 | chr19 | 6436479 | 6436108 | − | TAF |

TABLE 33-continued

Transcript fusion for Low Grade Glioma (LGG) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 12% | chr19 | 6444312 | 6444162 | − | ENST00000598704; ENST00000595810; ENST00000598908; ENST00000264088; ENST00000601322; ENST00000301454; ENST00000593600; ENST00000414491; ENST00000600682; ENST00000334510 | chr19 | 6436479 | 6436108 | − | TAF |
| 12% | chr19 | 6444312 | 6444162 | − | ENST00000598704; ENST00000595810; ENST00000598908; ENST00000264088; ENST00000601322; ENST00000301454; ENST00000593600; ENST00000414491; ENST00000600682; ENST00000334510 | chr19 | 6436479 | 6436108 | − | TAF |
| 12% | chr19 | 6444312 | 6444162 | − | ENST00000598704; ENST00000595810; ENST00000598908; ENST00000264088; ENST00000601322; ENST00000301454; ENST00000593600; ENST00000414491; ENST00000600682; ENST00000334510 | chr19 | 6436479 | 6436108 | − | TAF |
| 12% | chr19 | 6444312 | 6444162 | − | ENST00000598704; ENST00000595810; ENST00000598908; ENST00000264088; ENST00000601322; ENST00000301454; ENST00000593600; ENST00000414491; ENST00000600682; ENST00000334510 | chr19 | 6436479 | 6436108 | − | TAF |
| 12% | chr19 | 6444312 | 6444162 | − | ENST00000598704; ENST00000595810; ENST00000598908; ENST00000264088; ENST00000601322; ENST00000301454; ENST00000593600; ENST00000414491; ENST00000600682; ENST00000334510 | chr19 | 6436479 | 6436108 | − | TAF |
| 12% | chr19 | 6444312 | 6444162 | − | ENST00000598704; ENST00000595810; ENST00000598908; ENST00000264088; ENST00000601322; ENST00000301454; ENST00000593600; ENST00000414491; ENST00000600682; ENST00000334510 | chr19 | 6436479 | 6436108 | − | TAF |
| 12% | chr2 | 230135759 | 230135730 | − | ENST00000409462; ENST00000392055; ENST00000534952 | chr2 | 230127609 | 230127321 | − | TAF |
| 12% | chr10 | 55943353 | 55943204 | − | ENST00000373965; ENST00000414778; ENST00000395438; ENST00000409834; ENST00000395445; ENST00000395446; ENST00000395432; ENST00000361849; ENST00000395433; ENST00000373957; ENST00000320301; ENST00000395430; ENST00000448885; ENST00000437009; ENST00000373955 | chr10 | 55933689 | 55933395 | − | TSF |
| 12% | chr10 | 55943353 | 55943204 | − | ENST00000373965; ENST00000414778; ENST00000395438; ENST00000409834; ENST00000395445; ENST00000395446; ENST00000395432; ENST00000361849; ENST00000395433; ENST00000373957; ENST00000320301; ENST00000395430; ENST00000448885; ENST00000437009; ENST00000373955 | chr10 | 55933689 | 55933395 | − | TSF |
| 12% | chr10 | 55943353 | 55943204 | − | ENST00000373965; ENST00000414778; ENST00000395438; ENST00000409834; ENST00000395445; ENST00000395446; ENST00000395432; ENST00000361849; ENST00000395433; ENST00000373957; ENST00000320301; ENST00000395430; ENST00000448885; ENST00000437009; ENST00000373955 | chr10 | 55933689 | 55933395 | − | TSF |
| 12% | chr10 | 55943353 | 55943204 | − | ENST00000373965; ENST00000414778; ENST00000395438; ENST00000409834; ENST00000395445; ENST00000395446; ENST00000395432; ENST00000361849; ENST00000395433; ENST00000373957; ENST00000320301; ENST00000395430; ENST00000448885; ENST00000437009; ENST00000373955 | chr10 | 55933689 | 55933395 | − | TSF |
| 12% | chr10 | 55943353 | 55943204 | − | ENST00000373965; ENST00000414778; ENST00000395438; ENST00000409834; ENST00000395445; ENST00000395446; ENST00000395432; ENST00000361849; ENST00000395433; ENST00000373957; ENST00000320301; ENST00000395430; ENST00000448885; ENST00000437009; ENST00000373955 | chr10 | 55933689 | 55933395 | − | TSF |
| 12% | chr10 | 55943353 | 55943204 | − | ENST00000373965; ENST00000414778; ENST00000395438; ENST00000409834; ENST00000395445; ENST00000395446; ENST00000395432; ENST00000361849; | chr10 | 55933689 | 55933395 | − | TSF |

TABLE 33-continued

Transcript fusion for Low Grade Glioma (LGG) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| | | | | | ENST00000395433; ENST00000373957; ENST00000320301; ENST00000395430; ENST00000448885; ENST00000437009; ENST00000373955 | | | | | |
| 11% | chr14 | 93799274 | 93799166 | − | ENST00000554565 | chr14 | 93791211 | 93791104 | − | TAF |
| 11% | chr1 | 11718793 | 11718928 | + | ENST00000251546; ENST00000376770; ENST00000376768; ENST00000251547; ENST00000376760; ENST00000376762; ENST00000475435; ENST00000471895 | chr1 | 11719303 | 11719464 | + | TAF |
| 11% | chr1 | 11718793 | 11718928 | + | ENST00000251546; ENST00000376770; ENST00000376768; ENST00000251547; ENST00000376760; ENST00000376762; ENST00000475435; ENST00000471895 | chr1 | 11719303 | 11719464 | + | TAF |
| 11% | chr1 | 11718793 | 11718928 | + | ENST00000251546; ENST00000376770; ENST00000376768; ENST00000251547; ENST00000376760; ENST00000376762; ENST00000475435; ENST00000471895 | chr1 | 11719303 | 11719464 | + | TAF |
| 11% | chr1 | 11718793 | 11718928 | + | ENST00000251546; ENST00000376770; ENST00000376768; ENST00000251547; ENST00000376760; ENST00000376762; ENST00000475435; ENST00000471895 | chr1 | 11719303 | 11719464 | + | TAF |
| 10% | chr19 | 5208068 | 5207933 | − | ENST00000262963; ENST00000348075; ENST00000353284; ENST00000357368; ENST00000372412; ENST00000587303; ENST00000588012; ENST00000592099 | chr19 | 5159115 | 5158876 | − | TAF |
| 10% | chr19 | 5208068 | 5207933 | − | ENST00000262963; ENST00000348075; ENST00000353284; ENST00000357368; ENST00000372412; ENST00000587303; ENST00000588012; ENST00000592099 | chr19 | 5159115 | 5158876 | − | TAF |
| 10% | chr19 | 5208068 | 5207933 | − | ENST00000262963; ENST00000348075; ENST00000353284; ENST00000357368; ENST00000372412; ENST00000587303; ENST00000588012; ENST00000592099 | chr19 | 5159115 | 5158876 | − | TAF |
| 10% | chr19 | 5208068 | 5207933 | − | ENST00000262963; ENST00000348075; ENST00000353284; ENST00000357368; ENST00000372412; ENST00000587303; ENST00000588012; ENST00000592099 | chr19 | 5159115 | 5158876 | − | TAF |
| 10% | chr19 | 5208068 | 5207933 | − | ENST00000262963; ENST00000348075; ENST00000353284; ENST00000357368; ENST00000372412; ENST00000587303; ENST00000588012; ENST00000592099 | chr19 | 5159115 | 5158876 | − | TAF |
| 10% | chr2 | 175809671 | 175809616 | − | ENST00000409900; ENST00000409156 | chr2 | 175805622 | 175805109 | | TAF |
| 9% | chr5 | 152873488; 152873613 | 152873625 | + | ENST00000285900; ENST00000518142; ENST00000340592; ENST00000521843; ENST00000448073; ENST00000518783 | chr5 | 152889310 | 152889396 | + | TSF |
| 9% | chr5 | 152873488; 152873613 | 152873625 | + | ENST00000285900; ENST00000518142; ENST00000340592; ENST00000521843; ENST00000448073; ENST00000518783 | chr5 | 152889310 | 152889396 | + | TSF |
| 9% | chr5 | 152873488; 152873613 | 152873625 | + | ENST00000285900; ENST00000518142; ENST00000340592; ENST00000521843; ENST00000448073; ENST00000518783 | chr5 | 152889310 | 152889396 | + | TSF |
| 9% | chr8 | 63502273 | 63502353 | + | ENST00000523211; ENST00000328472 | chr8 | 63546747 | 63547118 | + | TSF |
| 9% | chr19 | 1461962 | 1462176 | + | ENST00000590469; ENST00000233607; ENST00000238483; ENST00000535453 | chr19 | 1462374 | 1462680 | + | TSF |
| 9% | chr19 | 1461962 | 1462176 | + | ENST00000590469; ENST00000233607; ENST00000238483; ENST00000535453 | chr19 | 1462374 | 1462680 | + | TSF |
| 8% | chr16 | 30783410 | 30783511 | + | ENST00000324685; ENST00000402121; ENST00000563683; ENST00000357890 | chr16 | 30785136 | 30785155 | + | TSF |
| 8% | chr16 | 30783410 | 30783511 | + | ENST00000324685; ENST00000402121; ENST00000563683; ENST00000357890 | chr16 | 30785136 | 30785155 | + | TSF |
| 8% | chr16 | 30783410 | 30783511 | + | ENST00000324685; ENST00000402121; ENST00000563683; ENST00000357890 | chr16 | 30785136 | 30785155 | + | TSF |
| 8% | chr16 | 30783410 | 30783511 | + | ENST00000324685; ENST00000402121; ENST00000563683; ENST00000357890 | chr16 | 30785136 | 30785155 | + | TSF |
| 8% | chr1 | 156618360 | 156618653 | + | ENST00000329117; ENST00000361588 | chr1 | 156620746 | 156620747 | + | TSF |
| 8% | chr1 | 160109683; 160109716 | 160109774 | + | ENST00000361216; ENST00000392233; ENST00000447527 | chr1 | 160110441 | 160110463 | + | TSF |
| 8% | chr1 | 160109683; 160109716 | 160109774 | + | ENST00000361216; ENST00000392233; ENST00000447527 | chr1 | 160110441 | 160110463 | + | TSF |
| 8% | chr1 | 160109683; 160109716 | 160109774 | + | ENST00000361216; ENST00000392233; ENST00000447527 | chr1 | 160110441 | 160110463 | + | TSF |
| 7% | chr19 | 19351412 | 19351494 | + | ENST00000252575; ENST00000538881 | chr19 | 19353543 | 19353658 | + | TSF |

TABLE 33-continued

Transcript fusion for Low Grade Glioma (LGG) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|----|----|
| 7% | chr19 | 19351412 | 19351494 | + | ENST00000588231 ENST00000252575; ENST00000538881;chr19 | | 19353543 | 19353658 | + | TSF |
| 7% | chr19 | 19351412 | 19351494 | + | ENST00000588231 ENST00000252575; ENST00000538881;chr19 | | 19353543 | 19353658 | + | TSF |
| 7% | chr1 | 31347435 | 31347144 | − | ENST00000588231 ENST00000336798; ENST00000339394 chr1 | | 31340352 | 31340311 | − | TSF |
| 7% | chr1 | 31347435 | 31347144 | − | ENST00000336798; ENST00000339394 chr1 | | 31340352 | 31340311 | − | TSF |
| 7% | chr22 | 39772057 | 39772202 | + | ENST00000318801; ENST00000406293;chr22 ENST00000328933; ENST00000381535 | | 39775891 | 39775926 | + | TSF |
| 7% | chr22 | 39772057 | 39772202 | + | ENST00000318801; ENST00000406293;chr22 ENST00000328933; ENST00000381535 | | 39775891 | 39775926 | + | TSF |
| 6% | chr11 | 117710545 | 117710496 | − | ENST00000532984; ENST00000584394;chr11 ENST00000529335 | | 117703821 | 117703741 | − | TSF |
| 6% | chr11 | 117710545 | 117710496 | − | ENST00000532984; ENST00000584394;chr11 ENST00000529335 | | 117703821 | 117703741 | − | TSF |
| 6% | chr11 | 117710545 | 117710496 | − | ENST00000532984; ENST00000584394;chr11 ENST00000529335 | | 117703821 | 117703741 1 | − | TSF |
| 6% | chr17 | 1028702; 1028625 | 1028518 | − | ENST00000302538; ENST00000544583;chr17 ENST00000574437; ENST00000575934; ENST00000574139; ENST00000570525; ENST00000574266 | | 1005267 | 1004964 | − | TSF |
| 6% | chr17 | 1028702; 1028625 | 1028518 | − | ENST00000302538; ENST00000544583;chr17 ENST00000574437; ENST00000575934; ENST00000574139; ENST00000570525; ENST00000574266 | | 1005267 | 1004964 | − | TSF |
| 6% | chr8 | 145001050 | 145000952 | − | ENST00000345136; ENST00000357649;chr8 ENST00000354589; ENST00000398774; ENST00000322810; ENST00000354958; ENST00000356346; ENST00000436759; ENST00000527096; ENST00000527303 | | 144977746 | 144977671 | − | TSF |
| 6% | chr8 | 145001050 | 145000952 | − | ENST00000345136; ENST00000357649;chr8 ENST00000354589; ENST00000398774; ENST00000322810; ENST00000354958; ENST00000356346; ENST00000436759; ENST00000527096; ENST00000527303 | | 144977746 | 144977671 | − | TSF |
| 6% | chr8 | 145001050 | 145000952 | − | ENST00000345136; ENST00000357649;chr8 ENST00000354589; ENST00000398774; ENST00000322810; ENST00000354958; ENST00000356346; ENST00000436759; ENST00000527096; ENST00000527303 | | 144977746 | 144977671 | − | TSF |
| 6% | chr8 | 145001050 | 145000952 | − | ENST00000345136; ENST00000357649;chr8 ENST00000354589; ENST00000398774; ENST00000322810; ENST00000354958; ENST00000356346; ENST00000436759; ENST00000527096; ENST00000527303 | | 144977746 | 144977671 | − | TSF |
| 6% | chr8 | 145001050 | 145000952 | − | ENST00000345136; ENST00000357649;chr8 ENST00000354589; ENST00000398774; ENST00000322810; ENST00000354958; ENST00000356346; ENST00000436759; ENST00000527096; ENST00000527303 | | 144977746 | 144977671 | − | TSF |
| 6% | chr8 | 145001050 | 145000952 | − | ENST00000345136; ENST00000357649;chr8 ENST00000354589; ENST00000398774; ENST00000322810; ENST00000354958; ENST00000356346; ENST00000436759; ENST00000527096; ENST00000527303 | | 144977746 | 144977671 | − | TSF |
| 6% | chr8 | 145001050 | 145000952 | − | ENST00000345136; ENST00000357649;chr8 ENST00000354589; ENST00000398774; ENST00000322810; ENST00000354958; ENST00000356346; ENST00000436759; ENST00000527096; ENST00000527303 | | 144977746 | 144977671 | | TSF |
| 6% | chr8 | 145001050 | 145000952 | − | ENST00000345136; ENST00000357649;chr8 ENST00000354589; ENST00000398774; ENST00000322810; ENST00000354958; ENST00000356346; ENST00000436759; ENST00000527096; ENST00000527303 | | 144977746 | 144977671 | − | TSF |
| 6% | chr8 | 145001050 | 145000952 | − | ENST00000345136; ENST00000357649;chr8 ENST00000354589; ENST00000398774; ENST00000322810; ENST00000354958; ENST00000356346; ENST00000436759; ENST00000527096; ENST00000527303 | | 144977746 | 144977671 | − | TSF |
| 6% | chr8 | 145001050 | 145000952 | − | ENST00000345136; ENST00000357649;chr8 ENST00000354589; ENST00000398774; ENST00000322810; ENST00000354958; ENST00000356346; ENST00000436759; ENST00000527096; ENST00000527303 | | 144977746 | 144977671 | − | TSF |
| 5% | chr13 | 115057109 | 115057267 | + | ENST00000375299; ENST00000351487 chr13 | | 115063902 | 115064025 | + | TSF |

TABLE 33-continued

Transcript fusion for Low Grade Glioma (LGG) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|----|----|
| 5% | chr13 | 115057109 | 115057267 | + | ENST00000375299; ENST00000351487 | chr13 | 115063902 | 115064025 | + | TSF |
| 5% | chr7 | 102249269 | 102249208 | − | ENST00000262940; ENST00000461209; ENST00000449970; ENST00000462172; ENST00000522801; ENST00000520042; ENST00000521076 | chr7 | 102248714 | 102248385 | − | TSF |
| 5% | chr7 | 102249269 | 102249208 | − | ENST00000262940; ENST00000461209; ENST00000449970; ENST00000462172; ENST00000522801; ENST00000520042; ENST00000521076 | chr7 | 102248714 | 102248385 | − | TSF |
| 5% | chr7 | 102249269 | 102249208 | − | ENST00000262940; ENST00000461209; ENST00000449970; ENST00000462172; ENST00000522801; ENST00000520042; ENST00000521076 | chr7 | 102248714 | 102248385 | − | TSF |
| 5% | chr1 | 156384545 | 156384446 | − | ENST00000368242; ENST00000310027; ENST00000368243; ENST00000357975 | chr1 | 156374431 | 156374430 | − | TSF |
| 5% | chr1 | 156384545 | 156384446 | − | ENST00000368242; ENST00000310027; ENST00000368243; ENST00000357975 | chr1 | 156374431 | 156374430 | − | TSF |
| 5% | chr1 | 156384545 | 156384446 | − | ENST00000368242; ENST00000310027; ENST00000368243; ENST00000357975 | chr1 | 156374431 | 156374430 | − | TSF |
| 5% | chr1 | 156384545 | 156384446 | − | ENST00000368242; ENST00000310027; ENST00000368243; ENST00000357975 | chr1 | 156374431 | 156374430 | − | TSF |
| 5% | chr7 | 55270210 | 55270401 | + | ENST00000455089 | chr7 | 55272949 | 55272949 | + | TSF |
| 5% | chr20 | 29978286 | 29978226 | − | ENST00000339144; ENST00000376321; ENST00000376315 | chr20 | 29976162 | 29976126 | − | TSF |
| 5% | chr7 | 102150107 | 102150046 | − | ENST00000541662; ENST00000465829; ENST00000306682 | chr7 | 102149552 | 102149223 | − | TSF |
| 5% | chr7 | 102150107 | 102150046 | − | ENST00000541662; ENST00000465829; ENST00000306682 | chr7 | 102149552 | 102149223 | − | TSF |
| 5% | chr20 | 62612599 | 62612669 | + | ENST00000535781; ENST00000266079 | chr20 | 62612803 | 62612943 | + | TSF |
| 5% | chr19 | 50213980 | 50214114 | + | ENST00000323446; ENST00000392518; ENST00000354199; ENST00000598293; ENST00000405931; ENST00000595031 | chr19 | 50214968 | 50214999 | + | TSF |
| 5% | chr19 | 50213980 | 50214114 | + | ENST00000323446; ENST00000392518; ENST00000354199; ENST00000598293; ENST00000405931; ENST00000595031 | chr19 | 50214968 | 50214999 | + | TSF |
| 5% | chr19 | 50213980 | 50214114 | + | ENST00000323446; ENST00000392518; ENST00000354199; ENST00000598293; ENST00000405931; ENST00000595031 | chr19 | 50214968 | 50214999 | + | TSF |
| 4% | chr1 | 99380476 | 99380357 | − | ENST00000370188; ENST00000263177 | chr1 | 99378537 | 99378478 | − | TSF |
| 4% | chr19 | 44129402 | 44129230 | − | ENST00000222374 | chr19 | 44129101 | 44128921 | − | TSF |
| 4% | chr10 | 55826645 | 55826517 | − | ENST00000373965; ENST00000414778; ENST00000395438; ENST00000409834; ENST00000395445; ENST00000395432; ENST00000361849; ENST00000395433; ENST00000373957; ENST00000320301; ENST00000395430; ENST00000437009; ENST00000373955 | chr10 | 55816578 | 55816423 | − | TSF |
| 4% | chr10 | 55826645 | 55826517 | − | ENST00000373965; ENST00000414778; ENST00000395438; ENST00000409834; ENST00000395445; ENST00000395432; ENST00000361849; ENST00000395433; ENST00000373957; ENST00000320301; ENST00000395430; ENST00000437009; ENST00000373955 | chr10 | 55816578 | 55816423 | − | TSF |
| 4% | chr10 | 55826645 | 55826517 | − | ENST00000373965; ENST00000414778; ENST00000395438; ENST00000409834; ENST00000395445; ENST00000395432; ENST00000361849; ENST00000395433; ENST00000373957; ENST00000320301; ENST00000395430; ENST00000437009; ENST00000373955 | chr10 | 55816578 | 55816423 | − | TSF |
| 4% | chr10 | 55826645 | 55826517 | − | ENST00000373965; ENST00000414778; ENST00000395438; ENST00000409834; ENST00000395445; ENST00000395432; ENST00000361849; ENST00000395433; ENST00000373957; ENST00000320301; ENST00000395430; ENST00000437009; ENST00000373955 | chr10 | 55816578 | 55816423 | − | TSF |
| 4% | chr10 | 55826645 | 55826517 | − | ENST00000373965; ENST00000414778; ENST00000395438; ENST00000409834; ENST00000395445; ENST00000395432; ENST00000361849; ENST00000395433; ENST00000373957; ENST00000320301; ENST00000395430; ENST00000437009; ENST00000373955 | chr10 | 55816578 | 55816423 | − | TSF |
| 4% | chr10 | 55826645 | 55826517 | − | ENST00000373965; ENST00000414778 | chr10 | 55816578 | 55816423 | − | TSF |

TABLE 33-continued

Transcript fusion for Low Grade Glioma (LGG) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
|  |  |  |  |  | ENST00000395438; ENST00000409834; ENST00000395445; ENST00000395432; ENST00000361849; ENST00000395433; ENST00000373957; ENST00000320301; ENST00000395430; ENST00000437009; ENST00000373955 |  |  |  |  |  |
| 4% | chr10 | 55826645 | 55826517 | − | ENST00000373965; ENST00000414778; ENST00000395438; ENST00000409834; ENST00000395445; ENST00000395432; ENST00000361849; ENST00000395433; ENST00000373957; ENST00000320301; ENST00000395430; ENST00000437009; ENST00000373955 | chr10 | 55816578 | 55816423 | − | TSF |
| 4% | chr19 | 3905432 | 3905653 | + | ENST00000450849; ENST00000301260; ENST00000398448; ENST00000600960 | chr19 | 3906655 | 3906700 | + | TSF |
| 4% | chr19 | 3905432 | 3905653 | + | ENST00000450849; ENST00000301260; ENST00000398448; ENST00000600960 | chr19 | 3906655 | 3906700 | + | TSF |
| 4% | chr11 | 17429000 | 17428901 | − | ENST00000389817; ENST00000302539 | chr11 | 17428722 | 17428716 | − | TSF |
| 4% | chr11 | 17429000 | 17428901 | − | ENST00000389817; ENST00000302539 | chr11 | 17428722 | 17428716 | − | TSF |
| 4% | chr3 | 98304342; 98304503 | 98304285 | − | ENST00000512905; ENST00000264193 | chr3 | 98292414 | 98292298 | − | TSF |
| 4% | chr3 | 98304342; 98304503 | 98304285 | − | ENST00000512905; ENST00000264193 | chr3 | 98292414 | 98292298 | − | TSF |
| 4% | chr5 | 90398036 | 90398157 | + | ENST00000405460; ENST00000425867 | chr5 | 90412152 | 90412249 | + | TSF |
| 4% | chr5 | 90398036 | 90398157 | + | ENST00000405460; ENST00000425867 | chr5 | 90412152 | 90412249 | + | TSF |
| 4% | chr16 | 50659396 | 50659491 | + | ENST00000268459 | chr16 | 50663933 | 50663990 | + | TSF |
| 4% | chr3 | 98236033; 98236004 | 98235896 | − | ENST00000502288; ENST00000507874; ENST00000341181; ENST00000437922; ENST00000394180; ENST00000506885; ENST00000503004; ENST00000394185; ENST00000394181; ENST00000513873; ENST00000510545; ENST00000511081; ENST00000513287; ENST00000511667; ENST00000513452; ENST00000502299; ENST00000512147; ENST00000508902; ENST00000510541; ENST00000514537; ENST00000515620 | chr3 | 98228614 | 98228468 | − | TSF |
| 4% | chr3 | 98236033; 98236004 | 98235896 | − | ENST00000502288; ENST00000507874; ENST00000341181; ENST00000437922; ENST00000394180; ENST00000506885; ENST00000503004; ENST00000394185; ENST00000394181; ENST00000513873; ENST00000510545; ENST00000511081; ENST00000513287; ENST00000511667; ENST00000513452; ENST00000502299; ENST00000512147; ENST00000508902; ENST00000510541; ENST00000514537; ENST00000515620 | chr3 | 98228614 | 98228468 | − | TSF |
| 4% | chr3 | 98236033; 98236004 | 98235896 | − | ENST00000502288; ENST00000507874; ENST00000341181; ENST00000437922; ENST00000394180; ENST00000506885; ENST00000503004; ENST00000394185; ENST00000394181; ENST00000513873; ENST00000510545; ENST00000511081; ENST00000513287; ENST00000511667; ENST00000513452; ENST00000502299; ENST00000512147; ENST00000508902; ENST00000510541; ENST00000514537; ENST00000515620 | chr3 | 98228614 | 98228468 | − | TSF |
| 4% | chr3 | 98236033; 98236004 | 98235896 | − | ENST00000502288; ENST00000507874; ENST00000341181; ENST00000437922; ENST00000394180; ENST00000506885; ENST00000503004; ENST00000394185; ENST00000394181; ENST00000513873; ENST00000510545; ENST00000511081; ENST00000513287; ENST00000511667; ENST00000513452; ENST00000502299; ENST00000512147; ENST00000508902; ENST00000510541; ENST00000514537; ENST00000515620 | chr3 | 98228614 | 98228468 | − | TSF |
| 4% | chr3 | 98236033; 98236004 | 98235896 | − | ENST00000502288; ENST00000507874; ENST00000341181; ENST00000437922; ENST00000394180; ENST00000506885; ENST00000503004; ENST00000394185; ENST00000394181; ENST00000513873; ENST00000510545; ENST00000511081; | chr3 | 98228614 | 98228468 | − | TSF |

TABLE 33-continued

Transcript fusion for Low Grade Glioma (LGG) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 4% | chr3 | 98236033; 98236004 | 98235896 | − | ENST00000513287; ENST00000511667; ENST00000513452; ENST00000502299; ENST00000512147; ENST00000508902; ENST00000510541; ENST00000514537; ENST00000515620 ENST00000502288; ENST00000507874; ENST00000341181; ENST00000437922; ENST00000394180; ENST00000506885; ENST00000503004; ENST00000394185; ENST00000394181; ENST00000513873; ENST00000510545; ENST00000511081; ENST00000513287; ENST00000511667; ENST00000513452; ENST00000502299; ENST00000512147; ENST00000508902; ENST00000510541; ENST00000514537; ENST00000515620 | chr3 | 98228614 | 98228468 | − | TSF |
| 4% | chr3 | 98236033; 98236004 | 98235896 | − | ENST00000502288; ENST00000507874; ENST00000341181; ENST00000437922; ENST00000394180; ENST00000506885; ENST00000503004; ENST00000394185; ENST00000394181; ENST00000513873; ENST00000510545; ENST00000511081; ENST00000513287; ENST00000511667; ENST00000513452; ENST00000502299; ENST00000512147; ENST00000508902; ENST00000510541; ENST00000514537; ENST00000515620 | chr3 | 98228614 | 98228468 | − | TSF |
| 3% | chr3 | 120068090 | 120067591 | − | ENST00000295628 | chr3 | 120067161 | 120067151 | − | TSF |
| 3% | chr2 | 220379066 | 220380028 | + | ENST00000347842; ENST00000358078 | chr2 | 220383470 | 220383510 | + | TSF |
| 3% | chr14 | 94594329 | 94594183 | − | ENST00000238609; ENST00000556727 | chr14 | 94591218 | 94590919 | − | TSF |
| 3% | chr14 | 94594329 | 94594183 | − | ENST00000238609; ENST00000556727 | chr14 | 94591218 | 94590919 | − | TSF |
| 3% | chr8 | 104778455 | 104778765 | + | ENST00000504942; ENST00000406091 | chr8 | 104821508 | 104821527 | + | TSF |
| 3% | chr15 | 64444837 | 64444941 | + | ENST00000325881; ENST00000558466 | chr15 | 64445122 | 64445138 | + | TSF |
| 3% | chr22 | 26747018; 26747020 | 26747209 | + | ENST00000404234; ENST00000529632; ENST00000248933; ENST00000343706; ENST00000402979; ENST00000403121; ENST00000411842 | chr22 | 26750424 | 26750495 | + | TSF |
| 3% | chr22 | 26747018; 26747020 | 26747209 | + | ENST00000404234; ENST00000529632; ENST00000248933; ENST00000343706; ENST00000402979; ENST00000403121; ENST00000411842 | chr22 | 26750424 | 26750495 | + | TSF |
| 3% | chr22 | 26747018; 26747020 | 26747209 | + | ENST00000404234; ENST00000529632; ENST00000248933; ENST00000343706; ENST00000402979; ENST00000403121; ENST00000411842 | chr22 | 26750424 | 26750495 | + | TSF |
| 3% | chr14 | 31922550 | 31922481 | − | ENST00000549185; ENST00000547378; ENST00000310850; ENST00000356180 | chr14 | 31907346 | 31905965 | − | TSF |
| 3% | chr20 | 1144962 | 1145120 | + | ENST00000381898; ENST00000333082; ENST00000246015; ENST00000335877; ENST00000438768; ENST00000435720 | chr20 | 1166984 | 1167052 | + | TSF |
| 3% | chr20 | 1144962 | 1145120 | + | ENST00000381898; ENST00000333082; ENST00000246015; ENST00000335877; ENST00000438768; ENST00000435720 | chr20 | 1166984 | 1167052 | + | TSF |
| 3% | chr20 | 1144962 | 1145120 | + | ENST00000381898; ENST00000333082; ENST00000246015; ENST00000335877; ENST00000438768; ENST00000435720 | chr20 | 1166984 | 1167052 | + | TSF |
| 3% | chr20 | 1144962 | 1145120 | + | ENST00000381898; ENST00000333082; ENST00000246015; ENST00000335877; ENST00000438768; ENST00000435720 | chr20 | 1166984 | 1167052 | + | TSF |
| 3% | chr5 | 65310497 | 65310553 | + | ENST00000284037; ENST00000380943; ENST00000416865; ENST00000380935; ENST00000380936; ENST00000380939; ENST00000380938; ENST00000511297; ENST00000506030; ENST00000508515 | chr5 | 65311417 | 65311436 | + | TSF |
| 3% | chr6 | 102483216 | 102483441 | + | ENST00000369138; ENST00000413795; ENST00000421544; ENST00000318991; ENST00000369137; ENST00000369134 | chr6 | 102495349 | 102495644 | + | TSF |
| 3% | chr6 | 102483216 | 102483441 | + | ENST00000369138; ENST00000413795; ENST00000421544; ENST00000318991; ENST00000369137; ENST00000369134 | chr6 | 102495349 | 102495644 | + | TSF |
| 3% | chr6 | 102483216 | 102483441 | + | ENST00000369138; ENST00000413795; ENST00000421544; ENST00000318991; ENST00000369137; ENST00000369134 | chr6 | 102495349 | 102495644 | + | TSF |
| 3% | chrX | 13956629 | 13956626 | − | ENST00000454189 | chrX | 13952867 | 13952865 | − | TSF |
| 3% | chr4 | 83626566 | 83626436 | − | ENST00000319540; ENST00000273908; ENST00000282709 | chr4 | 83616020 | 83615829 | − | TSF |

TABLE 33-continued

Transcript fusion for Low Grade Glioma (LGG) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 3% | chr8 | 27472298 | 27472172 | − | ENST00000560366 | chr8 | 27471250 | 27471189 | − | TSF |
| 2% | chr11 | 117342751 | 117342584 | − | ENST00000527706; ENST00000321322 | chr11 | 117342050 | 117341882 | − | TSF |
| 2% | chr11 | 117342751 | 117342584 | − | ENST00000527706; ENST00000321322 | chr11 | 117342050 | 117341882 | − | TSF |
| 2% | chr4 | 151124947 | 151125041 | + | ENST00000296550; ENST00000411937; ENST00000506325; ENST00000302176 | chr4 | 151135817 | 151135831 | + | TSF |
| 2% | chr4 | 151124947 | 151125041 | + | ENST00000296550; ENST00000411937; ENST00000506325; ENST00000302176 | chr4 | 151135817 | 151135831 | + | TSF |
| 2% | chr19 | 19349062; 19349068 | 19349220 | + | ENST00000252575; ENST00000538881; ENST00000588231 | chr19 | 19350543 | 19350866 | + | TSF |
| 2% | chr19 | 19349062; 19349068 | 19349220 | + | ENST00000252575; ENST00000538881; ENST00000588231 | chr19 | 19350543 | 19350866 | + | TSF |
| 2% | chr19 | 19349062; 19349068 | 19349220 | + | ENST00000252575; ENST00000538881; ENST00000588231 | chr19 | 19350543 | 19350866 | + | TSF |
| 2% | chr18 | 32650166; 32650159 | 32650286 | + | ENST00000591734; ENST00000413393; ENST00000587359; ENST00000436190; ENST00000588349; ENST00000300249; ENST00000588910; ENST00000589699 | chr18 | 32670836 | 32671096 | + | TSF |
| 2% | chr18 | 32650166; 32650159 | 32650286 | + | ENST00000591734; ENST00000413393; ENST00000587359; ENST00000436190; ENST00000588349; ENST00000300249; ENST00000588910; ENST00000589699 | chr18 | 32670836 | 32671096 | + | TSF |
| 2% | chr18 | 32650166; 32650159 | 32650286 | + | ENST00000591734; ENST00000413393; ENST00000587359; ENST00000436190; ENST00000588349; ENST00000300249; ENST00000588910; ENST00000589699 | chr18 | 32670836 | 32671096 | + | TSF |
| 2% | chr15 | 65687596 | 65687432 | − | ENST00000352385 | chr15 | 65687004 | 65686908 | − | TSF |
| 2% | chr1 | 160106691 | 160106821 | + | ENST00000361216; ENST00000392233; ENST00000447527 | chr1 | 160108093 | 160108301 | + | TSF |
| 2% | chr1 | 160106691 | 160106821 | + | ENST00000361216; ENST00000392233; ENST00000447527 | chr1 | 160108093 | 160108301 | + | TSF |
| 2% | chr17 | 30611678 | 30611836 | + | ENST00000431505; ENST00000269051; ENST00000538145 | chr17 | 30615251 | 30615440 | + | TSF |
| 2% | chr17 | 30611678 | 30611836 | + | ENST00000431505; ENST00000269051; ENST00000538145 | chr17 | 30615251 | 30615440 | + | TSF |
| 2% | chr7 | 103969270; 103969228 | 103969672 | + | ENST00000424859; ENST00000535008; ENST00000401970; ENST00000543266 | chr7 | 103974311 | 103974541 | + | TSF |
| 2% | chr7 | 103969270; 103969228 | 103969672 | + | ENST00000424859; ENST00000535008; ENST00000401970; ENST00000543266 | chr7 | 103974311 | 103974541 | + | TSF |
| 2% | chr4 | 83557976 | 83557744 | − | ENST00000319540 | chr4 | 83554583 | 83554006 | − | TSF |
| 2% | chr9 | 140261084; 140260993 | 140260945 | − | ENST00000491734; ENST00000340951; ENST00000478344; ENST00000479452 | chr9 | 140253058 | 140252867 | − | TSF |
| 2% | chr9 | 140261084; 140260993 | 140260945 | − | ENST00000491734; ENST00000340951; ENST00000478344; ENST00000479452 | chr9 | 140253058 | 140252867 | − | TSF |
| 2% | chr9 | 140261084; 140260993 | 140260945 | − | ENST00000491734; ENST00000340951; ENST00000478344; ENST00000479452 | chr9 | 140253058 | 140252867 | − | TSF |
| 2% | chr19 | 55178148; 55178145 | 55178200 | + | ENST00000391736; ENST00000270452; ENST00000430952;E NST00000391734; ENST00000391733; ENST00000434286 | chr19 | 55178294 | 55178458 | + | TSF |
| 2% | chr19 | 55178148; 55178145 | 55178200 | + | ENST00000391736; ENST00000270452; ENST00000430952;E NST00000391734; ENST00000391733; ENST00000434286 | chr19 | 55178294 | 55178458 | + | TSF |
| 2% | chr19 | 55178148; 55178145 | 55178200 | + | ENST00000391736; ENST00000270452; ENST00000430952;E NST00000391734; ENST00000391733; ENST00000434286 | chr19 | 55178294 | 55178458 | + | TSF |
| 2% | chr3 | 16216659; | 16217197 | + | ENST00000339732; ENST00000437509; ENST00000430410 | chr3 | 16224220 | 16224358 | + | TSF |
| 2% | chr3 | 16216659; | 16217197 | + | ENST00000339732; ENST00000437509; ENST00000430410 | chr3 | 16224220 | 16224358 | + | TSF |
| 2% | chr15 | 80883909 | 80884045 | + | ENST00000303329; ENST00000533983; ENST00000527771 | chr15 | 80885236 | 80885386 | + | TSF |
| 2% | chr15 | 80883909 | 80884045 | + | ENST00000303329; ENST00000533983; ENST00000527771 | chr15 | 80885236 | 80885386 | + | TSF |
| 2% | chr16 | 50666192 | 50666319 | + | ENST00000268459 | chr16 | 50682755 | 50682972 | + | TSF |
| 2% | chr22 | 48885405 | 48885516 | + | ENST00000402357; ENST00000336769 | chr22 | 48915770 | 48916108 | + | TSF |
| 2% | chr2 | 155115534 | 155115651 | + | ENST00000392825; ENST00000409237 | chr2 | 155142972 | 155143021 | + | TSF |
| 2% | chr1 | 156384545 | 156384446 | − | ENST00000368242; ENST00000310027; ENST00000368243; ENST00000357975 | chr1 | 156349478 | 156349429 | | TSF |
| 2% | chr1 | 156384545 | 156384446 | − | ENST00000368242; ENST00000310027; ENST00000368243; ENST00000357975 | chr1 | 156349478 | 156349429 | − | TSF |
| 2% | chr1 | 156384545 | 156384446 | − | ENST00000368242; ENST00000310027; ENST00000368243; ENST00000357975 | chr1 | 156349478 | 156349429 | − | TSF |
| 2% | chr1 | 156384545 | 156384446 | − | ENST00000368242; ENST00000310027; ENST00000368243; ENST00000357975 | chr1 | 156349478 | 156349429 | − | TSF |
| 2% | chr19 | 23556639 | 23556544 | − | ENST00000599743; ENST00000300619 | chr19 | 23491899 | 23491588 | − | TSF |
| 2% | chr1 | 12476713 | 12476880 | + | ENST00000356315; ENST00000358136; ENST00000011700; ENST00000543766 | chr1 | 12510638 | 12510871 | + | TSF |

TABLE 33-continued

Transcript fusion for Low Grade Glioma (LGG) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 2% | chr1 | 12476713 | 12476880 | + | ENST00000356315; ENST00000358136; ENST00000011700; ENST00000543766 | chr1 | 12510638 | 12510871 | + | TSF |
| 2% | chr1 | 12476713 | 12476880 | + | ENST00000356315; ENST00000358136; ENST00000011700; ENST00000543766 | chr1 | 12510638 | 12510871 | + | TSF |
| 2% | chr1 | 12476713 | 12476880 | + | ENST00000356315; ENST00000358136; ENST00000011700; ENST00000543766 | chr1 | 12510638 | 12510871 | + | TSF |
| 2% | chr6 | 36922537 | 36922707 | + | ENST00000373674 | chr6 | 36924759 | 36925208 | + | TSF |
| 2% | chr21 | 45222155 | 45222268 | + | ENST00000497547 | chr21 | 45240407 | 45240709 | + | TSF |
| 2% | chr11 | 105623707 | 105623946 | + | ENST00000393125; ENST00000282499; ENST00000393127; ENST00000428631; ENST00000531011; ENST00000525187; ENST00000530497 | chr11 | 105628730 | 105628963 | + | TSF |
| 2% | chr1 | 48771550 | 48771459 | − | ENST00000371847; ENST00000371843; ENST00000396199 | chr1 | 48730486 | 48730045 | − | TSF |
| 2% | chr1 | 48771550 | 48771459 | − | ENST00000371847; ENST00000371843; ENST00000396199 | chr1 | 48730486 | 48730045 | − | TSF |
| 2% | chr1 | 48771550 | 48771459 | − | ENST00000371847; ENST00000371843; ENST00000396199 | chr1 | 48730486 | 48730045 | − | TSF |
| 2% | chr15 | 43705532; 43705526; 43705484 | 43705317 | − | ENST00000263801; ENST00000382039; ENST00000382044; ENST00000450115; ENST00000434595 | chr15 | 43702724 | 43702621 | − | TSF |
| 2% | chr15 | 43705532; 43705526; 43705484 | 43705317 | − | ENST00000263801; ENST00000382039; ENST00000382044; ENST00000450115; ENST00000434595 | chr15 | 43702724 | 43702621 | − | TSF |
| 2% | chr15 | 43705532; 43705526; 43705484 | 43705317 | − | ENST00000263801; ENST00000382039; ENST00000382044; ENST00000450115; ENST00000434595 | chr15 | 43702724 | 43702621 | − | TSF |
| 2% | chr15 | 43705532; 43705526; 43705484 | 43705317 | − | ENST00000263801; ENST00000382039; ENST00000382044; ENST00000450115; ENST00000434595 | chr15 | 43702724 | 43702621 | − | TSF |
| 2% | chr15 | 43705532; 43705526; 43705484 | 43705317 | − | ENST00000263801; ENST00000382039; ENST00000382044; ENST00000450115; ENST00000434595 | chr15 | 43702724 | 43702621 | − | TSF |
| 2% | chr19 | 3869015; 3869013 | 3868963 | − | ENST00000262961; ENST00000438164; ENST00000587212; ENST00000586578; ENST00000439086 | chr19 | 3855694 | 3855445 | − | TSF |
| 2% | chr19 | 3869015; 3869013 | 3868963 | − | ENST00000262961; ENST00000438164; ENST00000587212; ENST00000586578; ENST00000439086 | chr19 | 3855694 | 3855445 | − | TSF |
| 2% | chr7 | 127953327 | 127953228 | − | ENST00000223073; ENST00000415472 | chr7 | 127921205 | 127920177 | − | TSF |
| 2% | chr7 | 127953327 | 127953228 | − | ENST00000223073; ENST00000415472 | chr7 | 127921205 | 127920177 | − | TSF |
| 2% | chr1 | 40313763; 40313769; 40313673; 40313734 | 40313658 | − | ENST00000441669; ENST00000462797; ENST00000316891; ENST00000372818; ENST00000537223; ENST00000537440; ENST00000545233 | chr1 | 40313419 | 40313374 | − | TSF |
| 2% | chr1 | 40313763; 40313769; 40313673; 40313734 | 40313658 | − | ENST00000441669; ENST00000462797; ENST00000316891; ENST00000372818; ENST00000537223; ENST00000537440; ENST00000545233 | chr1 | 40313419 | 40313374 | − | TSF |
| 2% | chr1 | 40313763; 40313769; 40313673; 40313734 | 40313658 | − | ENST00000441669; ENST00000462797; ENST00000316891; ENST00000372818; ENST00000537223; ENST00000537440; ENST00000545233 | chr1 | 40313419 | 40313374 | − | TSF |
| 2% | chr1 | 40313763; 40313769; 40313673; 40313734 | 40313658 | − | ENST00000441669; ENST00000462797; ENST00000316891; ENST00000372818; ENST00000537223; ENST00000537440; ENST00000545233 | chr1 | 40313419 | 40313374 | − | TSF |
| 1% | chr15 | 23810930 | 23811234 | + | ENST00000314520; ENST00000568252; ENST00000564592 | chr15 | 23872913 | 23873108 | + | TSF |
| 1% | chr7 | 73731877 | 73731997 | + | ENST00000361545; ENST00000223398; ENST00000395060 | chr7 | 73734711 | 73734869 | + | TSF |
| 1% | chr9 | 125054028 | 125054119 | + | ENST00000297908; ENST00000344641; ENST00000373723; ENST00000373729; ENST00000394315 | chr9 | 125068067 | 125068171 | + | TSF |
| 1% | chr9 | 125054028 | 125054119 | + | ENST00000297908; ENST00000344641; ENST00000373723; ENST00000373729; ENST00000394315 | chr9 | 125068067 | 125068171 | + | TSF |
| 1% | chr9 | 125054028 | 125054119 | + | ENST00000297908; ENST00000344641; ENST00000373723; ENST00000373729; ENST00000394315 | chr9 | 125068067 | 125068171 | + | TSF |
| 1% | chr16 | 15675074 | 15675188 | + | ENST00000300006; ENST00000566490; ENST00000452191; ENST00000564389; ENST00000561692; ENST00000565857 | chr16 | 15676435 | 15676574 | + | TSF |
| 1% | chr16 | 15675074 | 15675188 | + | ENST00000300006; ENST00000566490; ENST00000452191; ENST00000564389; ENST00000561692; ENST00000565857 | chr16 | 15676435 | 15676574 | + | TSF |

TABLE 33-continued

Transcript fusion for Low Grade Glioma (LGG) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 1% | chr16 | 15675074 | 15675188 | + | ENST00000300006; ENST00000566490; ENST00000452191; ENST00000564389; ENST00000561692; ENST00000565857 | chr16 | 15676435 | 15676574 | + | TSF |
| 1% | chr16 | 15675074 | 15675188 | + | ENST00000300006; ENST00000566490; ENST00000452191; ENST00000564389; ENST00000561692; ENST00000565857 | chr16 | 15676435 | 15676574 | + | TSF |
| 1% | chr16 | 15675074 | 15675188 | + | ENST00000300006; ENST00000566490; ENST00000452191; ENST00000564389; ENST00000561692; ENST00000565857 | chr16 | 15676435 | 15676574 | + | TSF |
| 1% | chr5 | 146460699; 146460671 | 146460622 | − | ENST00000504198; ENST00000394409 | chr5 | 146321615 | 146321345 | − | TSF |
| 1% | chr5 | 146460699; 146460671 | 146460622 | − | ENST00000504198; ENST00000394409 | chr5 | 146321615 | 146321345 | − | TSF |
| 1% | chr7 | 4955710 | 4955636 | − | ENST00000406755; ENST00000404774; ENST00000401401 | chr7 | 4953019 | 4952706 | − | TSF |
| 1% | chr19 | 45991775 | 45991729 | − | ENST00000245923; ENST00000430715; ENST00000344680; ENST00000590526 | chr19 | 45990601 | 45990291 | − | TSF |
| 1% | chr19 | 45991775 | 45991729 | − | ENST00000245923; ENST00000430715; ENST00000344680; ENST00000590526 | chr19 | 45990601 | 45990291 | − | TSF |
| 1% | chr19 | 45991775 | 45991729 | − | ENST00000245923; ENST00000430715; ENST00000344680; ENST00000590526 | chr19 | 45990601 | 45990291 | − | TSF |
| 1% | chr19 | 45991775 | 45991729 | − | ENST00000245923; ENST00000430715; ENST00000344680; ENST00000590526 | chr19 | 45990601 | 45990291 | − | TSF |
| 1% | chr13 | 31531010 | 31531166 | + | ENST00000380473 | chr13 | 31534099 | 31534280 | + | TSF |
| 1% | chr19 | 4210262 | 4210369 | + | ENST00000600132; ENST00000318934; ENST00000597689; ENST00000262970 | chr19 | 4210493 | 4210815 | + | TSF |
| 1% | chr19 | 4210262 | 4210369 | + | ENST00000600132; ENST00000318934; ENST00000597689; ENST00000262970 | chr19 | 4210493 | 4210815 | + | TSF |
| 1% | chr19 | 4210262 | 4210369 | + | ENST00000600132; ENST00000318934; ENST00000597689; ENST00000262970 | chr19 | 4210493 | 4210815 | + | TSF |
| 1% | chr6 | 84772612 | 84772711 | + | ENST00000257776 | chr6 | 84849189 | 84849246 | + | TSF |
| 1% | chr10 | 126205749 | 126205840 | + | ENST00000368842 | chr10 | 126251911 | 126252288 | + | TSF |
| 1% | chr3 | 142769781 | 142769891 | + | ENST00000397933; ENST00000473835; ENST00000493598; ENST00000480029; ENST00000467348 | chr3 | 142772077 | 142772316 | + | TSF |
| 1% | chr3 | 142769781 | 142769891 | + | ENST00000397933; ENST00000473835; ENST00000493598; ENST00000480029; ENST00000467348 | chr3 | 142772077 | 142772316 | + | TSF |
| 1% | chr3 | 142769781 | 142769891 | + | ENST00000397933; ENST00000473835; ENST00000493598; ENST00000480029; ENST00000467348 | chr3 | 142772077 | 142772316 | + | TSF |
| 1% | chr3 | 142769781 | 142769891 | + | ENST00000397933; ENST00000473835; ENST00000493598; ENST00000480029; ENST00000467348 | chr3 | 142772077 | 142772316 | + | TSF |
| 1% | chr3 | 142769781 | 142769891 | + | ENST00000397933; ENST00000473835; ENST00000493598; ENST00000480029; ENST00000467348 | chr3 | 142772077 | 142772316 | + | TSF |
| 1% | chr16 | 29913136; 29912293 | 29913241 | + | ENST00000563177; ENST00000483405; ENST00000308748; ENST00000414952; ENST00000566693 | chr16 | 29930852 | 29930945 | + | TSF |
| 1% | chr16 | 29913136; 29912293 | 29913241 | + | ENST00000563177; ENST00000483405; ENST00000308748; ENST00000414952; ENST00000566693 | chr16 | 29930852 | 29930945 | + | TSF |
| 1% | chr7 | 121513554 | 121513611 | + | ENST00000393386; ENST00000449182 | chr7 | 121549265 | 121550027 | + | TSF |
| 1% | chr18 | 54318306 | 54318248 | − | ENST00000587613 | chr18 | 54314766 | 54314664 | − | TSF |
| 1% | chr5 | 151052777 | 151052751 | − | ENST00000231061; ENST00000539687; ENST00000522348 | chr5 | 150931801 | 150931704 | − | TSF |
| 1% | chr1 | 156396664 | 156396590 | − | ENST00000400991; ENST00000310027; ENST00000357975 | chr1 | 156374431 | 156374430 |  | TSF |
| 1% | chr1 | 156396664 | 156396590 | − | ENST00000400991; ENST00000310027; ENST00000357975 | chr1 | 156374431 | 156374430 | − | TSF |
| 1% | chr1 | 156396664 | 156396590 | − | ENST00000400991; ENST00000310027; ENST00000357975 | chr1 | 156374431 | 156374430 | − | TSF |
| 1% | chr14 | 51446267 | 51446105 | − | ENST00000298355; ENST00000338969 | chr14 | 51433184 | 51433141 | − | TSF |
| 1% | chr14 | 51446267 | 51446105 | − | ENST00000298355; ENST00000338969 | chr14 | 51433184 | 51433141 | − | TSF |
| 1% | chr12 | 58024115 | 58023935 | − | ENST00000341156; ENST00000418555; ENST00000552798; ENST00000549391; ENST00000449184; ENST00000550764; ENST00000552350; ENST00000548888 | chr12 | 58023225 | 58023117 | − | TSF |
| 1% | chr12 | 58024115 | 58023935 | − | ENST00000341156; ENST00000418555; ENST00000552798; ENST00000549391; ENST00000449184; ENST00000550764; ENST00000552350; ENST00000548888 | chr12 | 58023225 | 58023117 | − | TSF |
| 1% | chr12 | 58024115 | 58023935 | − | ENST00000341156; ENST00000418555; ENST00000552798; ENST00000549391; ENST00000449184; ENST00000550764; | chr12 | 58023225 | 58023117 | − | TSF |

TABLE 33-continued

Transcript fusion for Low Grade Glioma (LGG) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 1% | chr12 | 58024115 | 58023935 | − | ENST00000552350; ENST00000548888 ENST00000341156; ENST00000418555; ENST00000552798; ENST00000549391; ENST00000449184; ENST00000550764; ENST00000552350; ENST00000548888 | chr12 | 58023225 | 58023117 | − | TSF |
| 1% | chr11 | 17429000 | 17428901 | − | ENST00000389817; ENST00000302539 | chr11 | 17428756 | 17428716 | − | TSF |
| 1% | chr11 | 17429000 | 17428901 | − | ENST00000389817; ENST00000302539 | chr11 | 17428756 | 17428716 | − | TSF |
| 1% | chr1 | 226825451 | 226825380 | − | ENST00000272117; ENST00000429204 | chr1 | 226799389 | 226799188 | | TSF |
| 1% | chr8 | 27461912 | 27461808 | − | ENST00000316403; ENST00000546343; ENST00000560366; ENST00000405140; ENST00000523500; ENST00000522098 | chr8 | 27458611 | 27458570 | − | TSF |
| 1% | chr8 | 27461912 | 27461808 | − | ENST00000316403; ENST00000546343; ENST00000560366; ENST00000405140; ENST00000523500; ENST00000522098 | chr8 | 27458611 | 27458570 | − | TSF |
| 1% | chr8 | 27461912 | 27461808 | | ENST00000316403; ENST00000546343; ENST00000560366; ENST00000405140; ENST00000523500; ENST00000522098 | chr8 | 27458611 | 27458570 | − | TSF |
| 1% | chr8 | 27461912 | 27461808 | − | ENST00000316403; ENST00000546343; ENST00000560366; ENST00000405140; ENST00000523500; ENST00000522098 | chr8 | 27458611 | 27458570 | − | TSF |
| 1% | chr20 | 62070073 | 62069978 | − | ENST00000357249; ENST00000359125; ENST00000354587; ENST00000359689; ENST00000360480; ENST00000370224; ENST00000344462; ENST00000344425 | chr20 | 62066140 | 62065806 | − | TSF |
| 1% | chr17 | 26938813 | 26938786 | | ENST00000494272; ENST00000301037 | chr17 | 26932233 | 26930495 | − | TSF |
| 1% | chr17 | 26938813 | 26938786 | − | ENST00000494272; ENST00000301037 | chr17 | 26932233 | 26930495 | − | TSF |

TABLE 34

Transcript fusion for Low Grade Glioma (LGG) Coordinates of the fusion sequences for which the donor is the TE.

| 1' | 2' | 3' | 4' | 5' | 6' | 7' | 8' | 9' | 10' | 11' |
|---|---|---|---|---|---|---|---|---|---|---|
| 100% | chr17 | 42989790 | 42989722 | − | chr17 | 42989165 | 42989040; 42989042; 42989065 | − | ENST00000253408; ENST00000435360; ENST00000586793; ENST00000587997; ENST00000588957; ENST00000588316 | TAF |
| 100% | chr17 | 42989790 | 42989722 | − | chr17 | 42989165 | 42989040; 42989042; 42989065 | − | ENST00000253408; ENST00000435360; ENST00000586793; ENST00000587997; ENST00000588957; ENST00000588316 | TAF |
| 100% | chr17 | 42989790 | 42989722 | − | chr17 | 42989165 | 42989040; 42989042; 42989065 | − | ENST00000253408; ENST00000435360; ENST00000586793; ENST00000587997; ENST00000588957; ENST00000588316 | TAF |
| 100% | chr17 | 42989790 | 42989722 | − | chr17 | 42989165 | 42989040; 42989042; 42989065 | − | ENST00000253408; ENST00000435360; ENST00000586793; ENST00000587997; ENST00000588957; ENST00000588316 | TAF |
| 100% | chr17 | 42989790 | 42989722 | − | chr17 | 42989165 | 42989040; 42989042; 42989065 | − | ENST00000253408; ENST00000435360; ENST00000586793; ENST00000587997; ENST00000588957; ENST00000588316 | TAF |
| 100% | chr17 | 42989790 | 42989722 | − | chr17 | 42989165 | 42989040; 42989042; 42989065 | − | ENST00000253408; ENST00000435360; ENST00000586793; ENST00000587997; ENST00000588957; ENST00000588316 | TAF |
| 93% | chr19 | 54930702 | 54930716 | + | chr19 | 54932451 | 54932562 | + | ENST00000423529; ENST00000301194; ENST00000376530; ENST00000445095; ENST00000391739; ENST00000376531 | TAF |
| 93% | chr19 | 54930702 | 54930716 | + | chr19 | 54932451 | 54932562 | + | ENST00000423529; ENST00000301194; ENST00000376530; ENST00000445095; ENST00000391739; ENST00000376531 | TAF |
| 93% | chr19 | 54930702 | 54930716 | + | chr19 | 54932451 | 54932562 | + | ENST00000423529; ENST00000301194; ENST00000376530; ENST00000445095; ENST00000391739; ENST00000376531 | TAF |
| 93% | chr19 | 54930702 | 54930716 | + | chr19 | 54932451 | 54932562 | + | ENST00000423529; ENST00000301194; ENST00000376530; ENST00000445095; ENST00000391739; ENST00000376531 | TAF |
| 93% | chr19 | 54930702 | 54930716 | + | chr19 | 54932451 | 54932562 | + | ENST00000423529; ENST00000301194; ENST00000376530; ENST00000445095; ENST00000391739; ENST00000376531 | TAF |
| 93% | chr19 | 54930702 | 54930716 | + | chr19 | 54932451 | 54932562 | + | ENST00000423529; ENST00000301194; ENST00000376530; ENST00000445095; ENST00000391739; ENST00000376531 | TAF |
| 88% | chr1 | 156374721 | 156374537 | − | chr1 | 156374393 | 156374318; 156374346 | − | ENST00000409991; ENST00000368242; ENST00000368243; ENST00000310027; ENST00000357975 | TAF |
| 88% | chr1 | 156374721 | 156374537 | − | chr1 | 156374393 | 156374318; 156374346 | − | ENST00000400991; ENST00000368242; ENST00000310027; ENST00000357975 | TAF |
| 87% | chr4 | 174310858 | 174310746 | − | chr4 | 174309546 | 174309492 | − | ENST00000296506 | TAF |
| 70% | chr2 | 230409549 | 230409481 | − | chr2 | 230377652 | 230377499 | − | ENST00000341772 | TAF |
| 65% | chr1 | 151683281 | 151683172 | − | chr1 | 151682267 | 151682219 | − | ENST00000290585; ENST00000290583 | TAF |
| 65% | chr1 | 151683281 | 151683172 | − | chr1 | 151682267 | 151682219 | − | ENST00000290585; ENST00000290583 | TAF |
| 65% | chr1 | 151683281 | 151683172 | − | chr1 | 151682267 | 151682219 | − | ENST00000290585; ENST00000290583; ENST00000420342 | TAF |
| 65% | chr1 | 151683281 | 151683172 | − | chr1 | 151682267 | 151682219 | − | ENST00000290585; ENST00000290583; ENST00000420342 | TAF |
| 63% | chrX | 13804185 | 13804092 | − | chrX | 13803927 | 13803741 | − | ENST00000316715; ENST00000454189; ENST00000493677; ENST00000355135; ENST00000356942; ENST00000475307 | TAF |
| 63% | chrX | 13804185 | 13804092 | − | chrX | 13803927 | 13803741 | − | ENST00000316715; ENST00000454189; ENST00000493677; ENST00000355135; ENST00000356942; ENST00000475307 | TAF |
| 63% | chrX | 13804185 | 13804092 | − | chrX | 13803927 | 13803741 | − | ENST00000316715; ENST00000454189; ENST00000493677; ENST00000355135; ENST00000356942; ENST00000475307 | TAF |
| 61% | chr3 | 39544232 | 39544405 | + | chr3 | 39554874 | 39554913; 39554874 | + | ENST00000428261; ENST00000415443; ENST00000447324; ENST00000383754; ENST00000311042; ENST00000452959; ENST00000396228; ENST00000442631 | TAF |
| 61% | chr3 | 39544232 | 39544405 | + | chr3 | 39554874 | 39554913; 39554874 | + | ENST00000428261; ENST00000415443; ENST00000447324; ENST00000383754; ENST00000311042; ENST00000452959; ENST00000396228; ENST00000442631 | TAF |
| 60% | chr16 | 19886067 | 19886054 | − | chr16 | 19884168 | 19883138 | − | ENST00000537135 | TAF |
| 56% | chr20 | 43919547 | 43919514 | − | chr20 | 43882374 | 43882216 | − | ENST00000338380 | TAF |
| 47% | chrX | 13907696 | 13907571 | − | chrX | 13803927 | 13803741 | − | ENST00000316715; ENST00000454189; ENST00000493677; ENST00000355135; ENST00000356942; ENST00000475307 | TAF |
| 47% | chrX | 13907696 | 13907571 | − | chrX | 13803927 | 13803741 | − | ENST00000316715; ENST00000454189; ENST00000493677; ENST00000355135; ENST00000356942; ENST00000475307 | TAF |
| 47% | chrX | 13907696 | 13907571 | − | chrX | 13803927 | 13803741 | − | ENST00000316715; ENST00000454189; ENST00000493677; ENST00000355135; ENST00000356942; ENST00000475307 | TAF |
| 46% | chr7 | 150938296 | 150938250 | − | chr7 | 150937608 | 150937511 | − | ENST00000262188; ENST00000392811; ENST00000356800 | TAF |
| 42% | chr17 | 42395269 | 42395306 | + | chr17 | 42395464 | 42395606 | + | ENST00000426726 | TAF |

TABLE 34-continued

Transcript fusion for Low Grade Glioma (LGG) Coordinates of the fusion sequences for which the donor is the TE.

| 1' | 2' | 3' | 4' | 5' | 6' | 7' | 8' | 9' | 10' | 11' |
|---|---|---|---|---|---|---|---|---|---|---|
| 41% | chr12 | 21478885 | 21477528 | – | chr12 | 21471857 | 21471716; 21471765 | – | ENST00000307378; ENST00000453443; ENST00000544020; ENST00000421294; ENST00000452078; ENST00000450590; ENST00000435179; ENST00000390670; ENST00000445053; ENST00000422327; ENST00000421287 | TAF |
| 41% | chr12 | 21478885 | 21477528 | – | chr12 | 21471857 | 21471716; 21471765 | – | ENST00000307378; ENST00000453443; ENST00000544020; ENST00000421294; ENST00000452078; ENST00000450590; ENST00000435179; ENST00000390670; ENST00000445053; ENST00000422327; ENST00000421287 | TAF |
| 41% | chr12 | 21478885 | 21477528 | – | chr12 | 21471857 | 21471716; 21471765 | – | ENST00000307378; ENST00000453443; ENST00000544020; ENST00000421294; ENST00000452078; ENST00000450590; ENST00000435179; ENST00000390670; ENST00000445053; ENST00000422327; ENST00000421287 | TAF |
| 41% | chr12 | 21478885 | 21477528 | – | chr12 | 21471857 | 21471716; 21471765 | – | ENST00000307378; ENST00000453443; ENST00000544020; ENST00000421294; ENST00000452078; ENST00000450590; ENST00000435179; ENST00000390670; ENST00000445053; ENST00000422327; ENST00000421287 | TAF |
| 41% | chr12 | 21478885 | 21477528 | – | chr12 | 21471857 | 21471716; 21471765 | – | ENST00000307378; ENST00000453443; ENST00000544020; ENST00000421294; ENST00000452078; ENST00000450590; ENST00000435179; ENST00000390670; ENST00000445053; ENST00000422327; ENST00000421287 | TAF |
| 41% | chr12 | 21478885 | 21477528 | – | chr12 | 21471857 | 21471716; 21471765 | – | ENST00000307378; ENST00000453443; ENST00000544020; ENST00000421294; ENST00000452078; ENST00000450590; ENST00000435179; ENST00000390670; ENST00000445053; ENST00000422327; ENST00000421287 | TAF |
| 41% | chr12 | 21478885 | 21477528 | – | chr12 | 21471857 | 21471716; 21471765 | – | ENST00000307378; ENST00000453443; ENST00000544020; ENST00000421294; ENST00000452078; ENST00000450590; ENST00000435179; ENST00000390670; ENST00000445053; ENST00000422327; ENST00000421287 | TAF |
| 41% | chr12 | 21478885 | 21477528 | – | chr12 | 21471857 | 21471716; 21471765 | – | ENST00000307378; ENST00000453443; ENST00000544020; ENST00000421294; ENST00000452078; ENST00000450590; ENST00000435179; ENST00000390670; ENST00000445053; ENST00000422327; ENST00000421287 | TAF |
| 41% | chr12 | 21478885 | 21477528 | – | chr12 | 21471857 | 21471716; 21471765 | – | ENST00000307378; ENST00000453443; ENST00000544020; ENST00000421294; ENST00000452078; ENST00000450590; ENST00000435179; ENST00000390670; ENST00000445053; ENST00000422327; ENST00000421287 | TAF |
| 40% | chr16 | 75685621 | 75685636 | + | chr16 | 75688171 | 75688295; 75688183 | + | ENST00000300086; ENST00000569234 | TAF |
| 40% | chr16 | 75685621 | 75685636 | + | chr16 | 75688171 | 75688295; 75688183 | + | ENST00000300086; ENST00000569234 | TAF |
| 40% | chr6 | 3247564 | 3247553 | – | chr6 | 3226903 | 3226795 | – | ENST00000259818 | TAF |
| 40% | chr4 | 55109748 | 55109839 | + | chr4 | 55124924 | 55124984 | + | ENST00000512143 | TAF |
| 40% | chr4 | 55096091 | 55096106 | + | chr4 | 55124924 | 55124984 | + | ENST00000512143 | TAF |
| 39% | chr2 | 65243329 | 65243368 | + | chr2 | 65243574 | 65243807 | + | ENST00000234256 | TSF |
| 39% | chr16 | 70714570 | 70714506 | – | chr16 | 70713958 | 70713874 | – | ENST00000338779 | TSF |
| 38% | chr4 | 151135833 | 151135882 | + | chr4 | 151141858 | 151141930 | + | ENST00000296550; ENST00000411937; ENST00000506325; ENST00000302176 | TSF |
| 38% | chr4 | 151135833 | 151135882 | + | chr4 | 151141858 | 151141930 | + | ENST00000296550; ENST00000411937; ENST00000506325; ENST00000302176 | TSF |
| 33% | chr14 | 21515206 | 21515025 | – | chr14 | 21491480 | 21491400 | – | ENST00000336798; ENST00000339394 | TAF |
| 32% | chr1 | 31346734 | 31346686 | – | chr1 | 31346224 | 31346058 | – | ENST00000403829 | TAF |
| 30% | chr19 | 13127972 | 13127986 | + | chr19 | 13135835 | 13136366; 13135976; 13136309 | + | ENST00000591028; ENST00000397661; ENST00000592199; ENST00000587760; ENST00000587260; ENST00000358552 | TAF |
| 30% | chr19 | 13127972 | 13127986 | + | chr19 | 13135835 | 13136366; 13135976; 13136309 | + | ENST00000591028; ENST00000397661; ENST00000592199; ENST00000587760; ENST00000587260; ENST00000358552 | ENST00000360105; ENST00000586797; TAF |
| 30% | chr19 | 13127972 | 13127986 | + | chr19 | 13135835 | 13136366; 13135976; 13136309 | + | ENST00000591028; ENST00000397661; ENST00000592199; ENST00000587760; ENST00000587260; ENST00000358552 | ENST00000360105; ENST00000586797; TAF |
| 30% | chr19 | 13127972 | 13127986 | + | chr19 | 13135835 | 13136366; 13135976; 13136309 | + | ENST00000591028; ENST00000397661; ENST00000592199; ENST00000587760; ENST00000587260; ENST00000358552 | ENST00000360105; ENST00000586797; TAF |
| 30% | chr19 | 13127972 | 13127986 | + | chr19 | 13135835 | 13136366; 13135976; 13136309 | + | ENST00000591028; ENST00000397661; ENST00000592199; ENST00000587760; ENST00000587260; ENST00000358552 | ENST00000360105; ENST00000586797; TAF |

TABLE 34-continued

Transcript fusion for Low Grade Glioma (LGG) Coordinates of the fusion sequences for which the donor is the TE.

| 1' | 2' | 3' | 4' | 5' | 6' | 7' | 8' | 9' | 10' | 11' |
|---|---|---|---|---|---|---|---|---|---|---|
| 30% | chr19 | 13127972 | 13127986 | + | chr19 | 13135835 | 13136309 13136366; 13136309 | + | ENST00000397661; ENST00000592199; ENST00000587760; ENST00000585575; ENST00000386797; ENST00000591028; ENST00000587260; ENST00000358552 | TAF |
| 30% | chr7 | 102208027 | 102207972 | − | chr7 | 102207530 | 102207498; 102207444 | − | ENST00000379340; ENST00000486319; ENST00000508848; ENST00000513506; ENST00000514917; ENST00000507355; ENST00000608621; ENST00000511313 | TSF |
| 30% | chr7 | 102208027 | 102207972 | − | chr7 | 102207530 | 102207498; 102207444 | − | ENST00000379340; ENST00000486319; ENST00000508848; ENST00000513506; ENST00000514917; ENST00000507355; ENST00000608621; ENST00000511313 | TSF |
| 30% | chr7 | 102208027 | 102207972 | − | chr7 | 102207530 | 102207498; 102207444; 102207440 | − | ENST00000379340; ENST00000486319; ENST00000508848; ENST00000513506; ENST00000514917; ENST00000507355; ENST00000608621; ENST00000511313 | TSF |
| 30% | chr7 | 102208027 | 102207972 | − | chr7 | 102207530 | 102207498; 102207444; 102207440 | − | ENST00000379340; ENST00000486319; ENST00000508848; ENST00000513506; ENST00000514917; ENST00000507355; ENST00000608621; ENST00000511313 | TSF |
| 30% | chr7 | 102208027 | 102207972 | − | chr7 | 102207530 | 102207498; 102207444; 102207440 | − | ENST00000379340; ENST00000486319; ENST00000508848; ENST00000513506; ENST00000514917; ENST00000507355; ENST00000608621; ENST00000511313 | TSF |
| 29% | chr19 | 18653186 | 18653179 | − | chr19 | 18652805 | 18652489 | − | ENST00000453489 | TAF |
| 29% | chr20 | 62066436 | 62065933 | − | chr20 | 62065256 | 62065162; 62065098 | − | ENST00000357249; ENST00000359125; ENST00000344462; ENST00000344425 | TSF |
| 29% | chr20 | 62066436 | 62065933 | − | chr20 | 62065256 | 62065162; 62065098 | − | ENST00000357249; ENST00000359125; ENST00000344462; ENST00000344425 | TSF |
| 29% | chr20 | 62066436 | 62065933 | − | chr20 | 62065256 | 62065162; 62065098 | − | ENST00000357249; ENST00000359125; ENST00000344462; ENST00000344425 | TSF |
| 29% | chr20 | 62066436 | 62065933 | − | chr20 | 62065256 | 62065162; 62065098 | − | ENST00000357249; ENST00000359125; ENST00000344462; ENST00000344425 | TSF |
| 29% | chr20 | 62066436 | 62065933 | − | chr20 | 62065256 | 62065162; 62065098 | − | ENST00000357249; ENST00000359125; ENST00000344462; ENST00000344425 | TSF |
| 29% | chr20 | 62066436 | 62065933 | − | chr20 | 62065256 | 62065162; 62065098 | − | ENST00000357249; ENST00000359125; ENST00000344462; ENST00000344425 | TSF |
| 29% | chr20 | 62066436 | 62065933 | − | chr20 | 62065256 | 62065162; 62065098 | − | ENST00000357249; ENST00000359125; ENST00000344462; ENST00000344425 | TSF |
| 28% | chr11 | 113094670 | 113094766 | + | chr11 | 113102367 | 113102517 | + | ENST00000533760; ENST00000524665; ENST00000534015; ENST00000401611; ENST00000316851 | TAF |
| 28% | chr11 | 113094670 | 113094766 | + | chr11 | 113102367 | 113102517 | + | ENST00000533760; ENST00000524665; ENST00000534015; ENST00000401611; ENST00000316851 | TAF |
| 28% | chr11 | 113094670 | 113094766 | + | chr11 | 113102367 | 113102517 | + | ENST00000533760; ENST00000524665; ENST00000534015; ENST00000401611; ENST00000316851 | TAF |
| 28% | chr11 | 113094670 | 113094766 | + | chr11 | 113102367 | 113102517 | + | ENST00000533760; ENST00000524665; ENST00000534015; ENST00000401611; ENST00000316851 | TAF |
| 28% | chr11 | 113094670 | 113094766 | + | chr11 | 113102367 | 113102517 | + | ENST00000533760; ENST00000524665; ENST00000534015; ENST00000401611; ENST00000316851 | TAF |
| 27% | chr2 | 79731998 | 79732308 | + | chr2 | 79878678 | 79878784 | + | ENST00000361291 | TAF |
| 27% | chr5 | 92920103 | 92920128 | + | chr5 | 92921107 | 92921192 | + | ENST00000327111 | TSF |
| 26% | chr20 | 25841506 | 25840376 | − | chr20 | 25755948 | 25755497; | − | ENST00000376403; ENST00000584071 | TSF |
| 26% | chr20 | 25841506 | 25840376 | − | chr20 | 25755948 | 25755497; | − | ENST00000376403; ENST00000584071 | TSF |
| 25% | chr7 | 74158449 | 74158566 | + | chr7 | 74159097 | 74159280 | + | ENST00000324896; ENST00000346152; ENST00000353920; ENST00000416070 | TAF |

TABLE 34-continued

Transcript fusion for Low Grade Glioma (LGG) Coordinates of the fusion sequences for which the donor is the TE.

| 1' | 2' | 3' | 4' | 5' | 6' | 7' | 8' | 9' | 10' | 11' |
|---|---|---|---|---|---|---|---|---|---|---|
| 25% | chr7 | 102307107 | 102307052 | – | chr7 | 102306610 | 102306578; 102306524 | – | ENST00000591000; ENST00000476151; ENST00000333432 | TSF |
| 25% | chr7 | 102307107 | 102307052 | – | chr7 | 102306610 | 102306578; 102306524 | – | ENST00000591000; ENST00000476151; ENST00000333432 | TSF |
| 25% | chr20 | 25843181 | 25842039 | – | chr20 | 25755948 | 25755497; 25755659 | – | ENST00000376403; ENST00000584071 | TSF |
| 25% | chr20 | 25843181 | 25842039 | – | chr20 | 25755948 | 25755497; 25755659 | – | ENST00000376403; ENST00000584071 | TSF |
| 24% | chr11 | 73367079 | 73367447 | + | chr11 | 73371798 | 73371897; 73371801; 73371811; 73371815; 73371918; 73371840 | + | ENST00000354190; ENST00000546251; ENST00000542389; ENST00000540431 | TAF |
| 24% | chr11 | 73367079 | 73367447 | + | chr11 | 73371798 | 73371897; 73371801; 73371811; 73371815; 73371918; 73371840 | + | ENST00000354190; ENST00000546251; ENST00000542389; ENST00000540431 | TAF |
| 24% | chr11 | 73367079 | 73367447 | + | chr11 | 73371798 | 73371897; 73371801; 73371811; 73371815; 73371918; 73371840 | + | ENST00000354190; ENST00000546251; ENST00000542389; ENST00000540431 | TAF |
| 24% | chr11 | 73367079 | 73367447 | + | chr11 | 73371798 | 73371897; 73371801; 73371811; 73371815; 73371918; 73371840 | + | ENST00000354190; ENST00000546251; ENST00000542389; ENST00000540431 | TAF |
| 24% | chr11 | 73367079 | 73367447 | + | chr11 | 73371798 | 73371897; 73371801; 73371811; 73371815; 73371918; 73371840 | + | ENST00000354190; ENST00000546251; ENST00000542389; ENST00000540431 | TAF |
| 24% | chr11 | 73367079 | 73367447 | + | chr11 | 73371798 | 73371897; 73371801; 73371811; 73371815; 73371918; 73371840 | + | ENST00000354190; ENST00000546251; ENST00000542389; ENST00000540431 | TAF |
| 24% | chr11 | 73367079 | 73367447 | + | chr11 | 73371798 | 73371897; 73371801; 73371811; 73371815; 73371918; 73371840 | + | ENST00000354190; ENST00000546251; ENST00000542389; ENST00000540431 | TAF |

Note: The 10' column for rows with TAF additionally includes: ENST00000398492; ENST00000535582; ENST00000540431 and ENST00000398494; ENST00000543524; ENST00000272214; ENST00000538227; ENST00000543085; ENST00000541597; ENST00000539157; ENST00000535129

TABLE 34-continued

Transcript fusion for Low Grade Glioma (LGG) Coordinates of the fusion sequences for which the donor is the TE.

| 1' | 2' | 3' | 4' | 5' | 6' | 7' | 8' | 9' | 10' | 11' |
|---|---|---|---|---|---|---|---|---|---|---|
| 24% | chr11 | 73367079 | 73367447 | + | chr11 | 73371798 | 73371840 73371897; 73371801; 73371811; 73371815; 73371918; 73371840 | + | ENST00000354190; ENST00000398492; ENST00000227214; ENST00000398494; ENST00000543085; ENST00000539157; ENST00000546251; ENST00000533582; ENST00000538227; ENST00000543524; ENST00000541597; ENST00000535129; ENST00000542389; ENST00000540431 | TAF |
| 24% | chr11 | 73367079 | 73367447 | + | chr11 | 73371798 | 73371840 73371897; 73371801; 73371811; 73371815; 73371918; 73371840 | + | ENST00000354190; ENST00000398492; ENST00000227214; ENST00000398494; ENST00000543085; ENST00000539157; ENST00000546251; ENST00000533582; ENST00000538227; ENST00000543524; ENST00000541597; ENST00000535129; ENST00000542389; ENST00000540431 | TAF |
| 23% | chr19 | 41816860 | 41816920 | + | chr19 | 41822289 | 41822744 | + | ENST00000269967 | TAF |
| 23% | chr1 | 125351332 | 125351294 | − | chr1 | 125333466 | 125333380 | − | ENST00000278919; ENST00000577924 | TAF |
| 23% | chr1 | 125351332 | 125351294 | − | chr1 | 125333466 | 125333380 | − | ENST00000278919; ENST00000577924 | TAF |
| 23% | chr12 | 55350849 | 55350538 | − | chr12 | 55344174 | 55343992; 55344114 | − | ENST00000528240; ENST00000532757 | TAF |
| 23% | chr12 | 55350849 | 55350538 | − | chr12 | 55344174 | 55343992; 55344114 | − | ENST00000528240; ENST00000532757 | TAF |
| 23% | chr20 | 25844836 | 25843696 | − | chr20 | 25755948 | 25755497; 25755659 | − | ENST00000376403; ENST00000584071 | TSF |
| 23% | chr20 | 25844836 | 25843696 | − | chr20 | 25755948 | 25755497; 25755659 | − | ENST00000376403; ENST00000584071 | TSF |
| 22% | chr9 | 131002678 | 131002811 | + | chr9 | 131004511 | 131004624 | + | ENST00000475805; ENST00000341179; ENST00000393594; ENST00000486160 | TAF |
| 22% | chr9 | 131002678 | 131002811 | + | chr9 | 131004511 | 131004624 | + | ENST00000475805; ENST00000341179; ENST00000393594; ENST00000486160 | TAF |
| 22% | chr4 | 166400036 | 166400127 | + | chr4 | 166403394 | 166403474; 166403511; 166403499 | + | ENST00000513982; ENST00000402744; ENST00000431967; ENST00000511992 | TAF |
| 22% | chr4 | 166400036 | 166400127 | + | chr4 | 166403394 | 166403474; 166403511; 166403499 | + | ENST00000513982; ENST00000402744; ENST00000431967; ENST00000511992 | TAF |
| 22% | chr4 | 166400036 | 166400127 | + | chr4 | 166403394 | 166403474; 166403511; 166403499 | + | ENST00000513982; ENST00000402744; ENST00000431967; ENST00000511992 | TAF |
| 22% | chr4 | 166400036 | 166400127 | + | chr4 | 166403394 | 166403474; 166403511; 166403499 | + | ENST00000513982; ENST00000402744; ENST00000431967; ENST00000511992 | TAF |
| 22% | chr7 | 149571552 | 149571710 | + | chr7 | 149572687 | 149572734 | + | ENST00000421974; ENST00000456496; ENST00000464683; ENST00000606024; ENST00000471877; ENST00000464662; ENST00000425642 | TAF |
| 22% | chr7 | 149571552 | 149571710 | + | chr7 | 149572687 | 149572734 | + | ENST00000421974; ENST00000456496; ENST00000464683; ENST00000606024; ENST00000471877; ENST00000464662; ENST00000425642 | TAF |
| 22% | chr7 | 149571552 | 149571710 | + | chr7 | 149572687 | 149572734 | + | ENST00000421974; ENST00000456496; ENST00000464683; ENST00000606024; ENST00000471877; ENST00000464662; ENST00000425642 | TAF |
| 22% | chr7 | 149571552 | 149571710 | + | chr7 | 149572687 | 149572734 | + | ENST00000421974; ENST00000456496; ENST00000464683; ENST00000606024; ENST00000471877; ENST00000464662; ENST00000425642 | TAF |
| 22% | chr17 | 45908775 | 45908677 | − | chr17 | 45906036 | 45905867 | − | ENST00000351111; ENST00000290208; ENST00000414011 | TAF |
| 22% | chr16 | 29915789 | 29915910 | + | chr16 | 29916173 | 29916286 | + | ENST00000563177; ENST00000483405; ENST00000308748; ENST00000414952; ENST00000566693 | TAF |
| 22% | chr16 | 29915789 | 29915910 | + | chr16 | 29916173 | 29916286 | + | ENST00000563177; ENST00000483405; ENST00000308748; ENST00000414952; ENST00000566693 | TAF |

TABLE 34-continued

Transcript fusion for Low Grade Glioma (LGG) Coordinates of the fusion sequences for which the donor is the TE.

| 1' | 2' | 3' | 4' | 5' | 6' | 7' | 8' | 9' | 10' | 11' |
|---|---|---|---|---|---|---|---|---|---|---|
| 21% | chr9 | 131189761 | 131190058 | + | chr9 | 131190581 | 131190700; 131190702 | + | ENST00000372842; ENST00000420512; ENST00000372838 | TAF |
| 21% | chr9 | 131189761 | 131190058 | + | chr9 | 131190581 | 131190700; 131190702 | + | ENST00000372842; ENST00000420512; ENST00000372838 | TAF |
| 21% | chr17 | 21476521 | 21476490 | − | chr17 | 21438799 | 21438561; 21438772 | − | ENST00000391411; ENST00000412778 | TAF |
| 21% | chr17 | 21476521 | 21476490 | − | chr17 | 21438799 | 21438561; 21438772 | − | ENST00000391411; ENST00000412778 | TAF |
| 21% | chr3 | 33550559 | 33550447 | − | chr3 | 33543260 | 33543144 | − | ENST00000468888; ENST00000399362; ENST00000359576; ENST00000480013; ENST00000461133; ENST00000487553 | TAF |
| 20% | chr16 | 56616788 | 56616837 | + | chr16 | 56623782 | 56623847; 56624029 | + | ENST00000561640; ENST00000565838; ENST00000200691; ENST00000570176 | TAF |
| 20% | chr16 | 56616788 | 56616837 | + | chr16 | 56623782 | 56623847; 56624029 | + | ENST00000561640; ENST00000565838; ENST00000200691; ENST00000570176 | TAF |
| 20% | chr3 | 9368437 | 9367694 | − | chr3 | 9166601 | 9166409 | − | ENST00000383836; ENST00000360413 | TAF |
| 20% | chr3 | 9368437 | 9367694 | − | chr3 | 9166601 | 9166409 | − | ENST00000383836; ENST00000360413 | TAF |
| 20% | chr1 | 155839652 | 155839730 | + | chr1 | 155850291 | 155850414 | + | ENST00000368324 | TAF |
| 19% | chr14 | 93425387 | 93425269 | − | chr14 | 93424711 | 93424546; 93424579; 93424616 | − | ENST00000267615; ENST00000354313; ENST00000555495; ENST00000556603; ENST00000554999; ENST00000556185; ENST00000555553 | TAF |
| 19% | chr14 | 93425387 | 93425269 | − | chr14 | 93424711 | 93424546; 93424579; 93424616 | − | ENST00000267615; ENST00000354313; ENST00000555495; ENST00000556603; ENST00000554999; ENST00000556185; ENST00000555553 | TAF |
| 19% | chr14 | 93425387 | 93425269 | − | chr14 | 93424711 | 93424546; 93424579; 93424616 | − | ENST00000267615; ENST00000354313; ENST00000555495; ENST00000556603; ENST00000554999; ENST00000556185; ENST00000555553 | TAF |
| 19% | chr14 | 93425387 | 93425269 | − | chr14 | 93424711 | 93424546; 93424579; 93424616 | − | ENST00000267615; ENST00000354313; ENST00000555495; ENST00000556603; ENST00000554999; ENST00000556185; ENST00000555553 | TAF |
| 19% | chr1 | 246581335 | 246580598 | − | chr1 | 246518396 | 246518333 | − | ENST00000388985; ENST00000403792 | TSF |
| 19% | chr1 | 246581335 | 246580598 | − | chr1 | 246518396 | 246518333 | − | ENST00000388985; ENST00000403792 | TSF |
| 18% | chr9 | 130569975 | 130570054 | + | chr9 | 130570513 | 130570590; 130570580 | + | ENST00000373247; ENST00000373245; ENST00000373228; ENST00000373225; ENST00000431857 | TAF |
| 18% | chr9 | 130569975 | 130570054 | + | chr9 | 130570513 | 130570590; 130570580 | + | ENST00000373247; ENST00000373245; ENST00000373228; ENST00000373225; ENST00000431857 | TAF |
| 18% | chr9 | 130569975 | 130570054 | + | chr9 | 130570513 | 130570590; 130570580 | + | ENST00000373247; ENST00000373245; ENST00000373228; ENST00000373225; ENST00000431857 | TAF |
| 18% | chr9 | 130569975 | 130570054 | + | chr9 | 130570513 | 130570590; 130570580 | + | ENST00000373247; ENST00000373245; ENST00000373228; ENST00000373225; ENST00000431857 | TAF |
| 17% | chr10 | 101952336 | 101952216 | − | chr10 | 101950725 | 101950626 | − | ENST00000370397; ENST00000251412 | TAF |
| 17% | chr17 | 40813377 | 40813974 | + | chr17 | 40814991 | 40815070 | + | ENST00000367534; ENST00000359856; ENST00000294742 | TAF |
| 17% | chr1 | 183600359 | 183599874 | − | chr1 | 183599772 | 183599596 | − | ENST00000367534; ENST00000359856; ENST00000294742 | TAF |
| 17% | chr1 | 183600359 | 183599874 | − | chr1 | 183599772 | 183599596 | − | ENST00000367534; ENST00000359856; ENST00000294742 | TAF |
| 17% | chr17 | 42991959 | 42991849 | − | chr17 | 42991456 | 42991396 | − | ENST00000253408; ENST00000435360; ENST00000586793; ENST00000592320; ENST00000588316; ENST00000588037 | TSF |
| 17% | chr17 | 42991959 | 42991849 | − | chr17 | 42991456 | 42991396 | − | ENST00000253408; ENST00000435360; ENST00000586793; ENST00000592320; ENST00000588316; ENST00000588037 | TSF |
| 17% | chr17 | 42991959 | 42991849 | − | chr17 | 42991456 | 42991396 | − | ENST00000253408; ENST00000435360; ENST00000586793; ENST00000592320; ENST00000588316; ENST00000588037 | TSF |

TABLE 34-continued

Transcript fusion for Low Grade Glioma (LGG) Coordinates of the fusion sequences for which the donor is the TE.

| 1' | 2' | 3' | 4' | 5' | 6' | 7' | 8' | 9' | 10' | 11' |
|---|---|---|---|---|---|---|---|---|---|---|
| 17% | chr17 | 42991959 | 42991849 | - | chr17 | 42991456 | 42991396 | - | ENST00000253408; ENST00000435360; ENST00000586793; ENST00000592320; ENST00000588316; ENST00000588037 | TSF |
| 17% | chr17 | 42991959 | 42991849 | - | chr17 | 42991456 | 42991396 | - | ENST00000253408; ENST00000435360; ENST00000586793; ENST00000592320; ENST00000588316; ENST00000588037 | TSF |
| 17% | chr17 | 42991959 | 42991849 | - | chr17 | 42991456 | 42991396 | - | ENST00000253408; ENST00000435360; ENST00000586793; ENST00000592320; ENST00000588316; ENST00000588037 | TAF |
| 16% | chr9 | 108112857 | 108112906 | + | chr9 | 108118493 | 108118662 | + | ENST00000374720; ENST00000374723; ENST00000470972; ENST00000374724 | TAF |
| 16% | chr9 | 108112857 | 108112906 | + | chr9 | 108118493 | 108118662 | + | ENST00000374720; ENST00000374723; ENST00000470972; ENST00000374724 | TAF |
| 16% | chr16 | 2564319 | 2564396 | + | chr16 | 2569219 | 2569384; 2569402 | + | ENST00000564543; ENST00000330398; ENST00000568562 | TAF |
| 16% | chr16 | 2564319 | 2564396 | + | chr16 | 2569219 | 2569384; 2569402 | + | ENST00000564543; ENST00000330398; ENST00000568562 | TAF |
| 16% | chr20 | 2633768 | 2633819 | + | chr20 | 2634039 | 2634039 | + | ENST00000329276; ENST00000445139 | TAF |
| 16% | chr20 | 2633768 | 2633819 | + | chr20 | 2634039 | 2634039 | + | ENST00000329276; ENST00000445139 | TAF |
| 16% | chr20 | 25777823 | 25776681 | - | chr20 | 25755948 | 25755497; 25755659 | - | ENST00000376403; ENST00000584071 | TSF |
| 16% | chr20 | 25777823 | 25776681 | - | chr20 | 25755948 | 25755497; 25755659 | - | ENST00000376403; ENST00000584071 | TAF |
| 16% | chr2 | 175806110 | 175805544 | - | chr2 | 175783293 | 175783262 | - | ENST00000409900; ENST00000409156 | TAF |
| 16% | chr2 | 175806110 | 175805544 | - | chr2 | 175783293 | 175783262 | - | ENST00000409900; ENST00000409156 | TAF |
| 16% | chr7 | 102307107 | 102307052 | - | chr7 | 102207530 | 102207444; 102207440 | - | ENST00000379340; ENST00000608621; ENST00000511313 | TSF |
| 16% | chr7 | 102307107 | 102307052 | - | chr7 | 102207530 | 102207498; 102207444; 102207440 | - | ENST00000379340; ENST00000486319; ENST00000608621; ENST00000511313 | TSF |
| 16% | chr7 | 102307107 | 102307052 | - | chr7 | 102207530 | 102207498; 102207444; 102207440 | - | ENST00000379340; ENST00000486319; ENST00000608621; ENST00000511313 | TSF |
| 16% | chr7 | 102307107 | 102307052 | - | chr7 | 102207530 | 102207498; 102207444; 102207440 | - | ENST00000379340; ENST00000486319; ENST00000608621; ENST00000511313 | TSF |
| 16% | chr7 | 102307107 | 102307052 | - | chr7 | 102207530 | 102207498; 102207444; 102207440 | - | ENST00000379340; ENST00000486319; ENST00000608621; ENST00000511313 | TSF |
| 16% | chr8 | 82356115 | 82355982 | - | chr8 | 82355683 | 82355633; 82355676 | - | ENST00000256103; ENST00000519260 | TSF |
| 16% | chr8 | 82356115 | 82355982 | - | chr8 | 82355683 | 82355633; 82355676 | - | ENST00000256103; ENST00000519260 | TSF |
| 15% | chr4 | 176868864 | 176868796 | - | chr4 | 176622918 | 176622726; 176622736 | - | ENST00000280187; ENST00000505304 | TAF |
| 15% | chr4 | 176868864 | 176868796 | - | chr4 | 176622918 | 176622726; 176622736 | - | ENST00000280187; ENST00000505304 | TAF |
| 15% | chr4 | 176868864 | 176868796 | - | chr4 | 176622918 | 176622726; 176622736 | - | ENST00000280187; ENST00000505304 | TAF |
| 15% | chr4 | 176868864 | 176868796 | - | chr4 | 176622918 | 176622726; 176622736 | - | ENST00000280187; ENST00000505304 | TAF |
| 15% | chr17 | 11973110 | 11973166 | + | chr17 | 11984673 | 11984847; | + | ENST00000353533; ENST00000415385; ENST00000602811; ENST00000602537; ENST00000602686 | TAF |

TABLE 34-continued

Transcript fusion for Low Grade Glioma (LGG) Coordinates of the fusion sequences for which the donor is the TE.

| 1' | 2' | 3' | 4' | 5' | 6' | 7' | 8' | 9' | 10' | 11' |
|---|---|---|---|---|---|---|---|---|---|---|
| 15% | chr17 | 11973110 | 11973166 | + | chr17 | 11984673 | 11984683; 11984847; 11984683 | | ENST00000353533; ENST00000415385; ENST00000602811; ENST00000602537; ENST00000602686 | TAF |
| 14% | chr3 | 180632728 | 180632783 | + | chr3 | 180651122 | 180651174 | + | ENST00000357559; ENST00000445140; ENST00000480918; ENST00000484042 | TAF |
| 14% | chr3 | 180632728 | 180632783 | + | chr3 | 180651122 | 180651174 | + | ENST00000357559; ENST00000445140; ENST00000480918; ENST00000484042 | TAF |
| 14% | chr3 | 180632728 | 180632783 | + | chr3 | 180651122 | 180651174 | + | ENST00000357559; ENST00000445140; ENST00000480918; ENST00000484042 | TAF |
| 14% | chr18 | 48249804 | 48249890 | + | chr18 | 48252332 | 48252545 | + | ENST00000400384; ENST00000540640 | TAF |
| 14% | chr6 | 111651498 | 111651389 | − | chr6 | 111650941 | 111650735 | − | ENST00000368802; ENST00000368805; ENST00000435970 | TAF |
| 14% | chr9 | 75695610 | 75695283 | − | chr9 | 75555168 | 75555064 | − | ENST00000297785; ENST00000376939; ENST00000419959; ENST00000446946 | TAF |
| 14% | chr9 | 75695610 | 75695283 | − | chr9 | 75555168 | 75555064 | − | ENST00000297785; ENST00000376939; ENST00000419959; ENST00000446946 | TAF |
| 14% | chr9 | 75695610 | 75695283 | − | chr9 | 75555168 | 75555064 | − | ENST00000297785; ENST00000376939; ENST00000419959; ENST00000446946 | TAF |
| 14% | chr9 | 75695610 | 75695283 | − | chr9 | 75555168 | 75555064 | − | ENST00000297785; ENST00000376939; ENST00000419959; ENST00000446946 | TAF |
| 14% | chr11 | 46670360 | 46670417 | + | chr11 | 46670687 | 46670733 | + | ENST00000312040; ENST00000434074; ENST00000451945; ENST00000529655; ENST00000533325; ENST00000395549 | TAF |
| 14% | chr11 | 46670360 | 46670417 | + | chr11 | 46670687 | 46670733 | + | ENST00000312040; ENST00000434074; ENST00000451945; ENST00000526308; ENST00000524625; ENST00000359513; ENST00000528494; ENST00000395549 | TAF |
| 14% | chr11 | 46670360 | 46670417 | + | chr11 | 46670687 | 46670733 | + | ENST00000312040; ENST00000434074; ENST00000451945; ENST00000526308; ENST00000524625; ENST00000359513; ENST00000528494; ENST00000529655; ENST00000533325; ENST00000395549 | TAF |
| 14% | chr11 | 46670360 | 46670417 | + | chr11 | 46670687 | 46670733 | + | ENST00000312040; ENST00000434074; ENST00000451945; ENST00000526308; ENST00000524625; ENST00000359513; ENST00000528494; ENST00000529655; ENST00000533325; ENST00000395549 | TAF |
| 14% | chr11 | 46670360 | 46670417 | + | chr11 | 46670687 | 46670733 | + | ENST00000312040; ENST00000434074; ENST00000451945; ENST00000526308; ENST00000524625; ENST00000359513; ENST00000528494; ENST00000529655; ENST00000533325; ENST00000395549 | TAF |
| 13% | chr9 | 140012434 | 140012371 | − | chr9 | 140009028 | 140008915 | − | ENST00000371579; ENST00000472306; ENST00000497375 | TAF |
| 13% | chr9 | 140012434 | 140012371 | − | chr9 | 140009028 | 140008915 | − | ENST00000371579; ENST00000472306; ENST00000497375 | TAF |
| 13% | chr9 | 140012434 | 140012371 | − | chr9 | 140009028 | 140008915 | − | ENST00000371579; ENST00000472306; ENST00000497375 | TAF |
| 13% | chrX | 13921681 | 13921670 | − | chrX | 13803927 | 13803741 | − | ENST00000316715; ENST00000454189; ENST00000493677; ENST00000355135; ENST00000356942; ENST00000475307 | TAF |
| 13% | chrX | 13921681 | 13921670 | − | chrX | 13803927 | 13803741 | − | ENST00000316715; ENST00000454189; ENST00000493677; ENST00000355135; ENST00000356942; ENST00000475307 | TAF |
| 13% | chrX | 13921681 | 13921670 | − | chrX | 13803927 | 13803741 | − | ENST00000316715; ENST00000454189; ENST00000493677; ENST00000355135; ENST00000356942; ENST00000475307 | TAF |
| 13% | chr19 | 58515808 | 58516068 | + | chr19 | 58517275 | 58517367; 58517363 | + | ENST00000550135; ENST00000553254 | TAF |
| 13% | chr19 | 58515808 | 58516068 | + | chr19 | 58517275 | 58517367; 58517363 | + | ENST00000550135; ENST00000553254 | TAF |
| 13% | chr17 | 80440912 | 80441180 | + | chr17 | 80441592 | 80441655; 80441659 | + | ENST00000390006; ENST00000309794; ENST00000345415; ENST00000457415; ENST00000577432; ENST00000584513 | TAF |
| 13% | chr17 | 80440912 | 80441180 | + | chr17 | 80441592 | 80441655; 80441659 | + | ENST00000390006; ENST00000309794; ENST00000345415; ENST00000457415; ENST00000577432; ENST00000584513 | TAF |
| 13% | chr17 | 80440912 | 80441180 | + | chr17 | 80441592 | 80441655; 80441659 | + | ENST00000390006; ENST00000309794; ENST00000345415; ENST00000457415; ENST00000577432; ENST00000584513 | TAF |
| 13% | chr17 | 80440912 | 80441180 | + | chr17 | 80441592 | 80441655; 80441659 | + | ENST00000390006; ENST00000309794; ENST00000345415; ENST00000457415; ENST00000577432; ENST00000584513 | TSF |
| 13% | chr17 | 80440912 | 80441180 | + | chr17 | 80441592 | 80441655; 80441659 | + | ENST00000390006; ENST00000309794; ENST00000345415; ENST00000457415; ENST00000577432; ENST00000584513 | TSF |
| 12% | chr10 | 104164273 | 104164216 | − | chr10 | 104163742 | 104163599 | − | ENST00000020673; ENST00000406432 | TAF |
| 12% | chr19 | 19353662 | 19353712 | + | chr19 | 19356122 | 19356266 | + | ENST00000252575; ENST00000538881; ENST00000588231 | TSF |
| 12% | chr19 | 19353662 | 19353712 | + | chr19 | 19356122 | 19356266 | + | ENST00000252575; ENST00000538881; ENST00000588231 | TSF |
| 12% | chr4 | 151135833 | 151135882 | + | chr4 | 151141855 | 151141930 | + | ENST00000296550; ENST00000302176 | TSF |
| 11% | chr11 | 73359298 | 73359321 | + | chr11 | 73360057 | 73360132 | + | ENST00000354190; ENST00000398492 | TAF |

TABLE 34-continued

Transcript fusion for Low Grade Glioma (LGG) Coordinates of the fusion sequences for which the donor is the TE.

| 1' | 2' | 3' | 4' | 5' | 6' | 7' | 8' | 9' | 10' | 11' |
|---|---|---|---|---|---|---|---|---|---|---|
| 11% | chr11 | 73359298 | 73359321 | + | chr11 | 73360057 | 73360132 | + | ENST00000354190; ENST00000398492 | TAF |
| 11% | chr14 | 70421994 | 70422072 | + | chr14 | 70442432 | 70442531 | + | ENST00000361956; ENST00000381280 | TAF |
| 11% | chr14 | 70421994 | 70422072 | + | chr14 | 70442432 | 70442531 | + | ENST00000361956; ENST00000381280 | TAF |
| 11% | chr8 | 23127459 | 23127756 | + | chr8 | 23146019 | 23146146 | + | ENST00000411463 | TAF |
| 11% | chr2 | 50264840 | 50264776 | − | chr2 | 50264436 | 50264287; 50264314; 50264356 | − | ENST00000320634; ENST00000550890; ENST00000552669; ENST00000552863 | TAF |
| 11% | chr2 | 50264840 | 50264776 | − | chr2 | 50264436 | 50264287; 50264314; 50264356 | − | ENST00000320634; ENST00000550890; ENST00000552669; ENST00000552863 | TAF |
| 11% | chr2 | 50264840 | 50264776 | − | chr2 | 50264436 | 50264287; 50264314; 50264356 | − | ENST00000320634; ENST00000550890; ENST00000552669; ENST00000552863 | TAF |
| 11% | chr10 | 102260069 | 102259867 | − | chr10 | 102259355 | 102259281 | − | ENST00000370345 | TAF |
| 11% | chr5 | 79293955 | 79294198 | + | chr5 | 79335900 | 79336103 | + | ENST00000350881 | TSF |
| 11% | chr3 | 66502660 | 66502653 | − | chr3 | 66502057 | 66501983 | − | ENST00000273261; ENST00000383703 | TSF |
| 11% | chr3 | 66502660 | 66502653 | − | chr3 | 66502057 | 66501983 | − | ENST00000273261; ENST00000383703 | TSF |
| 11% | chr17 | 42991959 | 42991941 | − | chr17 | 42991456 | 42991396 | − | ENST00000253408; ENST00000435360; ENST00000586793; ENST00000592320; ENST00000588316; ENST00000588037 | TSF |
| 11% | chr17 | 42991959 | 42991941 | − | chr17 | 42991456 | 42991396 | − | ENST00000253408; ENST00000435360; ENST00000586793; ENST00000592320; ENST00000588316; ENST00000588037 | TSF |
| 11% | chr17 | 42991959 | 42991941 | − | chr17 | 42991456 | 42991396 | − | ENST00000253408; ENST00000435360; ENST00000586793; ENST00000592320; ENST00000588316; ENST00000588037 | TSF |
| 11% | chr17 | 42991959 | 42991941 | − | chr17 | 42991456 | 42991396 | − | ENST00000253408; ENST00000435360; ENST00000586793; ENST00000592320; ENST00000588316; ENST00000588037 | TSF |
| 11% | chr17 | 42991959 | 42991941 | − | chr17 | 42991456 | 42991396 | − | ENST00000253408; ENST00000435360; ENST00000586793; ENST00000592320; ENST00000588316; ENST00000588037 | TSF |
| 10% | chr17 | 40813377 | 40813974 | + | chr17 | 40815395 | 40815521 | + | ENST00000251412 | TAF |
| 10% | chr18 | 60573526 | 60573623 | + | chr18 | 60582146 | 60582241 | + | ENST00000400316; ENST00000262719; ENST00000591386 | TSF |
| 10% | chr18 | 60573526 | 60573623 | + | chr18 | 60582146 | 60582241 | + | ENST00000400316; ENST00000262719; ENST00000591386 | TSF |
| 10% | chr3 | 115350112 | 115350159 | + | chr3 | 115394860 | 115395457 | + | ENST00000305124; ENST00000393780 | TSF |
| 9% | chr1 | 24645232 | 24645398 | + | chr1 | 24657916 | 24658102 | + | ENST00000361548; ENST00000350501; ENST00000236255 | TSF |
| 9% | chr1 | 24645232 | 24645398 | + | chr1 | 24657916 | 24658102 | + | ENST00000361545; ENST00000223398; ENST00000395060; ENST00000487447 | TSF |
| 9% | chr7 | 73811611 | 73818214 | + | chr7 | 73818167 | 73818178 | + | ENST00000376403; ENST00000584071 | TSF |
| 9% | chr20 | 25780351 | 25778939 | − | chr20 | 25755948 | 25755497; 25755659 | − | ENST00000376403; ENST00000584071 | TSF |
| 9% | chr20 | 25780351 | 25778939 | − | chr20 | 25755948 | 25755497; 25755659 | − | ENST00000376403; ENST00000584071 | TSF |
| 9% | chr11 | 62651471 | 62651559 | + | chr11 | 62651929 | 62651997 | + | ENST00000377892; ENST00000377890; ENST00000377891; ENST00000338663 | TSF |
| 8% | chr7 | 29899867 | 29900179 | + | chr7 | 29915446 | 29915578 | + | ENST00000409123; ENST00000242140; ENST00000409290 | TSF |
| 8% | chr7 | 29899867 | 29900179 | + | chr7 | 29915446 | 29915578 | + | ENST00000409123; ENST00000242140; ENST00000409290 | TSF |
| 8% | chr3 | 186989069 | 186988983 | − | chr3 | 186980508 | 186980331; 186980469; 186980502 | − | ENST00000337774; ENST00000296280; ENST00000169293; ENST00000392470; ENST00000392475; ENST00000439271; ENST00000425937 | ITSF |
| 8% | chr3 | 186989069 | 186988983 | − | chr3 | 186980508 | 186980331; 186980469; 186980502 | − | ENST00000337774; ENST00000296280; ENST00000169293; ENST00000392470; ENST00000392475; ENST00000439271; ENST00000425937 | TSF |
| 8% | chr3 | 186989069 | 186988983 | − | chr3 | 186980508 | 186980331; 186980469; 186980502 | − | ENST00000337774; ENST00000296280; ENST00000169293; ENST00000392470; ENST00000392475; ENST00000439271; ENST00000425937 | TSF |
| 8% | chr3 | 186989069 | 186988983 | − | chr3 | 186980508 | 186980331; 186980469; 186980502 | − | ENST00000337774; ENST00000296280; ENST00000169293; ENST00000392470; ENST00000392475; ENST00000439271; ENST00000425937 | TSF |

TABLE 34-continued

Transcript fusion for Low Grade Glioma (LGG) Coordinates of the fusion sequences for which the donor is the TE.

| 1' | 2' | 3' | 4' | 5' | 6' | 7' | 8' | 9' | 10' | 11' |
|---|---|---|---|---|---|---|---|---|---|---|
| 8% | chr3 | 186989069 | 186988983 | – | chr3 | 186980508 | 186980331; 186980469; 186980502 | – | ENST00000337774; ENST00000296280; ENST00000392470; ENST00000392475; ENST00000439271; ENST00000425937 | TSF |
| 8% | chr3 | 186989069 | 186988983 | – | chr3 | 186980508 | 186980331; 186980469; 186980502 | – | ENST00000337774; ENST00000296280; ENST00000392470; ENST00000392475; ENST00000439271; ENST00000425937 | TSF |
| 8% | chr14 | 77240992 | 77241058 | + | chr14 | 77242235 | 77242616 | + | ENST00000167106 | TSF |
| 8% | chr17 | 73847069 | 73847024 | – | chr17 | 73845820 | 73845685 | – | ENST00000254806; ENST00000585462; ENST00000591399; ENST00000591831; ENST00000590221; ENST00000344296; ENST00000433525; ENST00000593002 | ITSF |
| 8% | chr17 | 73847069 | 73847024 | – | chr17 | 73845820 | 73845685 | – | ENST00000254806; ENST00000585462; ENST00000591399; ENST00000591831; ENST00000590221; ENST00000344296; ENST00000433525; ENST00000593002 | TSF |
| 8% | chr17 | 73847069 | 73847024 | – | chr17 | 73845820 | 73845685 | – | ENST00000254806; ENST00000585462; ENST00000591399; ENST00000591831; ENST00000590221; ENST00000344296; ENST00000433525; ENST00000593002 | TSF |
| 8% | chr17 | 73847069 | 73847024 | – | chr17 | 73845820 | 73845685 | – | ENST00000254806; ENST00000585462; ENST00000591399; ENST00000591831; ENST00000590221; ENST00000344296; ENST00000433525; ENST00000593002 | TSF |
| 7% | chr2 | 230371170 | 230370928 | – | chr2 | 230341969 | 230341856 | – | ENST00000341772 | TSF |
| 7% | chr7 | 102146992 | 102146893 | – | chr7 | 102143691 | 102143610 | – | ENST00000541662; ENST00000465829; ENST00000306682 | TSF |
| 7% | chr7 | 102146992 | 102146893 | – | chr7 | 102143691 | 102143610 | – | ENST00000541662; ENST00000465829; ENST00000306682 | TSF |
| 7% | chr19 | 13183453 | 13183471 | + | chr19 | 13183861 | 13183923 | + | ENST00000397661; ENST00000592199; ENST00000585382; ENST00000587760; ENST00000585575; ENST00000360105; ENST00000588228; ENST00000587260; ENST00000358552 | TSF |
| 7% | chr19 | 13183453 | 13183471 | + | chr19 | 13183861 | 13183923 | + | ENST00000397661; ENST00000592199; ENST00000585382; ENST00000587760; ENST00000585575; ENST00000360105; ENST00000588228; ENST00000587260; ENST00000358552 | TSF |
| 7% | chr19 | 13183453 | 13183471 | + | chr19 | 13183861 | 13183923 | + | ENST00000397661; ENST00000592199; ENST00000585382; ENST00000587760; ENST00000585575; ENST00000360105; ENST00000588228; ENST00000587260; ENST00000358552 | TSF |
| 7% | chr19 | 13183453 | 13183471 | + | chr19 | 13183861 | 13183923 | + | ENST00000397661; ENST00000592199; ENST00000585382; ENST00000587760; ENST00000585575; ENST00000360105; ENST00000588228; ENST00000587260; ENST00000358552 | TSF |
| 7% | chr4 | 5830600 | 5830583 | + | chr4 | 5830395 | 5830216 | + | ENST00000324989; ENST00000397890; ENST00000512574 | TSF |
| 7% | chr17 | 38243904 | 38243929 | + | chr17 | 38244495 | 38244753 | + | ENST00000394121; ENST00000264637; ENST00000584985; ENST00000450525; ENST00000546243 | TSF |
| 7% | chr17 | 38243904 | 38243929 | + | chr17 | 38244495 | 38244753 | + | ENST00000394121; ENST00000264637; ENST00000584985; ENST00000450525; ENST00000546243 | TSF |
| 7% | chr17 | 38243904 | 38243929 | + | chr17 | 38244495 | 38244753 | + | ENST00000394121; ENST00000264637; ENST00000584985; ENST00000450525; ENST00000546243 | TSF |
| 6% | chr2 | 101024262 | 101024202 | – | chr2 | 101023169 | 101023038 | – | ENST00000542617; ENST00000448989 | TSF |
| 6% | chr2 | 101024262 | 101024202 | – | chr2 | 101023169 | 101023038 | – | ENST00000542617; ENST00000448989 | TSF |
| 6% | chr7 | 102246155 | 102246056 | – | chr7 | 102242852 | 102242771 | – | ENST00000262940; ENST00000461209; ENST00000449970; ENST00000462172; ENST00000522801; ENST00000520042; ENST00000521076 | TSF |
| 6% | chr7 | 102246155 | 102246056 | – | chr7 | 102242852 | 102242771 | – | ENST00000262940; ENST00000461209; ENST00000449970; ENST00000462172; ENST00000522801; ENST00000520042; ENST00000521076 | TSF |
| 6% | chr7 | 102246155 | 102246056 | – | chr7 | 102242852 | 102242771 | – | ENST00000262940; ENST00000461209; ENST00000449970; ENST00000462172; ENST00000522801; ENST00000520042; ENST00000521076 | TSF |
| 6% | chr7 | 102246155 | 102246056 | – | chr7 | 102242852 | 102242771 | – | ENST00000262940; ENST00000461209; ENST00000449970; ENST00000462172; ENST00000522801; ENST00000520042; ENST00000521076 | TSF |
| 6% | chr19 | 18991807 | 18991757 | – | chr19 | 18991244 | 18991083 | – | ENST00000427170; ENST00000429504; ENST00000542296; ENST00000596048 | TSF |
| 6% | chr19 | 18991807 | 18991757 | – | chr19 | 18991244 | 18991083 | – | ENST00000427170; ENST00000429504; ENST00000542296; ENST00000596048 | TSF |
| 6% | chr19 | 18991807 | 18991757 | – | chr19 | 18991244 | 18991083 | – | ENST00000427170; ENST00000429504; ENST00000542296; ENST00000596048 | TSF |
| 6% | chr20 | 25841506 | 25840376 | – | chr20 | 25755972 | 25755659 | – | ENST00000584071 | TSF |
| 6% | chr12 | 50292609 | 50292556 | – | chr12 | 50291869 | 50291770 | – | ENST00000320634; ENST00000550890; ENST00000550195; ENST00000552669; ENST00000547871 | TSF |

TABLE 34-continued

Transcript fusion for Low Grade Glioma (LGG) Coordinates of the fusion sequences for which the donor is the TE.

| 1' | 2' | 3' | 4' | 5' | 6' | 7' | 8' | 9' | 10' | 11' |
|---|---|---|---|---|---|---|---|---|---|---|
| 6% | chr12 | 50292609 | 50292556 | − | chr12 | 50291869 | 50291770 | − | ENST00000320634; ENST00000550890; ENST00000550195; ENST00000552669; ENST00000550635; ENST00000547871 | TSF |
| 6% | chr12 | 50292609 | 50292556 | − | chr12 | 50291869 | 50291770 | − | ENST00000320634; ENST00000550890; ENST00000550195; ENST00000552669; ENST00000550635; ENST00000547871 | TSF |
| 6% | chr12 | 50292609 | 50292556 | − | chr12 | 50291869 | 50291770 | − | ENST00000320634; ENST00000550890; ENST00000550195; ENST00000552669; ENST00000550635; ENST00000547871 | TSF |
| 6% | chr12 | 50292609 | 50292556 | − | chr12 | 50291869 | 50291770 | − | ENST00000320634; ENST00000550890; ENST00000550195; ENST00000552669; ENST00000550635; ENST00000547871 | TSF |
| 6% | chr20 | 25843181 | 25842039 | − | chr20 | 25755972 | 25755659 | − | ENST00000084071 | TSF |
| 5% | chr19 | 7895176 | 7895267 | + | chr19 | 7911468 | 7911565 | + | ENST00000270530; ENST00000538904 | TSF |
| 5% | chr19 | 7895176 | 7895267 | + | chr19 | 7911468 | 7911565 | + | ENST00000270530; ENST00000538904 | TSF |
| 5% | chr19 | 54944914 | 54945078 | + | chr19 | 54946722 | 54946864 | + | ENST00000301194; ENST00000376530; ENST00000391739; ENST00000376531 | TSF |
| 5% | chr19 | 54944914 | 54945078 | + | chr19 | 54946722 | 54946864 | + | ENST00000301194; ENST00000376530; ENST00000391739; ENST00000376531 | TSF |
| 5% | chr19 | 54944914 | 54945078 | + | chr19 | 54946722 | 54946864 | + | ENST00000301194; ENST00000376530; ENST00000391739; ENST00000376531 | TSF |
| 5% | chr17 | 40813111 | 40813245 | + | chr17 | 40815395 | 40815521 | + | ENST00000251412 | TSF |
| 5% | chr6 | 3229888 | 3229779 | − | chr6 | 3226903 | 3226795 | − | ENST00000259818 | TSF |
| 5% | chr20 | 29976260 | 29976126 | − | chr20 | 29966194 | 29966155 | − | ENST00000339144 | TSF |
| 5% | chr2 | 220383535 | 220383613 | + | chr2 | 220396480 | 220396624 | + | ENST00000347842; ENST00000358078 | TSF |
| 5% | chr2 | 220383535 | 220383613 | + | chr2 | 220396480 | 220396624 | + | ENST00000347842; ENST00000358078 | TSF |
| 5% | chr7 | 4949365 | 4949360 | − | chr7 | 4947230 | 4947027 | − | ENST00000401401 | TSF |
| 5% | chr1 | 175324477 | 175324412 | − | chr1 | 175323639 | 175323527 | − | ENST00000367674; ENST00000263525 | TSF |
| 5% | chr20 | 25844836 | 25843696 | − | chr20 | 25755972 | 25755659 | − | ENST00000584071 | TSF |
| 4% | chr19 | 11469032 | 11469050 | + | chr19 | 11470208 | 11470396; 11470395 | + | ENST00000251473; ENST00000591329 | TSF |
| 4% | chr19 | 11469032 | 11469050 | + | chr19 | 11470208 | 11470396; 11470395 | + | ENST00000251473; ENST00000591329 | TSF |
| 4% | chr7 | 102208027 | 102207815 | − | chr7 | 102207530 | 102207498; 102207444; 102207440 | − | ENST00000379340; ENST00000486319; ENST00000508848; ENST00000513506; ENST00000514917; ENST00000507355; ENST00000660862l; ENST00000511313 | TSF |
| 4% | chr7 | 102208027 | 102207815 | − | chr7 | 102207530 | 102207498; 102207444; 102207440 | − | ENST00000379340; ENST00000486319; ENST00000508848; ENST00000513506; ENST00000514917; ENST00000507355; ENST00000660862l; ENST00000511313 | TSF |
| 4% | chr7 | 102208027 | 102207815 | − | chr7 | 102207530 | 102207498; 102207444; 102207440 | − | ENST00000379340; ENST00000486319; ENST00000508848; ENST00000513506; ENST00000514917; ENST00000507355; ENST00000660862l; ENST00000511313 | TSF |
| 4% | chr7 | 102208027 | 102207815 | − | chr7 | 102207530 | 102207498; 102207444; 102207440 | − | ENST00000379340; ENST00000486319; ENST00000508848; ENST00000513506; ENST00000514917; ENST00000507355; ENST00000660862l; ENST00000511313 | TSF |
| 4% | chr7 | 102208027 | 102207815 | − | chr7 | 102207530 | 102207498; 102207444; 102207440 | − | ENST00000379340; ENST00000486319; ENST00000508848; ENST00000513506; ENST00000514917; ENST00000507355; ENST00000660862l; ENST00000511313 | TSF |
| 4% | chr12 | 4948345 | 4948527 | + | chr12 | 4959904 | 4960077 | + | ENST00000542998 | TSF |
| 4% | chr7 | 117376632 | 117376519 | − | chr7 | 117375475 | 117375323; 117375385 | − | ENST00000160373; ENST00000446636; ENST00000435233 | TSF |
| 4% | chr7 | 117376632 | 117376519 | − | chr7 | 117375475 | 117375323; 117375385 | − | ENST00000160373; ENST00000446636; ENST00000435233 | TSF |
| 4% | chr2 | 198536292 | 198536266 | − | chr2 | 198511390 | 198511207 | − | ENST00000295049; ENST00000429081 | TSF |
| 4% | chr2 | 198536292 | 198536266 | − | chr2 | 198511390 | 198511207 | − | ENST00000295049; ENST00000429081 | TSF |
| 4% | chr12 | 49602693 | 49602732 | + | chr12 | 49621874 | 49621949 | + | ENST00000541364; ENST00000549818; ENST00000552448; ENST00000552125 | TSF |

TABLE 34-continued

Transcript fusion for Low Grade Glioma (LGG) Coordinates of the fusion sequences for which the donor is the TE.

| 1' | 2' | 3' | 4' | 5' | 6' | 7' | 8' | 9' | 10' | 11' |
|---|---|---|---|---|---|---|---|---|---|---|
| 4% | chr12 | 49602693 | 49602732 | + | chr12 | 49621874 | 49621949 | + | ENST00000541364; ENST00000541364; ENST00000549818; ENST00000549818; ENST00000552448; ENST00000552448; ENST00000552125 ENST00000552125 | TSF |
| 4% | chr12 | 49602693 | 49602732 | + | chr12 | 49621874 | 49621949 | + | ENST00000307378; ENST00000452078; ENST00000458504; ENST00000537524 | TSF |
| 4% | chr2 | 21426370 | 21426215 | − | chr2 | 21422701 | 21422482 | − | ENST00000524419; ENST00000528989; ENST00000315571 | TSF |
| 4% | chr11 | 36219316 | 36219321 | + | chr11 | 36248635 | 36248980 | + | ENST00000382110; ENST00000324266; ENST00000417243; ENST00000415624 | TSF |
| 4% | chr2 | 3462278 | 3462286 | + | chr2 | 3464034 | 3464107; 3464074 | + | ENST00000382110; ENST00000324266; ENST00000417243; ENST00000415624 | TSF |
| 4% | chr2 | 3462278 | 3462286 | + | chr2 | 3464034 | 3464107; 3464074 | + | ENST00000382110; ENST00000324266; ENST00000417243; ENST00000415624 | TSF |
| 4% | chr2 | 3462278 | 3462286 | + | chr2 | 3464034 | 3464107; 3464074 | + | ENST00000382110; ENST00000324266; ENST00000417243; ENST00000415624 | TSF |
| 4% | chr15 | 93592614 | 93592599 | − | chr15 | 93588935 | 93588228; 93588877 | − | ENST00000425933; ENST00000543599; ENST00000542321; ENST00000538818; ENST00000565857 ENST00000557420; ENST00000556658 | TSF |
| 4% | chr15 | 93592614 | 93592599 | − | chr15 | 93588935 | 93588228; 93588877 | − | ENST00000425933; ENST00000543599; ENST00000542321; ENST00000538818; ENST00000565857 ENST00000557420; ENST00000556658 | TSF |
| 4% | chr16 | 15624455 | 15624694 | + | chr16 | 15661840 | 15661913 | + | ENST00000300006; ENST00000566490; ENST00000452191; ENST00000561692; ENST00000565857 | TSF |
| 4% | chr16 | 15624455 | 15624694 | + | chr16 | 15661840 | 15661913 | + | ENST00000300006; ENST00000566490; ENST00000452191; ENST00000561692; ENST00000565857 | TSF |
| 4% | chr16 | 15624455 | 15624694 | + | chr16 | 15661840 | 15661913 | + | ENST00000300006; ENST00000566490; ENST00000452191; ENST00000561692; ENST00000565857 | TSF |
| 4% | chr16 | 15624455 | 15624694 | + | chr16 | 15661840 | 15661913 | + | ENST00000300006; ENST00000566490; ENST00000452191; ENST00000561692; ENST00000565857 | TSF |
| 4% | chr11 | 60694460 | 60694542 | + | chr11 | 60694676 | 60694890 | + | ENST00000453848; ENST00000005286 | TSF |
| 4% | chr11 | 60694460 | 60694542 | + | chr11 | 60694676 | 60694890 | + | ENST00000453848; ENST00000005286 | TSF |
| 4% | chr2 | 79924995 | 79925043 | + | chr2 | 79971513 | 79971708; 79971609 | + | ENST00000466387; ENST00000496558; ENST00000451966; ENST00000402739; ENST00000540488; ENST00000541047 | TSF |
| 4% | chr2 | 79924995 | 79925043 | + | chr2 | 79971513 | 79971708; 79971609 | + | ENST00000466387; ENST00000496558; ENST00000451966; ENST00000402739; ENST00000540488; ENST00000541047 | TSF |
| 4% | chr2 | 79924995 | 79925043 | + | chr2 | 79971513 | 79971708; 79971609 | + | ENST00000466387; ENST00000496558; ENST00000451966; ENST00000402739; ENST00000540488; ENST00000541047 | TSF |
| 4% | chr2 | 79924995 | 79925043 | + | chr2 | 79971513 | 79971708; 79971609 | + | ENST00000466387; ENST00000496558; ENST00000451966; ENST00000402739; ENST00000540488; ENST00000541047 | TSF |
| 4% | chr17 | 64988088 | 64988129 | + | chr17 | 65014305 | 65014388 | + | ENST00000262138 | TSF |
| 4% | chr1 | 156628571 | 156628662 | + | chr1 | 156628819 | 156628926 | + | ENST00000329117 | TSF |
| 4% | chr1 | 121570168 | 121570258 | + | chr7 | 121608005 | 121608184 | + | ENST00000393386; ENST00000449182 | TSF |
| 4% | chr7 | 121570168 | 121570258 | + | chr7 | 121608005 | 121608184 | + | ENST00000393386; ENST00000449182 | TSF |
| 4% | chr16 | 75683160 | 75683228 | + | chr16 | 75688171 | 75688295; 75688183 | + | ENST00000300086; ENST00000569234 | TSF |
| 4% | chr16 | 75683160 | 75683228 | + | chr16 | 75688171 | 75688295; 75688183 | + | ENST00000300086; ENST00000569234 | TSF |
| 3% | chr12 | 51101579 | 51101831 | + | chr12 | 51102231 | 51102345 | + | ENST00000301180 | TSF |
| 3% | chr1 | 99718539 | 99718543 | + | chr1 | 99753521 | 99753706 | + | ENST00000370185; ENST00000457765 | TSF |
| 3% | chr1 | 99718539 | 99718543 | + | chr1 | 99753521 | 99753706 | + | ENST00000370185; ENST00000457765 | TSF |
| 3% | chr7 | 87600681 | 87600690 | + | chr7 | 87607651 | 87607727 | + | ENST00000398204; ENST00000439864; ENST00000398201; ENST00000412441; ENST00000398209; ENST00000398203 | TSF |
| 3% | chr7 | 87600681 | 87600690 | + | chr7 | 87607651 | 87607727 | + | ENST00000398204; ENST00000439864; ENST00000398201; ENST00000412441; ENST00000265727; ENST00000315984; ENST00000398209; ENST00000398203 | TSF |
| 3% | chr7 | 87600681 | 87600690 | + | chr7 | 87607651 | 87607727 | + | ENST00000398204; ENST00000439864; ENST00000398201; ENST00000412441; ENST00000265727; ENST00000315984; ENST00000398209; ENST00000398203 | TSF |
| 3% | chr7 | 87600681 | 87600690 | + | chr7 | 87607651 | 87607727 | + | ENST00000398204; ENST00000439864; ENST00000398201; ENST00000412441; ENST00000265727; ENST00000315984 | TSF |

TABLE 34-continued

Transcript fusion for Low Grade Glioma (LGG) Coordinates of the fusion sequences for which the donor is the TE.

| 1' | 2' | 3' | 4' | 5' | 6' | 7' | 8' | 9' | 10' | 11' |
|---|---|---|---|---|---|---|---|---|---|---|
| 3% | chr7 | 87600681 | 87600690 | + | chr7 | 87607651 | 87607727 | + | ENST00000398209; ENST00000398203 | TSF |
| 3% | chr7 | 87600681 | 87600690 | + | chr7 | 87607651 | 87607727 | + | ENST00000398204; ENST00000439864; ENST00000398201; ENST00000265727; ENST00000315984; ENST00000398209; ENST00000398203 | TSF |
| 3% | chr7 | 87600681 | 87600690 | + | chr7 | 87607651 | 87607727 | + | ENST00000398204; ENST00000439864; ENST00000398201; ENST00000265727; ENST00000315984; ENST00000398209; ENST00000398203 | TSF |
| 3% | chr7 | 87600681 | 87600690 | + | chr7 | 87607651 | 87607727 | + | ENST00000398204; ENST00000439864; ENST00000398201; ENST00000265727; ENST00000315984; ENST00000398209; ENST00000398203 | TSF |
| 3% | chr7 | 87600681 | 87600690 | + | chr7 | 87607651 | 87607727 | + | ENST00000398204; ENST00000439864; ENST00000398201; ENST00000265727; ENST00000315984; ENST00000398209; ENST00000398203 | TSF |
| 3% | chr3 | 195593372 | 195593261 | − | chr3 | 195591058 | 195591052 | − | ENST00000416152; ENST00000381916; ENST00000333602; ENST00000392400 | TSF |
| 3% | chr8 | 104220609 | 104220725 | + | chr8 | 104225147 | 104225313 | + | ENST00000309982; ENST00000429574 | TSF |
| 3% | chr8 | 51556816 | 51557016 | + | chr8 | 51569469 | 51569585 | + | ENST00000518864; ENST00000522124; ENST00000517473; ENST00000520825; ENST00000276467; ENST00000524004 | TSF |
| 3% | chr8 | 51556816 | 51557016 | + | chr8 | 51569469 | 51569585 | + | ENST00000518864; ENST00000522124; ENST00000517473; ENST00000520825; ENST00000276467; ENST00000524004 | TSF |
| 3% | chr8 | 51556816 | 51557016 | + | chr8 | 51569469 | 51569585 | + | ENST00000518864; ENST00000522124; ENST00000517473; ENST00000520825; ENST00000276467; ENST00000524004 | TSF |
| 3% | chr1 | 10404970 | 10404975 | + | chr1 | 10405903 | 10406011 | + | ENST00000263934; ENST00000377086; ENST00000377081 | TSF |
| 3% | chr1 | 10404970 | 10404975 | + | chr1 | 10405903 | 10406011 | + | ENST00000263934; ENST00000377086; ENST00000377081 | TSF |
| 3% | chr19 | 4211130 | 4211271 | + | chr19 | 4212472 | 4212510 | + | ENST00000600132; ENST00000597689; ENST00000262970 | TSF |
| 3% | chr19 | 4211130 | 4211271 | + | chr19 | 4212472 | 4212510 | + | ENST00000600132; ENST00000597689; ENST00000262970 | TSF |
| 3% | chr1 | 243727680 | 243727587 | − | chr1 | 243727150 | 243727022 | − | ENST00000318934; ENST00000366199; ENST00000366540; ENST00000263826 | TSF |
| 3% | chr1 | 243727680 | 243727587 | − | chr1 | 243727150 | 243727022 | − | ENST00000318934; ENST00000366199; ENST00000366540; ENST00000263826 | TSF |
| 3% | chr14 | 60107035 | 60106250 | − | chr14 | 60074210 | 60074003 | − | ENST00000395090; ENST00000342503; ENST00000267484 | TSF |
| 3% | chr3 | 9476647 | 9476785 | + | chr3 | 9477412 | 9477509; 9477590 | + | ENST00000450326; ENST00000402198; ENST00000402466; ENST00000406341; ENST00000407969; ENST00000442373; ENST00000302463 | TSF |
| 3% | chr3 | 9476647 | 9476785 | + | chr3 | 9477412 | 9477509; 9477590 | + | ENST00000450326; ENST00000402198; ENST00000402466; ENST00000406341; ENST00000407969; ENST00000442373; ENST00000302463 | TSF |
| 3% | chr3 | 9476647 | 9476785 | + | chr3 | 9477412 | 9477509; 9477590 | + | ENST00000450326; ENST00000402198; ENST00000402466; ENST00000406341; ENST00000407969; ENST00000442373; ENST00000302463 | ITSF |
| 3% | chr3 | 9476647 | 9476785 | + | chr3 | 9477412 | 9477509; 9477590 | + | ENST00000450326; ENST00000402198; ENST00000402466; ENST00000406341; ENST00000407969; ENST00000442373; ENST00000302463 | TSF |
| 3% | chr16 | 47350611 | 47350483 | − | chr16 | 47347734 | 47347640 | − | ENST00000320640; ENST00000544001 | TSF |
| 3% | chr16 | 47350611 | 47350483 | − | chr16 | 47347734 | 47347640 | − | ENST00000320640; ENST00000544001 | TSF |
| 3% | chr22 | 39228782 | 39228705 | − | chr22 | 39224514 | 39224292 | − | ENST00000333039 | TSF |
| 3% | chr1 | 176882517 | 176882366 | − | chr1 | 176863966 | 176863698 | − | ENST00000367657; ENST00000361833; ENST00000424564 | TSF |
| 3% | chr1 | 176882517 | 176882366 | − | chr1 | 176863966 | 176863698 | − | ENST00000367657; ENST00000361833; ENST00000424564 | TSF |
| 3% | chr1 | 176882517 | 176882366 | − | chr1 | 176863966 | 176863698 | − | ENST00000367657; ENST00000361833; ENST00000424564 | TSF |
| 3% | chr13 | 51289548 | 51289014 | − | chr13 | 51287376 | 51287353 | − | ENST00000400393 | TSF |
| 3% | chr10 | 98821635 | 98821532 | − | chr10 | 98820544 | 98820397 | − | ENST00000266058; ENST00000371070; ENST00000314867; ENST00000371041 | TSF |
| 3% | chr10 | 98821635 | 98821532 | − | chr10 | 98820544 | 98820397 | − | ENST00000266058; ENST00000371070; ENST00000314867; ENST00000371041 | TSF |
| 3% | chr10 | 98821635 | 98821532 | − | chr10 | 98820544 | 98820397 | − | ENST00000266058; ENST00000371070; ENST00000314867; ENST00000371041 | TSF |
| 3% | chr2 | 216976986 | 216977153 | + | chr2 | 216977739 | 216977852 | + | ENST00000392133; ENST00000392132 | TSF |
| 3% | chr20 | 24951582 | 24951515 | − | chr20 | 24951007 | 24950833 | − | ENST00000451442; ENST00000217456; ENST00000447138 | TSF |
| 3% | chr20 | 24951582 | 24951515 | − | chr20 | 24951007 | 24950833 | − | ENST00000451442; ENST00000217456; ENST00000447138 | TSF |
| 3% | chr20 | 24951582 | 24951515 | − | chr20 | 24951007 | 24950833 | − | ENST00000451442; ENST00000217456; ENST00000447138 | TSF |
| 3% | chr3 | 11645847 | 11645798 | − | chr3 | 11643496 | 11643307 | − | ENST00000273038; ENST00000430365; ENST00000404339; ENST00000445411; ENST00000418000; ENST00000458499; ENST00000417206; ENST00000419541 | TSF |

TABLE 34-continued

Transcript fusion for Low Grade Glioma (LGG) Coordinates of the fusion sequences for which the donor is the TE.

| 1' | 2' | 3' | 4' | 5' | 6' | 7' | 8' | 9' | 10' | 11' |
|---|---|---|---|---|---|---|---|---|---|---|
| 3% | chr3 | 11645847 | 11645798 | − | chr3 | 11643496 | 11643307 | − | ENST00000273038; ENST00000417206; ENST00000404339; ENST00000445411; ENST00000418000; ENST00000458499; ENST00000419541 | TSF |
| 3% | chr3 | 11645847 | 11645798 | − | chr3 | 11643496 | 11643307 | − | ENST00000273038; ENST00000417206; ENST00000404339; ENST00000445411; ENST00000418000; ENST00000458499; ENST00000419541 | TSF |
| 3% | chr3 | 11645847 | 11645798 | − | chr3 | 11643496 | 11643307 | − | ENST00000273038; ENST00000417206; ENST00000404339; ENST00000445411; ENST00000418000; ENST00000458499; ENST00000419541 | TSF |
| 3% | chr3 | 11645847 | 11645798 | − | chr3 | 11643496 | 11643307 | − | ENST00000273038; ENST00000417206; ENST00000404339; ENST00000445411; ENST00000418000; ENST00000458499; ENST00000419541 | TSF |
| 3% | chr8 | 82357757 | 82357691 | − | chr8 | 82357224 | 82357052 | − | ENST00000256103 | TSF |
| 3% | chr15 | 43802603 | 43802568 | − | chr15 | 43784666 | 43784482 | − | ENST00000382039; ENST00000450115; ENST00000413546 | TSF |
| 3% | chr15 | 43802603 | 43802568 | − | chr15 | 43784666 | 43784482 | − | ENST00000382039; ENST00000450115; ENST00000413546 | TSF |
| 3% | chr15 | 43802603 | 43802568 | − | chr15 | 43784666 | 43784482 | − | ENST00000382039; ENST00000450115; ENST00000413546 | TSF |
| 3% | chr15 | 43802603 | 43802568 | − | chr15 | 43784666 | 43784482 | − | ENST00000382039; ENST00000450115; ENST00000413546 | TSF |
| 3% | chr14 | 26959896 | 26959460 | − | chr14 | 26949349 | 26949183 | − | ENST00000465357; ENST00000549571; ENST00000449198; ENST00000539517; ENST00000574031 | TSF |
| 3% | chr14 | 26959896 | 26959460 | − | chr14 | 26949349 | 26949183 | − | ENST00000465357; ENST00000549571; ENST00000449198; ENST00000539517; ENST00000574031 | TSF |
| 3% | chr14 | 26959896 | 26959460 | − | chr14 | 26949349 | 26949183 | − | ENST00000465357; ENST00000549571; ENST00000449198; ENST00000539517; ENST00000574031 | TSF |
| 3% | chr14 | 26959896 | 26959460 | − | chr14 | 26949349 | 26949183 | − | ENST00000465357; ENST00000549571; ENST00000449198; ENST00000539517; ENST00000574031 | TSF |
| 3% | chr14 | 26959896 | 26959460 | − | chr14 | 26949349 | 26949183 | − | ENST00000465357; ENST00000549571; ENST00000449198; ENST00000539517; ENST00000574031 | TSF |
| 3% | chr4 | 70495075 | 70495153 | + | chr4 | 70496962 | 70496975 | + | ENST00000361956; ENST00000381280 | TSF |
| 3% | chr4 | 107241932 | 107242046 | + | chr4 | 107246142 | 107246275 | + | ENST00000394701 | TSF |
| 3% | chr19 | 54945134 | 54945169 | + | chr19 | 54946722 | 54946864 | + | ENST00000301194; ENST00000391739; ENST00000376530; ENST00000376531 | TSF |
| 3% | chr19 | 54945134 | 54945169 | + | chr19 | 54946722 | 54946864 | + | ENST00000301194; ENST00000391739; ENST00000376530; ENST00000376531 | TSF |
| 3% | chr19 | 54945134 | 54945169 | + | chr19 | 54946722 | 54946864 | + | ENST00000301194; ENST00000391739; ENST00000376530; ENST00000376531 | TSF |
| 3% | chr3 | 11060777 | 11060955 | + | chr3 | 11061899 | 11062008 | + | ENST00000287766 | TSF |
| 3% | chr7 | 121556048 | 121556146 | + | chr7 | 121568210 | 121568275 | + | ENST00000393386; ENST00000449182 | TSF |
| 3% | chr7 | 121556048 | 121556146 | + | chr7 | 121568210 | 121568275 | + | ENST00000393386; ENST00000449182 | TSF |
| 3% | chr6 | 123101055 | 123101091 | + | chr6 | 123101436 | 123101608 | + | ENST00000368444; ENST00000356535 | TSF |
| 3% | chr6 | 123101055 | 123101091 | + | chr6 | 123101436 | 123101608 | + | ENST00000368444; ENST00000356535 | TSF |
| 3% | chr10 | 118751278 | 118750845 | − | chr10 | 118738819 | 118738767 | − | ENST00000392903; ENST00000260777; ENST00000355371 | TSF |
| 3% | chr10 | 118751278 | 118750845 | − | chr10 | 118738819 | 118738767 | − | ENST00000392903; ENST00000260777; ENST00000355371 | TSF |
| 3% | chr10 | 118751278 | 118750845 | − | chr10 | 118738819 | 118738767 | − | ENST00000392903; ENST00000260777; ENST00000355371 | TSF |
| 3% | chr4 | 5869106 | 5868912 | − | chr4 | 5868483 | 5868395 | − | ENST00000324989; ENST00000397890; ENST00000512574 | TSF |
| 3% | chr5 | 152889167 | 152889366 | + | chr5 | 153026488 | 153026727 | + | ENST00000285900; ENST00000340592; ENST00000521843; ENST00000448073; ENST00000518783 | TSF |
| 3% | chr5 | 152889167 | 152889366 | + | chr5 | 153026488 | 153026727 | + | ENST00000285900; ENST00000340592; ENST00000521843; ENST00000448073; ENST00000518783 | TSF |
| 3% | chr7 | 121570168 | 121570251 | + | chr7 | 121608005 | 121608184 | + | ENST00000393386; ENST00000449182 | TSF |
| 3% | chr7 | 121570168 | 121570251 | + | chr7 | 121608005 | 121608184 | + | ENST00000393386; ENST00000449182 | TSF |
| 3% | chr9 | 126117506 | 126117568 | + | chr9 | 126125144 | 126125467 | + | ENST00000359999; ENST00000373631 | TSF |

TABLE 34-continued

Transcript fusion for Low Grade Glioma (LGG) Coordinates of the fusion sequences for which the donor is the TE.

| 1' | 2' | 3' | 4' | 5' | 6' | 7' | 8' | 9' | 10' | 11' |
|---|---|---|---|---|---|---|---|---|---|---|
| 3% | chr9 | 126117506 | 126117568 | + | chr9 | 126125144 | 126125467 | + | ENST00000359999; ENST00000373631 | TSF |
| 3% | chr7 | 55985644 | 55985990 | + | chr7 | 55990855 | 55990981 | + | ENST00000426595; ENST00000429591 | TSF |
| 3% | chr7 | 55985644 | 55985990 | − | chr7 | 55990855 | 55990981 | + | ENST00000426595; ENST00000429591 | TSF |
| 3% | chr1 | 226599484 | 226599358 | − | chr1 | 226590080 | 226589915; 226589733 | − | ENST00000366794; ENST00000366792; ENST00000366791; ENST00000366790 | TSF |
| 3% | chr1 | 226599484 | 226599358 | − | chr1 | 226590080 | 226589915; 226589733 | − | ENST00000366794; ENST00000366792; ENST00000366791; ENST00000366790 | TSF |
| 3% | chr1 | 226599484 | 226599358 | − | chr1 | 226590080 | 226589915; 226589733 | − | ENST00000366794; ENST00000366792; ENST00000366791; ENST00000366790 | TSF |
| 3% | chr18 | 74710407 | 74710247 | − | chr18 | 74702016 | 74701912; 74701967; 74701932; 74701935 | − | ENST00000382582; ENST00000359645; ENST00000580402; ENST00000578873; ENST00000355994; ENST00000397869; ENST00000579129; ENST00000459948; ENST00000397875; ENST00000531144; ENST00000578193; ENST00000498683; ENST00000397866; ENST00000583474; ENST00000447114; ENST00000527041; ENST00000533278; ENST00000473302; ENST00000526111; ENST00000493623 | TSF |
| 3% | chr18 | 74710407 | 74710247 | − | chr18 | 74702016 | 74701912; 74701967; 74701932; 74701935 | − | ENST00000382582; ENST00000359645; ENST00000580402; ENST00000578873; ENST00000355994; ENST00000397869; ENST00000579129; ENST00000459948; ENST00000397875; ENST00000531144; ENST00000578193; ENST00000498683; ENST00000397866; ENST00000583474; ENST00000447114; ENST00000527041; ENST00000533278; ENST00000473302; ENST00000526111; ENST00000493623 | TSF |
| 3% | chr18 | 74710407 | 74710247 | − | chr18 | 74702016 | 74701912; 74701967; 74701932; 74701935 | − | ENST00000382582; ENST00000359645; ENST00000580402; ENST00000578873; ENST00000355994; ENST00000397869; ENST00000579129; ENST00000459948; ENST00000397875; ENST00000531144; ENST00000578193; ENST00000498683; ENST00000397866; ENST00000583474; ENST00000447114; ENST00000527041; ENST00000533278; ENST00000473302; ENST00000526111; ENST00000493623 | TSF |
| 3% | chr18 | 74710407 | 74710247 | − | chr18 | 74702016 | 74701912; 74701967; 74701932; 74701935 | − | ENST00000382582; ENST00000359645; ENST00000580402; ENST00000578873; ENST00000355994; ENST00000397869; ENST00000579129; ENST00000459948; ENST00000397875; ENST00000531144; ENST00000578193; ENST00000498683; ENST00000397866; ENST00000583474; ENST00000447114; ENST00000527041; ENST00000533278; ENST00000473302; ENST00000526111; ENST00000493623 | TSF |
| 3% | chr18 | 74710407 | 74710247 | − | chr18 | 74702016 | 74701912; 74701967; 74701932; 74701935 | − | ENST00000382582; ENST00000359645; ENST00000580402; ENST00000578873; ENST00000355994; ENST00000397869; ENST00000579129; ENST00000459948; ENST00000397875; ENST00000531144; ENST00000578193; ENST00000498683; ENST00000397866; ENST00000583474; ENST00000447114; ENST00000527041; ENST00000533278; ENST00000473302; ENST00000526111; ENST00000493623 | TSF |
| 3% | chr18 | 74710407 | 74710247 | − | chr18 | 74702016 | 74701912; 74701967; 74701932; 74701935 | − | ENST00000382582; ENST00000359645; ENST00000580402; ENST00000578873; ENST00000355994; ENST00000397869; ENST00000579129; ENST00000459948; ENST00000397875; ENST00000531144; ENST00000578193; ENST00000498683; ENST00000397866; ENST00000583474; ENST00000447114; ENST00000527041; ENST00000533278; ENST00000473302; ENST00000526111; ENST00000493623 | TSF |
| 3% | chr18 | 74710407 | 74710247 | − | chr18 | 74702016 | 74701912; 74701967; 74701932; 74701935 | − | ENST00000382582; ENST00000359645; ENST00000580402; ENST00000578873; ENST00000355994; ENST00000397869; ENST00000579129; ENST00000459948; ENST00000397875; ENST00000531144; ENST00000578193; ENST00000498683; ENST00000397866; ENST00000583474; ENST00000447114; ENST00000527041; ENST00000533278; ENST00000473302; ENST00000526111; ENST00000493623 | TSF |
| 3% | chr18 | 74710407 | 74710247 | − | chr18 | 74702016 | 74701912; 74701967; 74701932; 74701935 | − | ENST00000382582; ENST00000359645; ENST00000580402; ENST00000578873; ENST00000355994; ENST00000397869; ENST00000579129; ENST00000459948; ENST00000397875; ENST00000531144; ENST00000578193; ENST00000498683; ENST00000397866; ENST00000583474; ENST00000447114; ENST00000527041; ENST00000533278; ENST00000473302; ENST00000526111; ENST00000493623 | TSF |

TABLE 34-continued

Transcript fusion for Low Grade Glioma (LGG) Coordinates of the fusion sequences for which the donor is the TE.

| 1' | 2' | 3' | 4' | 5' | 6' | 7' | 8' | 9' | 10' | 11' |
|---|---|---|---|---|---|---|---|---|---|---|
| 3% | chr18 | 74710407 | 74710247 | – | chr18 | 74702016 | 74701912; 74701967; 74701932; 7401935 | – | ENST00000382582; ENST00000355994; ENST00000397865; ENST00000397866; ENST00000527041; ENST00000359645; ENST00000397869; ENST00000531144; ENST00000583474; ENST00000526111; ENST00000580402; ENST00000579129; ENST00000578193; ENST00000447114; ENST00000473302; ENST00000493623; ENST00000578873; ENST00000459948; ENST00000498683 | TSF |
| 3% | chr18 | 74710407 | 74710247 | – | chr18 | 74702016 | 74701912; 74701967; 74701932; 7401935 | – | ENST00000382582; ENST00000355994; ENST00000397865; ENST00000397866; ENST00000527041; ENST00000359645; ENST00000397869; ENST00000531144; ENST00000583474; ENST00000526111; ENST00000580402; ENST00000579129; ENST00000578193; ENST00000447114; ENST00000473302; ENST00000493623; ENST00000578873; ENST00000459948; ENST00000498683 | TSF |
| 3% | chr18 | 74710407 | 74710247 | – | chr18 | 74702016 | 74701912; 74701967; 74701932; 7401935 | – | ENST00000382582; ENST00000355994; ENST00000397865; ENST00000397866; ENST00000527041; ENST00000359645; ENST00000397869; ENST00000531144; ENST00000583474; ENST00000526111; ENST00000580402; ENST00000579129; ENST00000578193; ENST00000447114; ENST00000473302; ENST00000493623; ENST00000578873; ENST00000459948; ENST00000498683 | TSF |
| 3% | chr18 | 74710407 | 74710247 | – | chr18 | 74702016 | 74701912; 74701967; 74701932; 7401935 | – | ENST00000382582; ENST00000355994; ENST00000397865; ENST00000397866; ENST00000527041; ENST00000359645; ENST00000397869; ENST00000531144; ENST00000583474; ENST00000526111; ENST00000580402; ENST00000579129; ENST00000578193; ENST00000447114; ENST00000473302; ENST00000493623; ENST00000578873; ENST00000459948; ENST00000498683 | TSF |
| 2% | chr5 | 152870891 | 152870892 | + | chr5 | 152873488 | 152873625 | + | ENST00000285900; ENST00000518142; ENST00000340592; ENST00000448073; ENST00000518783 | TSF |
| 2% | chr5 | 152870891 | 152870892 | + | chr5 | 152873488 | 152873625 | + | ENST00000285900; ENST00000518142; ENST00000340592; ENST00000448073; ENST00000518783 | TSF |
| 2% | chr5 | 152870891 | 152870892 | + | chr5 | 152873488 | 152873625 | + | ENST00000285900; ENST00000518142; ENST00000340592; ENST00000448073; ENST00000518783 | TSF |
| 2% | chr18 | 60453659 | 60453726 | + | chr18 | 60497268 | 60497464 | + | ENST00000400316; ENST00000262719 | TSF |
| 2% | chr7 | 95037343 | 95037151 | – | chr7 | 95035559 | 95035431 | – | ENST00000536183; ENST00000443091; ENST00000222572 | TSF |
| 2% | chr11 | 10549538 | 10549023 | – | chr11 | 10546920 | 10546739 | – | ENST00000265981; ENST00000528665; ENST00000533412 | TSF |
| 2% | chr11 | 10549538 | 10549023 | – | chr11 | 10546920 | 10546739 | – | ENST00000265981; ENST00000528665; ENST00000533412 | TSF |
| 2% | chr11 | 10549538 | 10549023 | – | chr11 | 10546920 | 10546739 | – | ENST00000265981; ENST00000528665; ENST00000533412 | TSF |
| 2% | chr7 | 102307107 | 102306895 | – | chr7 | 102306610 | 102306578; 102306524 | – | ENST00000591000; ENST00000476151; ENST00000333432 | TSF |
| 2% | chr7 | 102307107 | 102306895 | – | chr7 | 102306610 | 102306578; 102306524 | – | ENST00000591000; ENST00000476151; ENST00000333432 | TSF |
| 2% | chr20 | 25053246 | 25053172 | – | chr20 | 25052654 | 25052557; 25052571 | – | ENST00000429762; ENST00000444511 | TSF |
| 2% | chr20 | 25053246 | 25053172 | – | chr20 | 25052654 | 25052557; 25052571 | – | ENST00000429762; ENST00000444511 | TSF |
| 2% | chr7 | 55477082 | 55477474 | + | chr7 | 55479600 | 55479782 | + | ENST00000254770 | TSF |
| 2% | chr13 | 78324032 | 78324377 | + | chr13 | 78327338 | 78327493; 78327417; 78327376 | + | ENST00000466548; ENST00000441784; ENST00000314070; ENST00000418532; ENST00000442759; ENST00000474663; ENST00000488699; ENST00000267219; ENST00000351546; ENST00000358679 | TSF |
| 2% | chr13 | 78324032 | 78324377 | + | chr13 | 78327338 | 78327493; 78327417; 78327376 | + | ENST00000466548; ENST00000441784; ENST00000314070; ENST00000418532; ENST00000442759; ENST00000474663; ENST00000488699; ENST00000267219; ENST00000351546; ENST00000358679 | TSF |
| 2% | chr13 | 78324032 | 78324377 | + | chr13 | 78327338 | 78327493; 78327417; 78327376 | + | ENST00000466548; ENST00000441784; ENST00000314070; ENST00000418532; ENST00000442759; ENST00000474663; ENST00000488699; ENST00000267219; ENST00000351546; ENST00000358679 | TSF |
| 2% | chr13 | 78324032 | 78324377 | + | chr13 | 78327338 | 78327493; 78327417; 78327376 | + | ENST00000466548; ENST00000441784; ENST00000314070; ENST00000418532; ENST00000442759; ENST00000474663; ENST00000488699; ENST00000267219; ENST00000351546; ENST00000358679 | TSF |
| 2% | chr7 | 121663316 | 121663441 | + | chr7 | 121668606 | 121668697 | + | ENST00000393386; ENST00000449182 | TSF |
| 2% | chr7 | 121663316 | 121663441 | + | chr7 | 121668606 | 121668697 | + | ENST00000393386; ENST00000449182 | TSF |
| 2% | chr20 | 25777823 | 25776681 | – | chr20 | 25755972 | 25755659 | – | ENST00000584071 | TSF |
| 2% | chrX | 48752918 | 48752631 | – | chrX | 48751504 | 48751380 | – | ENST00000465150; ENST00000376582; ENST00000396779; ENST00000495490; ENST00000490755 | TSF |

TABLE 34-continued

Transcript fusion for Low Grade Glioma (LGG) Coordinates of the fusion sequences for which the donor is the TE.

| 1' | 2' | 3' | 4' | 5' | 6' | 7' | 8' | 9' | 10' | 11' |
|---|---|---|---|---|---|---|---|---|---|---|
| 2% | chrX | 48752918 | 48752631 | − | chrX | 48751504 | 48751380 | − | ENST00000465150; ENST00000376582; ENST00000396779; ENST00000495490; ENST00000490755 | TSF |
| 2% | chr9 | 101249511 | 101249441 | − | chr9 | 101243279 | 101243214 | − | ENST00000259455 | TSF |
| 2% | chr11 | 9172687 | 9172677 | − | chr11 | 9172311 | 9172227; 9172252 | − | ENST00000328194; ENST00000530044; ENST00000527700; ENST00000526707 | TSF |
| 2% | chr11 | 9172687 | 9172677 | − | chr11 | 9172311 | 9172227; 9172252 | − | ENST00000328194; ENST00000527700; ENST00000526707 | TSF |
| 2% | chr11 | 9172687 | 9172677 | − | chr11 | 9172311 | 9172227; 9172252 | − | ENST00000328194; ENST00000527700; ENST00000526707 | TSF |
| 2% | chr7 | 99810933 | 99810670 | − | chr7 | 99773988 | 99773830 | − | ENST00000292377 | TSF |
| 2% | chr15 | 80691014 | 80690949 | − | chr15 | 80690348 | 80690286 | − | ENST00000559008 | TSF |
| 2% | chr4 | 83652035 | 83651970 | − | chr4 | 83626566 | 83626436 | − | ENST00000319540; ENST00000273908; ENST00000282709 | TSF |
| 2% | chr4 | 83652035 | 83651970 | − | chr4 | 83626566 | 83626436 | − | ENST00000319540; ENST00000273908; ENST00000282709 | TSF |
| 2% | chr4 | 83652035 | 83651970 | − | chr4 | 83626566 | 83626436 | − | ENST00000319540; ENST00000273908; ENST00000282709 | TSF |
| 2% | chr7 | 55435136 | 55435321 | + | chr7 | 55459486 | 55459603 | + | ENST00000254770 | TSF |
| 2% | chr5 | 90248993 | 90249033 | + | chr5 | 90261232 | 90261348 | + | ENST00000405460; ENST00000425867 | TSF |
| 2% | chr3 | 133466701 | 133466865 | + | chr3 | 133467256 | 133467428; 133467513; 133467369 | + | ENST00000402696; ENST00000414694; ENST00000494430; ENST00000485977 | TSF |
| 2% | chr3 | 133466701 | 133466865 | + | chr3 | 133467256 | 133467428; 133467513; 133467369 | + | ENST00000402696; ENST00000414694; ENST00000494430; ENST00000485977 | TSF |
| 2% | chr3 | 133466701 | 133466865 | + | chr3 | 133467256 | 133467428; 133467513; 133467369 | + | ENST00000402696; ENST00000414694; ENST00000494430; ENST00000485977 | TSF |
| 2% | chr6 | 13616316 | 13616338 | + | chr6 | 13616695 | 13616753 | + | ENST00000451315; ENST00000420088 | TSF |
| 2% | chr6 | 13616316 | 13616338 | + | chr6 | 13616695 | 13616753 | + | ENST00000451315; ENST00000420088 | TSF |
| 2% | chr7 | 148982749 | 148982787 | + | chr7 | 148984656 | 148984699; 148984867 | + | ENST00000378052; ENST00000476295; ENST00000418158 | TSF |
| 2% | chr7 | 148982749 | 148982787 | + | chr7 | 148984656 | 148984699; 148984867 | + | ENST00000378052; ENST00000418158 | TSF |
| 2% | chr17 | 39974832 | 39974893 | + | chr17 | 39975462 | 39975651 | + | ENST00000321562 | TSF |
| 2% | chr10 | 31755851 | 31757459 | + | chr10 | 31784708 | 31784767 | + | ENST00000320985; ENST00000361642; ENST00000424869; ENST00000561212; ENST00000428815; ENST00000446923; ENST00000559476 | TSF |
| 2% | chr10 | 31755851 | 31757459 | + | chr10 | 31784708 | 31784767 | + | ENST00000320985; ENST00000361642; ENST00000424869; ENST00000561212; ENST00000428815; ENST00000446923; ENST00000559476 | TSF |
| 2% | chr10 | 31755851 | 31757459 | + | chr10 | 31784708 | 31784767 | + | ENST00000320985; ENST00000361642; ENST00000424869; ENST00000561212; ENST00000428815; ENST00000446923; ENST00000559476 | TSF |
| 2% | chr14 | 70495075 | 70495153 | + | chr14 | 70496959 | 70496975 | + | ENST00000480740; ENST00000471696; ENST00000361956; ENST00000485923 | TSF |
| 2% | chr3 | 150344303 | 150344471 | + | chr3 | 150344797 | 150344921 | + | ENST00000258767; ENST00000399322; ENST00000399351; ENST00000402815; ENST00000402700 | TSF |
| 2% | chr7 | 14309025 | 14308524 | − | chr7 | 14217776 | 14217656 | − | ENST00000406247 | TSF |
| 2% | chr7 | 14309025 | 14308524 | − | chr7 | 14217776 | 14217656 | − | ENST00000258767; ENST00000399322; ENST00000399351; ENST00000402815; ENST00000407950; ENST00000444700 | TSF |
| 2% | chr20 | 52615231 | 52614848 | − | chr20 | 52612589 | 52612431 | − | ENST00000406247; ENST00000448484; ENST00000371440; ENST00000371435; ENST00000395961 | TSF |

TABLE 34-continued

Transcript fusion for Low Grade Glioma (LGG) Coordinates of the fusion sequences for which the donor is the TE.

| 1' | 2' | 3' | 4' | 5' | 6' | 7' | 8' | 9' | 10' | 11' |
|---|---|---|---|---|---|---|---|---|---|---|
| 2% | chr20 | 52615231 | 52614848 | − | chr20 | 52612589 | 52612431 | − | ENST00000448484; ENST00000371440; ENST00000371435; ENST00000395961 | TSF |
| 2% | chr20 | 52615231 | 52614848 | − | chr20 | 52612589 | 52612431 | − | ENST00000448484; ENST00000371440; ENST00000371435; ENST00000395961 | TSF |
| 2% | chr4 | 174310858 | 174310746 | − | chr4 | 174309544 | 174309492 | − | ENST00000296506 | TSF |
| 2% | chr3 | 139244518 | 139244462 | − | chr3 | 139237364 | 139237263 | − | ENST00000232219 | TSF |
| 2% | chr13 | 51414162 | 51414079 | − | chr13 | 51397656 | 51397450 | − | ENST00000504404 | TSF |
| 2% | chr12 | 50285408 | 50285280 | − | chr12 | 50284897 | 50284860 | − | ENST00000320634; ENST00000550890; ENST00000552669; ENST00000552863; ENST00000550635; ENST00000547871 | TSF |
| 2% | chr12 | 50285408 | 50285280 | − | chr12 | 50284897 | 50284860 | − | ENST00000320634; ENST00000550890; ENST00000552669; ENST00000552863; ENST00000550635; ENST00000547871 | TSF |
| 2% | chr12 | 50285408 | 50285280 | − | chr12 | 50284897 | 50284860 | − | ENST00000320634; ENST00000550890; ENST00000552669; ENST00000552863; ENST00000550635; ENST00000547871 | TSF |
| 2% | chr12 | 50285408 | 50285280 | − | chr12 | 50284897 | 50284860 | − | ENST00000320634; ENST00000550890; ENST00000552669; ENST00000552863; ENST00000550635; ENST00000547871 | TSF |
| 2% | chr12 | 50285408 | 50285280 | − | chr12 | 50284897 | 50284860 | − | ENST00000320634; ENST00000550890; ENST00000552669; ENST00000552863; ENST00000550635; ENST00000547871 | TSF |
| 2% | chr9 | 104030196 | 104030320 | + | chr9 | 104032162 | 104032350 | + | ENST00000374874; ENST00000456287; ENST00000395056 | TSF |
| 2% | chr9 | 104030196 | 104030320 | + | chr9 | 104032162 | 104032350 | + | ENST00000374874; ENST00000456287; ENST00000395056 | TSF |
| 2% | chr2 | 173902425 | 173902474 | + | chr2 | 173913328 | 173913382 | + | ENST00000264111; ENST00000397081; ENST00000409036; ENST00000397087; ENST00000538974; ENST00000540783; ENST00000539331; ENST00000535187 | TSF |
| 2% | chr11 | 47435494 | 47435767 | + | chr11 | 47435976 | 47436026 | + | ENST00000533076; ENST00000531865; ENST00000362021; ENST00000354884 | TSF |
| 2% | chr11 | 47435494 | 47435767 | + | chr11 | 47435976 | 47436026 | + | ENST00000533076; ENST00000531865; ENST00000362021; ENST00000354884 | TSF |
| 2% | chr11 | 47435494 | 47435767 | + | chr11 | 47435976 | 47436026 | + | ENST00000533076; ENST00000531865; ENST00000362021; ENST00000354884 | TSF |
| 2% | chr11 | 47435494 | 47435767 | + | chr11 | 47435976 | 47436026 | + | ENST00000533076; ENST00000531865; ENST00000362021; ENST00000354884 | TSF |
| 2% | chr3 | 170144282 | 170144403 | + | chr3 | 170150312 | 170150544 | + | ENST00000393386; ENST00000449182 | TSF |
| 2% | chr18 | 60485771 | 60485978 | + | chr18 | 60497268 | 60497464 | + | ENST00000400316; ENST00000262719 | TSF |
| 2% | chr7 | 55464873 | 55464924 | + | chr7 | 55466116 | 55466323 | + | ENST00000254770 | TSF |
| 2% | chr20 | 35861188 | 35861289 | + | chr20 | 35862423 | 35862498 | + | ENST00000237530; ENST00000373622; ENST00000437329; ENST00000456400 | TSF |
| 2% | chr20 | 35861188 | 35861289 | + | chr20 | 35862423 | 35862498 | + | ENST00000237530; ENST00000373622; ENST00000437329; ENST00000456400 | TSF |
| 2% | chr20 | 35861188 | 35861289 | + | chr20 | 35862423 | 35862498 | + | ENST00000237530; ENST00000373622; ENST00000437329; ENST00000456400 | TSF |
| 2% | chr7 | 121614961 | 121615144 | + | chr7 | 121616227 | 121616322 | + | ENST00000393386; ENST00000449182 | TSF |
| 2% | chr7 | 121614961 | 121615144 | + | chr7 | 121616227 | 121616322 | + | ENST00000393386; ENST00000449182 | TSF |
| 2% | chr15 | 75891737 | 75891599 | − | chr15 | 75891022 | 75890699 | − | ENST00000567134; ENST00000308588; ENST00000371091; ENST00000564644; ENST00000564675 | TSF |
| 2% | chr18 | 58558391 | 58558348 | − | chr18 | 58555592 | 58555418 | − | ENST00000474531; ENST00000447756 | TSF |
| 2% | chr3 | 33556001 | 33556042 | − | chr3 | 33552256 | 33552050 | − | ENST00000468888; ENST00000399362; ENST00000307312; ENST00000359576; ENST00000480013; ENST00000461133 | TSF |
| 2% | chr12 | 58023123 | 58023062 | − | chr12 | 58022929 | 58022831; 58022905 | − | ENST00000341156; ENST00000552798; ENST00000549391 | TSF |
| 2% | chr12 | 58023123 | 58023062 | − | chr12 | 58022929 | 58022831; 58022905 | − | ENST00000341156; ENST00000552798; ENST00000549391 | TSF |
| 2% | chr17 | 27415371 | 274127415 | − | chr17 | 27414139 | 27413954 | − | ENST00000354329; ENST00000533112; ENST00000531253; ENST00000527372 | TSF |
| 2% | chr17 | 27415371 | 274127415 | − | chr17 | 27414139 | 27413954 | − | ENST00000354329; ENST00000533112; ENST00000531253; ENST00000527372 | TSF |
| 2% | chr18 | 48347181 | 48347090 | − | chr18 | 48346072 | 48345951 | − | ENST00000585524; ENST00000431965; ENST00000436348 | TSF |
| 2% | chr18 | 48347181 | 48347090 | − | chr18 | 48346072 | 48345951 | − | ENST00000585524; ENST00000431965; ENST00000436348 | TSF |
| 2% | chr18 | 48347181 | 48347090 | − | chr18 | 48346072 | 48345951 | − | ENST00000585524; ENST00000431965; ENST00000436348 | TSF |
| 2% | chr6 | 36924636 | 36924925 | + | chr6 | 36926921 | 36927142 | + | ENST00000373674 | TSF |
| 2% | chr5 | 140889477 | 140889480 | + | chr5 | 140890514 | 140890740 | + | ENST00000517417; ENST00000394576; ENST00000253812; ENST00000523390; ENST00000522605; ENST00000518069; ENST00000576222; ENST00000517434; ENST00000518325; ENST00000519479; ENST00000398604; ENST00000573521; ENST00000520790; ENST00000398610; ENST00000398594; ENST00000398587; ENST00000518882; | TSF |

TABLE 34-continued

Transcript fusion for Low Grade Glioma (LGG) Coordinates of the fusion sequences for which the donor is the TE.

| 1' | 2' | 3' | 4' | 5' | 6' | 7' | 8' | 9' | 10' | 11' |
|---|---|---|---|---|---|---|---|---|---|---|
| 2% | chr3 | 134857832 | 134857845 | + | chr3 | 134872994 | 134873118 | + | ENST00000252085; ENST00000308177; ENST00000306593; ENST00000252087 | TSF |
| 2% | chr2 | 79872412 | 79872487 | + | chr2 | 79878678 | 79878784 | + | ENST00000398015 | TSF |
| 2% | chr9 | 17779355 | 17779564 | + | chr9 | 17786379 | 17786522 | + | ENST00000380607; ENST00000361291 | TSF |
| 2% | chr7 | 150783303 | 150783304 | + | chr7 | 150784009 | 150784159 | + | ENST00000473312; ENST00000479901; ENST00000397238 | TSF |
| 2% | chr7 | 150783303 | 150783304 | + | chr7 | 150784009 | 150784159 | + | ENST00000473312; ENST00000479901; ENST00000397238 | TSF |
| 2% | chr7 | 150783303 | 150783304 | + | chr7 | 150784009 | 150784159 | + | ENST00000473312; ENST00000479901; ENST00000397238 | TSF |
| 2% | chr10 | 124238815 | 124238992 | + | chr10 | 124248418 | 124248517 | + | ENST00000368984 | TSF |
| 2% | chr2 | 220381821 | 220381889 | + | chr2 | 220396480 | 220396624 | + | ENST00000347842; ENST00000358078 | TSF |
| 2% | chr2 | 220381821 | 220381889 | + | chr2 | 220396480 | 220396624 | + | ENST00000347842; ENST00000358078 | TSF |
| 2% | chr11 | 113094670 | 113100589 | + | chr11 | 113102367 | 113102517 | + | ENST00000533760; ENST00000524665; ENST00000534015; ENST00000401611; ENST00000316851 | TSF |
| 2% | chr11 | 113094670 | 113100589 | + | chr11 | 113102367 | 113102517 | + | ENST00000533760; ENST00000524665; ENST00000534015; ENST00000401611; ENST00000316851 | TSF |
| 2% | chr11 | 113094670 | 113100589 | + | chr11 | 113102367 | 113102517 | + | ENST00000533760; ENST00000524665; ENST00000534015; ENST00000401611; ENST00000316851 | ITSF |
| 2% | chr11 | 113094670 | 113100589 | + | chr11 | 113102367 | 113102517 | + | ENST00000533760; ENST00000524665; ENST00000534015; ENST00000401611; ENST00000316851 | TSF |
| 2% | chr8 | 9629642 | 9629933 | + | chr8 | 9634160 | 9634246 | + | ENST00000310430; ENST00000518281 | TSF |
| 2% | chr17 | 7549704 | 7550019 | + | chr17 | 7557159 | 7557263 | + | ENST00000250111 | TSF |
| 2% | chr7 | 73816311 | 73816411 | + | chr7 | 73818167 | 73818178 | + | ENST00000361545; ENST00000223398; ENST00000395060; ENST00000487447 | ITSF |
| 2% | chr15 | 52850366 | 52850214 | − | chr15 | 52849419 | 52849297 | − | ENST00000566423; ENST00000249822; ENST00000567669; ENST00000569281; ENST00000561971 | TSF |
| 2% | chr8 | 80686236 | 80686056 | − | chr8 | 80678931 | 80678886 | − | ENST00000354724; ENST00000377919; ENST00000518733 | TSF |
| 2% | chr8 | 80686236 | 80686056 | − | chr8 | 80678931 | 80678886 | − | ENST00000354724; ENST00000377919; ENST00000518733 | TSF |
| 2% | chr6 | 131913985 | 131913952 | − | chr6 | 131913600 | 131913528 | − | ENST00000354577; ENST00000403834; ENST00000368068; ENST00000368060; ENST00000368058; ENST00000545957 | TSF |
| 2% | chr6 | 131913985 | 131913952 | − | chr6 | 131913600 | 131913528 | − | ENST00000354577; ENST00000403834; ENST00000368068; ENST00000368060; ENST00000368058; ENST00000545957 | TSF |
| 2% | chr6 | 131913985 | 131913952 | − | chr6 | 131913600 | 131913528 | − | ENST00000354577; ENST00000403834; ENST00000368068; ENST00000368060; ENST00000368058; ENST00000545957 | TSF |
| 2% | chr6 | 131913985 | 131913952 | − | chr6 | 131913600 | 131913528 | − | ENST00000354577; ENST00000403834; ENST00000368068; ENST00000368060; ENST00000368058; ENST00000545957 | TSF |
| 2% | chr1 | 246581335 | 246580598 | − | chr1 | 246498776 | 246498669 | − | ENST00000541742; ENST00000490107; ENST00000388985; ENST00000453676; ENST00000403792; ENST00000455277 | TSF |
| 2% | chr1 | 246581335 | 246580598 | − | chr1 | 246498776 | 246498669 | − | ENST00000541742; ENST00000490107; ENST00000388985; ENST00000453676; ENST00000403792; ENST00000455277 | TSF |
| 2% | chr1 | 246581335 | 246580598 | − | chr1 | 246498776 | 246498669 | − | ENST00000541742; ENST00000490107; ENST00000388985; ENST00000453676; ENST00000403792; ENST00000455277 | TSF |
| 2% | chr1 | 246581335 | 246580598 | − | chr1 | 246498776 | 246498669 | − | ENST00000541742; ENST00000490107; ENST00000388985; ENST00000453676; ENST00000403792; ENST00000455277 | TSF |
| 2% | chr11 | 124800143 | 124799875 | − | chr11 | 124794965 | 124794624 | − | ENST00000298251 | TSF |
| 2% | chr10 | 5454793 | 5454849 | + | chr10 | 5468618 | 5468684 | + | ENST00000355029 | TSF |
| 2% | chr11 | 66048968 | 66049045 | + | chr11 | 66049730 | 66049798; 66049824 | + | ENST00000528852; ENST00000311445; ENST00000528063 | TSF |
| 1% | chr11 | 66048968 | 66049045 | + | chr11 | 66049730 | 66049798; 66049824 | + | ENST00000528852; ENST00000311445; ENST00000528063 | TSF |
| 1% | chr11 | 66048968 | 66049045 | + | chr11 | 66049730 | 66049798; 66049824 | + | ENST00000528852; ENST00000311445; ENST00000528063 | TSF |
| 1% | chr10 | 86006670 | 86006726 | + | chr10 | 86007347 | 86007503 | + | ENST00000359452; ENST00000358110 | TSF |
| 1% | chr10 | 86006670 | 86006726 | + | chr10 | 86007347 | 86007503 | + | ENST00000359452; ENST00000358110 | TSF |
| 1% | chr1 | 120257032 | 120257108 | + | chr1 | 120263793 | 120263944 | + | ENST00000369409; ENST00000369407 | TSF |
| 1% | chr18 | 32400184 | 32400289 | + | chr18 | 32400755 | 32400879 | + | ENST00000283365; ENST00000315456; ENST00000598334; ENST00000554864; ENST00000348997; ENST00000598142; ENST00000598774; ENST00000399121; ENST00000597599; ENST00000269190; ENST00000269191; ENST00000444659; ENST00000595022; ENST00000399113; ENST00000590727 | TSF |
| 1% | chr18 | 32400184 | 32400289 | + | chr18 | 32400755 | 32400879 | + | ENST00000283365; ENST00000315456; ENST00000598334; ENST00000554864; ENST00000348997; ENST00000598142; ENST00000598774; ENST00000399121; ENST00000597599; ENST00000269190; ENST00000269191; ENST00000444659; ENST00000595022; ENST00000399113; ENST00000590727 | TSF |
| 1% | chr18 | 32400184 | 32400289 | + | chr18 | 32400755 | 32400879 | + | ENST00000283365; ENST00000315456; ENST00000598334; ENST00000554864; ENST00000348997; ENST00000598142; ENST00000598774; ENST00000399121; ENST00000597599; ENST00000269190; ENST00000269191; ENST00000444659; ENST00000595022; ENST00000399113; ENST00000590727 | TSF |

TABLE 34-continued

Transcript fusion for Low Grade Glioma (LGG) Coordinates of the fusion sequences for which the donor is the TE.

| 1' | 2' | 3' | 4' | 5' | 6' | 7' | 8' | 9' | 10' | 11' |
|---|---|---|---|---|---|---|---|---|---|---|
| 1% | chr18 | 32400184 | 32400289 | + | chr18 | 32400755 | 32400879 | + | ENST00000283365; ENST00000595022; ENST00000444659; | ENST00000315456; ENST00000598774; ENST00000399113; | ENST00000598334; ENST00000598142; ENST00000590727 | ENST00000554864; ENST00000348997; | ENST00000399121; ENST00000597599; | ENST00000269190; ENST00000269191; | TSF |
| 1% | chr18 | 32400184 | 32400289 | + | chr18 | 32400755 | 32400879 | + | ENST00000283365; ENST00000595022; ENST00000444659; ENST00000315456; ENST00000598774; ENST00000399113; ENST00000598334; ENST00000598142; ENST00000590727 ENST00000554864; ENST00000348997; ENST00000399121; ENST00000597599; ENST00000269190; ENST00000269191; | TSF |
| 1% | chr18 | 32400184 | 32400289 | + | chr18 | 32400755 | 32400879 | + | ENST00000283365; ENST00000595022; ENST00000444659; ENST00000315456; ENST00000598774; ENST00000399113; ENST00000598334; ENST00000598142; ENST00000590727 ENST00000554864; ENST00000348997; ENST00000399121; ENST00000597599; ENST00000269190; ENST00000269191; | TSF |
| 1% | chr18 | 32400184 | 32400289 | + | chr18 | 32400755 | 32400879 | + | ENST00000283365; ENST00000595022; ENST00000444659; ENST00000315456; ENST00000598774; ENST00000399113; ENST00000598334; ENST00000598142; ENST00000590727 ENST00000554864; ENST00000348997; ENST00000399121; ENST00000597599; ENST00000269190; ENST00000269191; | TSF |
| 1% | chr18 | 32400184 | 32400289 | + | chr18 | 32400755 | 32400879 | + | ENST00000283365; ENST00000595022; ENST00000444659; ENST00000315456; ENST00000598774; ENST00000399113; ENST00000598334; ENST00000598142; ENST00000590727 ENST00000554864; ENST00000348997; ENST00000399121; ENST00000597599; ENST00000269190; ENST00000269191; | TSF |
| 1% | chr18 | 32400184 | 32400289 | + | chr18 | 32400755 | 32400879 | + | ENST00000283365; ENST00000595022; ENST00000444659; ENST00000315456; ENST00000598774; ENST00000399113; ENST00000598334; ENST00000598142; ENST00000590727 ENST00000554864; ENST00000348997; ENST00000399121; ENST00000597599; ENST00000269190; ENST00000269191; | TSF |
| 1% | chr18 | 32400184 | 32400289 | + | chr18 | 32400755 | 32400879 | + | ENST00000283365; ENST00000595022; ENST00000444659; ENST00000315456; ENST00000598774; ENST00000399113; ENST00000598334; ENST00000598142; ENST00000590727 ENST00000554864; ENST00000348997; ENST00000399121; ENST00000597599; ENST00000269190; ENST00000269191; | TSF |
| 1% | chr3 | 10973219 | 10973389 | + | chr3 | 10974837 | 10974939 | + | ENST00000254488 | TSF |
| 1% | chr21 | 40851014 | 40851064 | + | chr21 | 40871749 | 40871841 | + | ENST00000380637; ENST00000447939 | ENST00000380634; ENST00000440288; ENST00000333634; ENST00000423596; | TSF |
| 1% | chr21 | 40851014 | 40851064 | + | chr21 | 40871749 | 40871841 | + | ENST00000380637; ENST00000447939 | ENST00000380634; ENST00000440288; ENST00000333634; ENST00000423596; | ITSF |
| 1% | chr21 | 40851014 | 40851064 | + | chr21 | 40871749 | 40871841 | + | ENST00000380637; ENST00000447939 | ENST00000380634; ENST00000440288; ENST00000333634; ENST00000423596; | TSF |
| 1% | chr20 | 44019144 | 44019785 | + | chr20 | 44037100 | 44037106; 44037101; 44037246 | + | ENST00000419593; | ENST00000458187; ENST00000452133; ENST00000380631; ENST00000372710; ENST00000443296 | TSF |
| 1% | chr20 | 44019144 | 44019785 | + | chr20 | 44037100 | 44037106; 44037101; 44037246 | + | ENST00000419593; | ENST00000458187; ENST00000452133; ENST00000372720; ENST00000372710; ENST00000443296 | TSF |
| 1% | chr20 | 44019144 | 44019785 | + | chr20 | 44037100 | 44037106; 44037101; 44037246 | + | ENST00000419593; | ENST00000458187; ENST00000452133; ENST00000372720; ENST00000372710; ENST00000443296 | TSF |

TABLE 34-continued

Transcript fusion for Low Grade Glioma (LGG) Coordinates of the fusion sequences for which the donor is the TE.

| 1' | 2' | 3' | 4' | 5' | 6' | 7' | 8' | 9' | 10' | 11' |
|---|---|---|---|---|---|---|---|---|---|---|
| 1% | chr10 | 31755851 | 31756382 | + | chr10 | 31784708 | 31784767 | + | ENST00000320985; ENST00000559476 | TSF |
| 1% | chr10 | 31755851 | 31756382 | + | chr10 | 31784708 | 31784767 | + | ENST00000320985; ENST00000559476 | TSF |
| 1% | chr10 | 31755851 | 31756382 | + | chr10 | 31784708 | 31784767 | + | ENST00000320985; ENST00000559476 | TSF |
| 1% | chr10 | 31755851 | 31756382 | + | chr10 | 31784708 | 31784767 | + | ENST00000320985; ENST00000559476 | TSF |
| 1% | chr1 | 32264516 | 32264490 | − | chr1 | 32264202 | 32264043; 32264174 | − | ENST00000257100; ENST00000559476 | TSF |
| 1% | chr1 | 32264516 | 32264490 | − | chr1 | 32264202 | 32264043; 32264174 | − | ENST00000257100 | TSF |
| 1% | chr1 | 32264516 | 32264490 | − | chr1 | 32264202 | 32264043; 32264174 | − | ENST00000257100 | ITSF |
| 1% | chr1 | 32264516 | 32264490 | − | chr1 | 32264202 | 32264043; 32264174 | − | ENST00000257100 | TSF |
| 1% | chr1 | 32264516 | 32264490 | − | chr1 | 32264202 | 32264043; 32264174 | − | ENST00000257100 | TSF |
| 1% | chrX | 123618682 | 123617816 | − | chrX | 123615814 | 123615582 | − | ENST00000371130; ENST00000422452 | TSF |
| 1% | chr10 | 1100230 | 1100108 | − | chr10 | 1089333 | 1089241 | − | ENST00000381344; ENST00000427898 | TSF |
| 1% | chr10 | 1100230 | 1100108 | − | chr10 | 1089333 | 1089241 | − | ENST00000381344; ENST00000427898 | TSF |
| 1% | chr10 | 1100230 | 1100108 | − | chr10 | 1089333 | 1089241 | − | ENST00000381344; ENST00000427898 | TSF |
| 1% | chr22 | 31359261 | 31359211 | − | chr22 | 31354680 | 31354627 | − | ENST00000397641 | TSF |
| 1% | chr7 | 96380645 | 96380353 | − | chr7 | 96324203 | 96324110 | − | ENST00000417009; ENST00000449279; ENST00000413065; ENST00000248566 | TSF |
| 1% | chr7 | 96380645 | 96380353 | − | chr7 | 96324203 | 96324110 | − | ENST00000417009; ENST00000449279; ENST00000413065; ENST00000248566 | TSF |
| 1% | chr7 | 96380645 | 96380353 | − | chr7 | 96324203 | 96324110 | − | ENST00000417009; ENST00000449279; ENST00000413065; ENST00000248566 | TSF |
| 1% | chr7 | 96380645 | 96380353 | − | chr7 | 96324203 | 96324110 | − | ENST00000417009; ENST00000449279; ENST00000413065; ENST00000248566 | TSF |
| 1% | chr19 | 18982032 | 18981924 | − | chr19 | 18981428 | 18981386 | − | ENST00000427170 | TSF |
| 1% | chr11 | 60663653 | 60661987 | − | chr11 | 60658735 | 60658638 | − | ENST00000275524; ENST00000296220 | TSF |
| 1% | chr3 | 125267022 | 125266880 | − | chr3 | 125266436 | 125266250 | − | ENST00000520777; ENST00000505820; ENST00000487053; ENST00000357210; ENST00000378712 | TSF |
| 1% | chr1 | 1562829 | 1562926 | + | chr1 | 1563053 | 1563209 | + | ENST00000520777; ENST00000505820; ENST00000487053; ENST00000357210; ENST00000378712 | TSF |
| 1% | chr1 | 1562829 | 1562926 | + | chr1 | 1563053 | 1563209 | + | ENST00000520777; ENST00000505820; ENST00000487053; ENST00000357210; ENST00000378712 | TSF |
| 1% | chr1 | 1562829 | 1562926 | + | chr1 | 1563053 | 1563209 | + | ENST00000520777; ENST00000505820; ENST00000487053; ENST00000357210; ENST00000378712 | TSF |
| 1% | chr10 | 70433076 | 70433244 | + | chr10 | 70441156 | 70441245 | + | ENST00000373644 | TSF |
| 1% | chr16 | 7555906 | 7555956 | + | chr16 | 7568149 | 7568391 | + | ENST00000547605; ENST00000550418; ENST00000553186; ENST00000551752; ENST00000340209; ENST00000570626 | TSF |
| 1% | chr16 | 7555906 | 7555956 | + | chr16 | 7568149 | 7568391 | + | ENST00000547605; ENST00000552089; ENST00000550418; ENST00000551752; ENST00000340209; ENST00000570626 | |
| 1% | chr16 | 7555906 | 7555956 | + | chr16 | 7568149 | 7568391 | + | ENST00000547605; ENST00000552089; ENST00000550418; ENST00000551752; ENST00000340209; ENST00000570626 | TSF |
| 1% | chr16 | 7555906 | 7555956 | + | chr16 | 7568149 | 7568391 | + | ENST00000547605; ENST00000552089; ENST00000550418; ENST00000551752; ENST00000340209; ENST00000570626 | TSF |

TABLE 34-continued

Transcript fusion for Low Grade Glioma (LGG) Coordinates of the fusion sequences for which the donor is the TE.

| 1' | 2' | 3' | 4' | 5' | 6' | 7' | 8' | 9' | 10' | 11' |
|---|---|---|---|---|---|---|---|---|---|---|
| 1% | chr16 | 7555906 | 7555956 | + | chr16 | 7568149 | 7568391 | + | ENST00000547605; ENST00000552089; ENST00000340209; ENST00000550418; ENST00000551752; ENST00000570626 | ENST00000553186; ENST00000547338; ENST00000547372; ENST00000436368; ENST00000422070; ENST00000311745; ENST00000535565; ENST00000355637; | TSF |
| 1% | chr16 | 7555906 | 7555956 | + | chr16 | 7568149 | 7568391 | + | ENST00000547605; ENST00000552089; ENST00000340209; ENST00000550418; ENST00000551752; ENST00000570626 | ENST00000553186; ENST00000547338; ENST00000547372; ENST00000436368; ENST00000422070; ENST00000311745; ENST00000535565; ENST00000355637; | TSF |
| 1% | chr16 | 7555906 | 7555956 | + | chr16 | 7568149 | 7568391 | + | ENST00000547605; ENST00000552089; ENST00000340209; ENST00000550418; ENST00000551752; ENST00000570626 | ENST00000553186; ENST00000547338; ENST00000547372; ENST00000436368; ENST00000422070; ENST00000311745; ENST00000535565; ENST00000355637; | TSF |
| 1% | chr16 | 7555906 | 7555956 | + | chr16 | 7568149 | 7568391 | + | ENST00000547605; ENST00000552089; ENST00000340209; ENST00000550418; ENST00000551752; ENST00000570626 | ENST00000553186; ENST00000547338; ENST00000547372; ENST00000436368; ENST00000422070; ENST00000311745; ENST00000535565; ENST00000355637; | TSF |
| 1% | chr16 | 7555906 | 7555956 | + | chr16 | 7568149 | 7568391 | + | ENST00000547605; ENST00000552089; ENST00000340209; ENST00000550418; ENST00000551752; ENST00000570626 | ENST00000553186; ENST00000547338; ENST00000547372; ENST00000436368; ENST00000422070; ENST00000311745; ENST00000535565; ENST00000355637; | TSF |
| 1% | chr16 | 7555906 | 7555956 | + | chr16 | 7568149 | 7568391 | + | ENST00000547605; ENST00000552089; ENST00000340209; ENST00000550418; ENST00000551752; ENST00000570626 | ENST00000553186; ENST00000547338; ENST00000547372; ENST00000436368; ENST00000422070; ENST00000311745; ENST00000535565; ENST00000355637; | TSF |
| 1% | chr16 | 7555906 | 7555956 | + | chr16 | 7568149 | 7568391 | + | ENST00000547605; ENST00000552089; ENST00000340209; ENST00000550418; ENST00000551752; ENST00000570626 | ENST00000553186; ENST00000547338; ENST00000547372; ENST00000436368; ENST00000422070; ENST00000311745; ENST00000535565; ENST00000355637; | TSF |
| 1% | chr19 | 4288851 | 4288919 | + | chr19 | 4290444 | 4290630 | + | ENST00000543264; ENST00000599689 | | TSF |
| 1% | chr5 | 79371074 | 79371193 | + | chr5 | 79372678 | 79372871 | + | ENST00000350881; ENST00000511733 | | TSF |
| 1% | chr15 | 57573646 | 57573990 | + | chr15 | 57574643 | 57574785; 57574674 | + | ENST00000559609; ENST00000333725; ENST00000559703; ENST00000559710; ENST00000560836 | ENST00000267811; ENST00000557843; ENST00000452095; | TSF |
| 1% | chr15 | 57573646 | 57573990 | + | chr15 | 57574643 | 57574785; 57574674 | + | ENST00000559609; ENST00000333725; ENST00000559703; ENST00000559710; ENST00000560836 | ENST00000557843; ENST00000543579; ENST00000537840; ENST00000343827; | TSF |
| 1% | chr6 | 163875469 | 163875527 | + | chr6 | 163876311 | 163876453 | + | ENST00000361758; ENST00000275262; ENST00000424802 | ENST00000453779; ENST00000392127; ENST00000361752; ENST00000361195; | TSF |
| 1% | chr6 | 163875469 | 163875527 | + | chr6 | 163876311 | 163876453 | + | ENST00000361758; ENST00000275262; ENST00000424802 | ENST00000453779; ENST00000392127; ENST00000361752; ENST00000361195; | TSF |
| 1% | chr6 | 163875469 | 163875527 | + | chr6 | 163876311 | 163876453 | + | ENST00000361758; ENST00000275262; ENST00000424802 | ENST00000453779; ENST00000392127; ENST00000361752; ENST00000361195; | TSF |
| 1% | chr6 | 163875469 | 163875527 | + | chr6 | 163876311 | 163876453 | + | ENST00000361758; ENST00000275262; ENST00000424802 | ENST00000453779; ENST00000392127; ENST00000361752; ENST00000361195; | TSF |
| 1% | chr1 | 1562829 | 1562875 | + | chr1 | 1563053 | 1563209 | + | ENST00000520777; ENST00000505820; ENST00000357210; ENST00000487053; ENST00000378712; ENST00000378708; ENST00000424802 | ENST00000360522; ENST00000378710; ENST00000378708; ENST00000504599; ENST00000355826; ENST00000518681; ENST00000514234 | TSF |
| 1% | chr1 | 1562829 | 1562875 | + | chr1 | 1563053 | 1563209 | + | ENST00000520777; ENST00000505820; ENST00000357210; ENST00000487053; ENST00000378712; | ENST00000360522; ENST00000378710; ENST00000504599; ENST00000355826; ENST00000518681; ENST00000514234 | TSF |
| 1% | chr1 | 1562829 | 1562875 | + | chr1 | 1563053 | 1563209 | + | ENST00000520777; ENST00000505820; ENST00000357210; ENST00000487053; ENST00000378712; | ENST00000360522; ENST00000378710; ENST00000504599; ENST00000355826; ENST00000518681; ENST00000514234 | TSF |

TABLE 34-continued

Transcript fusion for Low Grade Glioma (LGG) Coordinates of the fusion sequences for which the donor is the TE.

| 1' | 2' | 3' | 4' | 5' | 6' | 7' | 8' | 9' | 10' | 11' |
|---|---|---|---|---|---|---|---|---|---|---|
| 1% | chr5 | 135216301 | 135216599 | + | chr5 | 135223721 | 135223773 | + | ENST00000412661 | TSF |
| 1% | chr6 | 36850815 | 36851128 | + | chr6 | 36867202 | 36867409 | + | ENST00000355190 | TSF |
| 1% | chr11 | 60694460 | 60694539 | + | chr11 | 60694676 | 60694890 | + | ENST00000453848; ENST00000005286 | TSF |
| 1% | chr11 | 60694460 | 60694539 | + | chr11 | 60694676 | 60694890 | + | ENST00000453848; ENST00000005286 | TSF |
| 1% | chr9 | 72500819 | 72501289 | + | chr9 | 72501754 | 72501811 | + | ENST00000377197 | TSF |
| 1% | chr11 | 62649715 | 62649740 | + | chr11 | 62650380 | 62650471 | + | ENST00000377892; ENST00000377890; ENST00000377889; ENST00000338663 | TSF |
| 1% | chr18 | 32426045 | 32426197 | + | chr18 | 32428260 | 32428347 | + | ENST00000283365; ENST00000598334; ENST00000598142; ENST00000598190; ENST00000269190; ENST00000399121; ENST00000399097; ENST00000595022; ENST00000348997; ENST00000597599; ENST00000269191; ENST00000444659; ENST00000399113; ENST00000591182; ENST00000269192; ENST00000597674; ENST00000556414; ENST00000599844; ENST00000587723 | TSF |
| 1% | chr18 | 32426045 | 32426197 | + | chr18 | 32428260 | 32428347 | + | ENST00000283365; ENST00000598334; ENST00000598142; ENST00000598190; ENST00000269190; ENST00000399121; ENST00000399097; ENST00000595022; ENST00000348997; ENST00000597599; ENST00000269191; ENST00000444659; ENST00000399113; ENST00000591182; ENST00000269192; ENST00000597674; ENST00000556414; ENST00000599844; ENST00000587723 | TSF |
| 1% | chr18 | 32426045 | 32426197 | + | chr18 | 32428260 | 32428347 | + | ENST00000283365; ENST00000598334; ENST00000598142; ENST00000598190; ENST00000269190; ENST00000399121; ENST00000399097; ENST00000595022; ENST00000348997; ENST00000597599; ENST00000269191; ENST00000444659; ENST00000399113; ENST00000591182; ENST00000269192; ENST00000597674; ENST00000556414; ENST00000599844; ENST00000587723 | TSF |
| 1% | chr18 | 32426045 | 32426197 | + | chr18 | 32428260 | 32428347 | + | ENST00000283365; ENST00000598334; ENST00000598142; ENST00000598190; ENST00000269190; ENST00000399121; ENST00000399097; ENST00000595022; ENST00000348997; ENST00000597599; ENST00000269191; ENST00000444659; ENST00000399113; ENST00000591182; ENST00000269192; ENST00000597674; ENST00000556414; ENST00000599844; ENST00000587723 | TSF |
| 1% | chr18 | 32426045 | 32426197 | + | chr18 | 32428260 | 32428347 | + | ENST00000283365; ENST00000598334; ENST00000598142; ENST00000598190; ENST00000269190; ENST00000399121; ENST00000399097; ENST00000595022; ENST00000348997; ENST00000597599; ENST00000269191; ENST00000444659; ENST00000399113; ENST00000591182; ENST00000269192; ENST00000597674; ENST00000556414; ENST00000599844; ENST00000587723 | TSF |
| 1% | chr20 | 44540290 | 44540197 | − | chr20 | 44540102 | 44539992 | − | ENST00000542937 | TSF |
| 1% | chr20 | 29976260 | 29976126 | − | chr20 | 29965242 | 29965212; 29965049 | − | ENST00000339144; ENST00000376321 | TSF |
| 1% | chr20 | 29976260 | 29976126 | − | chr20 | 29965242 | 29965212; 29965049 | − | ENST00000339144; ENST00000376321 | TSF |
| 1% | chr11 | 82551957 | 82551841 | − | chr11 | 82550467 | 82550303; 82550373 | − | ENST00000313010; ENST00000393399; ENST00000535099; ENST00000531801 | TSF |
| 1% | chr11 | 82551957 | 82551841 | − | chr11 | 82550467 | 82550303; 82550373 | − | ENST00000313010; ENST00000393399; ENST00000535099; ENST00000531801 | TSF |
| 1% | chr16 | 19893258 | 19893237 | − | chr16 | 19884168 | 19883138 | − | ENST00000537135 | TSF |
| 1% | chr19 | 19015073 | 19015005 | − | chr19 | 19014232 | 19014077; 19014082 | − | ENST00000262812; ENST00000600932; ENST00000351079; ENST00000593827 | TSF |
| 1% | chr19 | 19015073 | 19015005 | − | chr19 | 19014232 | 19014077; 19014082 | − | ENST00000262812; ENST00000600932; ENST00000351079; ENST00000593827 | TSF |
| 1% | chr20 | 25780351 | 25778939 | − | chr20 | 25755972 | 25755659 | − | ENST00000584071 | TSF |
| 1% | chr17 | 73847069 | 73846895 | − | chr17 | 73845820 | 73845685 | − | ENST00000254806; ENST00000585462; ENST00000591399; ENST00000591831; ENST00000590221; ENST00000344296; ENST00000433525; ENST00000593002 | TSF |
| 1% | chr17 | 73847069 | 73846895 | − | chr17 | 73845820 | 73845685 | − | ENST00000254806; ENST00000585462; ENST00000591399; ENST00000591831; ENST00000590221; ENST00000344296; ENST00000433525; ENST00000593002 | TSF |

TABLE 34-continued

Transcript fusion for Low Grade Glioma (LGG) Coordinates of the fusion sequences for which the donor is the TE.

| 1' | 2' | 3' | 4' | 5' | 6' | 7' | 8' | 9' | 10' | 11' |
|---|---|---|---|---|---|---|---|---|---|---|
| 1% | chr17 | 73847069 | 73846895 | – | chr17 | 73845820 | 73845685 | – | ENST00000254806; ENST00000585462; ENST00000591399; ENST00000591831; ENST00000590221; ENST00000344296; ENST00000433525; ENST00000593002 | TSF |
| 1% | chr17 | 73847069 | 73846895 | – | chr17 | 73845820 | 73845685 | – | ENST00000254806; ENST00000585462; ENST00000591399; ENST00000591831; ENST00000590221; ENST00000344296; ENST00000433525; ENST00000593002 | TSF |
| 1% | chr17 | 73847069 | 73846895 | – | chr17 | 73845820 | 73845685 | – | ENST00000254806; ENST00000585462; ENST00000591399; ENST00000591831; ENST00000590221; ENST00000344296; ENST00000433525; ENST00000593002 | TSF |
| 1% | chr19 | 13080090 | 13079995 | – | chr19 | 13065340 | 13065022 | – | ENST00000316939 | TSF |
| 1% | chr10 | 1100230 | 1100074 | – | chr10 | 1089333 | 1089241 | – | ENST00000381344; ENST00000427898; ENST00000429642 | TSF |
| 1% | chr10 | 1100230 | 1100074 | – | chr10 | 1089333 | 1089241 | – | ENST00000381344; ENST00000427898; ENST00000429642 | TSF |
| 1% | chr10 | 1100230 | 1100074 | – | chr10 | 1089333 | 1089241 | – | ENST00000381344; ENST00000427898; ENST00000429642 | TSF |
| 1% | chr15 | 75650395 | 75650345 | – | chr15 | 75649243 | 75649134 | – | ENST00000569482; ENST00000565683; ENST00000563622; ENST00000267978 | TSF |
| 1% | chr15 | 75650395 | 75650345 | – | chr15 | 75649243 | 75649134 | – | ENST00000569482; ENST00000565683; ENST00000563622; ENST00000267978 | TSF |
| 1% | chr17 | 42991959 | 42991849 | – | chr17 | 42991449 | 42991396 | – | ENST00000253408; ENST00000435360; ENST00000586793; ENST00000592320; ENST00000588316; ENST00000588037 | TSF |
| 1% | chr17 | 42991959 | 42991849 | – | chr17 | 42991449 | 42991396 | – | ENST00000253408; ENST00000435360; ENST00000586793; ENST00000592320; ENST00000588316; ENST00000588037 | TSF |
| 1% | chr17 | 42991959 | 42991849 | – | chr17 | 42991449 | 42991396 | – | ENST00000253408; ENST00000435360; ENST00000586793; ENST00000592320; ENST00000588316; ENST00000588037 | TSF |
| 1% | chr17 | 42991959 | 42991849 | – | chr17 | 42991449 | 42991396 | – | ENST00000253408; ENST00000435360; ENST00000586793; ENST00000592320; ENST00000588316; ENST00000588037 | TSF |
| 1% | chr17 | 42991959 | 42991849 | – | chr17 | 42991449 | 42991396 | – | ENST00000253408; ENST00000435360; ENST00000586793; ENST00000592320; ENST00000588316; ENST00000588037 | TSF |
| 1% | chr1 | 175328580 | 175328513 | – | chr1 | 175325598 | 175325455 | – | ENST00000367674; ENST00000263525 | TSF |
| 1% | chr7 | 44158417 | 44158351 | – | chr7 | 44157663 | 44157542 | – | ENST00000406581; ENST00000223361; ENST00000452185; ENST00000433715; ENST00000456038; ENST00000418438 | TSF |
| 1% | chr7 | 44158417 | 44158351 | – | chr7 | 44157663 | 44157542 | – | ENST00000406581; ENST00000223361; ENST00000452185; ENST00000433715; ENST00000456038; ENST00000418438 | TSF |
| 1% | chr7 | 44158417 | 44158351 | – | chr7 | 44157663 | 44157542 | – | ENST00000406581; ENST00000223361; ENST00000452185; ENST00000433715; ENST00000456038; ENST00000418438 | TSF |
| 1% | chr7 | 44158417 | 44158351 | – | chr7 | 44157663 | 44157542 | – | ENST00000406581; ENST00000223361; ENST00000452185; ENST00000433715; ENST00000456038; ENST00000418438 | TSF |
| 1% | chr7 | 44158417 | 44158351 | – | chr7 | 44157663 | 44157542 | – | ENST00000406581; ENST00000223361; ENST00000452185; ENST00000433715; ENST00000456038; ENST00000418438 | TSF |
| 1% | chr7 | 44158417 | 44158351 | – | chr7 | 44157663 | 44157542 | – | ENST00000406581; ENST00000223361; ENST00000452185; ENST00000433715; ENST00000456038; ENST00000418438 | TSF |

TABLE 35

Transcript fusion for Liver Hepatocellular Carcinoma (LIHC) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 49% | chr16 | 16251666 | 16251520 | − | ENST00000205557 | chr16 | 16249711 | 16249633 | − | TAF |
| 33% | chr6 | 11000397 | 11000320 | − | ENST00000354666 | chr6 | 11000151 | 11000002 | − | TAF |
| 31% | chr20 | 3614958 | 3615036 | + | ENST00000262919 | chr20 | 3615708 | 3616042 | + | TSF |
| 29% | chr3 | 186337646 | 186337729 | + | ENST00000411641; ENST00000273784 | chr3 | 186345390 | 186345564 | + | TAF |
| 29% | chr3 | 186337646 | 186337729 | + | ENST00000411641; ENST00000273784 | chr3 | 186345390 | 186345564 | + | TAF |
| 25% | chr1 | 196748927 | 196749103 | + | ENST00000367425; ENST00000471440; ENST00000367427; ENST00000391985 | chr1 | 196835508 | 196835844 | + | TAF |
| 25% | chr16 | 83986867 | 83986975 | + | ENST00000561552 | chr16 | 83989608 | 83989764 | + | TAF |
| 25% | chr1 | 196659193 | 196659369 | + | ENST00000439155; ENST00000367429; ENST00000359637 | chr1 | 196835508 | 196835844 | + | TAF |
| 25% | chr1 | 196659193 | 196659369 | + | ENST00000439155; ENST00000367429; ENST00000359637 | chr1 | 196835508 | 196835844 | + | ITAF |
| 22% | chr9 | 104130604 | 104130402 | − | ENST00000259407; ENST00000395051 | chr9 | 104117689 | 104116763 | − | TAF |
| 21% | chr10 | 5040939 | 5040817 | − | ENST00000380753; ENST00000421196; ENST00000407674; ENST00000604507 | chr10 | 5002427 | 5002117 | − | TAF |
| 21% | chr10 | 5040939 | 5040817 | − | ENST00000380753; ENST00000421196; ENST00000407674; ENST00000604507 | chr10 | 5002427 | 5002117 | − | TAF |
| 21% | chr8 | 91057077 | 91057223 | + | ENST00000220764; ENST00000522161 | chr8 | 91058369 | 91063412 | + | TAF |
| 21% | chr8 | 91057077 | 91057223 | + | ENST00000220764; ENST00000522161 | chr8 | 91058369 | 91063412 | + | TAF |
| 20% | chr1 | 159683928 | 159683793 | − | ENST00000255030; ENST00000368112 | chr1 | 159682370 | 159682050 | − | TAF |
| 18% | chr3 | 149205406 | 149205542 | + | ENST00000305354 | chr3 | 149210784 | 149210892 | + | TAF |
| 18% | chr12 | 122284839 | 122284768 | − | ENST00000289004; ENST00000543163 | chr12 | 122282078 | 122281958 | − | TAF |
| 18% | chr12 | 122284839 | 122284768 | − | ENST00000289004; ENST00000543163 | chr12 | 122282078 | 122281958 | − | TAF |
| 17% | chr15 | 58724232 | 58724319 | + | ENST00000356113; ENST00000414170; ENST00000299022; ENST00000433326 | chr15 | 58787321 | 58787441 | + | TAF |
| 16% | chr1 | 156352539 | 156352660 | + | ENST00000451864; ENST00000255013; ENST00000368246; ENST00000400992; ENST00000368249 | chr1 | 156354102 | 156354192 | + | ITAF |
| 16% | chr1 | 156352539 | 156352660 | + | ENST00000451864; ENST00000255013; ENST00000368246; ENST00000400992; ENST00000368249 | chr1 | 156354102 | 156354192 | + | TAF |
| 16% | chr1 | 156352539 | 156352660 | + | ENST00000451864; ENST00000255013; ENST00000368246; ENST00000400992; ENST00000368249 | chr1 | 156354102 | 156354192 | + | TAF |
| 16% | chr1 | 156352539 | 156352660 | + | ENST00000451864; ENST00000255013; ENST00000368246; ENST00000400992; ENST00000368249 | chr1 | 156354102 | 156354192 | + | TAF |
| 15% | chr7 | 27582719 | 27582586 | − | ENST00000265395; ENST00000425715 | chr7 | 27581374 | 27579272 | − | TAF |
| 15% | chr7 | 27582719 | 27582586 | − | ENST00000265395; ENST00000425715 | chr7 | 27581374 | 27579272 | − | TAF |
| 14% | chr10 | 15151838 | 15151701 | − | ENST00000378165; ENST00000378150; ENST00000540259; ENST00000535341 | chr10 | 15148697 | 15148684 | − | TAF |
| 14% | chr10 | 15151838 | 15151701 | − | ENST00000378165; ENST00000378150; ENST00000540259; ENST00000535341 | chr10 | 15148697 | 15148684 | − | TAF |
| 14% | chr10 | 15151838 | 15151701 | − | ENST00000378165; ENST00000378150; ENST00000540259; ENST00000535341 | chr10 | 15148697 | 15148684 | − | TAF |
| 14% | chr10 | 15151838 | 15151701 | − | ENST00000378165; ENST00000378150; ENST00000540259; ENST00000535341 | chr10 | 15148697 | 15148684 | − | ITAF |
| 14% | chr2 | 27320371 | 27320517 | + | ENST00000260599; ENST00000260598; ENST00000429697 | chr2 | 27321791 | 27321916 | + | TAF |
| 14% | chr2 | 27320371 | 27320517 | + | ENST00000260599; ENST00000260598; ENST00000429697 | chr2 | 27321791 | 27321916 | + | TAF |
| 14% | chr2 | 27320371 | 27320517 | + | ENST00000260599; ENST00000260598; ENST00000429697 | chr2 | 27321791 | 27321916 | + | TAF |
| 13% | chr12 | 122284839 | 122284768 | − | ENST00000289004; ENST00000543163 | chr12 | 122282086 | 122281958 | − | TAF |
| 13% | chr12 | 122284839 | 122284768 | − | ENST00000289004; ENST00000543163 | chr12 | 122282086 | 122281958 | − | TAF |
| 13% | chr3 | 125828952 | 125828787 | − | ENST00000273450; ENST00000472186; ENST00000452905; ENST00000393434 | chr3 | 125828416 | 125828224 | − | TAF |
| 13% | chr3 | 125828952 | 125828787 | − | ENST00000273450; ENST00000472186; ENST00000452905; ENST00000393434 | chr3 | 125828416 | 125828224 | − | TAF |
| 13% | chr3 | 125828952 | 125828787 | − | ENST00000273450; ENST00000472186; ENST00000452905; ENST00000393434 | chr3 | 125828416 | 125828224 | − | ITAF |
| 13% | chr1 | 159683928 | 159683797 | − | ENST00000255030; ENST00000368112; ENST00000368111; ENST00000368110; ENST00000343919 | chr1 | 159682370 | 159682050 | − | TAF |
| 13% | chr3 | 39942308 | 39942417 | + | ENST00000444716; ENST00000302541; ENST00000425621; ENST00000458292; ENST00000458441 | chr3 | 40032343 | 40032651 | + | TAF |
| 12% | chr20 | 6015110 | 6015201 | + | ENST00000378863; ENST00000378868 | chr20 | 6020406 | 6020676 | + | TAF |
| 12% | chr20 | 6015110 | 6015201 | + | ENST00000378863; ENST00000378868 | chr20 | 6020406 | 6020676 | + | TAF |
| 12% | chrX | 117900807 | 117900939 | + | ENST00000371666 | chrX | 117938895 | 117939267 | + | TAF |
| 12% | chr9 | 123716146 | 123716008 | − | ENST00000223642 | chr9 | 123705787 | 123705454 | − | TAF |
| 12% | chr15 | 101845560 | 101845467 | − | ENST00000398185; ENST00000348070; ENST00000358417 | chr15 | 101841074 | 101840901 | − | TAF |
| 12% | chr15 | 101845560 | 101845467 | − | ENST00000398185; ENST00000348070; ENST00000358417 | chr15 | 101841074 | 101840901 | − | TAF |

TABLE 35-continued

Transcript fusion for Liver Hepatocellular Carcinoma (LIHC) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 12% | chr15 | 101845560 | 101845467 | − | ENST00000398185; ENST00000348070; ENST00000358417 | chr15 | 101841074 | 101840901 | − | TAF |
| 12% | chr3 | 186334976; 186334973 | 186335139 | + | ENST00000411641; ENST00000273784 | chr3 | 186345390 | 186345564 | + | TSF |
| 12% | chr3 | 186334976; 186334973 | 186335139 | + | ENST00000411641; ENST00000273784 | chr3 | 186345390 | 186345564 | + | TSF |
| 11% | chr19 | 45451958 | 45452117 | + | ENST00000589057; ENST00000252490; ENST00000590360; ENST00000585786 | chr19 | 45452371 | 45452396 | + | TAF |
| 11% | chr19 | 45451958 | 45452117 | + | ENST00000589057; ENST00000252490; ENST00000590360; ENST00000585786 | chr19 | 45452371 | 45452396 | + | TAF |
| 11% | chr17 | 66538306 | 66538126 | − | ENST00000592554 | chr17 | 66537704 | 66537648 | − | TAF |
| 11% | chr20 | 37002581 | 37002657 | + | ENST00000217407 | chr20 | 37003944 | 37004237 | + | TAF |
| 10% | chr9 | 117085414 | 117085527 | + | ENST00000259396; ENST00000538816 | chr9 | 117092629 | 117092673 | + | TAF |
| 10% | chr1 | 156352539 | 156352660 | + | ENST00000451864; ENST00000255013; ENST00000368246; ENST00000400992; ENST00000368249 | chr1 | 156354082 | 156354192 | + | TSF |
| 10% | chr1 | 156352539 | 156352660 | + | ENST00000451864; ENST00000255013; ENST00000368246; ENST00000400992; ENST00000368249 | chr1 | 156354082 | 156354192 | + | TSF |
| 10% | chr1 | 156352539 | 156352660 | + | ENST00000451864; ENST00000255013; ENST00000368246; ENST00000400992; ENST00000368249 | chr1 | 156354082 | 156354192 | + | TSF |
| 10% | chr1 | 156352539 | 156352660 | + | ENST00000451864; ENST00000255013; ENST00000368246; ENST00000400992; ENST00000368249 | chr1 | 156354082 | 156354192 | + | TSF |
| 10% | chr19 | 49335016 | 49334925 | − | ENST00000263278; ENST00000595764 | chr19 | 49322122 | 49322095 | − | TSF |
| 10% | chr19 | 49335016 | 49334925 | − | ENST00000263278; ENST00000595764 | chr19 | 49322122 | 49322095 | − | TSF |
| 9% | chr1 | 204183034 | 204183010 | − | ENST00000308302 | chr1 | 204178313 | 204177989 | − | TSF |
| 9% | chr17 | 79912179 | 79912132 | − | ENST00000409678 | chr17 | 79911834 | 79911647 | − | TSF |
| 9% | chr7 | 44198719 | 44198672 | − | ENST00000345378 | chr7 | 44197795 | 44197675 | − | TSF |
| 8% | chr22 | 47071365 | 47071449 | + | ENST00000406902; ENST00000361034; ENST00000408031 | chr22 | 47078308 | 47078350 | + | TSF |
| 8% | chr22 | 47071365 | 47071449 | + | ENST00000406902; ENST00000361034; ENST00000408031 | chr22 | 47078308 | 47078350 | + | TSF |
| 8% | chrX | 119708472 | 119708406 | − | ENST00000404115 | chrX | 119705855 | 119705820 | − | TSF |
| 7% | chr20 | 29632611 | 29632721 | + | ENST00000278882; ENST00000358464 | chr20 | 29652086 | 29652324 | + | TSF |
| 7% | chr19 | 35540379 | 35540420 | + | ENST00000262626; ENST00000392226; ENST00000600390 | chr19 | 35547041 | 35547341 | + | TSF |
| 7% | chr1 | 225156461 | 225156576 | + | ENST00000430092; ENST00000400952; ENST00000366849; ENST00000439375 | chr1 | 225157336 | 225158402 | + | TSF |
| 7% | chr1 | 225156461 | 225156576 | + | ENST00000430092; ENST00000400952; ENST00000366849; ENST00000439375 | chr1 | 225157336 | 225158402 | + | TSF |
| 6% | chr16 | 50583333 | 50583466 | + | ENST00000268459 | chr16 | 50614862 | 50614981 | + | TSF |
| 6% | chr4 | 57319769 | 57319927 | + | ENST00000514888; ENST00000264221; ENST00000505164; ENST00000399688; ENST00000512576 | chr4 | 57321183 | 57321327 | + | TSF |
| 6% | chr4 | 57319769 | 57319927 | + | ENST00000514888; ENST00000264221; ENST00000505164; ENST00000399688; ENST00000512576 | chr4 | 57321183 | 57321327 | + | TSF |
| 6% | chr4 | 57319769 | 57319927 | + | ENST00000514888; ENST00000264221; ENST00000505164; ENST00000399688; ENST00000512576 | chr4 | 57321183 | 57321327 | + | TSF |
| 6% | chr1 | 196659193 | 196659369 | + | ENST00000439155; ENST00000367429; ENST00000359637 | chr1 | 196678901 | 196678922 | + | TSF |
| 6% | chr1 | 196659193 | 196659369 | + | ENST00000439155; ENST00000367429; ENST00000359637 | chr1 | 196678901 | 196678922 | + | TSF |
| 5% | chr22 | 21133601 | 21134489 | + | ENST00000215727; ENST00000406799 | chr22 | 21136178 | 21136264 | + | TSF |
| 5% | chr10 | 127483547 | 127483449 | − | ENST00000368797; ENST00000368786 | chr10 | 127473829 | 127473633 | − | TSF |
| 5% | chr3 | 186336325 | 186336426 | + | ENST00000411641; ENST00000273784 | chr3 | 186345404 | 186345564 | + | TSF |
| 5% | chr3 | 186336325 | 186336426 | + | ENST00000411641; ENST00000273784 | chr3 | 186345401 | 186345564 | + | TSF |
| 4% | chr22 | 50639466 | 50640019 | + | ENST00000380903 | chr22 | 50643348 | 50643731 | + | TSF |
| 4% | chr3 | 52823669 | 52823870 | + | ENST00000273283; ENST00000540715; ENST00000537050; ENST00000428133; ENST00000405128 | chr3 | 52824522 | 52824594 | + | TSF |
| 4% | chr3 | 52823669 | 52823870 | + | ENST00000273283; ENST00000540715; ENST00000537050; ENST00000428133; ENST00000405128 | chr3 | 52824522 | 52824594 | + | TSF |
| 4% | chr3 | 52823669 | 52823870 | + | ENST00000273283; ENST00000540715; ENST00000537050; ENST00000428133; ENST00000405128 | chr3 | 52824522 | 52824594 | + | TSF |
| 4% | chr3 | 52823669 | 52823870 | + | ENST00000273283; ENST00000540715; ENST00000537050; ENST00000428133; ENST00000405128 | chr3 | 52824522 | 52824594 | + | TSF |
| 4% | chr3 | 52823669 | 52823870 | + | ENST00000273283; ENST00000540715; ENST00000537050; ENST00000428133; | chr3 | 52824522 | 52824594 | + | TSF |

TABLE 35-continued

Transcript fusion for Liver Hepatocellular Carcinoma (LIHC) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| | | | | | ENST00000405128 | | | | | |
| 4% | chr2 | 211452782 | 211452871 | + | ENST00000430249; ENST00000233072 | chr2 | 211454033 | 211454053 | + | TSF |
| 4% | chr2 | 211452782 | 211452871 | + | ENST00000430249; ENST00000233072 | chr2 | 211454033 | 211454053 | + | TSF |
| 4% | chr9 | 104133686 | 104133221 | − | ENST00000259407; ENST00000395051 | chr9 | 104117689 | 104116763 | − | TSF |
| 4% | chr3 | 186334232 | 186334316 | + | ENST00000411641; ENST00002273784 | chr3 | 186345390 | 186345564 | + | TSF |
| 4% | chr3 | 48716169 | 48715997 | − | ENST00000341520; ENST00000416649; ENST00000294129; ENST00000413374 | chr3 | 48702393 | 48702198 | − | TSF |
| 4% | chr3 | 48716169 | 48715997 | − | ENST00000341520; ENST00000416649; ENST00000294129; ENST00000413374 | chr3 | 48702393 | 48702198 | − | TSF |
| 4% | chr3 | 48716169 | 48715997 | − | ENST00000341520; ENST00000416649; ENST00000294129; ENST00000413374 | chr3 | 48702393 | 48702198 | − | TSF |
| 4% | chr12 | 103237557 | 103237424 | − | ENST00000553106; ENST00000307000 | chr12 | 103236886 | 103236826 | − | TSF |
| 4% | chr12 | 103237557 | 103237424 | − | ENST00000553106; ENST00000307000 | chr12 | 103236886 | 103236826 | − | TSF |
| 3% | chr12 | 71928895 | 71928966 | + | ENST00000266674; ENST00000536515; ENST00000540815 | chr12 | 71938771 | 71938901 | + | TSF |
| 3% | chr10 | 96731861 | 96732002 | + | ENST00000260682 | chr10 | 96735182 | 96735858 | + | TSF |
| 3% | chr12 | 113623819 | 113623826 | + | ENST00000552495 | chr12 | 113623998 | 113624117 | + | TSF |
| 3% | chr9 | 104133686 | 104133600 | − | ENST00000259407; ENST00000395051 | chr9 | 104117689 | 104116763 | − | TSF |
| 3% | chr8 | 42924698; 42924750 | 42924802 | + | ENST00000534420; ENST00000302279; ENST00000533998; ENST00000342116; ENST00000531266; ENST00000525699; ENST00000529687; ENST00000533336 | chr8 | 42925245 | 42925476 | + | TSF |
| 3% | chr8 | 42924698; 42924750 | 42924802 | + | ENST00000534420; ENST00000302279; ENST00000533998; ENST00000342116; ENST00000531266; ENST00000525699; ENST00000529687; ENST00000533336 | chr8 | 42925245 | 42925476 | + | TSF |
| 3% | chr8 | 42924698; 42924750 | 42924802 | + | ENST00000534420; ENST00000302279; ENST00000533998; ENST00000342116; ENST00000531266; ENST00000525699; ENST00000529687; ENST00000533336 | chr8 | 42925245 | 42925476 | + | TSF |
| 3% | chr8 | 42924698; 42924750 | 42924802 | + | ENST00000534420; ENST00000302279; ENST00000533998; ENST00000342116; ENST00000531266; ENST00000525699; ENST00000529687; ENST00000533336 | chr8 | 42925245 | 42925476 | + | TSF |
| 3% | chr8 | 42924698; 42924750 | 42924802 | + | ENST00000534420; ENST00000302279; ENST00000533998; ENST00000342116; ENST00000531266; ENST00000525699; ENST00000529687; ENST00000533336 | chr8 | 42925245 | 42925476 | + | TSF |
| 3% | chr8 | 42924698; 42924750 | 42924802 | + | ENST00000534420; ENST00000302279; ENST00000533998; ENST00000342116; ENST00000531266; ENST00000525699; ENST00000529687; ENST00000533336 | chr8 | 42925245 | 42925476 | + | TSF |
| 3% | chr10 | 126205749 | 126205840 | + | ENST00000368842 | chr10 | 126251911 | 126252288 | + | TSF |
| 3% | chr22 | 48885405 | 48885516 | + | ENST00000402357; ENST00000336769 | chr22 | 48915770 | 48916108 | + | TSF |
| 3% | chr12 | 21377656 | 21377773 | + | ENST00000256958 | chr12 | 21420585 | 21420936 | + | TSF |
| 3% | chr19 | 48382387 | 48382293 | − | ENST00000222002 | chr19 | 48379566 | 48379257 | − | TSF |
| 3% | chr11 | 62987493 | 62987404 | − | ENST00000528239 | chr11 | 62986972 | 62986804 | − | TSF |
| 2% | chr3 | 195956786; 195956876 | 195956932 | + | ENST00000296327; ENST00000415111 | chr3 | 195970598 | 195971983 | + | TSF |
| 2% | chr3 | 195956786; 195956876 | 195956932 | + | ENST00000296327; ENST00000415111 | chr3 | 195970598 | 195971983 | + | TSF |
| 2% | chr9 | 17143286 | 17143374 | + | ENST00000380647; ENST00000262360; ENST00000425824; ENST00000380641 | chr9 | 17166816 | 17167136 | + | TSF |
| 2% | chr16 | 50666192 | 50666319 | + | ENST00000268459 | chr16 | 50682755 | 50682972 | + | TSF |
| 2% | chr6 | 24533735 | 24533915 | + | ENST00000546278; ENST00000357578; ENST00000491546; ENST00000348925 | chr6 | 24536738 | 24536757 | + | TSF |
| 2% | chr6 | 24533735 | 24533915 | + | ENST00000546278; ENST00000357578; ENST00000491546; ENST00000348925 | chr6 | 24536738 | 24536757 | + | TSF |
| 2% | chr6 | 24533735 | 24533915 | + | ENST00000546278; ENST00000357578; ENST00000491546; ENST00000348925 | chr6 | 24536738 | 24536757 | + | TSF |
| 2% | chr6 | 24533735 | 24533915 | + | ENST00000546278; ENST00000357578; ENST00000491546; ENST00000348925 | chr6 | 24536738 | 24536757 | + | TSF |
| 2% | chr7 | 91509397 | 91509369 | − | ENST00000351870; ENST00000442961 | chr7 | 91430582 | 91429696 | − | TSF |
| 2% | chr22 | 37492755 | 37492688 | − | ENST00000381792; ENST00000346753; ENST00000406725; ENST00000406856; ENST00000442782; ENST00000423761 | chr22 | 37492292 | 37492206 | − | TSF |
| 2% | chr22 | 37492755 | 37492688 | − | ENST00000381792; ENST00000346753; ENST00000406725; ENST00000406856; ENST00000442782; ENST00000423761 | chr22 | 37492292 | 37492206 | − | TSF |
| 2% | chr5 | 176830398 | 176830255 | − | ENST00000253496 | chr5 | 176829864 | 176829767 | − | TSF |
| 2% | chr11 | 116701489 | 116701612 | + | ENST00000227667; ENST00000375345 | chr11 | 116704332 | 116704408 | + | TSF |
| 2% | chr11 | 116701489 | 116701612 | + | ENST00000227667; ENST00000375345 | chr11 | 116704332 | 116704408 | + | TSF |
| 2% | chr1 | 226016431 | 226016613 | + | ENST00000445856; ENST00000272167; ENST00000448202; ENST00000366837 | chr1 | 226018885 | 226018904 | + | TSF |
| 2% | chr22 | 47072497 | 47072565 | + | ENST00000406902; ENST00000361034; | chr22 | 47078308 | 47078350 | + | TSF |

TABLE 35-continued

Transcript fusion for Liver Hepatocellular Carcinoma (LIHC) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 2% | chr22 | 47072497 | 47072565 | + | ENST00000408031 ENST00000406902; ENST00000361034; ENST00000408031 | chr22 | 47078308 | 47078350 | + | TSF |
| 2% | chr4 | 107237705 | 107237751 | + | ENST00000394701 | chr4 | 107242023 | 107243452 | + | TSF |
| 2% | chr9 | 116825038 | 116824957 | − | ENST00000265132; ENST00000466610 | chr9 | 116823895 | 116823894 | − | TSF |
| 2% | chr9 | 116825038 | 116824957 | − | ENST00000265132; ENST00000466610 | chr9 | 116823895 | 116823894 | − | TSF |
| 2% | chr19 | 6718175 | 6718105 | − | ENST00000245907 | chr19 | 6716545 | 6716239 | − | TSF |
| 2% | chr12 | 122292698 | 122292609 | − | ENST00000289004; ENST00000543163 | chr12 | 122289515 | 122289239 | − | TSF |
| 2% | chr12 | 122292698 | 122292609 | − | ENST00000289004; ENST00000543163 | chr12 | 122289515 | 122289239 | − | TSF |
| 2% | chr19 | 45418149 | 45418206 | + | ENST00000588750; ENST00000588802; ENST00000592535; ENST00000252491; ENST00000592885; ENST00000589781; ENST00000589078; ENST00000590334; ENST00000586638; ENST00000592176 | chr19 | 45430934 | 45430990 | + | TSF |
| 2% | chr10 | 96443577 | 96443744 | + | ENST00000339022; ENST00000285979 | chr10 | 96698194 | 96698222 | + | TSF |
| 2% | chr1 | 161207850 | 161207831 | − | ENST00000512372; ENST00000437437; ENST00000412844; ENST00000508740; ENST00000506018; ENST00000367981; ENST00000504010; ENST00000507215; ENST00000508387; ENST00000510951; ENST00000511676; ENST00000511748; ENST00000512340; ENST00000506209 | chr1 | 161204494 | 161204367 | − | TSF |
| 2% | chr12 | 120966944 | 120966743 | − | ENST00000288532; ENST00000445328; ENST00000547943 | chr12 | 120965181 | 120964888 | − | TSF |
| 2% | chr14 | 24768312 | 24768163 | − | ENST00000288111; ENST00000396813; ENST00000558340 | chr14 | 24767944 | 24767783 | − | TSF |
| 2% | chr19 | 12987177 | 12986994 | − | ENST00000222219; ENST00000538460 | chr19 | 12986142 | 12986038 | − | TSF |
| 2% | chr19 | 12987177 | 12986994 | − | ENST00000222219; ENST00000538460 | chr19 | 12986142 | 12986038 | − | TSF |
| 2% | chr15 | 101858627 | 101858524 | − | ENST00000398185; ENST00000348070; ENST00000358417 | chr15 | 101841074 | 101840901 | − | TSF |
| 2% | chr15 | 101858627 | 101858524 | − | ENST00000398185; ENST00000348070; ENST00000358417 | chr15 | 101841074 | 101840901 | − | TSF |
| 2% | chr15 | 101858627 | 101858524 | − | ENST00000398185; ENST00000348070; ENST00000358417 | chr15 | 101841074 | 101840901 | − | TSF |
| 2% | chr6 | 44200080 | 44200165 | + | ENST00000393844; ENST00000313248; ENST00000427851; ENST00000371740; ENST00000371755; ENST00000371731; ENST00000393841; ENST00000371713; ENST00000371724; ENST00000371708 | chr6 | 44209921 | 44210213 | + | TSF |
| 2% | chr6 | 44200080 | 44200165 | + | ENST00000393844; ENST00000313248; ENST00000427851; ENST00000371740; ENST00000371755; ENST00000371731; ENST00000393841; ENST00000371713; ENST00000371724; ENST00000371708 | chr6 | 44209921 | 44210213 | + | TSF |
| 2% | chr8 | 71619168 | 71619388 | + | ENST00000408926; ENST00000520030 | chr8 | 71625661 | 71625673 | + | TSF |
| 2% | chr6 | 24533735 | 24533915 | + | ENST00000546278; ENST00000357578; ENST00000491546; ENST00000348925 | chr6 | 24543356 | 24543371 | + | lTSF |
| 2% | chr6 | 24533735 | 24533915 | + | ENST00000546278; ENST00000357578; ENST00000491546; ENST00000348925 | chr6 | 24543356 | 24543371 | + | TSF |
| 2% | chr6 | 24533735 | 24533915 | + | ENST00000546278; ENST00000357578; ENST00000491546; ENST00000348925 | chr6 | 24543356 | 24543371 | + | TSF |
| 2% | chr6 | 24533735 | 24533915 | + | ENST00000546278; ENST00000357578; ENST00000491546; ENST00000348925 | chr6 | 24543356 | 24543371 | + | TSF |
| 2% | chr19 | 45419447 | 45419582 | + | ENST00000588750; ENST00000588802; ENST00000592535; ENST00000252491; ENST00000592885; ENST00000590334; ENST00000586638 | chr19 | 45420139 | 45420241 | + | TSF |
| 2% | chr8 | 36780008 | 36780147 | + | ENST00000399881; ENST00000522372 | chr8 | 36786424 | 36786484 | + | TSF |
| 2% | chr14 | 32020101 | 32020133 | + | ENST00000550005 | chr14 | 32027031 | 32027274 | + | TSF |
| 2% | chr20 | 6017720 | 6017789 | + | ENST00000378863; ENST00000378868 | chr20 | 6020406 | 6020676 | + | TSF |
| 2% | chr20 | 6017720 | 6017789 | + | ENST00000378863; ENST00000378868 | chr20 | 6020406 | 6020676 | + | TSF |
| 2% | chr5 | 79410474 | 79410337 | − | ENST00000509193 | chr5 | 79407525 | 79407007 | − | TSF |
| 2% | chr17 | 79912179 | 79912132 | − | ENST00000409678 | chr17 | 79911819 | 79911647 | − | TSF |
| 2% | chr12 | 49317635 | 49317565 | − | ENST00000444214; ENST00000550765; ENST00000552878; ENST00000453172 | chr12 | 49310033 | 49308894 | − | TSF |
| 2% | chr12 | 49317635 | 49317565 | − | ENST00000444214; ENST00000550765; ENST00000552878; ENST00000453172 | chr12 | 49310033 | 49308894 | − | TSF |

TABLE 36

Transcript fusion for Liver Hepatocellular Carcinoma (LIHC) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 46% | chr16 | 16249761 | 16249649 | − | chr16 | 16248888 | 16248730 | − | ENST00000205557 | TAF |
| 46% | chr1 | 207263335 | 207263385 | + | chr1 | 207263653 | 207263826 | + | ENST00000367078; ENST00000452902; ENST00000243611; ENST00000391923 | TAF |
| 46% | chr1 | 207263335 | 207263385 | + | chr1 | 207263653 | 207263826 | + | ENST00000367078; ENST00000452902; ENST00000243611; ENST00000391923 | TAF |
| 44% | chr19 | 51854024 | 51853970 | − | chr19 | 51853645 | 51853583 | − | ENST00000354232; ENST00000309244; ENST00000596253 | TAF |
| 44% | chr19 | 51854024 | 51853970 | − | chr19 | 51853645 | 51853583 | − | ENST00000354232; ENST00000309244; ENST00000596253 | TAF |
| 36% | chr1 | 59980221 | 59980497 | + | chr1 | 60019796 | 60019899 | + | ENST00000371218; ENST00000303721; ENST00000430447; ENST00000371212 | TSF |
| 36% | chr1 | 59980221 | 59980497 | + | chr1 | 60019796 | 60019899 | + | ENST00000371218; ENST00000303721; ENST00000430447; ENST00000371212 | TSF |
| 36% | chr1 | 59980221 | 59980497 | + | chr1 | 60019796 | 60019899 | + | ENST00000371218; ENST00000303721; ENST00000430447; ENST00000371212 | TSF |
| 30% | chr19 | 51854233 | 51854037 | − | chr19 | 51853645 | 51853583 | − | ENST00000354232; ENST00000309244; ENST00000596253 | TAF |
| 30% | chr19 | 51854233 | 51854037 | − | chr19 | 51853645 | 51853583 | − | ENST00000354232; ENST00000309244; ENST00000596253 | TAF |
| 29% | chr16 | 72098678 | 72105593 | + | chr16 | 72107791 | 72107876 | + | ENST00000356967; ENST00000540303; ENST00000561690; ENST00000228226 | TAF |
| 29% | chr16 | 72098678 | 72105593 | + | chr16 | 72107791 | 72107876 | + | ENST00000356967; ENST00000540303; ENST00000561690; ENST00000228226 | TAF |
| 29% | chr9 | 117089333 | 117089580 | + | chr9 | 117092714 | 117092856; 117092769 | + | ENST00000431067; ENST00000412657 | TAF |
| 29% | chr9 | 117089333 | 117089580 | + | chr9 | 117092714 | 117092856; 117092769 | + | ENST00000431067; ENST00000412657 | TAF |
| 27% | chr17 | 56612963 | 56612799 | − | chr17 | 56603674 | 56603581; 56603614 | − | ENST00000393086; ENST00000426861; ENST00000579371; ENST00000317268; ENST00000457347; ENST00000580844; ENST00000317256; ENST00000412945; ENST00000580809; ENST00000577729; ENST00000581615; ENST00000578131; ENST00000583291 | TAF |
| 27% | chr17 | 56612963 | 56612799 | − | chr17 | 56603674 | 56603581; 56603614 | − | ENST00000393086; ENST00000426861; ENST00000579371; ENST00000317268; ENST00000457347; ENST00000580844; ENST00000317256; ENST00000412945; ENST00000580809; ENST00000577729; ENST00000581615; ENST00000578131; ENST00000583291 | TAF |
| 27% | chr17 | 56612963 | 56612799 | − | chr17 | 56603674 | 56603581; 56603614 | − | ENST00000393086; ENST00000426861; ENST00000579371; ENST00000317268; ENST00000457347; ENST00000580844; ENST00000317256; ENST00000412945; ENST00000580809; ENST00000577729; ENST00000581615; ENST00000578131; ENST00000583291 | TAF |
| 27% | chr17 | 56612963 | 56612799 | − | chr17 | 56603674 | 56603581; 56603614 | − | ENST00000393086; ENST00000426861; ENST00000579371; ENST00000317268; ENST00000457347; ENST00000580844; ENST00000317256; ENST00000412945; ENST00000580809; ENST00000577729; ENST00000581615; ENST00000578131; ENST00000583291 | TAF |
| 27% | chr17 | 56612963 | 56612799 | − | chr17 | 56603674 | 56603581; 56603614 | − | ENST00000393086; ENST00000426861; ENST00000579371; ENST00000317268; ENST00000457347; ENST00000580844; ENST00000317256; ENST00000412945; ENST00000580809; ENST00000577729; ENST00000581615; ENST00000578131; ENST00000583291 | TAF |
| 27% | chr17 | 56612963 | 56612799 | − | chr17 | 56603674 | 56603581; 56603614 | − | ENST00000393086; ENST00000426861; ENST00000579371; ENST00000317268; ENST00000457347; ENST00000580844; ENST00000317256; ENST00000412945; ENST00000580809; ENST00000577729; ENST00000581615; ENST00000578131; ENST00000583291 | TAF |
| 27% | chr1 | 207268999 | 207269340 | + | chr1 | 207269867 | 207269960 | + | ENST00000367078; ENST00000452902; ENST00000243611; ENST00000367076; ENST00000391923 | TAF |
| 27% | chr1 | 207268999 | 207269340 | + | chr1 | 207269867 | 207269960 | + | ENST00000367078; ENST00000452902; ENST00000243611; ENST00000367076; ENST00000391923 | TAF |

TABLE 36-continued

Transcript fusion for Liver Hepatocellular Carcinoma (LIHC) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 24% | chr16 | 72098678 | 72105852 | + | chr16 | 72107791 | 72107876 | + | ENST00000356967; ENST00000540303; ENST00000561690; ENST00000228226 | TAF |
| 24% | chr16 | 72098678 | 72105852 | + | chr16 | 72107791 | 72107876 | + | ENST00000356967; ENST00000540303; ENST00000561690; ENST00000228226 | TAF |
| 23% | chr5 | 34010561 | 34010276 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TAF |
| 23% | chr5 | 34010561 | 34010276 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TAF |
| 23% | chr5 | 34010561 | 34010276 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TAF |
| 23% | chr5 | 34010561 | 34010276 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TAF |
| 23% | chr5 | 34010561 | 34010276 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TAF |
| 23% | chr5 | 34010561 | 34010276 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TAF |
| 23% | chr5 | 34010561 | 34010276 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TAF |
| 23% | chr5 | 34010561 | 34010276 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TAF |
| 22% | chr16 | 83989605 | 83989746 | + | chr16 | 83991245 | 83991255; 83991343 | + | ENST00000561552; ENST00000343939 | TSF |
| 22% | chr16 | 83989605 | 83989746 | + | chr16 | 83991245 | 83991255; 83991343 | + | ENST00000561552; ENST00000343939 | TSF |
| 20% | chr10 | 71851150 | 71851334 | + | chr10 | 71851513 | 71851710 | + | ENST00000373255 | TAF |
| 20% | chr17 | 80440912 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |
| 20% | chr17 | 80440912 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |
| 20% | chr17 | 80440912 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |
| 20% | chr17 | 80440912 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |
| 20% | chr8 | 17722594 | 17722494 | − | chr8 | 17722260 | 17722101 | − | ENST00000398056; ENST00000522444; ENST00000381840; ENST00000398054; ENST00000381841; ENST00000427924; ENST00000518650 | TAF |
| 20% | chr17 | 79911953 | 79911734 | − | chr17 | 79911143 | 79910837 | − | ENST00000409678 | TAF |

TABLE 36-continued

Transcript fusion for Liver Hepatocellular Carcinoma (LIHC) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 19% | chr22 | 24899415 | 24899562 | + | chr22 | 24906717 | 24906811 | + | ENST00000413389; ENST00000326010 | TAF |
| 19% | chr5 | 34006954 | 34006922 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TAF |
| 19% | chr5 | 34006954 | 34006922 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TAF |
| 19% | chr5 | 34006954 | 34006922 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TAF |
| 19% | chr5 | 34006954 | 34006922 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TAF |
| 19% | chr5 | 34006954 | 34006922 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TAF |
| 19% | chr5 | 34006954 | 34006922 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TAF |
| 19% | chr5 | 34006954 | 34006922 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TAF |
| 19% | chr5 | 34006954 | 34006922 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TAF |
| 19% | chr5 | 34006954 | 34006922 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TAF |
| 18% | chr4 | 73969917 | 73969720 | − | chr4 | 73968264 | 73968093; 73968180 | − | ENST00000358602; ENST00000558247; ENST00000509867; ENST00000330838; ENST00000561029 | TAF |
| 18% | chr4 | 73969917 | 73969720 | − | chr4 | 73968264 | 73968093; 73968180 | − | ENST00000358602; ENST00000558247; ENST00000509867; ENST00000330838; ENST00000561029 | TAF |
| 17% | chr16 | 20553998 | 20553701 | − | chr16 | 20552095 | 20551976 | − | ENST00000329697; ENST00000565322; ENST00000565232; ENST00000567001 | TAF |
| 16% | chr10 | 5241290 | 5241827 | + | chr10 | 5242144 | 5242311 | + | ENST00000380448; ENST00000263126 | TSF |
| 15% | chr3 | 125898576 | 125898558 | − | chr3 | 125879845 | 125879696 | − | ENST00000273450 | TAF |
| 15% | chr14 | 24105943 | 24105981 | + | chr14 | 24112361 | 24112428 | + | ENST00000432832; ENST00000250383; ENST00000344777; ENST00000557535; ENST00000553600 | TAF |
| 15% | chr14 | 24105943 | 24105981 | + | chr14 | 24112361 | 24112428 | + | ENST00000432832; ENST00000250383; ENST00000344777; ENST00000557535; ENST00000553600 | TAF |
| 15% | chr14 | 24105943 | 24105981 | + | chr14 | 24112361 | 24112428 | + | ENST00000432832; ENST00000250383; ENST00000344777; ENST00000557535; ENST00000553600 | TAF |
| 15% | chr14 | 24105943 | 24105981 | + | chr14 | 24112361 | 24112428 | + | ENST00000432832; ENST00000250383; ENST00000344777; ENST00000557535; ENST00000553600 | TAF |
| 15% | chr14 | 24105943 | 24105981 | + | chr14 | 24112361 | 24112428 | + | ENST00000432832; ENST00000250383; ENST00000344777; ENST00000557535; ENST00000553600 | TAF |
| 15% | chr4 | 72608401 | 72608377 | − | chr4 | 72607587 | 72607552 | − | ENST00000513476 | TAF |
| 15% | chr19 | 1600051 | 1599987 | − | chr19 | 1599559 | 1599439 | − | ENST00000585937; ENST00000591899; ENST00000589880; ENST00000585671 | TAF |
| 15% | chr10 | 5241290 | 5241755 | + | chr10 | 5242144 | 5242311 | + | ENST00000380448; ENST00000263126 | TSF |

TABLE 36-continued

Transcript fusion for Liver Hepatocellular Carcinoma (LIHC) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 14% | chr1 | 23721341 | 23721341 | – | chr1 | 23720514 | 23720372 | – | ENST00000450454 | TAF |
| 13% | chr3 | 133465755 | 133465758 | + | chr3 | 133467256 | 133467428; 133467513; 133467369 | + | ENST00000402696; ENST00000414694; ENST00000494430; ENST00000485977 | TAF |
| 13% | chr3 | 133465755 | 133465758 | + | chr3 | 133467256 | 133467428; 133467513; 133467369 | + | ENST00000402696; ENST00000414694; ENST00000494430; ENST00000485977 | TAF |
| 13% | chr3 | 133465755 | 133465758 | + | chr3 | 133467256 | 133467428; 133467513; 133467369 | + | ENST00000402696; ENST00000414694; ENST00000494430; ENST00000485977 | TAF |
| 13% | chr3 | 133465755 | 133465758 | + | chr3 | 133467256 | 133467428; 133467513; 133467369 | + | ENST00000402696; ENST00000414694; ENST00000494430; ENST00000485977 | TAF |
| 13% | chr17 | 79214190 | 79214239 | + | chr17 | 79214787 | 79214816; 79214953 | + | ENST00000431388; ENST00000576002 | TAF |
| 13% | chr17 | 79214190 | 79214239 | + | chr17 | 79214787 | 79214816; 79214953 | + | ENST00000431388; ENST00000576002 | TAF |
| 13% | chr5 | 147210961 | 147210946 | – | chr5 | 147209193 | 147209162 | – | ENST00000296695; ENST00000510027 | TAF |
| 13% | chr5 | 147210961 | 147210946 | – | chr5 | 147209193 | 147209162 | – | ENST00000296695; ENST00000510027 | TAF |
| 12% | chr10 | 13337060 | 13336880 | – | chr10 | 13336596 | 13336428 | – | ENST00000263038; ENST00000396920; ENST00000479604 | TAF |
| 12% | chr10 | 13337060 | 13336880 | – | chr10 | 13336596 | 13336428 | – | ENST00000263038; ENST00000396920; ENST00000479604 | TAF |
| 12% | chr10 | 13337060 | 13336880 | – | chr10 | 13336596 | 13336428 | – | ENST00000263038; ENST00000396920; ENST00000479604 | TAF |
| 12% | chr10 | 120902016 | 120901765 | – | chr10 | 120900831 | 120900754 | – | ENST00000355697; ENST00000330036 | TAF |
| 12% | chr7 | 99394816 | 99394725 | – | chr7 | 99250402 | 99250176 | – | ENST00000222982; ENST00000343703 | TAF |
| 12% | chr6 | 160522124 | 160522271 | + | chr6 | 160523551 | 160523703 | + | ENST00000356956 | TAF |
| 12% | chr4 | 48013268 | 48012811 | – | chr4 | 47954720 | 47954600 | – | ENST00000402813 | TAF |
| 12% | chr10 | 5241290 | 5241368 | + | chr10 | 5242144 | 5242311 | + | ENST00000380448; ENST00000263126 | TSF |
| 11% | chr7 | 1193171 | 1193154 | – | chr7 | 1192860 | 1192709; 1192543; 1192705 | – | ENST00000401903; ENST00000397083; ENST00000316495 | TAF |
| 11% | chr7 | 1193171 | 1193154 | – | chr7 | 1192860 | 1192709; 1192543; 1192705 | – | ENST00000401903; ENST00000397083; ENST00000316495 | TAF |
| 11% | chr7 | 1193171 | 1193154 | – | chr7 | 1192860 | 1192709; 1192543; 1192705 | – | ENST00000401903; ENST00000397083; ENST00000316495 | TAF |
| 11% | chr17 | 76192772 | 76192809 | + | chr17 | 76198580 | 76198684 | + | ENST00000409257; ENST00000591256; ENST00000588199; ENST00000327898; ENST00000586542 | TAF |
| 11% | chr17 | 76192772 | 76192809 | + | chr17 | 76198580 | 76198684 | + | ENST00000409257; ENST00000591256; ENST00000588199; ENST00000327898; ENST00000586542 | TAF |
| 11% | chr17 | 76192772 | 76192809 | + | chr17 | 76198580 | 76198684 | + | ENST00000409257; ENST00000591256; ENST00000588199; ENST00000327898; ENST00000586542 | TAF |
| 11% | chr17 | 76192772 | 76192809 | + | chr17 | 76198580 | 76198684 | + | ENST00000409257; ENST00000591256; ENST00000588199; ENST00000327898; ENST00000586542 | TAF |
| 11% | chr17 | 76192772 | 76192809 | + | chr17 | 76198580 | 76198684 | + | ENST00000409257; ENST00000591256; ENST00000588199; ENST00000327898; ENST00000586542 | TAF |
| 11% | chr7 | 99401376 | 99401279 | – | chr7 | 99250402 | 99250176 | – | ENST00000222982; ENST00000343703 | TAF |
| 11% | chr3 | 125869700 | 125869634 | – | chr3 | 125869374 | 125869249 | – | ENST00000273450; ENST00000472186; ENST00000452905; ENST00000393434; ENST00000393431 | TAF |
| 11% | chr3 | 125869700 | 125869634 | – | chr3 | 125869374 | 125869249 | – | ENST00000273450; ENST00000472186; ENST00000452905; ENST00000393434; ENST00000393431 | TAF |
| 11% | chr8 | 144638103 | 144638200 | + | chr8 | 144640548 | 144640621 | + | ENST00000533063 | TAF |
| 11% | chr9 | 111648536 | 111648048 | – | chr9 | 111644467 | 111644405 | – | ENST00000495759; ENST00000374647; ENST00000537196 | TAF |
| 11% | chr9 | 111648536 | 111648048 | – | chr9 | 111644467 | 111644405 | – | ENST00000495759; ENST00000374647; ENST00000537196 | TAF |
| 10% | chr3 | 149210772 | 149210837 | + | chr3 | 149216509 | 149216698 | + | ENST00000305354 | TAF |
| 10% | chr11 | 322262 | 322206 | – | chr11 | 320772 | 320565 | – | ENST00000399808 | TAF |
| 10% | chr11 | 321450 | 321426 | – | chr11 | 320772 | 320565 | – | ENST00000399808 | TAF |
| 10% | chr11 | 321638 | 321543 | – | chr11 | 320772 | 320565 | – | ENST00000399808 | TAF |
| 10% | chr11 | 321638 | 321504 | – | chr11 | 320772 | 320565 | – | ENST00000399808 | TAF |
| 10% | chr11 | 322457 | 322401 | – | chr11 | 320772 | 320565 | – | ENST00000399808 | TAF |
| 10% | chr11 | 321911 | 321855 | – | chr11 | 320772 | 320565 | – | ENST00000399808 | TAF |
| 10% | chr11 | 321488 | 321465 | – | chr11 | 320772 | 320565 | – | ENST00000399808 | TAF |
| 10% | chr11 | 322580 | 322557 | – | chr11 | 320772 | 320565 | – | ENST00000399808 | TAF |

TABLE 36-continued

Transcript fusion for Liver Hepatocellular Carcinoma (LIHC) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 10% | chr11 | 321410 | 321387 | − | chr11 | 320772 | 320565 | − | ENST00000399808 | TAF |
| 10% | chr11 | 321638 | 321582 | − | chr11 | 320772 | 320565 | − | ENST00000399808 | TAF |
| 10% | chr11 | 321716 | 321660 | − | chr11 | 320772 | 320565 | − | ENST00000399808 | TAF |
| 10% | chr11 | 322067 | 322011 | − | chr11 | 320772 | 320565 | − | ENST00000399808 | TAF |
| 9% | chr1 | 59980753 | 59980969 | + | chr1 | 60019796 | 60019899 | + | ENST00000371218; ENST00000303721; ENST00000430447; ENST00000371212 | TSF |
| 9% | chr1 | 59980753 | 59980969 | + | chr1 | 60019796 | 60019899 | + | ENST00000371218; ENST00000303721; ENST00000430447; ENST00000371212 | TSF |
| 9% | chr1 | 59980753 | 59980969 | + | chr1 | 60019796 | 60019899 | + | ENST00000371218; ENST00000303721; ENST00000430447; ENST00000371212 | TSF |
| 7% | chr16 | 72098678 | 72105626 | + | chr16 | 72107791 | 72107876 | + | ENST00000356967; ENST00000540303; ENST00000561690; ENST00000228226 | TSF |
| 7% | chr16 | 72098678 | 72105626 | + | chr16 | 72107791 | 72107876 | + | ENST00000356967; ENST00000540303; ENST00000561690; ENST00000228226 | TSF |
| 6% | chr11 | 46744446 | 46744531 | + | chr11 | 46744730 | 46744835 | + | ENST00000311907; ENST00000530231; ENST00000442468 | TSF |
| 6% | chr11 | 46744446 | 46744531 | + | chr11 | 46744730 | 46744835 | + | ENST00000311907; ENST00000530231; ENST00000442468 | TSF |
| 6% | chr11 | 46744446 | 46744531 | + | chr11 | 46744730 | 46744835 | + | ENST00000311907; ENST00000530231; ENST00000442468 | TSF |
| 6% | chr1 | 60092543 | 60093457 | + | chr1 | 60103900 | 60104047 | + | ENST00000371218; ENST00000303721; ENST00000430447; ENST00000371212; ENST00000371210 | TSF |
| 6% | chr1 | 60092543 | 60093457 | + | chr1 | 60103900 | 60104047 | + | ENST00000371218; ENST00000303721; ENST00000430447; ENST00000371212; ENST00000371210 | TSF |
| 6% | chr1 | 60092543 | 60093457 | + | chr1 | 60103900 | 60104047 | + | ENST00000371218; ENST00000303721; ENST00000430447; ENST00000371212; ENST00000371210 | TSF |
| 6% | chr15 | 75030988 | 75030728 | − | chr15 | 75014682 | 75014614; 75014676 | − | ENST00000395048; ENST00000379727; ENST00000567032; ENST00000395049; ENST00000562201; ENST00000569630 | TSF |
| 6% | chr15 | 75030988 | 75030728 | − | chr15 | 75014682 | 75014614; 75014676 | − | ENST00000395048; ENST00000379727; ENST00000567032; ENST00000395049; ENST00000562201; ENST00000569630 | TSF |
| 6% | chr15 | 75030988 | 75030728 | − | chr15 | 75014682 | 75014614; 75014676 | − | ENST00000395048; ENST00000379727; ENST00000567032; ENST00000395049; ENST00000562201; ENST00000569630 | TSF |
| 6% | chrX | 133098739 | 133098673 | − | chrX | 133087238 | 133087077 | − | ENST00000370818; ENST00000394299 | TSF |
| 6% | chrX | 133098739 | 133098673 | − | chrX | 133087238 | 133087077 | − | ENST00000370818; ENST00000394299 | TSF |
| 6% | chr7 | 134212336 | 134212386 | + | chr7 | 134215479 | 134215562 | + | ENST00000359579 | TSF |
| 5% | chr1 | 161205595 | 161205477 | − | chr1 | 161203128 | 161202959 | − | ENST00000512372; ENST00000367980; ENST00000367983; ENST00000437437; ENST00000412844; ENST00000428574; ENST00000442691; ENST00000505005; ENST00000508740; ENST00000367982; ENST00000506018; ENST00000367981; ENST00000504010; ENST00000511676; ENST00000515621; ENST00000367984; ENST00000367985; ENST00000367979; ENST00000506209; ENST00000515452 | TSF |
| 5% | chr1 | 161205595 | 161205477 | − | chr1 | 161203128 | 161202959 | − | ENST00000512372; ENST00000367980; ENST00000367983; ENST00000437437; ENST00000412844; ENST00000428574; ENST00000442691; ENST00000505005; ENST00000508740; ENST00000367982; ENST00000506018; ENST00000367981; ENST00000504010; ENST00000511676; ENST00000515621; ENST00000367984; ENST00000367985; ENST00000367979; ENST00000506209; ENST00000515452 | TSF |
| 5% | chr1 | 161205595 | 161205477 | − | chr1 | 161203128 | 161202959 | − | ENST00000512372; ENST00000367980; ENST00000367983; ENST00000437437; ENST00000412844; ENST00000428574; ENST00000442691; ENST00000505005; ENST00000508740; ENST00000367982; ENST00000506018; ENST00000367981; ENST00000504010; ENST00000511676; ENST00000515621; ENST00000367984; ENST00000367985; ENST00000367979; ENST00000506209; ENST00000515452 | TSF |
| 5% | chr1 | 161205595 | 161205477 | − | chr1 | 161203128 | 161202959 | − | ENST00000512372; ENST00000367980; ENST00000367983; ENST00000437437; ENST00000412844; ENST00000428574; ENST00000442691; ENST00000505005; | TSF |

TABLE 36-continued

Transcript fusion for Liver Hepatocellular Carcinoma (LIHC) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 5% | chr1 | 161205595 | 161205477 | − | chr1 | 161203128 | 161202959 | − | ENST00000508740; ENST00000367982; ENST00000506018; ENST00000367981; ENST00000504010; ENST00000511676; ENST00000515621; ENST00000367984; ENST00000367985; ENST00000367979; ENST00000506209; ENST00000515452 ENST00000512372; ENST00000367980; ENST00000367983; ENST00000437437; ENST00000412844; ENST00000428574; ENST00000442691; ENST00000505005; ENST00000508740; ENST00000367982; ENST00000506018; ENST00000367981; ENST00000504010; ENST00000511676; ENST00000515621; ENST00000367984; ENST00000367985; ENST00000367979; ENST00000506209; ENST00000515452 | TSF |
| 5% | chr1 | 161205595 | 161205477 | − | chr1 | 161203128 | 161202959 | − | ENST00000512372; ENST00000367980; ENST00000367983; ENST00000437437; ENST00000412844; ENST00000428574; ENST00000442691; ENST00000505005; ENST00000508740; ENST00000367982; ENST00000506018; ENST00000367981; ENST00000504010; ENST00000511676; ENST00000515621; ENST00000367984; ENST00000367985; ENST00000367979; ENST00000506209; ENST00000515452 | TSF |
| 5% | chr1 | 161205595 | 161205477 | − | chr1 | 161203128 | 161202959 | − | ENST00000512372; ENST00000367980; ENST00000367983; ENST00000437437; ENST00000412844; ENST00000428574; ENST00000442691; ENST00000505005; ENST00000508740; ENST00000367982; ENST00000506018; ENST00000367981; ENST00000504010; ENST00000511676; ENST00000515621; ENST00000367984; ENST00000367985; ENST00000367979; ENST00000506209; ENST00000515452 | TSF |
| 5% | chr1 | 161205595 | 161205477 | − | chr1 | 161203128 | 161202959 | − | ENST00000512372; ENST00000367980; ENST00000367983; ENST00000437437; ENST00000412844; ENST00000428574; ENST00000442691; ENST00000505005; ENST00000508740; ENST00000367982; ENST00000506018; ENST00000367981; ENST00000504010; ENST00000511676; ENST00000515621; ENST00000367984; ENST00000367985; ENST00000367979; ENST00000506209; ENST00000515452 | TSF |
| 5% | chr1 | 161205595 | 161205477 | − | chr1 | 161203128 | 161202959 | − | ENST00000512372; ENST00000367980; ENST00000367983; ENST00000437437; ENST00000412844; ENST00000428574; ENST00000442691; ENST00000505005; ENST00000508740; ENST00000367982; ENST00000506018; ENST00000367981; ENST00000504010; ENST00000511676; ENST00000515621; ENST00000367984; ENST00000367985; ENST00000367979; ENST00000506209; ENST00000515452 | TSF |
| 5% | chr1 | 161205595 | 161205477 | − | chr1 | 161203128 | 161202959 | − | ENST00000512372; ENST00000367980; ENST00000367983; ENST00000437437; ENST00000412844; ENST00000428574; ENST00000442691; ENST00000505005; ENST00000508740; ENST00000367982; ENST00000506018; ENST00000367981; ENST00000504010; ENST00000511676; ENST00000515621; ENST00000367984; ENST00000367985; ENST00000367979; ENST00000506209; ENST00000515452 | TSF |
| 5% | chr1 | 161205595 | 161205477 | − | chr1 | 161203128 | 161202959 | − | ENST00000512372; ENST00000367980; ENST00000367983; ENST00000437437; ENST00000412844; ENST00000428574; ENST00000442691; ENST00000505005; ENST00000508740; ENST00000367982; ENST00000506018; ENST00000367981; ENST00000504010; ENST00000511676; ENST00000515621; ENST00000367984; ENST00000367985; ENST00000367979; | TSF |

TABLE 36-continued

Transcript fusion for Liver Hepatocellular Carcinoma (LIHC) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 5% | chr1 | 161205595 | 161205477 | − | chr1 | 161203128 | 161202959 | − | ENST00000506209; ENST00000515452 ENST00000512372; ENST00000367980; ENST00000367983; ENST00000437437; ENST00000412844; ENST00000428574; ENST00000442691; ENST00000505005; ENST00000508740; ENST00000367982; ENST00000506018; ENST00000367981; ENST00000504010; ENST00000511676; ENST00000515621; ENST00000367984; ENST00000367985; ENST00000367979; | TSF |
| 5% | chr1 | 161205595 | 161205477 | − | chr1 | 161203128 | 161202959 | − | ENST00000506209; ENST00000515452 ENST00000512372; ENST00000367980; ENST00000367983; ENST00000437437; ENST00000412844; ENST00000428574; ENST00000442691; ENST00000505005; ENST00000508740; ENST00000367982; ENST00000506018; ENST00000367981; ENST00000504010; ENST00000511676; ENST00000515621; ENST00000367984; ENST00000367985; ENST00000367979; | TSF |
| 5% | chr1 | 161205595 | 161205477 | − | chr1 | 161203128 | 161202959 | − | ENST00000506209; ENST00000515452 ENST00000512372; ENST00000367980; ENST00000367983; ENST00000437437; ENST00000412844; ENST00000428574; ENST00000442691; ENST00000505005; ENST00000508740; ENST00000367982; ENST00000506018; ENST00000367981; ENST00000504010; ENST00000511676; ENST00000515621; ENST00000367984; ENST00000367985; ENST00000367979; ENST00000506209; ENST00000515452 | TSF |
| 5% | chr11 | 118892255 | 118892263 | + | chr11 | 118892470 | 118892596; 118892500 | + | ENST00000533632; ENST00000528230; ENST00000525303; ENST00000434101; ENST00000533058; ENST00000533012 | TSF |
| 5% | chr11 | 118892255 | 118892263 | + | chr11 | 118892470 | 118892596; 118892500 | + | ENST00000533632; ENST00000528230; ENST00000525303; ENST00000434101; ENST00000533058; ENST00000533012 | TSF |
| 5% | chr11 | 118892255 | 118892263 | + | chr11 | 118892470 | 118892596; 118892500 | + | ENST00000533632; ENST00000528230; ENST00000525303; ENST00000434101; ENST00000533058; ENST00000533012 | TSF |
| 5% | chr1 | 169819657 | 169819707 | + | chr1 | 169820958 | 169821077 | + | ENST00000359326; ENST00000286031 | TSF |
| 5% | chr17 | 56612963 | 56612799 | − | chr17 | 56604339 | 56604043; 56604293; 56604126 | − | ENST00000393086; ENST00000426861; ENST00000317268; ENST00000457347; ENST00000317256; ENST00000412945; ENST00000581615; ENST00000578131; ENST00000583291; ENST00000581607 | TSF |
| 5% | chr17 | 56612963 | 56612799 | − | chr17 | 56604339 | 56604043; 56604293; 56604126 | − | ENST00000393086; ENST00000426861; ENST00000317268; ENST00000457347; ENST00000317256; ENST00000412945; ENST00000581615; ENST00000578131; ENST00000583291; ENST00000581607 | TSF |
| 5% | chr17 | 56612963 | 56612799 | − | chr17 | 56604339 | 56604043; 56604293; 56604126 | − | ENST00000393086; ENST00000426861; ENST00000317268; ENST00000457347; ENST00000317256; ENST00000412945; ENST00000581615; ENST00000578131; ENST00000583291; ENST00000581607 | TSF |
| 5% | chr17 | 56612963 | 56612799 | − | chr17 | 56604339 | 56604043; 56604293; 56604126 | − | ENST00000393086; ENST00000426861; ENST00000317268; ENST00000457347; ENST00000317256; ENST00000412945; ENST00000581615; ENST00000578131; ENST00000583291; ENST00000581607 | TSF |
| 5% | chr17 | 56612963 | 56612799 | − | chr17 | 56604339 | 56604043; 56604293; 56604126 | − | ENST00000393086; ENST00000426861; ENST00000317268; ENST00000457347; ENST00000317256; ENST00000412945; ENST00000581615; ENST00000578131; ENST00000583291; ENST00000581607 | TSF |
| 5% | chr22 | 37408003 | 37407942 | − | chr22 | 37407366 | 37407068 | − | ENST00000403892; ENST00000249042 | TSF |
| 5% | chr19 | 45439440 | 45439575 | + | chr19 | 45448006 | 45448147; 45448151 | + | ENST00000592954; ENST00000419266; ENST00000585685; ENST00000589057; ENST00000591600 | TSF |
| 5% | chr19 | 45439440 | 45439575 | + | chr19 | 45448006 | 45448147; 45448151 | + | ENST00000592954; ENST00000419266; ENST00000585685; ENST00000589057; ENST00000591600 | TSF |
| 5% | chr19 | 45439440 | 45439575 | + | chr19 | 45448006 | 45448147; 45448151 | + | ENST00000592954; ENST00000419266; ENST00000585685; ENST00000589057; | TSF |

TABLE 36-continued

Transcript fusion for Liver Hepatocellular Carcinoma (LIHC) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 5% | chr1 | 31218846 | 31218765 | − | chr1 | 31215396 | 31215303 | − | ENST00000591600 ENST00000294507 | TSF |
| 5% | chr7 | 100230492 | 100230403 | − | chr7 | 100229568 | 100229429 | − | ENST00000223051; ENST00000490084; ENST00000462107 | TSF |
| 5% | chr7 | 100230492 | 100230403 | − | chr7 | 100229568 | 100229429 | − | ENST00000223051; ENST00000490084; ENST00000462107 | TSF |
| 5% | chr8 | 63949410 | 63948932 | − | chr8 | 63948329 | 63948215 | − | ENST00000260118 | TSF |
| 4% | chr17 | 42085560 | 42085588 | + | chr17 | 42085816 | 42085969 | + | ENST00000293404; ENST00000589767 | TSF |
| 4% | chr19 | 35551883 | 35551974 | + | chr19 | 35556154 | 35556249 | + | ENST00000262626; ENST00000392226; ENST00000597419 | TSF |
| 4% | chr9 | 117089333 | 117089631 | + | chr9 | 117092819 | 117092856 | + | ENST00000431067 | TSF |
| 4% | chr10 | 101180795 | 101180714 | − | chr10 | 101180381 | 101180562 | − | ENST00000370508; ENST00000543866 | TSF |
| 4% | chr16 | 20463435 | 20463788 | + | chr16 | 20476839 | 20476978; 20477049; 20477015 | + | ENST00000576361; ENST00000424070; ENST00000573854; ENST00000219054; ENST00000575690; ENST00000574692; ENST00000571894; ENST00000396104 | TSF |
| 4% | chr16 | 20463435 | 20463788 | + | chr16 | 20476839 | 20476978; 20477049; 20477015 | + | ENST00000576361; ENST00000424070; ENST00000573854; ENST00000219054; ENST00000575690; ENST00000574692; ENST00000571894; ENST00000396104 | TSF |
| 4% | chr16 | 20463435 | 20463788 | + | chr16 | 20476839 | 20476978; 20477049; 20477015 | + | ENST00000576361; ENST00000424070; ENST00000573854; ENST00000219054; ENST00000575690; ENST00000574692; ENST00000571894; ENST00000396104 | TSF |
| 4% | chr16 | 20463435 | 20463788 | + | chr16 | 20476839 | 20476978; 20477049; 20477015 | + | ENST00000576361; ENST00000424070; ENST00000573854; ENST00000219054; ENST00000575690; ENST00000574692; ENST00000571894; ENST00000396104 | TSF |
| 4% | chr1 | 59980753 | 59981111 | + | chr1 | 60019796 | 60019899 | + | ENST00000371218; ENST00000303721; ENST00000430447; ENST00000371212 | TSF |
| 4% | chr1 | 59980753 | 59981111 | + | chr1 | 60019796 | 60019899 | + | ENST00000371218; ENST00000303721; ENST00000430447; ENST00000371212 | TSF |
| 4% | chr1 | 59980753 | 59981111 | + | chr1 | 60019796 | 60019899 | + | ENST00000371218; ENST00000303721; ENST00000430447; ENST00000371212 | TSF |
| 4% | chr5 | 80703954 | 80703677 | − | chr5 | 80681645 | 80681576 | − | ENST00000307624; ENST00000513751 | TSF |
| 4% | chr5 | 80703954 | 80703677 | − | chr5 | 80681645 | 80681576 | − | ENST00000307624; ENST00000513751 | TSF |
| 4% | chr6 | 161637963 | 161637691 | − | chr6 | 161587449 | 161587280; 161587148 | − | ENST00000320285; ENST00000366908; ENST00000436279; ENST00000366905 | TSF |
| 4% | chr6 | 161637963 | 161637691 | − | chr6 | 161587449 | 161587280; 161587148 | − | ENST00000320285; ENST00000366908; ENST00000436279; ENST00000366905 | TSF |
| 4% | chr6 | 161637963 | 161637691 | − | chr6 | 161587449 | 161587280; 161587148 | − | ENST00000320285; ENST00000366908; ENST00000436279; ENST00000366905 | TSF |
| 4% | chr17 | 79936116 | 79936215 | + | chr17 | 79937060 | 79937115 | + | ENST00000581484; ENST00000306729; ENST00000306739; ENST00000344865; ENST00000581647; ENST00000583503; ENST00000579684 | TSF |
| 4% | chr17 | 79936116 | 79936215 | + | chr17 | 79937060 | 79937115 | + | ENST00000581484; ENST00000306729; ENST00000306739; ENST00000344865; ENST00000581647; ENST00000583503; ENST00000579684 | TSF |
| 4% | chr17 | 79936116 | 79936215 | + | chr17 | 79937060 | 79937115 | + | ENST00000581484; ENST00000306729; ENST00000306739; ENST00000344865; ENST00000581647; ENST00000583503; ENST00000579684 | TSF |
| 4% | chr17 | 79936116 | 79936215 | + | chr17 | 79937060 | 79937115 | + | ENST00000581484; ENST00000306729; ENST00000306739; ENST00000344865; ENST00000581647; ENST00000583503; ENST00000579684 | TSF |
| 4% | chr17 | 79936116 | 79936215 | + | chr17 | 79937060 | 79937115 | + | ENST00000581484; ENST00000306729; ENST00000306739; ENST00000344865; ENST00000581647; ENST00000583503; ENST00000579684 | TSF |
| 4% | chr17 | 79936116 | 79936215 | + | chr17 | 79937060 | 79937115 | + | ENST00000581484; ENST00000306729; ENST00000306739; ENST00000344865; ENST00000581647; ENST00000583503; ENST00000579684 | TSF |
| 4% | chr8 | 63958276 | 63958130 | − | chr8 | 63948329 | 63948215 | − | ENST00000260118 | TSF |
| 4% | chr3 | 182757105 | 182757101 | − | chr3 | 182756923 | 182756814 | − | ENST00000265594; ENST00000492597; ENST00000497959; ENST00000539926; ENST00000476176 | TSF |
| 4% | chr3 | 182757105 | 182757101 | − | chr3 | 182756923 | 182756814 | − | ENST00000265594; ENST00000492597; | TSF |

TABLE 36-continued

Transcript fusion for Liver Hepatocellular Carcinoma (LIHC) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| | | | | | | | | | ENST00000497959; ENST00000539926; ENST00000476176 | |
| 4% | chr3 | 182757105 | 182757101 | − | chr3 | 182756923 | 182756814 | − | ENST00000265594; ENST00000492597; ENST00000497959; ENST00000539926; ENST00000476176 | TSF |
| 4% | chr3 | 182757105 | 182757101 | − | chr3 | 182756923 | 182756814 | − | ENST00000265594; ENST00000492597; ENST00000497959; ENST00000539926; ENST00000476176 | TSF |
| 4% | chr1 | 50993149 | 50992877 | − | chr1 | 50957473 | 50957393 | − | ENST00000396153; ENST00000371778; ENST00000545823; ENST00000494400 | TSF |
| 4% | chr1 | 50993149 | 50992877 | − | chr1 | 50957473 | 50957393 | − | ENST00000396153; ENST00000371778; ENST00000545823; ENST00000494400 | TSF |
| 4% | chr19 | 45439440 | 45439575 | + | chr19 | 45451723 | 45451790 | + | ENST00000589057 | TSF |
| 4% | chr19 | 45420573 | 45420622 | + | chr19 | 45422430 | 45422487; 45422466; 45422480; 45422461 | + | ENST00000588750; ENST00000588802; ENST00000592535; ENST00000252491; ENST00000592885; ENST00000589781; ENST00000586638 | TSF |
| 4% | chr19 | 45420573 | 45420622 | + | chr19 | 45422430 | 45422487; 45422466; 45422480; 45422461 | + | ENST00000588750; ENST00000588802; ENST00000592535; ENST00000252491; ENST00000592885; ENST00000589781; ENST00000586638 | TSF |
| 4% | chr19 | 45420573 | 45420622 | + | chr19 | 45422430 | 45422487; 45422466; 45422480; 45422461 | + | ENST00000588750; ENST00000588802; ENST00000592535; ENST00000252491; ENST00000592885; ENST00000589781; ENST00000586638 | TSF |
| 4% | chr19 | 45420573 | 45420622 | + | chr19 | 45422430 | 45422487; 45422466; 45422480; 45422461 | + | ENST00000588750; ENST00000588802; ENST00000592535; ENST00000252491; ENST00000592885; ENST00000589781; ENST00000586638 | TSF |
| 4% | chr11 | 118083018 | 118082875 | − | chr11 | 118081427 | 118081202; 118081333 | − | ENST00000356289; ENST00000292067; ENST00000533261; ENST00000526595; ENST00000526620; ENST00000524477; ENST00000527877; ENST00000525565 | TSF |
| 4% | chr11 | 118083018 | 118082875 | − | chr11 | 118081427 | 118081202; 118081333 | − | ENST00000356289; ENST00000292067; ENST00000533261; ENST00000526595; ENST00000526620; ENST00000524477; ENST00000527877; ENST00000525565 | TSF |
| 4% | chr11 | 118083018 | 118082875 | − | chr11 | 118081427 | 118081202; 118081333 | − | ENST00000356289; ENST00000292067; ENST00000533261; ENST00000526595; ENST00000526620; ENST00000524477; ENST00000527877; ENST00000525565 | TSF |
| 4% | chr11 | 118083018 | 118082875 | − | chr11 | 118081427 | 118081202; 118081333 | − | ENST00000356289; ENST00000292067; ENST00000533261; ENST00000526595; ENST00000526620; ENST00000524477; ENST00000527877; ENST00000525565 | TSF |
| 4% | chr11 | 118083018 | 118082875 | − | chr11 | 118081427 | 118081202; 118081333 | − | ENST00000356289; ENST00000292067; ENST00000533261; ENST00000526595; ENST00000526620; ENST00000524477; ENST00000527877; ENST00000525565 | TSF |
| 4% | chr11 | 118083018 | 118082875 | − | chr11 | 118081427 | 118081202; 118081333 | − | ENST00000356289; ENST00000292067; ENST00000533261; ENST00000526595; ENST00000526620; ENST00000524477; ENST00000527877; ENST00000525565 | TSF |
| 4% | chr5 | 34006954 | 34006915 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TSF |
| 4% | chr5 | 34006954 | 34006915 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TSF |
| 4% | chr5 | 34006954 | 34006915 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TSF |
| 4% | chr5 | 34006954 | 34006915 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TSF |
| 4% | chr5 | 34006954 | 34006915 | − | chr5 | 34006004 | 34005861 | − | ENST00000335606; ENST00000382072; ENST00000382079; ENST00000506639; | TSF |

TABLE 36-continued

Transcript fusion for Liver Hepatocellular Carcinoma (LIHC) Coordinates of the fusion sequences for which the donor is the TE.

| 1 | 2' | 3' | 4' | 5' | 6' | 7' | 8' | 9' | 10' | 11' |
|---|----|----|----|----|----|----|----|----|-----|-----|
| 4% | chr5 | 34006954 | 34006915 | − | chr5 | 34006004 | 34005861 | − | ENST00000382085; ENST00000502637; ENST00000441713; ENST00000426255; ENST00000512079; ENST00000382068 ENST00000335606; ENST00000382072; ENST00000382079; ENST00000506639; | TSF |
| 4% | chr5 | 34006954 | 34006915 | − | chr5 | 34006004 | 34005861 | − | ENST00000382085; ENST00000502637; ENST00000441713; ENST00000426255; ENST00000512079; ENST00000382068 ENST00000335606; ENST00000382072; ENST00000382079; ENST00000506639; | TSF |
| 4% | chr5 | 34006954 | 34006915 | − | chr5 | 34006004 | 34005861 | − | ENST00000382085; ENST00000502637; ENST00000441713; ENST00000426255; ENST00000512079; ENST00000382068 ENST00000335606; ENST00000382072; ENST00000382079; ENST00000506639; | TSF |
| 4% | chr5 | 34006954 | 34006915 | − | chr5 | 34006004 | 34005861 | − | ENST00000382085; ENST00000502637; ENST00000441713; ENST00000426255; ENST00000512079; ENST00000382068 ENST00000335606; ENST00000382072; ENST00000382079; ENST00000506639; | TSF |
| 3% | chr16 | 72098678 | 72105523 | + | chr16 | 72107791 | 72107876 | + | ENST00000356967; ENST00000540303; ENST00000561690; ENST00000228226 | TSF |
| 3% | chr16 | 72098678 | 72105523 | + | chr16 | 72107791 | 72107876 | + | ENST00000356967; ENST00000540303; ENST00000561690; ENST00000228226 | TSF |
| 3% | chr19 | 45409998 | 45410105 | + | chr19 | 45411017 | 45411209 | + | ENST00000252486; ENST00000446996; ENST00000434152; ENST00000425718 | TSF |
| 3% | chr19 | 45409998 | 45410105 | + | chr19 | 45411017 | 45411209 | + | ENST00000252486; ENST00000446996; ENST00000434152; ENST00000425718 | TSF |
| 3% | chr19 | 45409998 | 45410105 | + | chr19 | 45411017 | 45411209 | + | ENST00000252486; ENST00000446996; ENST00000434152; ENST00000425718 | TSF |
| 3% | chr19 | 45409998 | 45410105 | + | chr19 | 45411017 | 45411209 | + | ENST00000252486; ENST00000446996; ENST00000434152; ENST00000425718 | TSF |
| 3% | chr19 | 45450127 | 45450350 | + | chr19 | 45451723 | 45451790 | + | ENST00000589057 | TSF |
| 3% | chr1 | 59980221 | 59980497 | + | chr1 | 60073475 | 60073582 | + | ENST00000371218; ENST00000303721; ENST00000430447; ENST00000371212; ENST00000371210 | TSF |
| 3% | chr1 | 59980221 | 59980497 | + | chr1 | 60073475 | 60073582 | + | ENST00000371218; ENST00000303721; ENST00000430447; ENST00000371212; ENST00000371210 | TSF |
| 3% | chr1 | 59980221 | 59980497 | + | chr1 | 60073475 | 60073582 | + | ENST00000371218; ENST00000303721; ENST00000430447; ENST00000371212; ENST00000371210 | TSF |
| 3% | chr20 | 10400592 | 10400319 | − | chr20 | 10389451 | 10389276 | − | ENST00000347364; ENST00000399054 | TSF |
| 3% | chr2 | 85811874 | 85811992 | + | chr2 | 85818852 | 85818985 | + | ENST00000306384 | TSF |
| 3% | chr1 | 196673673 | 196675339 | + | chr1 | 196682865 | 196683047 | + | ENST00000367429 | TSF |
| 3% | chr6 | 5530387 | 5530482 | + | chr6 | 5545413 | 5545573 | + | ENST00000324331; ENST00000274680 | TSF |
| 3% | chr10 | 5060345 | 5060092 | − | chr10 | 5043777 | 5043706 | − | ENST00000380753; ENST00000421196; ENST00000407674; ENST00000604507; ENST00000455190 | TSF |
| 3% | chr10 | 5060345 | 5060092 | − | chr10 | 5043777 | 5043706 | − | ENST00000380753; ENST00000421196; ENST00000407674; ENST00000604507; ENST00000455190 | TSF |
| 3% | chr10 | 5060345 | 5060092 | − | chr10 | 5043777 | 5043706 | − | ENST00000380753; ENST00000421196; ENST00000407674; ENST00000604507; ENST00000455190 | TSF |
| 3% | chr10 | 5060345 | 5060092 | − | chr10 | 5043777 | 5043706 | − | ENST00000380753; ENST00000421196; ENST00000407674; ENST00000604507; ENST00000455190 | TSF |
| 3% | chr5 | 34014243 | 34013950 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TSF |
| 3% | chr5 | 34014243 | 34013950 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TSF |
| 3% | chr5 | 34014243 | 34013950 | − | chr5 | 34006004 | 34005861 | − | ENST00000335606; ENST00000382072; ENST00000382079; ENST00000506639; ENST00000382085; ENST00000502637; ENST00000441713; ENST00000426255; | TSF |

TABLE 36-continued

Transcript fusion for Liver Hepatocellular Carcinoma (LIHC) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 3% | chr5 | 34014243 | 34013950 | − | chr5 | 34006004 | 34005861 | − | ENST00000512079; ENST00000382068 ENST00000335606; ENST00000382072; ENST00000382079; ENST00000506639; ENST00000382085; ENST00000502637; ENST00000441713; ENST00000426255; ENST00000512079; ENST00000382068 | TSF |
| 3% | chr5 | 34014243 | 34013950 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TSF |
| 3% | chr5 | 34014243 | 34013950 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TSF |
| 3% | chr5 | 34014243 | 34013950 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TSF |
| 3% | chr5 | 34014243 | 34013950 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TSF |
| 3% | chr5 | 34014243 | 34013950 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TSF |
| 3% | chr6 | 80022917 | 80022085 | − | chr6 | 79924739 | 79924689 | − | ENST00000275036; ENST00000344726 | TSF |
| 3% | chr6 | 80022917 | 80022085 | − | chr6 | 79924739 | 79924689 | − | ENST00000275036; ENST00000344726 | TSF |
| 3% | chr5 | 1257846 | 1257816 | − | chr5 | 1255526 | 1255402 | − | ENST00000310581; ENST00000334602 | TSF |
| 3% | chr9 | 99067886 | 99067556 | − | chr9 | 99064349 | 99064233 | − | ENST00000375263; ENST00000375262 | TSF |
| 3% | chr9 | 99067886 | 99067556 | − | chr9 | 99064349 | 99064233 | − | ENST00000375263; ENST00000375262 | TSF |
| 3% | chr7 | 100230492 | 100230403 | − | chr7 | 100229772 | 100229705 | − | ENST00000223051; ENST00000490084; ENST00000462107 | TSF |
| 3% | chr7 | 100230492 | 100230403 | − | chr7 | 100229772 | 100229705 | − | ENST00000223051; ENST00000490084; ENST00000462107 | TSF |
| 3% | chr4 | 107241932 | 107242046 | + | chr4 | 107246142 | 107246275 | + | ENST00000394701 | TSF |
| 3% | chr2 | 234733211 | 234733401 | + | chr2 | 234737276 | 234737425 | + | ENST00000389758 | TSF |
| 3% | chr7 | 65545998 | 65546064 | + | chr7 | 65546790 | 65546984 | + | ENST00000304874; ENST00000380839; ENST00000395332; ENST00000395331 | TSF |
| 3% | chr7 | 65545998 | 65546064 | + | chr7 | 65546790 | 65546984 | + | ENST00000304874; ENST00000380839; ENST00000395332; ENST00000395331 | TSF |
| 3% | chr7 | 65545998 | 65546064 | + | chr7 | 65546790 | 65546984 | + | ENST00000304874; ENST00000380839; ENST00000395332; ENST00000395331 | TSF |
| 3% | chr9 | 117090746 | 117090775 | + | chr9 | 117092714 | 117092856; 117092769 | + | ENST00000431067; ENST00000412657 | TSF |
| 3% | chr9 | 117090746 | 117090775 | + | chr9 | 117092714 | 117092856; 117092769 | + | ENST00000431067; ENST00000412657 | TSF |
| 3% | chr17 | 40029733 | 40029683 | − | chr17 | 40028435 | 40028285 | − | ENST00000352035; ENST00000590151; ENST00000353196; ENST00000537919; ENST00000393896 | TSF |
| 3% | chr3 | 58508590 | 58508545 | − | chr3 | 58508328 | 58508223 | − | ENST00000459701; ENST00000302819 | TSF |
| 3% | chr9 | 116860197 | 116860071 | − | chr9 | 116840393 | 116840373 | − | ENST00000265132; ENST00000603230 | TSF |
| 3% | chr9 | 116860197 | 116860071 | − | chr9 | 116840393 | 116840373 | − | ENST00000265132; ENST00000603230 | TSF |
| 2% | chr1 | 182406436 | 182406465 | + | chr1 | 182423093 | 182423175 | + | ENST00000542961; ENST00000294854; ENST00000443996; ENST00000416676; ENST00000422241 | TSF |
| 2% | chr1 | 182406436 | 182406465 | + | chr1 | 182423093 | 182423175 | + | ENST00000542961; ENST00000294854; ENST00000443996; ENST00000416676; ENST00000422241 | TSF |
| 2% | chr1 | 182406436 | 182406465 | + | chr1 | 182423093 | 182423175 | + | ENST00000542961; ENST00000294854; ENST00000443996; ENST00000416676; ENST00000422241 | TSF |
| 2% | chr1 | 182406436 | 182406465 | + | chr1 | 182423093 | 182423175 | + | ENST00000542961; ENST00000294854; ENST00000443996; ENST00000416676; ENST00000422241 | TSF |
| 2% | chr8 | 91057494 | 91058452 | + | chr8 | 91063905 | 91063967; 91063912 | + | ENST00000220764; ENST00000522161; ENST00000520148 | TSF |
| 2% | chr8 | 91057494 | 91058452 | + | chr8 | 91063905 | 91063967; 91063912 | + | ENST00000220764; ENST00000522161; ENST00000520148 | TSF |
| 2% | chr21 | 39513161 | 39513404 | + | chr21 | 39528398 | 39528496 | + | ENST00000357704; ENST00000400477 | TSF |

TABLE 36-continued

Transcript fusion for Liver Hepatocellular Carcinoma (LIHC) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 2% | chr17 | 27373782 | 27373865 | + | chr17 | 27380431 | 27380613; 27380610 | + | ENST00000323372; ENST00000466889; ENST00000469082 | TSF |
| 2% | chr17 | 27373782 | 27373865 | + | chr17 | 27380431 | 27380613; 27380610 | + | ENST00000323372; ENST00000466889; ENST00000469082 | TSF |
| 2% | chr17 | 27373782 | 27373865 | + | chr17 | 27380431 | 27380613; 27380610 | + | ENST00000323372; ENST00000466889; ENST00000469082 | TSF |
| 2% | chr5 | 139976114 | 139976476 | + | chr5 | 140021250 | 140021365; 140021408; 140021344 | + | ENST00000394671; ENST00000511410; ENST00000515653; ENST00000252100 | TSF |
| 2% | chr5 | 139976114 | 139976476 | + | chr5 | 140021250 | 140021365; 140021408; 140021344 | + | ENST00000394671; ENST00000511410; ENST00000515653; ENST00000252100 | TSF |
| 2% | chr5 | 139976114 | 139976476 | + | chr5 | 140021250 | 140021365; 140021408; 140021344 | + | ENST00000394671; ENST00000511410; ENST00000515653; ENST00000252100 | TSF |
| 2% | chr5 | 139976114 | 139976476 | + | chr5 | 140021250 | 140021365; 140021408; 140021344 | + | ENST00000394671; ENST00000511410; ENST00000515653; ENST00000252100 | TSF |
| 2% | chr12 | 122293286 | 122293120 | − | chr12 | 122292698 | 122292609 | − | ENST00000289004; ENST00000543163 | TSF |
| 2% | chr10 | 5060345 | 5060092 | − | chr10 | 5043783 | 5043706 | − | ENST00000380753; ENST00000421196; ENST00000407674; ENST00000604507; ENST00000455190 | TSF |
| 2% | chr10 | 5060345 | 5060092 | − | chr10 | 5043783 | 5043706 | − | ENST00000380753; ENST00000421196; ENST00000407674; ENST00000604507; ENST00000455190 | TSF |
| 2% | chr10 | 5060345 | 5060092 | − | chr10 | 5043783 | 5043706 | − | ENST00000380753; ENST00000421196; ENST00000407674; ENST00000604507; ENST00000455190 | TSF |
| 2% | chr10 | 5060345 | 5060092 | − | chr10 | 5043783 | 5043706 | − | ENST00000380753; ENST00000421196; ENST00000407674; ENST00000604507; ENST00000455190 | TSF |
| 2% | chr7 | 99257824 | 99251951 | − | chr7 | 99250402 | 99250176 | − | ENST00000222982; ENST00000343703 | TSF |
| 2% | chr12 | 54862718 | 54862609 | − | chr12 | 54858951 | 54858851 | − | ENST00000546931; ENST00000552397; ENST00000305879 | TSF |
| 2% | chr12 | 54862718 | 54862609 | − | chr12 | 54858951 | 54858851 | − | ENST00000546931; ENST00000552397; ENST00000305879 | TSF |
| 2% | chr16 | 20587097 | 20586744 | − | chr16 | 20570769 | 20570559; 20570593; 20570630 | − | ENST00000329697; ENST00000565232; ENST00000567001; ENST00000569327; ENST00000414188; ENST00000566384; ENST00000569344 | TSF |
| 2% | chr16 | 20587097 | 20586744 | − | chr16 | 20570769 | 20570559; 20570593; 20570630 | − | ENST00000329697; ENST00000565232; ENST00000567001; ENST00000569327; ENST00000414188; ENST00000566384; ENST00000569344 | TSF |
| 2% | chr16 | 20587097 | 20586744 | − | chr16 | 20570769 | 20570559; 20570593; 20570630 | − | ENST00000329697; ENST00000565232; ENST00000567001; ENST00000569327; ENST00000414188; ENST00000566384; ENST00000569344 | TSF |
| 2% | chr16 | 20587097 | 20586744 | − | chr16 | 20570769 | 20570559; 20570593; 20570630 | − | ENST00000329697; ENST00000565232; ENST00000567001; ENST00000569327; ENST00000414188; ENST00000566384; ENST00000569344 | TSF |
| 2% | chr17 | 80070847 | 80070635 | − | chr17 | 80059742 | 80059558; 08005967 | − | ENST00000389641; ENST00000392347; ENST00000392345 | TSF |
| 2% | chr17 | 80070847 | 80070635 | − | chr17 | 80059742 | 80059558; 80059607 | − | ENST00000389641; ENST00000392347; ENST00000392345 | TSF |
| 2% | chr5 | 34010561 | 34010327 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TSF |
| 2% | chr5 | 34010561 | 34010327 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TSF |
| 2% | chr5 | 34010561 | 34010327 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TSF |
| 2% | chr5 | 34010561 | 34010327 | − | chr5 | 34006004 | 34005861 | − | ENST00000335606; ENST00000382072; ENST00000382079; ENST00000506639; ENST00000382085; ENST00000502637; ENST00000441713; ENST00000426255; | TSF |

TABLE 36-continued

Transcript fusion for Liver Hepatocellular Carcinoma (LIHC) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 2% | chr5 | 34010561 | 34010327 | − | chr5 | 34006004 | 34005861 | − | ENST00000512079; ENST00000382068 ENST00000335606; ENST00000382072; ENST00000382079; ENST00000506639; ENST00000382085; ENST00000502637; ENST00000441713; ENST00000426255; | TSF |
| 2% | chr5 | 34010561 | 34010327 | − | chr5 | 34006004 | 34005861 | − | ENST00000512079; ENST00000382068 ENST00000335606; ENST00000382072; ENST00000382079; ENST00000506639; ENST00000382085; ENST00000502637; ENST00000441713; ENST00000426255; | TSF |
| 2% | chr5 | 34010561 | 34010327 | − | chr5 | 34006004 | 34005861 | − | ENST00000512079; ENST00000382068 ENST00000335606; ENST00000382072; ENST00000382079; ENST00000506639; ENST00000382085; ENST00000502637; ENST00000441713; ENST00000426255; | TSF |
| 2% | chr5 | 34010561 | 34010327 | − | chr5 | 34006004 | 34005861 | − | ENST00000512079; ENST00000382068 ENST00000335606; ENST00000382072; ENST00000382079; ENST00000506639; ENST00000382085; ENST00000502637; ENST00000441713; ENST00000426255; | TSF |
| 2% | chr5 | 34010561 | 34010327 | − | chr5 | 34006004 | 34005861 | − | ENST00000512079; ENST00000382068 ENST00000335606; ENST00000382072; ENST00000382079; ENST00000506639; ENST00000382085; ENST00000502637; ENST00000441713; ENST00000426255; ENST00000512079; ENST00000382068 | TSF |
| 2% | chr1 | 207263335 | 207263401 | + | chr1 | 207263653 | 207263826 | + | ENST00000367078; ENST00000452902; ENST00000243611; ENST00000391923 | TSF |
| 2% | chr1 | 207263335 | 207263401 | + | chr1 | 207263653 | 207263826 | + | ENST00000367078; ENST00000452902; ENST00000243611; ENST00000391923 | TSF |
| 2% | chr16 | 72098678 | 72098893 | + | chr16 | 72108183 | 72108284 | + | ENST00000356967; ENST00000540303; ENST00000561690; ENST00000228226 | TSF |
| 2% | chr16 | 72098678 | 72098893 | + | chr16 | 72108183 | 72108284 | + | ENST00000356967; ENST00000540303; ENST00000561690; ENST00000228226 | TSF |
| 2% | chr16 | 84000773 | 84000932 | + | chr16 | 84005756 | 84005780 | + | ENST00000305202 | TSF |
| 2% | chr4 | 74314427 | 74314578 | + | chr4 | 74315052 | 74315184 | + | ENST00000395792; ENST00000226359 | TSF |
| 2% | chr4 | 74314427 | 74314578 | + | chr4 | 74315052 | 74315184 | + | ENST00000395792; ENST00000226359 | TSF |
| 2% | chr16 | 25189880 | 25189933 | + | chr16 | 25232778 | 25232904 | + | ENST00000566125; ENST00000219660 | TSF |
| 2% | chr15 | 51649563 | 51649596 | + | chr15 | 51669646 | 51669697 | + | ENST00000335449; ENST00000558426 | TSF |
| 2% | chr15 | 51649563 | 51649596 | + | chr15 | 51669646 | 51669697 | + | ENST00000335449; ENST00000558426 | TSF |
| 2% | chr20 | 634541 | 634468 | − | chr20 | 629561 | 629358; 629500 | − | ENST00000381962; ENST00000488788 | TSF |
| 2% | chr20 | 634541 | 634468 | − | chr20 | 629561 | 629358; 629500 | − | ENST00000381962; ENST00000488788 | TSF |
| 2% | chr2 | 216905778 | 216905772 | − | chr2 | 216904083 | 216903998 | − | ENST00000265322 | TSF |
| 2% | chr9 | 123165858 | 123165617 | − | chr9 | 123165349 | 123165084 | − | ENST00000359309; ENST00000360822; ENST00000349780; ENST00000360190; ENST00000416449; ENST00000425647 | TSF |
| 2% | chr10 | 74704869 | 74704617 | − | chr10 | 74702498 | 74702410 | − | ENST00000373032 | TSF |
| 2% | chr19 | 48387733 | 48387636 | − | chr19 | 48387042 | 48386834 | − | ENST00000222002 | TSF |
| 2% | chr12 | 21426370 | 21426215 | − | chr12 | 21422701 | 21422482 | − | ENST00000307378; ENST00000452078; ENST00000458504; ENST00000537524 | TSF |
| 2% | chr16 | 20553998 | 20553656 | − | chr16 | 20552095 | 20551976 | − | ENST00000329697; ENST00000565322; ENST00000565232; ENST00000567001 | TSF |
| 2% | chr4 | 72625242 | 72624879 | − | chr4 | 72623888 | 72623759 | − | ENST00000273951; ENST00000504199; ENST00000513476; ENST00000509740 | TSF |
| 2% | chr4 | 72625242 | 72624879 | − | chr4 | 72623888 | 72623759 | − | ENST00000273951; ENST00000504199; ENST00000513476; ENST00000509740 | TSF |
| 2% | chr4 | 72625242 | 72624879 | − | chr4 | 72623888 | 72623759 | − | ENST00000273951; ENST00000504199; ENST00000513476; ENST00000509740 | TSF |
| 2% | chr19 | 14129234 | 14129243 | + | chr19 | 14141522 | 14141760; 14141549 | + | ENST00000431365; ENST00000585987 | TSF |
| 2% | chr19 | 14129234 | 14129243 | + | chr19 | 14141522 | 14141760; 14141549 | + | ENST00000431365; ENST00000585987 | TSF |
| 2% | chr1 | 182374948 | 182375081 | + | chr1 | 182423093 | 182423175 | + | ENST00000542961; ENST00000294854; ENST00000443996; ENST00000416676; ENST00000422241 | TSF |
| 2% | chr1 | 182374948 | 182375081 | + | chr1 | 182423093 | 182423175 | + | ENST00000542961; ENST00000294854; ENST00000443996; ENST00000416676; ENST00000422241 | TSF |
| 2% | chr1 | 182374948 | 182375081 | + | chr1 | 182423093 | 182423175 | + | ENST00000542961; ENST00000294854; ENST00000443996; ENST00000416676; ENST00000422241 | TSF |
| 2% | chr1 | 182374948 | 182375081 | + | chr1 | 182423093 | 182423175 | + | ENST00000542961; ENST00000294854; ENST00000443996; ENST00000416676; | TSF |

TABLE 36-continued

Transcript fusion for Liver Hepatocellular Carcinoma (LIHC) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 2% | chr1 | 226013104 | 226013146 | + | chr1 | 226019533 | 226019660 | + | ENST00000422241 ENST00000445856; ENST00000272167; ENST00000448202; ENST00000366837 | TSF |
| 2% | chr1 | 226013104 | 226013146 | + | chr1 | 226019533 | 226019660 | + | ENST00000445856; ENST00000272167; ENST00000448202; ENST00000366837 | TSF |
| 2% | chr1 | 226013104 | 226013146 | + | chr1 | 226019533 | 226019660 | + | ENST00000445856; ENST00000272167; ENST00000448202; ENST00000366837 | TSF |
| 2% | chr22 | 24967426 | 24967475 | + | chr22 | 24967884 | 24967945 | + | ENST00000215829; ENST00000404603 | TSF |
| 2% | chrX | 106007615 | 106007873 | + | chrX | 106016143 | 106016390 | + | ENST00000418562; ENST00000324342; ENST00000255499 | TSF |
| 2% | chrX | 106007615 | 106007873 | + | chrX | 106016143 | 106016390 | + | ENST00000418562; ENST00000324342; ENST00000255499 | TSF |
| 2% | chr9 | 104030196 | 104030320 | + | chr9 | 104032162 | 104032350 | + | ENST00000374874; ENST00000456287; ENST00000395056 | TSF |
| 2% | chr9 | 104030196 | 104030320 | + | chr9 | 104032162 | 104032350 | + | ENST00000374874; ENST00000456287; ENST00000395056 | TSF |
| 2% | chr9 | 33033420 | 33033436 | + | chr9 | 33034214 | 33034328 | + | ENST00000330899; ENST00000544625 | TSF |
| 2% | chr16 | 72106207 | 72106386 | + | chr16 | 72107791 | 72107876 | + | ENST00000356967; ENST00000540303; ENST00000561690; ENST00000228226 | TSF |
| 2% | chr16 | 72106207 | 72106386 | + | chr16 | 72107791 | 72107876 | + | ENST00000356967; ENST00000540303; ENST00000561690; ENST00000228226 | TSF |
| 2% | chr2 | 234967204 | 234967342 | + | chr2 | 234967480 | 234967602 | + | ENST00000373368; ENST00000168148 | TSF |
| 2% | chr19 | 35548506 | 35548655 | + | chr19 | 35556802 | 35556936 | + | ENST00000262626; ENST00000392226; ENST00000597419 | TSF |
| 2% | chr1 | 226013104 | 226013146 | + | chr1 | 226016587 | 226016613 | + | ENST00000445856; ENST00000272167; ENST00000448202; ENST00000366837 | TSF |
| 2% | chr1 | 226013104 | 226013146 | + | chr1 | 226016587 | 226016613 | + | ENST00000445856; ENST00000272167; ENST00000448202; ENST00000366837 | TSF |
| 2% | chr1 | 226013104 | 226013146 | + | chr1 | 226016587 | 226016613 | + | ENST00000445856; ENST00000272167; ENST00000448202; ENST00000366837 | TSF |
| 2% | chr19 | 6692279 | 6692148 | − | chr19 | 6690738 | 6690640 | − | ENST00000245907 | TSF |
| 2% | chr3 | 49725746 | 49725728 | − | chr3 | 49725330 | 49725183 | − | ENST00000449682; ENST00000545762 | TSF |
| 2% | chr3 | 49725746 | 49725728 | − | chr3 | 49725330 | 49725183 | − | ENST00000449682; ENST00000545762 | TSF |
| 2% | chr5 | 34010561 | 34010259 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TSF |
| 2% | chr5 | 34010561 | 34010259 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TSF |
| 2% | chr5 | 34010561 | 34010259 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TSF |
| 2% | chr5 | 34010561 | 34010259 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TSF |
| 2% | chr5 | 34010561 | 34010259 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TSF |
| 2% | chr5 | 34010561 | 34010259 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TSF |
| 2% | chr5 | 34010561 | 34010259 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TSF |
| 2% | chr5 | 34010561 | 34010259 | − | chr5 | 34006004 | 34005861 | − | ENST00000335606; ENST00000382072; ENST00000382079; ENST00000506639; | TSF |

TABLE 36-continued

Transcript fusion for Liver Hepatocellular Carcinoma (LIHC) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| | | | | | | | | ENST00000382085; ENST00000502637; ENST00000441713; ENST00000426255; ENST00000512079; ENST00000382068 | |
| 2% | chr9 | 85967664 | 85967460 | − | chr9 | 85964672 | 85964594 | − | ENST00000376438; ENST00000304195 | TSF |
| 2% | chr9 | 85967664 | 85967460 | | chr9 | 85964672 | 85964594 | | ENST00000376438; ENST00000304195 | TSF |
| 2% | chr10 | 7735189 | 7733712 | − | chr10 | 7697638 | 7697594 | − | ENST00000256861; ENST00000397146; ENST00000397145 | TSF |
| 2% | chr10 | 7735189 | 7733712 | | chr10 | 7697638 | 7697594 | | ENST00000256861; ENST00000397146; ENST00000397145 | TSF |
| 2% | chr10 | 7735189 | 7733712 | | chr10 | l7697638 | 7697594 | | ENST00000256861; ENST00000397146; ENST00000397145 | TSF |
| 2% | chr2 | 77256752 | 77256391 | − | chr2 | 76976042 | 76975821 | − | ENST00000409911; ENST00000409884; ENST00000409093 | TSF |
| 2% | chr3 | 186352354 | 186352397 | + | chr3 | 186362540 | 186362709; 186362563 | + | ENST00000450521; ENST00000382134; ENST00000265029; ENST00000435961; ENST00000382136 | TSF |
| 2% | chr3 | 186352354 | 186352397 | + | chr3 | 186362540 | 186362709; 186362563 | + | ENST00000450521; ENST00000382134; ENST00000265029; ENST00000435961; ENST00000382136 | TSF |
| 2% | chr1 | 41465686 | 41465756 | + | chr1 | 41466701 | 41466789 | + | ENST00000372621; ENST00000541520; ENST00000372616 | TSF |
| 2% | chr12 | 133264718 | 133264790 | + | chr12 | 133266849 | 133266962 | + | ENST00000317479; ENST00000543589 | TSF |
| 2% | chr12 | 133264718 | 133264790 | + | chr12 | 133266849 | 133266962 | + | ENST00000317479; ENST00000543589 | TSF |
| 2% | chr10 | 18179688 | 18180042 | + | chr10 | 18183139 | 18183241 | + | ENST00000239761 | TSF |
| 2% | chr12 | 133264718 | 133264751 | + | chr12 | 133266849 | 133266962 | + | ENST00000317479; ENST00000543589 | TSF |
| 2% | chr12 | 133264718 | 133264751 | + | chr12 | 133266849 | 133266962 | + | ENST00000317479; ENST00000543589 | TSF |
| 2% | chr1 | 64652641 | 64652652 | + | chr1 | 64671322 | 64671403 | + | ENST00000371077; ENST00000371076 | TSF |
| 2% | chr1 | 64652641 | 64652652 | + | chr1 | 64671322 | 64671403 | + | ENST00000371077; ENST00000371076 | TSF |
| 2% | chr22 | 37423933 | 37423947 | + | chr22 | 37425305 | 37425555 | + | ENST00000401419; ENST00000397129; ENST00000404802; ENST00000341116; ENST00000429360; ENST00000397225 | TSF |
| 2% | chr20 | 410407 | 410425 | + | chr20 | 410994 | 411074 | + | ENST00000356286; ENST00000353660; ENST00000382181 | TSF |
| 2% | chr12 | 133264718 | 133264868 | + | chr12 | 133266849 | 133266962 | + | ENST00000317479; ENST00000543589 | TSF |
| 2% | chr12 | 133264718 | 133264868 | + | chr12 | 133266849 | 133266962 | + | ENST00000317479; ENST00000543589 | TSF |
| 2% | chr1 | 226013104 | 226013120 | + | chr1 | 226030115 | 226030175 | + | ENST00000272167; ENST00000366837 | TSF |
| 2% | chr10 | 17932769 | 17933123 | + | chr10 | 17936221 | 17936323 | + | ENST00000331429 | TSF |
| 2% | chr9 | 124090761 | 124090761 | + | chr9 | 124091169 | 124091293 | + | ENST00000373823; ENST00000341272; ENST00000373808; ENST00000394353; ENST00000412819; ENST00000436847; ENST00000449733; ENST00000545652; ENST00000373818; ENST00000373807; ENST00000373806 | TSF |
| 2% | chr9 | 124090761 | 124090761 | + | chr9 | 124091169 | 124091293 | + | ENST00000373823; ENST00000341272; ENST00000373808; ENST00000394353; ENST00000412819; ENST00000436847; ENST00000449733; ENST00000545652; ENST00000373818; ENST00000373807; ENST00000373806 | TSF |
| 2% | chr1 | 226013104 | 226013120 | + | chr1 | 226016587 | 226016613 | + | ENST00000445856; ENST00000272167; ENST00000448202; ENST00000366837 | TSF |
| 2% | chr1 | 226013104 | 226013120 | + | chr1 | 226016587 | 226016613 | + | ENST00000445856; ENST00000272167; ENST00000448202; ENST00000366837 | TSF |
| 2% | chr1 | 226013104 | 226013120 | + | chr1 | 226016587 | 226016613 | + | ENST00000445856; ENST00000272167; ENST00000448202; ENST00000366837 | TSF |
| 2% | chr9 | 130866734 | 130866740 | + | chr9 | 130868008 | 130868160 | + | ENST00000373068; ENST00000373069; ENST00000373066; ENST00000432073; ENST00000373064; ENST00000433501 | TSF |
| 2% | chr1 | 27271260 | 27271351 | + | chr1 | 27271881 | 27271964 | + | ENST00000321265 | TSF |
| 2% | chr1 | 111960622 | 111960373 | − | chr1 | 111959080 | 111958945; 111959068 | − | ENST00000369732; ENST00000540696 | TSF |
| 2% | chr1 | 111960622 | 111960373 | − | chr1 | 111959080 | 111958945; 111959068 | − | ENST00000369732; ENST00000540696 | TSF |
| 2% | chr1 | 204110253 | 204110153 | − | chr1 | 204109246 | 204109163 | − | ENST00000367201; ENST00000367202; ENST00000367199; ENST00000367198; ENST00000422072; ENST00000422699; ENST00000452983; ENST00000444817 | TSF |
| 2% | chr1 | 204110253 | 204110153 | − | chr1 | 204109246 | 204109163 | − | ENST00000367201; ENST00000367202; ENST00000367199; ENST00000367198; ENST00000422072; ENST00000422699; ENST00000452983; ENST00000444817 | TSF |
| 2% | chr1 | 204110253 | 204110153 | − | chr1 | 204109246 | 204109163 | − | ENST00000367201; ENST00000367202; ENST00000367199; ENST00000367198; ENST00000422072; ENST00000422699; ENST00000452983; ENST00000444817 | TSF |

TABLE 36-continued

Transcript fusion for Liver Hepatocellular Carcinoma (LIHC) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 2% | chr1 | 204110253 | 204110153 | – | chr1 | 204109246 | 204109163 | – | ENST00000367201; ENST00000367202; ENST00000367199; ENST00000367198; ENST00000422072; ENST00000422699; ENST00000452983; ENST00000444817 | TSF |
| 2% | chr1 | 204110253 | 204110153 | – | chr1 | 204109246 | 204109163 | – | ENST00000367201; ENST00000367202; ENST00000367199; ENST00000367198; ENST00000422072; ENST00000422699; ENST00000452983; ENST00000444817 | TSF |
| 2% | chrX | 123618682 | 123617816 | – | chrX | 123615814 | 123615582 | – | ENST00000371130; ENST00000422452 | TSF |
| 2% | chr12 | 117498589 | 117498567 | – | chr12 | 117494691 | 117494611 | – | ENST00000470612; ENST00000335209; ENST00000392545; ENST00000462502 | TSF |
| 2% | chr12 | 117498589 | 117498567 | – | chr12 | 117494691 | 117494611 | – | ENST00000470612; ENST00000335209; ENST00000392545; ENST00000462502 | TSF |
| 2% | chr12 | 117498589 | 117498567 | – | chr12 | 117494691 | 117494611 | – | ENST00000470612; ENST00000335209; ENST00000392545; ENST00000462502 | TSF |
| 2% | chr4 | 39516601 | 39516501 | – | chr4 | 39515804 | 39515703; 39515713 | – | ENST00000316423; ENST00000501493; ENST00000506179; ENST00000515021; ENST00000514106; ENST00000509391; ENST00000505698 | TSF |
| 2% | chr4 | 39516601 | 39516501 | – | chr4 | 39515804 | 39515703; 39515713 | – | ENST00000316423; ENST00000501493; ENST00000506179; ENST00000515021; ENST00000514106; ENST00000509391; ENST00000505698 | TSF |
| 2% | chr4 | 39516601 | 39516501 | – | chr4 | 39515804 | 39515703; 39515713 | – | ENST00000316423; ENST00000501493; ENST00000506179; ENST00000515021; ENST00000514106; ENST00000509391; ENST00000505698 | TSF |
| 2% | chr4 | 39516601 | 39516501 | – | chr4 | 39515804 | 39515703; 39515713 | – | ENST00000316423; ENST00000501493; ENST00000506179; ENST00000515021; ENST00000514106; ENST00000509391; ENST00000505698 | TSF |
| 2% | chr4 | 39516601 | 39516501 | – | chr4 | 39515804 | 39515703; 39515713 | – | ENST00000316423; ENST00000501493; ENST00000506179; ENST00000515021; ENST00000514106; ENST00000509391; ENST00000505698 | TSF |
| 2% | chr4 | 39516601 | 39516501 | – | chr4 | 39515804 | 39515703; 39515713 | – | ENST00000316423; ENST00000501493; ENST00000506179; ENST00000515021; ENST00000514106; ENST00000509391; ENST00000505698 | TSF |
| 2% | chr8 | 3040579 | 3040513 | – | chr8 | 3038736 | 3038632 | – | ENST00000335551; ENST00000400186; ENST00000602723; ENST00000520002; ENST00000602557; ENST00000537824; ENST00000542608; ENST00000539096 | TSF |
| 2% | chr8 | 3040579 | 3040513 | – | chr8 | 3038736 | 3038632 | – | ENST00000335551; ENST00000400186; ENST00000602723; ENST00000520002; ENST00000602557; ENST00000537824; ENST00000542608; ENST00000539096 | TSF |
| 2% | chr8 | 3040579 | 3040513 | – | chr8 | 3038736 | 3038632 | – | ENST00000335551; ENST00000400186; ENST00000602723; ENST00000520002; ENST00000602557; ENST00000537824; ENST00000542608; ENST00000539096 | TSF |
| 2% | chr8 | 3040579 | 3040513 | – | chr8 | 3038736 | 3038632 | – | ENST00000335551; ENST00000400186; ENST00000602723; ENST00000520002; ENST00000602557; ENST00000537824; ENST00000542608; ENST00000539096 | TSF |
| 2% | chr7 | 27581923 | 27581188 | – | chr7 | 27578036 | 27577960 | – | ENST00000265395; ENST00000425715 | TSF |
| 2% | chr7 | 27581923 | 27581188 | – | chr7 | 27578036 | 27577960 | – | ENST00000265395; ENST00000425715 | TSF |
| 2% | chr5 | 34007349 | 34007048 | – | chr5 | 34006004 | 34005861 | – | ENST00000335606; ENST00000382072; ENST00000382079; ENST00000506639; ENST00000382085; ENST00000502637; ENST00000441713; ENST00000426255; ENST00000512079; ENST00000382068 | TSF |
| 2% | chr5 | 34007349 | 34007048 | – | chr5 | chr5 | 34005861 | – | ENST00000335606; ENST00000382072; ENST00000382079; ENST00000506639; ENST00000382085; ENST00000502637; ENST00000441713; ENST00000426255; ENST00000512079; ENST00000382068 | TSF |
| 2% | chr5 | 34007349 | 34007048 | – | chr5 | chr5 | 34005861 | – | ENST00000335606; ENST00000382072; ENST00000382079; ENST00000506639; ENST00000382085; ENST00000502637; ENST00000441713; ENST00000426255; ENST00000512079; ENST00000382068 | TSF |
| 2% | chr5 | 34007349 | 34007048 | – | chr5 | chr5 | 34005861 | – | ENST00000335606; ENST00000382072; ENST00000382079; ENST00000506639; ENST00000382085; ENST00000502637; | TSF |

TABLE 36-continued

Transcript fusion for Liver Hepatocellular Carcinoma (LIHC) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 2% | chr5 | 34007349 | 34007048 | − | chr5 | chr5 | 34005861 | − | ENST00000441713; ENST00000426255; ENST00000512079; ENST00000382068 ENST00000335606; ENST00000382072; ENST00000382079; ENST00000506639; ENST00000382085; ENST00000502637; | TSF |
| 2% | chr5 | 34007349 | 34007048 | − | chr5 | chr5 | 34005861 | − | ENST00000441713; ENST00000426255; ENST00000512079; ENST00000382068 ENST00000335606; ENST00000382072; ENST00000382079; ENST00000506639; ENST00000382085; ENST00000502637; | TSF |
| 2% | chr5 | 34007349 | 34007048 | − | chr5 | chr5 | 34005861 | − | ENST00000441713; ENST00000426255; ENST00000512079; ENST00000382068 ENST00000335606; ENST00000382072; ENST00000382079; ENST00000506639; ENST00000382085; ENST00000502637; | TSF |
| 2% | chr5 | 34007349 | 34007048 | − | chr5 | chr5 | 34005861 | − | ENST00000441713; ENST00000426255; ENST00000512079; ENST00000382068 ENST00000335606; ENST00000382072; ENST00000382079; ENST00000506639; ENST00000382085; ENST00000502637; | TSE |
| 2% | chr5 | 34007349 | 34007048 | − | chr5 | chr5 | 34005861 | − | ENST00000441713; ENST00000426255; ENST00000512079; ENST00000382068 ENST00000335606; ENST00000382072; ENST00000382079; ENST00000506639; ENST00000382085; ENST00000502637; | TSF |
| 2% | chr9 | 75517880 | 75517763 | − | chr9 | 75516196 | 75516124 | − | ENST00000297785 | TSF |
| 2% | chr4 | 100304888 | 100304649 | − | chr4 | 100268301 | 100268163 | − | ENST00000515683 | TSF |
| 2% | chr10 | 7735546 | 7735278 | − | chr10 | 7697638 | 7697594 | − | ENST00000256861; ENST00000397146; ENST00000397145 | TSF |
| 2% | chr10 | 7735546 | 7735278 | − | chr10 | 7697638 | 7697594 | − | ENST00000256861; ENST00000397146; ENST00000397145 | TSF |
| 2% | chr10 | 7735546 | 7735278 | − | chr10 | 7697638 | 7697594 | − | ENST00000256861; ENST00000397146; ENST00000397145 | TSF |
| 2% | chr9 | 123541039 | 123540941 | − | chr9 | 123540823 | 123540629 | − | ENST00000608872; ENST00000453291 | TSF |
| 2% | chr9 | 123541039 | 123540941 | − | chr9 | 123540823 | 123540629 | − | ENST00000608872; ENST00000453291 | TSF |
| 2% | chr12 | 122293286 | 122293243 | − | chr12 | 122292698 | 122292609 | − | ENST00000289004; ENST00000543163 | TSF |
| 2% | chr7 | 100850556 | 100850506 | − | chr7 | 100850185 | 100850060 | − | ENST00000454310; ENST00000223127 | TSF |
| 2% | chr4 | 39516601 | 39516533 | − | chr4 | 39515804 | 39515703; 39515713 | − | ENST00000316423; ENST00000501493; ENST00000506179; ENST00000515021; ENST00000514106; ENST00000509391; ENST00000505698 | TSF |
| 2% | chr4 | 39516601 | 39516533 | − | chr4 | 39515804 | 39515703; 39515713 | − | ENST00000316423; ENST00000501493; ENST00000506179; ENST00000515021; ENST00000514106; ENST00000509391; ENST00000505698 | TSF |
| 2% | chr4 | 39516601 | 39516533 | − | chr4 | 39515804 | 39515703; 39515713 | − | ENST00000316423; ENST00000501493; ENST00000506179; ENST00000515021; ENST00000514106; ENST00000509391; ENST00000505698 | TSF |
| 2% | chr4 | 39516601 | 39516533 | − | chr4 | 39515804 | 39515703; 39515713 | − | ENST00000316423; ENST00000501493; ENST00000506179; ENST00000515021; ENST00000514106; ENST00000509391; ENST00000505698 | TSF |
| 2% | chr4 | 39516601 | 39516533 | − | chr4 | 39515804 | 39515703; 39515713 | − | ENST00000316423; ENST00000501493; ENST00000506179; ENST00000515021; ENST00000514106; ENST00000509391; ENST00000505698 | TSF |
| 2% | chr4 | 39516601 | 39516533 | − | chr4 | 39515804 | 39515703; 39515713 | − | ENST00000316423; ENST00000501493; ENST00000506179; ENST00000515021; ENST00000514106; ENST00000509391; ENST00000505698 | TSF |
| 2% | chr19 | 9974212 | 9974055 | − | chr19 | 9971470 | 9971321 | − | ENST00000264833; ENST00000593091 | TSF |
| 2% | chr19 | 9974212 | 9974055 | − | chr19 | 9971470 | 9971321 | − | ENST00000264833; ENST00000593091 | TSF |

TABLE 37

Transcript fusion for Lung Adenocarcinoma (LUAD) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 17% | chr12 | 71509738 | 71509630 | − | ENST00000549357 | chr12 | 71504233 | 71503634 | − | TAF |
| 15% | chr3 | 49927493 | 49927357 | − | ENST00000296474; ENST00000344206 | chr3 | 49927248 | 49927201 | − | TAF |
| 15% | chr3 | 49927493 | 49927357 | − | ENST00000296474; ENST00000344206 | chr3 | 49927248 | 49927204 | − | TAF |
| 12% | chr5 | 82554349 | 82554496 | + | ENST00000282268; ENST00000338635; ENST00000396027; ENST00000511817 | chr5 | 82606608 | 82606935 | + | TAF |
| 12% | chrX | 117900807 | 117900939 | + | ENST00000371666 | chrX | 117938895 | 117939267 | + | TAF |
| 12% | chr19 | 1147419 | 1147308 | − | ENST00000361757; ENST00000587024; ENST00000590998; ENST00000590176; ENST00000587655 | chr19 | 1143923 | 1143814 | − | TAF |
| 11% | chr11 | 428199 | 428088 | − | ENST00000332826 | chr11 | 424187 | 423924 | − | TAF |
| 10% | chr6 | 117700322 | 117700222 | − | ENST00000368507; ENST00000368508 | chr6 | 117693892 | 117693601 | − | TAF |
| 10% | chr6 | 117700322 | 117700222 | − | ENST00000368507; ENST00000368508 | chr6 | 117693892 | 117693601 | − | TAF |
| 10% | chr3 | 98600498; 98600611 | 98600384 | − | ENST00000449482; ENST00000326840; ENST00000326857 | chr3 | 98586282 | 98584565 | − | TSF |
| 10% | chr3 | 98600498; 98600611 | 98600384 | − | ENST00000449482; ENST00000326840; ENST00000326857 | chr3 | 98586282 | 98584565 | − | TSF |
| 8% | chrX | 100170072 | 100169610 | − | ENST00000328526; ENST00000372956 | chrX | 100143801 | 100143669 | − | TSF |
| 8% | chrX | 100170072 | 100169610 | − | ENST00000328526; ENST00000372956 | chrX | 100143801 | 1001436 69 | − | TSF |
| 7% | chrX | 100178050 | 100177782 | − | ENST00000328526; ENST00000372956 | chrX | 100143801 | 100143669 | − | TSF |
| 7% | chrX | 100178050 | 100177782 | − | ENST00000328526; ENST00000372956 | chrX | 100143801 | 100143669 | − | TSF |
| 6% | chr1 | 225156461 | 225156576 | + | ENST00000430092; ENST00000400952; ENST00000366849; ENST00000439375 | chr1 | 225157336 | 225158402 | + | TSF |
| 6% | chr1 | 225156461 | 225156576 | + | ENST00000430092; ENST00000400952; ENST00000366849; ENST00000439375 | chr1 | 225157336 | 225158402 | + | TSF |
| 6% | chr8 | 63502273 | 63502353 | + | ENST00000523211; ENST00000328472 | chr8 | 63546747 | 63547118 | + | TSF |
| 4% | chr4 | 57319769 | 57319927 | + | ENST00000514888; ENST00000264221; ENST00000505164; ENST00000399688; ENST00000512576 | chr4 | 57321183 | 57321327 | + | TSF |
| 4% | chr4 | 57319769 | 57319927 | + | ENST00000514888; ENST00000264221; ENST00000505164; ENST00000399688; ENST00000512576 | chr4 | 57321183 | 57321327 | + | TSF |
| 4% | chr4 | 57319769 | 57319927 | + | ENST00000514888; ENST00000264221; ENST00000505164; ENST00000399688; ENST00000512576 | chr4 | 57321183 | 57321327 | + | TSF |
| 4% | chr12 | 113623819 | 113623826 | + | ENST00000552495 | chr12 | 113623998 | 113624117 | + | TSF |
| 4% | chr3 | 32280465 | 32280611 | + | ENST00000458535; ENST00000307526 | chr3 | 32324083 | 32324625 | + | TSF |
| 4% | chr4 | 56230241 | 56230438 | + | ENST00000264228 | chr4 | 56252510 | 56252750 | + | TSF |
| 4% | chr19 | 3869013; 3869015 | 3868963 | − | ENST00000586578; ENST00000262961; ENST00000438164; ENST00000587212; ENST00000439086 | chr19 | 3855694 | 3855445 | − | TSF |
| 4% | chr19 | 3869013; 3869015 | 3868963 | − | ENST00000586578; ENST00000262961; ENST00000438164; ENST00000587212; ENST00000439086 | chr19 | 3855694 | 3855445 | − | TSF |
| 3% | chr10 | 126205749 | 126205840 | + | ENST00000368842 | chr10 | 126251911 | 126252288 | + | TSF |
| 3% | chr1 | 241803556 | 241803184 | − | ENST00000366554; ENST00000331838 | chr1 | 241771682 | 241771633 | − | TSF |
| 3% | chr12 | 56742407 | 56742313 | − | ENST00000314128; ENST00000557235 | chr12 | 56740986 | 56740975 | − | TSF |
| 3% | chr12 | 56742407 | 56742313 | − | ENST00000314128; ENST00000557235 | chr12 | 56740986 | 56740975 | − | TSF |
| 3% | chr1 | 234546277 | 234546191 | − | ENST00000040877 | chr1 | 234545319 | 234545287 | − | TSF |
| 3% | chr7 | 81964567 | 81964451 | − | ENST00000356860; ENST00000356253; ENST00000423588 | chr7 | 81929467 | 81929190 | − | TSF |
| 3% | chr2 | 89160434 | 89160398 | − | ENST00000390239 | chr2 | 89129384 | 89129304 | − | TSF |
| 3% | chr11 | 20981978 | 20982106 | + | ENST00000298925; ENST00000357134; ENST00000325319; ENST00000532434 | chr11 | 21041136 | 21041271 | + | TSF |
| 3% | chr11 | 20981978 | 20982106 | + | ENST00000298925; ENST00000357134; ENST00000325319; ENST00000532434 | chr11 | 21041136 | 21041271 | + | TSF |
| 3% | chr11 | 20981978 | 20982106 | + | ENST00000298925; ENST00000357134; ENST00000325319; ENST00000532434 | chr11 | 21041136 | 21041271 | + | TSF |
| 3% | chr5 | 54993786 | 54993674 | − | ENST00000396865; ENST00000539768; ENST00000318672; ENST00000508124; ENST00000511233; ENST00000503891; ENST00000513993; ENST00000505563; ENST00000506624; ENST00000507109 | chr5 | 54993040 | 54992544 | − | TSF |
| 3% | chrX | 119708472 | 119708406 | − | ENST00000404115 | chrX | 119705855 | 119705820 | − | TSF |
| 3% | chr2 | 135223796 | 135223685 | − | ENST00000281924 | chr2 | 135216236 | 135216223 | − | TSF |
| 2% | chr5 | 23976106 | 23976159 | + | ENST00000512559; ENST00000507936 | chr5 | 24177946 | 24178380 | + | TSF |
| 2% | chr9 | 125054028 | 125054119 | + | ENST00000297908; ENST00000344641; ENST00000373723; ENST00000373729; ENST00000394315 | chr9 | 125068067 | 125068171 | + | TSF |
| 2% | chr9 | 125054028 | 125054119 | + | ENST00000297908; ENST00000344641; ENST00000373723; ENST00000373729; ENST00000394315 | chr9 | 125068067 | 125068171 | + | TSF |
| 2% | chr9 | 125054028 | 125054119 | + | ENST00000297908; ENST00000344641; ENST00000373723; ENST00000373729; ENST00000394315 | chr9 | 125068067 | 125068171 | + | TSF |
| 2% | chrX | 117900807 | 117900939 | + | ENST00000371666 | chrX | 117902549 | 117902902 | + | TSF |
| 2% | chr13 | 53307473; 53307354 | | − | ENST00000431550; ENST00000448904; | chr13 | 53304269 | 53303967 | − | TSF |

TABLE 37-continued

Transcript fusion for Lung Adenocarcinoma (LUAD) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 2% | chr13 | 53307473; 53307494 | 53307354 | – | ENST00000377962 ENST00000431550; ENST00000448904; ENST00000377962 | chr13 | 53304269 | 53303967 | – | TSF |
| 2% | chr3 | 138289340 | 138289160 | – | ENST00000264982; ENST00000542237; ENST00000484888; ENST00000474781; ENST00000481834; ENST00000468900; ENST00000462419; ENST00000464035 | chr3 | 138261631 | 138260784 | – | TSF |
| 2% | chr3 | 138289340 | 138289160 | – | ENST00000264982; ENST00000542237; ENST00000484888; ENST00000474781; ENST00000481834; ENST00000468900; ENST00000462419; ENST00000464035 | chr3 | 138261631 | 138260784 | – | TSF |
| 2% | chr3 | 138289340 | 138289160 | – | ENST00000264982; ENST00000542237; ENST00000484888; ENST00000474781; ENST00000481834; ENST00000468900; ENST00000462419; ENST00000464035 | chr3 | 138261631 | 138260784 | – | TSF |
| 2% | chr3 | 138289340 | 138289160 | – | ENST00000264982; ENST00000542237; ENST00000484888; ENST00000474781; ENST00000481834; ENST00000468900; ENST00000462419; ENST00000464035 | chr3 | 138261631 | 138260784 | – | TSF |
| 2% | chr1 | 1255909 | 1255836 | – | ENST00000435064; ENST00000540437; ENST00000450926; ENST00000545578; ENST00000528879; ENST00000434694; ENST00000526797; ENST00000527719; ENST00000530031; ENST00000534345; ENST00000498476 | chr1 | 1255085 | 1254988 | – | TSF |
| 2% | chr1 | 1255909 | 1255836 | – | ENST00000435064; ENST00000540437; ENST00000450926; ENST00000545578; ENST00000528879; ENST00000434694; ENST00000526797; ENST00000527719; ENST00000530031; ENST00000534345; ENST00000498476 | chr1 | 1255085 | 1254988 | – | TSF |
| 2% | chr1 | 1255909 | 1255836 | – | ENST00000435064; ENST00000540437; ENST00000450926; ENST00000545578; ENST00000528879; ENST00000434694; ENST00000526797; ENST00000527719; ENST00000530031; ENST00000534345; ENST00000498476 | chr1 | 1255085 | 1254988 | – | TSF |
| 2% | chr1 | 1255909 | 1255836 | – | ENST00000435064; ENST00000540437; ENST00000450926; ENST00000545578; ENST00000528879; ENST00000434694; ENST00000526797; ENST00000527719; ENST00000530031; ENST00000534345; ENST00000498476 | chr1 | 1255085 | 1254988 | – | TSF |
| 2% | chr1 | 1255909 | 1255836 | – | ENST00000435064; ENST00000540437; ENST00000450926; ENST00000545578; ENST00000528879; ENST00000434694; ENST00000526797; ENST00000527719; ENST00000530031; ENST00000534345; ENST00000498476 | chr1 | 1255085 | 1254988 | – | TSF |
| 2% | chr1 | 1255909 | 1255836 | – | ENST00000435064; ENST00000540437; ENST00000450926; ENST00000545578; ENST00000528879; ENST00000434694; ENST00000526797; ENST00000527719; ENST00000530031; ENST00000534345; ENST00000498476 | chr1 | 1255085 | 1254988 | – | TSF |
| 2% | chr2 | 135470889 | 135470770 | – | ENST00000281924 | chr2 | 135443800 | 135443742 | – | TSF |
| 2% | chr5 | 31493400 | 31493314 | – | ENST00000511367; ENST00000344624; ENST00000442743; ENST00000513349 | chr5 | 31489188 | 31488661 | – | TSF |
| 2% | chr5 | 31493400 | 31493314 | – | ENST00000511367; ENST00000344624; ENST00000442743; ENST00000513349 | chr5 | 31489188 | 31488661 | – | TSF |
| 2% | chr20 | 29632611 | 29632721 | + | ENST00000278882; ENST00000358464 | chr20 | 29652086 | 29652324 | + | TSF |
| 2% | chr14 | 66096210; 66096217 | 66096324 | + | ENST00000360689; ENST00000394586; ENST00000342677; ENST00000394585; ENST00000358307; ENST00000557164 | chr14 | 66099743 | 66101298 | + | TSF |
| 2% | chr14 | 66096210; 66096217 | 66096324 | + | ENST00000360689; ENST00000394586; ENST00000342677; ENST00000394585; ENST00000358307; ENST00000557164 | chr14 | 66099743 | 66101298 | + | TSF |
| 2% | chr14 | 66096210; 66096217 | 66096324 | + | ENST00000360689; ENST00000394586; ENST00000342677; ENST00000394585; ENST00000358307; ENST00000557164 | chr14 | 66099743 | 66101298 | + | TSF |
| 2% | chr2 | 89417128 | 89416936 | – | ENST00000490686 | chr2 | 89370042 | 89366766 | – | TSF |
| 2% | chr9 | 130678698 | 130678687 | – | ENST00000335791 | chr9 | 130678449 | 130678449 | – | TSF |
| 2% | chr1 | 180283857 | 180283827 | – | ENST00000367595 | chr1 | 180281457 | 180281103 | – | TSF |
| 2% | chr20 | 44333200 | 44333136 | – | ENST00000335769 | chr20 | 44322980 | 44322621 | – | TSF |
| 2% | chr7 | 55270210 | 55270401 | + | ENST00000455089 | chr7 | 55272949 | 55272949 | + | TSF |
| 2% | chr8 | 42924698; | 42924802 | + | ENST00000534420; ENST00000302279; | chr8 | 42925245 | 42925476 | + | TSF |

TABLE 37-continued

Transcript fusion for Lung Adenocarcinoma (LUAD) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 2% | chr8 | 42924698; 42924750 | 42924802 | + | ENST00000534420; ENST00000302279; ENST00000533998; ENST00000342116; ENST00000531266; ENST00000533336; ENST00000525699; ENST00000529687 | chr8 | 42925245 | 42925476 | + | TSF |
| 2% | chr8 | 42924698; 42924750 | 42924802 | + | ENST00000534420; ENST00000302279; ENST00000533998; ENST00000342116; ENST00000531266; ENST00000533336; ENST00000525699; ENST00000529687 | chr8 | 42925245 | 42925476 | + | TSF |
| 2% | chr8 | 42924698; 42924750 | 42924802 | + | ENST00000534420; ENST00000302279; ENST00000533998; ENST00000342116; ENST00000531266; ENST00000533336; ENST00000525699; ENST00000529687 | chr8 | 42925245 | 42925476 | + | TSF |
| 2% | chr8 | 42924698; 42924750 | 42924802 | + | ENST00000534420; ENST00000302279; ENST00000533998; ENST00000342116; ENST00000531266; ENST00000533336; ENST00000525699; ENST00000529687 | chr8 | 42925245 | 42925476 | + | TSF |
| 2% | chr8 | 42924698; 42924750 | 42924802 | + | ENST00000534420; ENST00000302279; ENST00000533998; ENST00000342116; ENST00000531266; ENST00000533336; ENST00000525699; ENST00000529687 | chr8 | 42925245 | 42925476 | + | TSF |
| 2% | chr2 | 89513203 | 89512947 | − | ENST00000498435 | chr2 | 89389297 | 89388194 | − | TSF |
| 2% | chr8 | 62546286 | 62546242 | − | ENST00000541428; ENST00000379454; ENST00000522919; ENST00000356457; ENST00000519234; ENST00000518068; ENST00000517903; ENST00000445642; ENST00000517847; ENST00000522835 | chr8 | 62544521 | 62544342 | − | TSF |
| 2% | chr8 | 62546286 | 62546242 | − | ENST00000541428; ENST00000379454; ENST00000522919; ENST00000356457; ENST00000519234; ENST00000518068; ENST00000517903; ENST00000445642; ENST00000517847; ENST00000522835 | chr8 | 62544521 | 62544342 | − | TSF |
| 2% | chr8 | 62546286 | 62546242 | − | ENST00000541428; ENST00000379454; ENST00000522919; ENST00000356457; ENST00000519234; ENST00000518068; ENST00000517903; ENST00000445642; ENST00000517847; ENST00000522835 | chr8 | 62544521 | 62544342 | − | TSF |
| 2% | chr8 | 62546286 | 62546242 | − | ENST00000541428; ENST00000379454; ENST00000522919; ENST00000356457; ENST00000519234; ENST00000518068; ENST00000517903; ENST00000445642; ENST00000517847; ENST00000522835 | chr8 | 62544521 | 62544342 | − | TSF |
| 2% | chr8 | 62546286 | 62546242 | − | ENST00000541428; ENST00000379454; ENST00000522919; ENST00000356457; ENST00000519234; ENST00000518068; ENST00000517903; ENST00000445642; ENST00000517847; ENST00000522835 | chr8 | 62544521 | 62544342 | − | TSF |
| 2% | chr8 | 62546286 | 62546242 | − | ENST00000541428; ENST00000379454; ENST00000522919; ENST00000356457; ENST00000519234; ENST00000518068; ENST00000517903; ENST00000445642; ENST00000517847; ENST00000522835 | chr8 | 62544521 | 62544342 | − | TSF |
| 2% | chr8 | 62546286 | 62546242 | − | ENST00000541428; ENST00000379454; ENST00000522919; ENST00000356457; ENST00000519234; ENST00000518068; ENST00000517903; ENST00000445642; ENST00000517847; ENST00000522835 | chr8 | 62544521 | 62544342 | − | TSF |
| 2% | chr8 | 62546286 | 62546242 | − | ENST00000541428; ENST00000379454; ENST00000522919; ENST00000356457; ENST00000519234; ENST00000518068; ENST00000517903; ENST00000445642; ENST00000517847; ENST00000522835 | chr8 | 62544521 | 62544342 | − | TSF |
| 2% | chr4 | 1102192 | 1102131 | − | ENST00000382968; ENST00000433731; ENST00000511620; ENST00000510715; ENST00000333673 | chr4 | 1101132 | 1100845 | − | TSF |
| 2% | chr6 | 24551753 | 24551662 | − | ENST00000430948; ENST00000535378; ENST00000378214; ENST00000543707 | chr6 | 24548828 | 24548413 | − | TSF |
| 2% | chr6 | 24551753 | 24551662 | − | ENST00000430948; ENST00000535378; ENST00000378214; ENST00000543707 | chr6 | 24548828 | 24548413 | − | TSF |
| 2% | chr6 | 24551753 | 24551662 | − | ENST00000430948; ENST00000535378; ENST00000378214; ENST00000543707 | chr6 | 24548828 | 24548413 | − | TSF |
| 2% | chr1 | 11115877; 11115983 | 11115838 | − | ENST00000490101; ENST00000376957 | chr1 | 11115464 | 11115178 | − | TSF |
| 2% | chr1 | 11115877; | 11115838 | − | ENST00000490101; ENST00000376957 | chr1 | 11115464 | 11115178 | − | TSF |

TABLE 37-continued

Transcript fusion for Lung Adenocarcinoma (LUAD) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 2% | chr2 | 11115983 176860292; 176860312 | 176860286 | − | ENST00000392540; ENST00000272748; ENST00000544803; ENST00000445472 | chr2 | 176859008 | 176858934 | − | TSF |
| 2% | chr2 | 176860292; 176860312 | 176860286 | − | ENST00000392540; ENST00000272748; ENST00000544803; ENST00000445472 | chr2 | 176859008 | 176858934 | − | TSF |
| 2% | chr19 | 55178145; 55178148 | 55178200 | + | ENST00000391733; ENST00000391736; ENST00000270452; ENST00000430952; ENST00000391734; ENST00000434286 | chr19 | 55178294 | 55178458 | + | TSF |
| 2% | chr19 | 55178145; 55178148 | 55178200 | + | ENST00000391733; ENST00000391736; ENST00000270452; ENST00000430952; ENST00000391734; ENST00000434286 | chr19 | 55178294 | 55178458 | + | TSF |
| 2% | chr19 | 55178145; 55178148 | 55178200 | + | ENST00000391733; ENST00000391736; ENST00000270452; ENST00000430952; ENST00000391734; ENST00000434286 | chr19 | 55178294 | 55178458 | + | TSF |
| 2% | chr3 | 137906397; 137906427 | 137906441 | + | ENST00000469044; ENST00000461600; ENST00000461822; ENST00000470821; ENST00000471709; ENST00000538260; ENST00000463485; ENST00000393058 | chr3 | 137907243 | 137907252 | + | TSF |
| 2% | chr3 | 137906397; 137906427 | 137906441 | + | ENST00000469044; ENST00000461600; ENST00000461822; ENST00000470821; ENST00000471709; ENST00000538260; ENST00000463485; ENST00000393058 | chr3 | 137907243 | 137907252 | + | TSF |
| 2% | chr1 | 63955889 | 63955754 | − | ENST00000371092; ENST00000271002; ENST00000489099; ENST00000283568 | chr1 | 63952444 | 63951983 | − | TSF |
| 2% | chr1 | 63955889 | 63955754 | − | ENST00000371092; ENST00000271002; ENST00000489099; ENST00000283568 | chr1 | 63952444 | 63951983 | − | TSF |
| 2% | chr16 | 2825557; 2825626 | 2825452 | − | ENST00000262306; ENST00000409906; ENST00000409477; ENST00000494946 | chr16 | 2823822 | 2823809 | − | TSF |
| 2% | chr16 | 2825557; 2825626 | 2825452 | − | ENST00000262306; ENST00000409906; ENST00000409477; ENST00000494946 | chr16 | 2823822 | 2823809 | − | TSF |
| 2% | chr16 | 2825557; 2825626 | 2825452 | − | ENST00000262306; ENST00000409906; ENST00000409477; ENST00000494946 | chr16 | 2823822 | 2823809 | − | TSF |
| 2% | chr7 | 16900207 | 16900124 | − | ENST00000402239; ENST00000310398; ENST00000414935 | chr7 | 16894536 | 16894260 | − | TSF |
| 2% | chr7 | 16900207 | 16900124 | − | ENST00000402239; ENST00000310398; ENST00000414935 | chr7 | 16894536 | 16894260 | − | TSF |
| 2% | chr17 | 79532633; 79532593 | 79532531 | − | ENST00000374747; ENST00000539314; ENST00000572760; ENST00000573876; ENST00000331134; ENST00000573519; ENST00000571714; ENST00000572824; ENST00000573212 | chr17 | 79527702 | 79527690 | − | TSF |
| 2% | chr17 | 79532633; 79532593 | 79532531 | − | ENST00000374747; ENST00000539314; ENST00000572760; ENST00000573876; ENST00000331134; ENST00000573519; ENST00000571714; ENST00000572824; ENST00000573212 | chr17 | 79527702 | 79527690 | − | TSF |
| 2% | chr17 | 79532633; 79532593 | 79532531 | − | ENST00000374747; ENST00000539314; ENST00000572760; ENST00000573876; ENST00000331134; ENST00000573519; ENST00000571714; ENST00000572824; ENST00000573212 | chr17 | 79527702 | 79527690 | − | TSF |
| 2% | chr17 | 79532633; 79532593 | 79532531 | − | ENST00000374747; ENST00000539314; ENST00000572760; ENST00000573876; ENST00000331134; ENST00000573519; ENST00000571714; ENST00000572824; ENST00000573212 | chr17 | 79527702 | 79527690 | − | TSF |
| 2% | chr17 | 79532633; 79532593 | 79532531 | − | ENST00000374747; ENST00000539314; ENST00000572760; ENST00000573876; ENST00000331134; ENST00000573519; ENST00000571714; ENST00000572824; ENST00000573212 | chr17 | 79527702 | 79527690 | − | TSF |
| 2% | chr17 | 79532633; 79532593 | 79532531 | − | ENST00000374747; ENST00000539314; ENST00000572760; ENST00000573876; ENST00000331134; ENST00000573519; ENST00000571714; ENST00000572824; ENST00000573212 | chr17 | 79527702 | 79527690 | − | TSF |
| 2% | chr17 | 79532633; 79532593 | 79532531 | − | ENST00000374747; ENST00000539314; ENST00000572760; ENST00000573876; ENST00000331134; ENST00000573519; ENST00000571714; ENST00000572824; ENST00000573212 | chr17 | 79527702 | 79527690 | − | TSF |
| 2% | chr3 | 48716169 | 48715997 | − | ENST00000413374; ENST00000341520; ENST00000416649; ENST00000294129 | chr3 | 48702393 | 48702198 | − | TSF |
| 2% | chr3 | 48716169 | 48715997 | − | ENST00000413374; ENST00000341520; ENST00000416649; ENST00000294129 | chr3 | 48702393 | 48702198 | − | TSF |
| 2% | chr3 | 48716169 | 48715997 | − | ENST00000413374; ENST00000341520; ENST00000416649; ENST00000294129 | chr3 | 48702393 | 48702198 | − | TSF |

TABLE 37-continued

Transcript fusion for Lung Adenocarcinoma (LUAD) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 2% | chr12 | 93873164 | 93873248 | + | ENST00000416649; ENST00000294129 ENST00000549982; ENST00000361630; ENST00000552217; ENST00000393128; ENST00000547098; ENST00000549561; ENST00000548545 | chr12 | 93876129 | 93876286 | + | TSF |
| 2% | chr12 | 93873164 | 93873248 | + | ENST00000549982; ENST00000361630; ENST00000552217; ENST00000393128; ENST00000547098; ENST00000549561; ENST00000548545 | chr12 | 93876129 | 93876286 | + | TSF |
| 2% | chr2 | 143743517 | 143743590 | + | ENST00000264170; ENST00000375773; ENST00000409512 | chr2 | 143745513 | 143745682 | + | TSF |
| 2% | chr1 | 53558459 | 53558226 | − | ENST00000371494 | chr1 | 53556655 | 53556632 | − | TSF |
| 1% | chr5 | 1802435 | 1802488 | + | ENST00000274137; ENST00000469176 | chr5 | 1811112 | 1811428 | + | TSF |
| 1% | chr22 | 47071365 | 47071449 | + | ENST00000406902; ENST00000361034; ENST00000408031 | chr22 | 47078308 | 47078350 | + | TSF |
| 1% | chr22 | 47071365 | 47071449 | + | ENST00000406902; ENST00000361034; ENST00000408031 | chr22 | 47078308 | 47078350 | + | TSF |
| 1% | chr16 | 16381600 | 16381719 | + | ENST00000399336; ENST00000263012; ENST00000538468 | chr16 | 16382422 | 16382605 | + | TSF |
| 1% | chr16 | 16381600 | 16381719 | + | ENST00000399336; ENST00000263012; ENST00000538468 | chr16 | 16382422 | 16382605 | + | TSF |
| 1% | chr18 | 56807181 | 56807267 | + | ENST00000587834; ENST00000299714; ENST00000588875 | chr18 | 56814218 | 56814267 | + | TSF |
| 1% | chr22 | 48885405 | 48885516 | + | ENST00000402357; ENST00000336769 | chr22 | 48915770 | 48916108 | + | TSF |
| 1% | chr10 | 75555297 | 75555421 | + | ENST00000604729; ENST00000603114; ENST00000604524; ENST00000398706; ENST00000605216; ENST00000433366; ENST00000492395; ENST00000603187; ENST00000412198; ENST00000604754 | chr10 | 75556079 | 75556138 | + | TSF |
| 1% | chr10 | 75555297 | 75555421 | + | ENST00000604729; ENST00000603114; ENST00000604524; ENST00000398706; ENST00000605216; ENST00000433366; ENST00000492395; ENST00000603187; ENST00000412198; ENST00000604754 | chr10 | 75556079 | 75556138 | + | TSF |
| 1% | chr10 | 75555297 | 75555421 | + | ENST00000604729; ENST00000603114; ENST00000604524; ENST00000398706; ENST00000605216; ENST00000433366; ENST00000492395; ENST00000603187; ENST00000412198; ENST00000604754 | chr10 | 75556079 | 75556138 | + | TSF |
| 1% | chr10 | 75555297 | 75555421 | + | ENST00000604729; ENST00000603114; ENST00000604524; ENST00000398706; ENST00000605216; ENST00000433366; ENST00000492395; ENST00000603187; ENST00000412198; ENST00000604754 | chr10 | 75556079 | 75556138 | + | TSF |
| 1% | chr10 | 75555297 | 75555421 | + | ENST00000604729; ENST00000603114; ENST00000604524; ENST00000398706; ENST00000605216; ENST00000433366; ENST00000492395; ENST00000603187; ENST00000412198; ENST00000604754 | chr10 | 75556079 | 75556138 | + | TSF |
| 1% | chr10 | 75555297 | 75555421 | + | ENST00000604729; ENST00000603114; ENST00000604524; ENST00000398706; ENST00000605216; ENST00000433366; ENST00000492395; ENST00000603187; ENST00000412198; ENST00000604754 | chr10 | 75556079 | 75556138 | + | TSF |
| 1% | chr10 | 75555297 | 75555421 | + | ENST00000604729; ENST00000603114; ENST00000604524; ENST00000398706; ENST00000605216; ENST00000433366; ENST00000492395; ENST00000603187; ENST00000412198; ENST00000604754 | chr10 | 75556079 | 75556138 | + | TSF |
| 1% | chr12 | 117537087; 117537246 | 117537030 | − | ENST00000470612; ENST00000335209; ENST00000541210; ENST00000462502; ENST00000392545 | chr12 | 117513606 | 117513469 | − | TSF |
| 1% | chr12 | 117537087; 117537246 | 117537030 | − | ENST00000470612; ENST00000335209; ENST00000541210; ENST00000462502; ENST00000392545 | chr12 | 117513606 | 117513469 | − | TSF |
| 1% | chr11 | 63365635 | 63365533 | − | ENST00000323646; ENST00000415826 | chr11 | 63360665 | 63360559 | − | TSF |
| 1% | chr16 | 14782128 | 14782022 | − | ENST00000438167; ENST00000567462 | chr16 | 14779702 | 14779542 | − | TSF |
| 1% | chr7 | 22532348 | 22532184 | − | ENST00000406890; ENST00000404369; ENST00000424363 | chr7 | 22512853 | 22512669 | − | TSF |
| 1% | chr7 | 22532348 | 22532184 | − | ENST00000406890; ENST00000404369; ENST00000424363 | chr7 | 22512853 | 22512669 | − | TSF |

TABLE 37-continued

Transcript fusion for Lung Adenocarcinoma (LUAD) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 1% | chr7 | 93516667; 93516743 | 93516573 | − | ENST00000451238; ENST00000222543 | chr7 | 93492029 | 93491711 | − | TSF |
| 1% | chr7 | 93516667; 93516743 | 93516573 | − | ENST00000451238; ENST00000222543 | chr7 | 93492029 | 93491711 | − | TSF |
| 1% | chr14 | 106235896 | 106235574 | − | ENST00000390551 | chr14 | 106216701 | 106216511 | − | TSF |
| 1% | chr7 | 22532348 | 22532184 | − | ENST00000406890; ENST00000404369; ENST00000424363 | chr7 | 22531483 | 2253137 0 | − | TSF |
| 1% | chr7 | 22532348 | 22532184 | − | ENST00000406890; ENST00000404369; ENST00000424363 | chr7 | 22531483 | 22531370 | − | TSF |
| 1% | chr8 | 17872093 | 17872349 | + | ENST00000325083; ENST00000519253; ENST00000327578; ENST00000522275 | chr8 | 17873210 | 17873221 | + | TSF |
| 1% | chr8 | 17872093 | 17872349 | + | ENST00000325083; ENST00000519253; ENST00000327578; ENST00000522275 | chr8 | 17873210 | 17873221 | + | TSF |
| 1% | chr8 | 17872093 | 17872349 | + | ENST00000325083; ENST00000519253; ENST00000327578; ENST00000522275 | chr8 | 17873210 | 17873221 | + | TSF |
| 1% | chr8 | 17872093 | 17872349 | + | ENST00000325083; ENST00000519253; ENST00000327578; ENST00000522275 | chr8 | 17873210 | 17873221 | + | TSF |
| 1% | chr2 | 192546672; 192546682 | 192546743 | + | ENST00000307849; ENST00000451500; ENST00000425611; ENST00000435931; ENST00000307834; ENST00000410026; ENST00000409510 | chr2 | 192548016 | 192548103 | + | TSF |
| 1% | chr2 | 192546672; 192546682 | 192546743 | + | ENST00000307849; ENST00000451500; ENST00000425611; ENST00000435931; ENST00000307834; ENST00000410026; ENST00000409510 | chr2 | 192548016 | 192548103 | + | TSF |
| 1% | chr2 | 192546672; 192546682 | 192546743 | + | ENST00000307849; ENST00000451500; ENST00000425611; ENST00000435931; ENST00000307834; ENST00000410026; ENST00000409510 | chr2 | 192548016 | 192548103 | + | TSF |
| 1% | chr11 | 67786242 | 67786362 | + | ENST00000539229; ENST00000316367; ENST00000007633; ENST00000342456 | chr11 | 67786535 | 67786588 | + | TSF |
| 1% | chr11 | 67786242 | 67786362 | + | ENST00000539229; ENST00000316367; ENST00000007633; ENST00000342456 | chr11 | 67786535 | 67786588 | + | TSF |
| 1% | chr12 | 102547647 | 102547754 | + | ENST00000327680; ENST00000378128; ENST00000541394; ENST00000358383; ENST00000392911; ENST00000412715; ENST00000417507; ENST00000457614 | chr12 | 102548605 | 102548938 | + | TSF |
| 1% | chr12 | 102547647 | 102547754 | + | ENST00000327680; ENST00000378128; ENST00000541394; ENST00000358383; ENST00000392911; ENST00000412715; ENST00000417507; ENST00000457614 | chr12 | 102548605 | 102548938 | + | TSF |
| 1% | chr12 | 102547647 | 102547754 | + | ENST00000327680; ENST00000378128; ENST00000541394; ENST00000358383; ENST00000392911; ENST00000412715; ENST00000417507; ENST00000457614 | chr12 | 102548605 | 102548938 | + | TSF |
| 1% | chr12 | 102547647 | 102547754 | + | ENST00000327680; ENST00000378128; ENST00000541394; ENST00000358383; ENST00000392911; ENST00000412715; ENST00000417507; ENST00000457614 | chr12 | 102548605 | 102548938 | + | TSF |
| 1% | chr12 | 102547647 | 102547754 | + | ENST00000327680; ENST00000378128; ENST00000541394; ENST00000358383; ENST00000392911; ENST00000412715; ENST00000417507; ENST00000457614 | chr12 | 102548605 | 102548938 | + | TSF |
| 1% | chr10 | 79796952 | 79797062 | + | ENST00000435275; ENST00000440692; ENST00000372360; ENST00000360830 | chr4 | 176584518 | 176584519 | + | TSF |
| 1% | chr20 | 37384500 | 37384682 | + | ENST0000243903 | chr20 | 37390296 | 37390409 | + | TSF |
| 1% | chr4 | 169086398 | 169086477 | + | ENST00000359299 | chr4 | 169090666 | 169090754 | + | TSF |
| 1% | chr22 | 23165476 | 23165642 | + | ENST00000390317 | chr22 | 23175722 | 23175755 | + | TSF |
| 1% | chr16 | 4401235; 4401294 | 4401233 | − | ENST00000577031; ENST00000318059; ENST00000571986; ENST00000576217; ENST00000571178 | chr16 | 4398819 | 4398660 | − | TSF |
| 1% | chr16 | 4401235; 4401294 | 4401233 | − | ENST00000577031; ENST00000318059; ENST00000571986; ENST00000576217; ENST00000571178 | chr16 | 4398819 | 4398660 | − | TSF |
| 1% | chr1 | 220240735 | 220240644 | − | ENST00000322067; ENST00000469520; ENST00000354807; ENST00000544404; ENST00000414869; ENST00000463953; ENST00000498791; ENST00000480959 | chr1 | 220237757 | 220237680 | − | TSF |
| 1% | chr1 | 220240735 | 220240644 | − | ENST00000322067; ENST00000469520; ENST00000354807; ENST00000544404; ENST00000414869; ENST00000463953; ENST00000498791; ENST00000480959 | chr1 | 220237757 | 220237680 | − | TSF |
| 1% | chr1 | 220240735 | 220240644 | − | ENST00000322067; ENST00000469520; ENST00000354807; ENST00000544404; ENST00000414869; ENST00000463953; ENST00000498791; ENST00000480959 | chr1 | 220237757 | 220237680 | − | TSF |

TABLE 37-continued

Transcript fusion for Lung Adenocarcinoma (LUAD) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 1% | chr14 | 106092403 | 106092109 | – | ENST00000390543 | chr14 | 105470421 | 105470286 | – | TSF |
| 1% | chr1 | 53569240 | 53569018 | – | ENST00000371494 | chr1 | 53568657 | 53568616 | – | TSF |
| 1% | chr9 | 5164265 | 5164179 | – | ENST00000381641 | chr9 | 4992433 | 4991945 | – | TSF |
| 1% | chr7 | 8198282 | 8198157 | – | ENST00000402384; ENST00000406470; ENST00000265577; ENST00000396675; ENST00000339809; ENST00000401396; ENST00000422063; ENST00000407906; ENST00000317367 | chr7 | 8197727 | 8197714 | – | TSF |
| 1% | chr7 | 8198282 | 8198157 | – | ENST00000402384; ENST00000406470; ENST00000265577; ENST00000396675; ENST00000339809; ENST00000401396; ENST00000422063; ENST00000407906; ENST00000317367 | chr7 | 8197727 | 8197714 | – | TSF |
| 1% | chr7 | 8198282 | 8198157 | – | ENST00000402384; ENST00000406470; ENST00000265577; ENST00000396675; ENST00000339809; ENST00000401396; ENST00000422063; ENST00000407906; ENST00000317367 | chr7 | 8197727 | 8197714 | – | TSF |
| 1% | chr8 | 62546286 | 62546242 | – | ENST00000541428; ENST00000379454; ENST00000522919; ENST00000356457; ENST00000519234; ENST00000518068; ENST00000517903; ENST00000445642; ENST00000517847; ENST00000522835 | chr8 | 62544404 | 62544342 | – | TSF |
| 1% | chr8 | 62546286 | 62546242 | – | ENST00000541428; ENST00000379454; ENST00000522919; ENST00000356457; ENST00000519234; ENST00000518068; ENST00000517903; ENST00000445642; ENST00000517847; ENST00000522835 | chr8 | 62544404 | 62544342 | – | TSF |
| 1% | chr8 | 62546286 | 62546242 | – | ENST00000541428; ENST00000379454; ENST00000522919; ENST00000356457; ENST00000519234; ENST00000518068; ENST00000517903; ENST00000445642; ENST00000517847; ENST00000522835 | chr8 | 62544401 | 62544342 | – | TSF |
| 1% | chr8 | 62546286 | 62546242 | – | ENST00000541428; ENST00000379454; ENST00000522919; ENST00000356457; ENST00000519234; ENST00000518068; ENST00000517903; ENST00000445642; ENST00000517847; ENST00000522835 | chr8 | 62544404 | 62544342 | – | TSF |
| 1% | chr8 | 62546286 | 62546242 | – | ENST00000541428; ENST00000379454; ENST00000522919; ENST00000356457; ENST00000519234; ENST00000518068; ENST00000517903; ENST00000445642; ENST00000517847; ENST00000522835 | chr8 | 62544404 | 62544342 | – | TSF |
| 1% | chr8 | 62546286 | 62546242 | – | ENST00000541428; ENST00000379454; ENST00000522919; ENST00000356457; ENST00000519234; ENST00000518068; ENST00000517903; ENST00000445642; ENST00000517847; ENST00000522835 | chr8 | 62544404 | 62544342 | – | TSF |
| 1% | chr8 | 62546286 | 62546242 | – | ENST00000541428; ENST00000379454; ENST00000522919; ENST00000356457; ENST00000519234; ENST00000518068; ENST00000517903; ENST00000445642; ENST00000517847; ENST00000522835 | chr8 | 62544404 | 62544342 | – | TSF |
| 1% | chr19 | 18710656 | 18710375 | – | ENST00000392386 | chr19 | 18709961 | 18709918 | – | TSF |
| 1% | chrX | 41598709 | 41598637 | – | ENST00000421587; ENST00000318588; ENST00000361962; ENST00000378163; ENST00000378158; ENST00000378166; ENST00000442742; ENST00000378154 | chrX | 41557348 | 41557057 | – | TSF |
| 1% | chr10 | 5037676 | 5037511 | – | ENST00000380753; ENST00000421196; ENST00000407674 | chr10 | 5023140 | 5022655 | – | TSF |
| 1% | chr10 | 5037676 | 5037511 | – | ENST00000380753; ENST00000421196; ENST00000407674 | chr10 | 5023140 | 5022655 | – | TSF |
| 1% | chr4 | 25759228 | 25759156 | – | ENST00000399878; ENST00000264868; ENST00000502949; ENST00000510448 | chr4 | 25723603 | 25723555 | – | TSF |
| 1% | chr4 | 25759228 | 25759156 | – | ENST00000399878; ENST00000264868; ENST00000502949; ENST00000510448 | chr4 | 25723603 | 25723555 | – | TSF |
| 1% | chr4 | 25759228 | 25759156 | – | ENST00000399878; ENST00000264868; ENST00000502949; ENST00000510448 | chr4 | 25723603 | 25723555 | – | TSF |
| 1% | chr4 | 25759228 | 25759156 | – | ENST00000399878; ENST00000264868; ENST00000502949; ENST00000510448 | chr4 | 25723603 | 25723555 | – | TSF |

TABLE 38

Transcript fusion for Lung Adenocarcinoma (LUAD) Coordinates of the fusion sequences for which the donor is the TE.

| 1 | 2' | 3' | 4' | 5' | 6' | 7' | 8' | 9' | 10 | 11' |
|---|---|---|---|---|---|---|---|---|---|---|
| 42% | chr8 | 104389530 | 104389551 | + | chr8 | 104390255 | 104390471 | + | ENST00000330295; ENST00000520337 | TAF |
| 36% | chr12 | 122430912 | 122431615 | + | chr12 | 122437622 | 122437850 | + | ENST00000288912 | TAF |
| 36% | chr17 | 80440912 | 80441180 | + | chr17 | 80441592 | 80441655; 80441659 | + | ENST00000390006; ENST00000309794; ENST00000345415; ENST00000457415; ENST00000577432; ENST00000584513; ENST00000412079 | TAF |
| 36% | chr17 | 80440912 | 80441180 | + | chr17 | 80441592 | 80441655; 80441659 | + | ENST00000390006; ENST00000309794; ENST00000345415; ENST00000457415; ENST00000577432; ENST00000584513; ENST00000412079 | TAF |
| 36% | chr17 | 80440912 | 80441180 | + | chr17 | 80441592 | 80441655; 80441659 | + | ENST00000390006; ENST00000309794; ENST00000345415; ENST00000457415; ENST00000577432; ENST00000584513; ENST00000412079 | TAF |
| 36% | chr17 | 80440912 | 80441180 | + | chr17 | 80441592 | 80441655; 80441659 | + | ENST00000390006; ENST00000309794; ENST00000345415; ENST00000457415; ENST00000577432; ENST00000584513; ENST00000412079 | TAF |
| 32% | chr20 | 44420870 | 44421070 | + | chr20 | 44421316 | 44421386 | + | ENST00000372622; ENST00000449078; ENST00000456939 | TAF |
| 32% | chr20 | 44420870 | 44421070 | + | chr20 | 44421316 | 44421386 | + | ENST00000372622; ENST00000449078; ENST00000456939 | TAF |
| 32% | chr20 | 44420870 | 44421070 | + | chr20 | 44421316 | 44421386 | + | ENST00000372622; ENST00000449078; ENST00000456939 | TAF |
| 32% | chr6 | 80022917 | 80022085 | − | chr6 | 79924739 | 79924689 | − | ENST00000275036; ENST00000344726 | TSF |
| 32% | chr6 | 80022917 | 80022085 | − | chr6 | 79924739 | 79924689 | − | ENST00000275036; ENST00000344726 | TSF |
| 24% | chr7 | 116364854 | 116364901 | + | chr7 | 116371722 | 116371913 | + | ENST00000397752; ENST00000318493; ENST00000436117 | TAF |
| 24% | chr7 | 116364854 | 116364901 | + | chr7 | 116371722 | 116371913 | + | ENST00000397752; ENST00000318493; ENST00000436117 | TAF |
| 24% | chr7 | 116364854 | 116364901 | + | chr7 | 116371722 | 116371913 | + | ENST00000397752; ENST00000318493; ENST00000436117 | TAF |
| 23% | chr17 | 70713894 | 70713885 | − | chr17 | 70645407 | 70645309 | − | ENST00000255559; ENST00000542342; ENST00000582769 | TSF |
| 23% | chr17 | 70713894 | 70713885 | − | chr17 | 70645407 | 70645309 | − | ENST00000255559; ENST00000542342; ENST00000582769 | TSF |
| 22% | chr10 | 5077666 | 5077808 | + | chr10 | 5138602 | 5138769 | + | ENST00000602997; ENST00000605149; ENST00000380554 | TAF |
| 22% | chr10 | 5077666 | 5077808 | + | chr10 | 5138602 | 5138769 | + | ENST00000602997; ENST00000605149; ENST00000380554 | TAF |
| 18% | chr11 | 424193 | 423942 | − | chr11 | 421198 | 421141 | − | ENST00000332826 | TAF |
| 17% | chr5 | 66178759 | 66178848 | + | chr5 | 66195779 | 66195810 | + | ENST00000404260; ENST00000403625; ENST00000406374; ENST00000406039; ENST00000452953; ENST00000432817; ENST00000434115; ENST00000411628; ENST00000490016; ENST00000403666; ENST00000450827 | TAF |
| 17% | chr5 | 66178759 | 66178848 | + | chr5 | 66195779 | 66195810 | + | ENST00000404260; ENST00000403625; ENST00000406374; ENST00000406039; ENST00000452953; ENST00000432817; ENST00000434115; ENST00000411628; ENST00000490016; ENST00000403666; ENST00000450827 | TAF |
| 17% | chr5 | 66178759 | 66178848 | + | chr5 | 66195779 | 66195810 | + | ENST00000404260; ENST00000403625; ENST00000406374; ENST00000406039; ENST00000452953; ENST00000432817; ENST00000434115; ENST00000411628; ENST00000490016; ENST00000403666; ENST00000450827 | TAF |
| 17% | chr5 | 66178759 | 66178848 | + | chr5 | 66195779 | 66195810 | + | ENST00000404260; ENST00000403625; ENST00000406374; ENST00000406039; ENST00000452953; ENST00000432817; ENST00000434115; ENST00000411628; ENST00000490016; ENST00000403666; ENST00000450827 | TAF |
| 17% | chr5 | 66178759 | 66178848 | + | chr5 | 66195779 | 66195810 | + | ENST00000404260; ENST00000403625; ENST00000406374; ENST00000406039; ENST00000452953; ENST00000432817; ENST00000434115; ENST00000411628; ENST00000490016; ENST00000403666; ENST00000450827 | TAF |
| 17% | chr5 | 66178759 | 66178848 | + | chr5 | 66195779 | 66195810 | + | ENST00000404260; ENST00000403625; ENST00000406374; ENST00000406039; ENST00000452953; ENST00000432817; ENST00000434115; ENST00000411628; ENST00000490016; ENST00000403666; | TAF |

TABLE 38-continued

Transcript fusion for Lung Adenocarcinoma (LUAD) Coordinates of the fusion sequences for which the donor is the TE.

| 1 | 2' | 3' | 4' | 5' | 6' | 7' | 8' | 9' | 10 | 11' |
|---|---|---|---|---|---|---|---|---|---|---|
| 17% | chr5 | 66178759 | 66178848 | + | chr5 | 66195779 | 66195810 | + | ENST00000450827 ENST00000404260; ENST00000403625; ENST00000406374; ENST00000406039; ENST00000452953; ENST00000432817; ENST00000434115; ENST00000411628; ENST00000490016; ENST00000403666; ENST00000450827 | TAF |
| 17% | chr5 | 66178759 | 66178848 | + | chr5 | 66195779 | 66195810 | + | ENST00000404260; ENST00000403625; ENST00000406374; ENST00000406039; ENST00000452953; ENST00000432817; ENST00000434115; ENST00000411628; ENST00000490016; ENST00000403666; ENST00000450827 | TAF |
| 17% | chr5 | 66178759 | 66178848 | + | chr5 | 66195779 | 66195810 | + | ENST00000404260; ENST00000403625; ENST00000406374; ENST00000406039; ENST00000452953; ENST00000432817; ENST00000434115; ENST00000411628; ENST00000490016; ENST00000403666; ENST00000450827 | TAF |
| 17% | chr5 | 66178759 | 66178848 | + | chr5 | 66195779 | 66195810 | + | ENST00000404260; ENST00000403625; ENST00000406374; ENST00000406039; ENST00000452953; ENST00000432817; ENST00000434115; ENST00000411628; ENST00000490016; ENST00000403666; ENST00000450827 | TAF |
| 16% | chr4 | 100021143 | 100021056 | − | chr4 | 100006367 | 100006266 | − | ENST00000296412; ENST00000512659; ENST00000503130; ENST00000502590; ENST00000505652 | TAF |
| 16% | chr4 | 100021143 | 100021056 | − | chr4 | 100006367 | 100006266 | − | ENST00000296412; ENST00000512659; ENST00000503130; ENST00000502590; ENST00000505652 | TAF |
| 16% | chr4 | 100021143 | 100021056 | − | chr4 | 100006367 | 100006266 | − | ENST00000296412; ENST00000512659; ENST00000503130; ENST00000502590; ENST00000505652 | TAF |
| 16% | chr4 | 100021143 | 100021056 | − | chr4 | 100006367 | 100006266 | − | ENST00000296412; ENST00000512659; ENST00000503130; ENST00000502590; ENST00000505652 | TAF |
| 16% | chr4 | 100021143 | 100021056 | − | chr4 | 100006367 | 100006266 | − | ENST00000296412; ENST00000512659; ENST00000503130; ENST00000502590; ENST00000505652 | |TAF |
| 16% | chr11 | 93468219 | 93468129 | − | chr11 | 93467826 | 93467791; 93467814 | − | ENST00000393259; ENST00000527169 | TAF |
| 16% | chr11 | 93468219 | 93468129 | − | chr11 | 93467826 | 93467791; 93467814 | − | ENST00000393259; ENST00000527169 | TAF |
| 15% | chr5 | 54528691 | 54528595 | − | chr5 | 54528374 | 54528189 | − | ENST00000282572 | TAF |
| 15% | chr17 | 70671026 | 70670643 | − | chr17 | 70645407 | 70645309 | − | ENST00000255559; ENST00000542342; ENST00000582769 | TAF |
| 15% | chr17 | 70671026 | 70670643 | − | chr17 | 70645407 | 70645309 | − | ENST00000255559; ENST00000542342; ENST00000582769 | TAF |
| 14% | chr5 | 823586 | 823504 | − | chr5 | 822010 | 821976 | − | ENST00000424784; ENST00000283441 | TAF |
| 13% | chr7 | 98974090 | 98974197 | + | chr7 | 98983325 | 98983401 | + | ENST00000432884 | TAF |
| 12% | chr20 | 31764878 | 31764929 | + | chr20 | 31765953 | 31766034 | + | ENST00000253362; ENST00000354932 | TAF |
| 11% | chr1 | 224551810 | 224551900 | + | chr1 | 224553581 | 224553693 | + | ENST00000465271; ENST00000366858; ENST00000366857; ENST00000366856 | TAF |
| 11% | chr1 | 224551810 | 224551900 | + | chr1 | 224553581 | 224553693 | + | ENST00000465271; ENST00000366858; ENST00000366857; ENST00000366856 | TAF |
| 11% | chr1 | 224551810 | 224551900 | + | chr1 | 224553581 | 224553693 | + | ENST00000465271; ENST00000366858; ENST00000366857; ENST00000366856 | TAF |
| 11% | chr1 | 224551810 | 224551900 | + | chr1 | 224553581 | 224553693 | + | ENST00000465271; ENST00000366858; ENST00000366857; ENST00000366856 | TAF |
| 10% | chr19 | 45347212 | 45347340 | + | chr19 | 45368528 | 45368917 | + | ENST00000252485; ENST00000252483 | TAF |
| 10% | chr19 | 45347212 | 45347340 | + | chr19 | 45368528 | 45368917 | + | ENST00000252485; ENST00000252483 | TAF |
| 10% | chr3 | 172098199 | 172098266 | +chr3 | | 172098756 | 172098883 | + | ENST00000415807; ENST00000336824; ENST00000416957 | TAF |
| 10% | chr5 | 1475119 | 1475076 | − | chr5 | 1474800 | 1474675 | − | ENST00000475622; ENST00000283415 | TSF |
| 9% | chr19 | 14129234 | 14129243 | + | chr19 | 14141522 | 14141549; 14141760 | + | ENST00000585987; ENST00000431365 | TSF |
| 9% | chr19 | 14129234 | 14129243 | + | chr19 | 14141522 | 14141549; 14141760 | + | ENST00000585987; ENST00000431365 | TSF |
| 9% | chr7 | 48039730 | 48039725 | − | chr7 | 48035743 | 48035628 | − | ENST00000453071; ENST00000297325; ENST00000412371; ENST00000412142; ENST00000395572; ENST00000453192; ENST00000438771 | TSF |
| 9% | chr7 | 48039730 | 48039725 | − | chr7 | 48035743 | 48035628 | − | ENST00000453071; ENST00000297325; ENST00000412371; ENST00000412142; ENST00000395572; ENST00000453192; | TSF |

TABLE 38-continued

Transcript fusion for Lung Adenocarcinoma (LUAD) Coordinates of the fusion sequences for which the donor is the TE.

| 1 | 2' | 3' | 4' | 5' | 6' | 7' | 8' | 9' | 10 | 11' |
|---|---|---|---|---|---|---|---|---|---|---|
| 9% | chr7 | 48039730 | 48039725 | − | chr7 | 48035743 | 48035628 | − | ENST00000438771 ENST00000453071; ENST00000297325; ENST00000412371; ENST00000412142; ENST00000395572; ENST00000453192; ENST00000438771 | TSF |
| 8% | chr10 | 33505669 | 33505616 | − | chr10 | 33502645 | 33502134; 33502314 | − | ENST00000432372; ENST00000374875; ENST00000265371; ENST00000374867; ENST00000395995; ENST00000374821; ENST00000374822; ENST00000374823; ENST00000374816 | TSF |
| 8% | chr10 | 33505669 | 33505616 | − | chr10 | 33502645 | 33502134; 33502314 | − | ENST00000432372; ENST00000374875; ENST00000265371; ENST00000374867; ENST00000395995; ENST00000374821; ENST00000374822; ENST00000374823; ENST00000374816 | TSF |
| 8% | chr10 | 33505669 | 33505616 | − | chr10 | 33502645 | 33502134; 33502314 | − | ENST00000432372; ENST00000374875; ENST00000265371; ENST00000374867; ENST00000395995; ENST00000374821; ENST00000374822; ENST00000374823; ENST00000374816 | TSF |
| 8% | chr10 | 33505669 | 33505616 | − | chr10 | 33502645 | 33502134; 33502314 | − | ENST00000432372; ENST00000374875; ENST00000265371; ENST00000374867; ENST00000395995; ENST00000374821; ENST00000374822; ENST00000374823; ENST00000374816 | TSF |
| 8% | chr10 | 33505669 | 33505616 | − | chr10 | 33502645 | 33502134; 33502314 | − | ENST00000432372; ENST00000374875; ENST00000265371; ENST00000374867; ENST00000395995; ENST00000374821; ENST00000374822; ENST00000374823; ENST00000374816 | TSF |
| 8% | chr10 | 33505669 | 33505616 | − | chr10 | 33502645 | 33502134; 33502314 | − | ENST00000432372; ENST00000374875; ENST00000265371; ENST00000374867; ENST00000395995; ENST00000374821; ENST00000374822; ENST00000374823; ENST00000374816 | TSF |
| 8% | chr10 | 33505669 | 33505616 | − | chr10 | 33502645 | 33502134; 33502314 | − | ENST00000432372; ENST00000374875; ENST00000265371; ENST00000374867; ENST00000395995; ENST00000374821; ENST00000374822; ENST00000374823; ENST00000374816 | TSF |
| 8% | chr10 | 33505669 | 33505616 | − | chr10 | 33502645 | 33502134; 33502314 | − | ENST00000432372; ENST00000374875; ENST00000265371; ENST00000374867; ENST00000395995; ENST00000374821; ENST00000374822; ENST00000374823; ENST00000374816 | TSF |
| 7% | chrX | 107293989 | 107294242 | + | chrX | 107301268 | 107301431 | + | ENST00000415430; ENST00000217957; ENST00000458383 | TSF |
| 7% | chrX | 107293989 | 107294242 | + | chrX | 107301268 | 107301431 | + | ENST00000415430; ENST00000217957; ENST00000458383 | TSF |
| 7% | chrX | 107293989 | 107294242 | + | chrX | 107301268 | 107301431 | + | ENST00000415430; ENST00000217957; ENST00000458383 | TSF |
| 5% | chr7 | 7559044 | 7558760 | − | chr7 | 7557468 | 7557427 | − | ENST00000399429; ENST00000444268 | TSF |
| 5% | chr7 | 7559044 | 7558760 | − | chr7 | 7557468 | 7557427 | − | ENST00000399429; ENST00000444268 | TSF |
| 5% | chr3 | 182833330 | 182833262 | − | chr3 | 182812393 | 182812347 | − | ENST00000265594; ENST00000497830; ENST00000495767; ENST00000476176; ENST00000487634; ENST00000466650; ENST00000486226 | TSF |
| 5% | chr3 | 182833330 | 182833262 | − | chr3 | 182812393 | 182812347 | − | ENST00000265594; ENST00000497830; ENST00000495767; ENST00000476176; ENST00000487634; ENST00000466650; ENST00000486226 | TSF |
| 5% | chr3 | 182833330 | 182833262 | − | chr3 | 182812393 | 182812347 | − | ENST00000265594; ENST00000497830; ENST00000495767; ENST00000476176; ENST00000487634; ENST00000466650; ENST00000486226 | TSF |
| 5% | chr3 | 182833330 | 182833262 | − | chr3 | 182812393 | 182812347 | − | ENST00000265594; ENST00000497830; ENST00000495767; ENST00000476176; ENST00000487634; ENST00000466650; ENST00000486226 | TSF |
| 5% | chr3 | 182833330 | 182833262 | − | chr3 | 182812393 | 182812347 | − | ENST00000265594; ENST00000497830; ENST00000495767; ENST00000476176; ENST00000487634; ENST00000466650; ENST00000486226 | TSF |
| 5% | chr3 | 98586295 | 98586135 | − | chr3 | 98568442 | 98568232; 98568305 | − | ENST00000449482; ENST00000326840; ENST00000326857 | TSF |
| 5% | chr3 | 98586295 | 98586135 | − | chr3 | 98568442 | 98568232; | − | ENST00000449482; ENST00000326840; | TSF |

TABLE 38-continued

Transcript fusion for Lung Adenocarcinoma (LUAD) Coordinates of the fusion sequences for which the donor is the TE.

| 1 | 2' | 3' | 4' | 5' | 6' | 7' | 8' | 9' | 10 | 11' |
|---|---|---|---|---|---|---|---|---|---|---|
| 5% | chr3 | 98586295 | 98586135 | – | chr3 | 98568442 | 98568305 98568232; 98568305 | – | ENST00000326857 ENST00000449482; ENST00000326840; ENST00000326857 | TSF |
| 4% | chr2 | 143794737 | 143794842 | + | chr2 | 143797997 | 143798227 | + | ENST00000264170; ENST00000409512 | TSF |
| 4% | chr10 | 5057417 | 5057095 | – | chr10 | 5043873 | 5043706 | – | ENST00000380753; ENST00000421196; ENST00000407674; ENST00000604507; ENST00000455190 | TSF |
| 4% | chr10 | 5057417 | 5057095 | – | chr10 | 5043873 | 5043706 | – | ENST00000380753; ENST00000421196; ENST00000407674; ENST00000604507; ENST00000455190 | TSF |
| 4% | chr10 | 5057417 | 5057095 | – | chr10 | 5043873 | 5043706 | – | ENST00000380753; ENST00000421196; ENST00000407674; ENST00000604507; ENST00000455190 | TSF |
| 4% | chr10 | 5057417 | 5057095 | – | chr10 | 5043873 | 5043706 | – | ENST00000380753; ENST00000421196; ENST00000407674; ENST00000604507; ENST00000455190 | TSF |
| 4% | chr12 | 122430912 | 122432103 | + | chr12 | 122437622 | 122437850 | + | ENST00000288912 | TSF |
| 4% | chr12 | 122430912 | 122431795 | + | chr12 | 122437622 | 122437850 | + | ENST00000288912 | TSF |
| 4% | chr22 | 22899971 | 22899965 | – | chr22 | 22893511 | 22893185; 22893189; 22893274; 22893481 | – | ENST00000406503; ENST00000398743; ENST00000398741; ENST00000543184; ENST00000405655; ENST00000402697; ENST00000439106; ENST00000438888; ENST00000420709; ENST00000403441; ENST00000442481 | TSF |
| 4% | chr22 | 22899971 | 22899965 | – | chr22 | 22893511 | 22893185; 22893189; 22893274; 22893481 | – | ENST00000406503; ENST00000398743; ENST00000398741; ENST00000543184; ENST00000405655; ENST00000402697; ENST00000439106; ENST00000438888; ENST00000420709; ENST00000403441; ENST00000442481 | TSF |
| 4% | chr22 | 22899971 | 22899965 | – | chr22 | 22893511 | 22893185; 22893189; 22893274; 22893481 | – | ENST00000406503; ENST00000398743; ENST00000398741; ENST00000543184; ENST00000405655; ENST00000402697; ENST00000439106; ENST00000438888; ENST00000420709; ENST00000403441; ENST00000442481 | TSF |
| 4% | chr22 | 22899971 | 22899965 | – | chr22 | 22893511 | 22893185; 22893189; 22893274; 22893481 | – | ENST00000406503; ENST00000398743; ENST00000398741; ENST00000543184; ENST00000405655; ENST00000402697; ENST00000439106; ENST00000438888; ENST00000420709; ENST00000403441; ENST00000442481 | TSF |
| 4% | chr22 | 22899971 | 22899965 | – | chr22 | 22893511 | 22893185; 22893189; 22893274; 22893481 | – | ENST00000406503; ENST00000398743; ENST00000398741; ENST00000543184; ENST00000405655; ENST00000402697; ENST00000439106; ENST00000438888; ENST00000420709; ENST00000403441; ENST00000442481 | TSF |
| 4% | chr22 | 22899971 | 22899965 | – | chr22 | 22893511 | 22893185; 22893189; 22893274; 22893481 | – | ENST00000406503; ENST00000398743; ENST00000398741; ENST00000543184; ENST00000405655; ENST00000402697; ENST00000439106; ENST00000438888; ENST00000420709; ENST00000403441; ENST00000442481 | TSF |
| 4% | chr22 | 22899971 | 22899965 | – | chr22 | 22893511 | 22893185; 22893189; 22893274; 22893481 | – | ENST00000406503; ENST00000398743; ENST00000398741; ENST00000543184; ENST00000405655; ENST00000402697; ENST00000439106; ENST00000438888; ENST00000420709; ENST00000403441; ENST00000442481 | TSF |
| 4% | chr8 | 104389530 | 104389536 | + | chr8 | 104390255 | 104390471 | + | ENST00000330295; ENST00000520337 | TSF |
| 4% | chr12 | 117498589 | 117498567 | – | chr12 | 117494691 | 117494611 | – | ENST00000470612; ENST00000335209; ENST00000392545; ENST00000462502 | TSF |
| 4% | chr12 | 117498589 | 117498567 | – | chr12 | 117494691 | 117494611 | – | ENST00000470612; ENST00000335209; ENST00000392545; ENST00000462502 | TSF |
| 4% | chr12 | 117498589 | 117498567 | – | chr12 | 117494691 | 117494611 | – | ENST00000470612; ENST00000335209; ENST00000392545; ENST00000462502 | TSF |
| 4% | chr2 | 38983894 | 38983253 | – | chr2 | 38977336 | 38977156 | – | ENST00000313117; ENST00000425778; ENST00000425941; ENST00000446327; ENST00000409276; ENST00000431066; ENST00000443213 | TSF |
| 4% | chr2 | 38983894 | 38983253 | – | chr2 | 38977336 | 38977156 | – | ENST00000313117; ENST00000425778; ENST00000425941; ENST00000446327; ENST00000409276; ENST00000431066; ENST00000443213 | TSF |
| 4% | chr2 | 38983894 | 38983253 | – | chr2 | 38977336 | 38977156 | – | ENST00000313117; ENST00000425778; | TSF |

TABLE 38-continued

Transcript fusion for Lung Adenocarcinoma (LUAD) Coordinates of the fusion sequences for which the donor is the TE.

| 1 | 2' | 3' | 4' | 5' | 6' | 7' | 8' | 9' | 10 | 11' |
|---|---|---|---|---|---|---|---|---|---|---|
| 4% | chr2 | 38983894 | 38983253 | − | chr2 | 38977336 | 38977156 | − | ENST00000425941; ENST00000446327; ENST00000409276; ENST00000431066; ENST00000443213 ENST00000313117; ENST00000425778; | TSF |
| 4% | chr2 | 38983894 | 38983253 | − | chr2 | 38977336 | 38977156 | − | ENST00000425941; ENST00000446327; ENST00000409276; ENST00000431066; ENST00000443213 ENST00000313117; ENST00000425778; | TSF |
| 4% | chr5 | 66178759 | 66179020 | + | chr5 | 66195779 | 66195810 | + | ENST00000404260; ENST00000403625; ENST00000406374; ENST00000406039; ENST00000452953; ENST00000432817; ENST00000434115; ENST00000411628; ENST00000490016; ENST00000403666; ENST00000450827 | TSF |
| 4% | chr5 | 66178759 | 66179020 | + | chr5 | 66195779 | 66195810 | + | ENST00000404260; ENST00000403625; ENST00000406374; ENST00000406039; ENST00000452953; ENST00000432817; ENST00000434115; ENST00000411628; ENST00000490016; ENST00000403666; ENST00000450827 | TSF |
| 4% | chr5 | 66178759 | 66179020 | + | chr5 | 66195779 | 66195810 | + | ENST00000404260; ENST00000403625; ENST00000406374; ENST00000406039; ENST00000452953; ENST00000432817; ENST00000434115; ENST00000411628; ENST00000490016; ENST00000403666; ENST00000450827 | TSF |
| 4% | chr5 | 66178759 | 66179020 | + | chr5 | 66195779 | 66195810 | + | ENST00000404260; ENST00000403625; ENST00000406374; ENST00000406039; ENST00000452953; ENST00000432817; ENST00000434115; ENST00000411628; ENST00000490016; ENST00000403666; ENST00000450827 | TSF |
| 4% | chr5 | 66178759 | 66179020 | + | chr5 | 66195779 | 66195810 | + | ENST00000404260; ENST00000403625; ENST00000406374; ENST00000406039; ENST00000452953; ENST00000432817; ENST00000434115; ENST00000411628; ENST00000490016; ENST00000403666; ENST00000450827 | TSF |
| 4% | chr5 | 66178759 | 66179020 | + | chr5 | 66195779 | 66195810 | + | ENST00000404260; ENST00000403625; ENST00000406374; ENST00000406039; ENST00000452953; ENST00000432817; ENST00000434115; ENST00000411628; ENST00000490016; ENST00000403666; ENST00000450827 | TSF |
| 4% | chr5 | 66178759 | 66179020 | + | chr5 | 66195779 | 66195810 | + | ENST00000404260; ENST00000403625; ENST00000406374; ENST00000406039; ENST00000452953; ENST00000432817; ENST00000434115; ENST00000411628; ENST00000490016; ENST00000403666; ENST00000450827 | TSF |
| 4% | chr5 | 66178759 | 66179020 | + | chr5 | 66195779 | 66195810 | + | ENST00000404260; ENST00000403625; ENST00000406374; ENST00000406039; ENST00000452953; ENST00000432817; ENST00000434115; ENST00000411628; ENST00000490016; ENST00000403666; ENST00000450827 | TSF |
| 4% | chr5 | 66178759 | 66179020 | + | chr5 | 66195779 | 66195810 | + | ENST00000404260; ENST00000403625; ENST00000406374; ENST00000406039; ENST00000452953; ENST00000432817; ENST00000434115; ENST00000411628; ENST00000490016; ENST00000403666; ENST00000450827 | TSF |
| 4% | chr5 | 66178759 | 66179020 | + | chr5 | 66195779 | 66195810 | + | ENST00000404260; ENST00000403625; ENST00000406374; ENST00000406039; ENST00000452953; ENST00000432817; ENST00000434115; ENST00000411628; ENST00000490016; ENST00000403666; ENST00000450827 | TSF |
| 4% | chr20 | 45337040 | 45337192 | + | chr20 | 45353680 | 45354963 | + | ENST00000359271 | TSF |
| 4% | chr7 | 56018506 | 56018522 | + | chr7 | 56020872 | 56021011 | + | ENST00000426595 | TSF |
| 4% | chr4 | 57560508 | 57559845 | − | chr4 | 57522178 | 57522023; 57522025 | − | ENST00000420433; ENST00000554144; ENST00000508121; ENST00000557328 | TSF |
| 4% | chr4 | 57560508 | 57559845 | − | chr4 | 57522178 | 57522023; | − | ENST00000420433; ENST00000554144; | TSF |

TABLE 38-continued

Transcript fusion for Lung Adenocarcinoma (LUAD) Coordinates of the fusion sequences for which the donor is the TE.

| 1 | 2' | 3' | 4' | 5' | 6' | 7' | 8' | 9' | 10 | 11' |
|---|---|---|---|---|---|---|---|---|---|---|
| 4% | chr4 | 57560508 | 57559845 | − | chr4 | 57522178 | 57522025 57522023; 57522025 | − | ENST00000508121; ENST00000557328 ENST00000420433; ENST00000554144; ENST00000508121; ENST00000557328 | TSF |
| 4% | chr6 | 117763870 | 117763597 | − | chr6 | 117739669 | 117739625 | − | ENST00000368507; ENST00000368508 | TSF |
| 4% | chr6 | 117763870 | 117763597 | − | chr6 | 117739669 | 117739625 | − | ENST00000368507; ENST00000368508 | TSF |
| 3% | chr5 | 147244208 | 147245387 | + | chr5 | 147261009 | 147261211 | + | ENST00000296694 | TSF |
| 3% | chr17 | 39974832 | 39974893 | + | chr17 | 39975462 | 39975651 | + | ENST00000321562 | TSF |
| 3% | chr12 | 122430912 | 122432282 | + | chr12 | 122437622 | 122437850 | + | ENST00000288912 | TSF |
| 3% | chr19 | 1114930 | 1114676 | − | chr19 | 1114421 | 1114230 | − | ENST00000361757; ENST00000587024; ENST00000438103 | TSF |
| 3% | chr4 | 57560508 | 57559885 | − | chr4 | 57522178 | 57522023; 57522025 | − | ENST00000420433; ENST00000554144; ENST00000508121; ENST00000557328 | TSF |
| 3% | chr4 | 57560508 | 57559885 | − | chr4 | 57522178 | 57522023; 57522025 | − | ENST00000420433; ENST00000554144; ENST00000508121; ENST00000557328 | TSF |
| 3% | chr4 | 57560508 | 57559885 | − | chr4 | 57522178 | 57522023; 57522025 | − | ENST00000420433; ENST00000554144; ENST00000508121; ENST00000557328 | TSF |
| 3% | chr4 | 873272 | 873014 | − | chr4 | 871597 | 871403 | − | ENST00000314167; ENST00000511163 | TSF |
| 3% | chr22 | 42511426 | 42511212 | − | chr22 | 42483179 | 42483064 | − | ENST00000602404; ENST00000498737 | TSF |
| 3% | chr22 | 29117574 | 29117506 | − | chr22 | 29115473 | 29115383; 29115458 | − | ENST00000348295; ENST00000382566; ENST00000382578; ENST00000404276; ENST00000328354; ENST00000405598; ENST00000382580; ENST00000433728; ENST00000402731; ENST00000403642; ENST00000439200; ENST00000448511 | TSF |
| 3% | chr22 | 29117574 | 29117506 | − | chr22 | 29115473 | 29115383; 29115458 | − | ENST00000348295; ENST00000382566; ENST00000382578; ENST00000404276; ENST00000328354; ENST00000405598; ENST00000382580; ENST00000433728; ENST00000402731; ENST00000403642; ENST00000439200; ENST00000448511 | TSF |
| 3% | chr22 | 29117574 | 29117506 | − | chr22 | 29115473 | 29115383; 29115458 | − | ENST00000348295; ENST00000382566; ENST00000382578; ENST00000404276; ENST00000328354; ENST00000405598; ENST00000382580; ENST00000433728; ENST00000402731; ENST00000403642; ENST00000439200; ENST00000448511 | TSF |
| 3% | chr22 | |29117574 | 29117506 | − | chr22 | 29115473 | 29115383; 29115458 | − | ENST00000348295; ENST00000382566; ENST00000382578; ENST00000404276; ENST00000328354; ENST00000405598; ENST00000382580; ENST00000433728; ENST00000402731; ENST00000403642; ENST00000439200; ENST00000448511 | TSF |
| 3% | chr22 | 29117574 | 29117506 | − | chr22 | 29115473 | 29115383; 29115458 | − | ENST00000348295; ENST00000382566; ENST00000382578; ENST00000404276; ENST00000328354; ENST00000405598; ENST00000382580; ENST00000433728; ENST00000402731; ENST00000403642; ENST00000439200; ENST00000448511 | TSF |
| 3% | chr8 | 117816470 | 117816753 | + | chr8 | 117861127 | 117861256; 117861276 | + | ENST00000517820; ENST00000520733 | TSF |
| 3% | chr8 | 117816470 | 117816753 | + | chr8 | 117861127 | 117861256; 117861276 | + | ENST00000517820; ENST00000520733 | TSF |
| 3% | chr16 | 66461229 | 66461334 | + | chr16 | 66503505 | 66503768 | + | ENST00000536005 | TSF |
| 3% | chr17 | 39976225 | 39976301 | + | chr17 | 39976521 | 39976713 | + | ENST00000321562; ENST00000455106; ENST00000544340 | TSF |
| 3% | chr17 | 70713894 | 70713885 | − | chr17 | 70709120 | 70709075 | − | ENST00000581581 | TSF |
| 3% | chr1 | 223720576 | 223720355 | − | chr1 | 223718212 | 223718134 | − | ENST00000430824; ENST00000366872 | TSF |
| 3% | chrX | 151410500 | 151410406 | − | chrX | 151393317 | 151393235 | − | ENST00000370314; ENST00000535043 | TSF |
| 3% | chr16 | 74833301 | 74833256 | − | chr16 | 74774013 | 74773921 | − | ENST00000219368; ENST00000567683; ENST00000569949 | TSF |
| 3% | chr16 | 74833301 | 74833256 | − | chr16 | 74774013 | 74773921 | − | ENST00000219368; ENST00000567683; ENST00000569949 | TSF |
| 3% | chr16 | 74833301 | 74833256 | − | chr16 | 74774013 | 74773921 | − | ENST00000219368; ENST00000567683; ENST00000569949 | TSF |
| 2% | chr16 | 4708255 | 4708353 | + | chr16 | 4714710 | 4714776 | + | ENST00000262370; ENST00000415496; ENST00000536343; ENST00000587747; ENST00000399577; ENST00000588994; ENST00000586183; ENST00000590790 | TSF |
| 2% | chr16 | 4708255 | 4708353 | + | chr16 | 4714710 | 4714776 | + | ENST00000262370; ENST00000415496; ENST00000536343; ENST00000587747; ENST00000399577; ENST00000588994; ENST00000586183; ENST00000590790 | TSF |
| 2% | chr16 | 4708255 | 4708353 | + | chr16 | 4714710 | 4714776 | + | ENST00000262370; ENST00000415496; ENST00000536343; ENST00000587747; ENST00000399577; ENST00000588994; ENST00000586183; ENST00000590790 | TSF |

TABLE 38-continued

Transcript fusion for Lung Adenocarcinoma (LUAD) Coordinates of the fusion sequences for which the donor is the TE.

| 1 | 2' | 3' | 4' | 5' | 6' | 7' | 8' | 9' | 10 | 11' |
|---|---|---|---|---|---|---|---|---|---|---|
| 2% | chr16 | 4708255 | 4708353 | + | chr16 | 4714710 | 4714776 | + | ENST00000262370; ENST00000415496; ENST00000536343; ENST00000587747; ENST00000399577; ENST00000588994; ENST00000586183; ENST00000590790 | TSF |
| 2% | chr16 | 4708255 | 4708353 | + | chr16 | 4714710 | 4714776 | + | ENST00000262370; ENST00000415496; ENST00000536343; ENST00000587747; ENST00000399577; ENST00000588994; ENST00000586183; ENST00000590790 | TSF |
| 2% | chr16 | 4708255 | 4708353 | + | chr16 | 4714710 | 4714776 | + | ENST00000262370; ENST00000415496; ENST00000536343; ENST00000587747; ENST00000399577; ENST00000588994; ENST00000586183; ENST00000590790 | TSF |
| 2% | chr16 | 4708255 | 4708353 | + | chr16 | 4714710 | 4714776 | + | ENST00000262370; ENST00000415496; ENST00000536343; ENST00000587747; ENST00000399577; ENST00000588994; ENST00000586183; ENST00000590790 | TSF |
| 2% | chr16 | 4708255 | 4708353 | + | chr16 | 4714710 | 4714776 | + | ENST00000262370; ENST00000415496; ENST00000536343; ENST00000587747; ENST00000399577; ENST00000588994; ENST00000586183; ENST00000590790 | TSF |
| 2% | chr1 | 1422590 | 1422685 | + | chr1 | 1423243 | 1423294 | + | ENST00000308647 | TSF |
| 2% | chr15 | 43467899 | 43467988 | + | chr15 | 43470805 | 43470909 | + | ENST00000260403 | TSF |
| 2% | chr7 | 44158417 | 44158351 | − | chr7 | 44157663 | 44157542 | − | ENST00000406581; ENST00000223361; ENST00000452185; ENST00000433715; ENST00000456038; ENST00000418438 | TSF |
| 2% | chr7 | 44158417 | 44158351 | − | chr7 | 44157663 | 44157542 | − | ENST00000406581; ENST00000223361; ENST00000452185; ENST00000433715; ENST00000456038; ENST00000418438 | TSF |
| 2% | chr7 | 44158417 | 44158351 | − | chr7 | 44157663 | 44157542 | − | ENST00000406581; ENST00000223361; ENST00000452185; ENST00000433715; ENST00000456038; ENST00000418438 | TSF |
| 2% | chr7 | 44158417 | 44158351 | − | chr7 | 44157663 | 44157542 | − | ENST00000406581; ENST00000223361; ENST00000452185; ENST00000433715; ENST00000456038; ENST00000418438 | TSF |
| 2% | chr7 | 44158417 | 44158351 | − | chr7 | 44157663 | 44157542 | − | ENST00000406581; ENST00000223361; ENST00000452185; ENST00000433715; ENST00000456038; ENST00000418438 | TSF |
| 2% | chr10 | 5060345 | 5060092 | − | chr10 | 5043777 | 5043706 | − | ENST00000380753; ENST00000421196; ENST00000407674; ENST00000604507; ENST00000455190 | TSF |
| 2% | chr10 | 5060345 | 5060092 | − | chr10 | 5043777 | 5043706 | − | ENST00000380753; ENST00000421196; ENST00000407674; ENST00000604507; ENST00000455190 | TSF |
| 2% | chr10 | 5060345 | 5060092 | − | chr10 | 5043777 | 5043706 | − | ENST00000380753; ENST00000421196; ENST00000407674; ENST00000604507; ENST00000455190 | TSF |
| 2% | chr10 | 5060345 | 5060092 | − | chr10 | 5043777 | 5043706 | − | ENST00000380753; ENST00000421196; ENST00000407674; ENST00000604507; ENST00000455190 | TSF |
| 2% | chr8 | 121662427 | 121662337 | − | chr8 | 121644891 | 121644684 | − | ENST00000395601; ENST00000517992 | TSF |
| 2% | chr5 | 58596952 | 58596862 | − | chr5 | 58511794 | 58511603 | − | ENST00000340635; ENST00000360047; ENST00000507116; ENST00000503258; ENST00000405755; ENST00000502484; ENST00000546160; ENST00000309641; ENST00000502575 | TSF |
| 2% | chr5 | 58596952 | 58596862 | − | chr5 | 58511794 | 58511603 | − | ENST00000340635; ENST00000360047; ENST00000507116; ENST00000503258; ENST00000405755; ENST00000502484; ENST00000546160; ENST00000309641; ENST00000502575 | TSF |
| 2% | chr5 | 58596952 | 58596862 | − | chr5 | 58511794 | 58511603 | − | ENST00000340635; ENST00000360047; ENST00000507116; ENST00000503258; ENST00000405755; ENST00000502484; ENST00000546160; ENST00000309641; ENST00000502575 | TSF |
| 2% | chr14 | 106258982 | 106258725 | − | chr14 | 106209234 | 106209114 | − | ENST00000390548; ENST00000390549; ENST00000390542 | TSF |
| 2% | chr14 | 106258982 | 106258725 | − | chr14 | 106209234 | 106209114 | − | ENST00000390548; ENST00000390549; ENST00000390542 | TSF |
| 2% | chr14 | 106258982 | 106258725 | − | chr14 | 106209234 | 106209114 | − | ENST00000390548; ENST00000390549; ENST00000390542 | TSF |
| 2% | chrX | 149997009 | 149996779 | − | chrX | 149963959 | 149963891 | − | ENST00000370377; ENST00000466436; ENST00000418547 | TSF |
| 2% | chrX | 149997009 | 149996779 | − | chrX | 149963959 | 149963891 | − | ENST00000370377; ENST00000466436; ENST00000418547 | TSF |
| 2% | chr14 | 106258982 | 106258725 | − | chr14 | 106237569 | 106237449 | − | ENST00000390551 | TSF |

TABLE 38-continued

Transcript fusion for Lung Adenocarcinoma (LUAD) Coordinates of the fusion sequences for which the donor is the TE.

| 1 | 2' | 3' | 4' | 5' | 6' | 7' | 8' | 9' | 10 | 11' |
|---|---|---|---|---|---|---|---|---|---|---|
| 2% | chrX | 123618682 | 123617816 | − | chrX | 123615814 | 123615582 | − | ENST00000371130; ENST00000422452 | TSF |
| 2% | chrX | 100655477 | 100654732 | − | chrX | 100653934 | 100653773 | − | ENST00000218516 | TSF |
| 2% | chr1 | 156716197 | 156716133 | − | chr1 | 156715165 | 156715089 | − | ENST00000357325; ENST00000537739; ENST00000368209; ENST00000368206 | TSF |
| 2% | chr1 | 224527533 | 224527861 | + | chr1 | 224553581 | 224553693 | + | ENST00000465271; ENST00000366858; ENST00000366857; ENST00000366856 | TSF |
| 2% | chr1 | 224527533 | 224527861 | + | chr1 | 224553581 | 224553693 | + | ENST00000465271; ENST00000366858; ENST00000366857; ENST00000366856 | TSF |
| 2% | chr1 | 224527533 | 224527861 | + | chr1 | 224553581 | 224553693 | + | ENST00000465271; ENST00000366858; ENST00000366857; ENST00000366856 | TSF |
| 2% | chr1 | 224527533 | 224527861 | + | chr1 | 224553581 | 224553693 | + | ENST00000465271; ENST00000366858; ENST00000366857; ENST00000366856 | TSF |
| 2% | chr18 | 70840904 | 70840073 | − | chr18 | 70829208 | 70829180 | − | ENST00000581011; ENST00000581862 | TSF |
| 2% | chr5 | 132737340 | 132737281 | − | chr5 | 132736678 | 132736430 | − | ENST00000265342; ENST00000510685 | TSF |
| 2% | chr5 | 132737340 | 132737281 | − | chr5 | 132736678 | 132736430 | − | ENST00000265342; ENST00000510685 | TSF |
| 2% | chr2 | 89370075 | 89370031 | − | chr2 | 89292018 | 89291928 | − | ENST00000495489 | TSF |
| 2% | chr6 | 32746812 | 32746483 | − | chr6 | 32731247 | 32731151 | − | ENST00000411527; ENST00000435145; ENST00000437316 | TSF |
| 2% | chr6 | 32746812 | 32746483 | − | chr6 | 32731247 | 32731151 | − | ENST00000411527; ENST00000435145; ENST00000437316 | TSF |
| 2% | chr6 | 32746812 | 32746483 | − | chr6 | 32731247 | 32731151 | − | ENST00000411527; ENST00000435145; ENST00000437316 | TSF |
| 2% | chr1 | 236485958 | 236485567 | − | chr1 | 236433294 | 236433175 | − | ENST00000354619; ENST00000327333 | TSF |
| 2% | chr1 | 236485958 | 236485567 | − | chr1 | 236433294 | 236433175 | − | ENST00000354619; ENST00000327333 | TSF |
| 2% | chr16 | 74834658 | 74834274 | − | chr16 | 74774013 | 74773921 | − | ENST00000219368; ENST00000567683; ENST00000569949 | TSF |
| 2% | chr16 | 74834658 | 74834274 | − | chr16 | 74774013 | 74773921 | − | ENST00000219368; ENST00000567683; ENST00000569949 | TSF |
| 2% | chr16 | 74834658 | 74834274 | − | chr16 | 74774013 | 74773921 | − | ENST00000219368; ENST00000567683; ENST00000569949 | TSF |
| 2% | chr2 | 85823332 | 85823377 | + | chr2 | 85823642 | 85823772 | + | ENST00000441634; ENST00000306368; ENST00000414390; ENST00000443647; ENST00000456023 | TSF |
| 2% | chr2 | 85823332 | 85823377 | + | chr2 | 85823642 | 85823772 | + | ENST00000441634; ENST00000306368; ENST00000414390; ENST00000443647; ENST00000456023 | TSF |
| 2% | chr2 | 85823332 | 85823377 | + | chr2 | 85823642 | 85823772 | + | ENST00000441634; ENST00000306368; ENST00000414390; ENST00000443647; ENST00000456023 | TSF |
| 2% | chr2 | 85823332 | 85823377 | + | chr2 | 85823642 | 85823772 | + | ENST00000441634; ENST00000306368; ENST00000414390; ENST00000443647; ENST00000456023 | TSF |
| 2% | chr2 | 85823332 | 85823377 | + | chr2 | 85823642 | 85823772 | + | ENST00000441634; ENST00000306368; ENST00000414390; ENST00000443647; ENST00000456023 | TSF |
| 2% | chr12 | 104681506 | 104681628 | + | chr12 | 104682709 | 104682818 | + | ENST00000378070; ENST00000525566; ENST00000429002; ENST00000526691; ENST00000388854; ENST00000542918 | TSF |
| 2% | chr12 | 104681506 | 104681628 | + | chr12 | 104682709 | 104682818 | + | ENST00000378070; ENST00000525566; ENST00000429002; ENST00000526691; ENST00000388854; ENST00000542918 | TSF |
| 2% | chr12 | 104681506 | 104681628 | + | chr12 | 104682709 | 104682818 | + | ENST00000378070; ENST00000525566; ENST00000429002; ENST00000526691; ENST00000388854; ENST00000542918 | TSF |
| 2% | chr5 | 52897435; 52897700 | 52897704 | + | chr5 | 52899282 | 52899360 | + | ENST00000502423; ENST00000296684; ENST00000506974; ENST00000506765 | TSF |
| 2% | chr5 | 52897435; 52897700 | 52897704 | + | chr5 | 52899282 | 52899360 | + | ENST00000502423; ENST00000296684; ENST00000506974; ENST00000506765 | TSF |
| 2% | chr5 | 52897435; 52897700 | 52897704 | + | chr5 | 52899282 | 52899360 | + | ENST00000502423; ENST00000296684; ENST00000506974; ENST00000506765 | TSF |
| 2% | chr5 | 52897435; 52897700 | 52897704 | + | chr5 | 52899282 | 52899360 | + | ENST00000502423; ENST00000296684; ENST00000506974; ENST00000506765 | TSF |
| 2% | chr5 | 52897435; 52897700 | 52897704 | + | chr5 | 52899282 | 52899360 | + | ENST00000502423; ENST00000296684; ENST00000506974; ENST00000506765 | TSF |
| 2% | chr5 | 52897435; 52897700 | 52897704 | + | chr5 | 52899282 | 52899360 | + | ENST00000502423; ENST00000296684; ENST00000506974; ENST00000506765 | TSF |
| 2% | chr5 | 52897435; 52897700 | 52897704 | + | chr5 | 52899282 | 52899360 | + | ENST00000502423; ENST00000296684; ENST00000506974; ENST00000506765 | TSF |
| 2% | chr5 | 52897435; 52897700 | 52897704 | + | chr5 | 52899282 | 52899360 | + | ENST00000502423; ENST00000296684; ENST00000506974; ENST00000506765 | TSF |
| 2% | chr11 | 60694460 | 60694542 | + | chr11 | 60694676 | 60694890 | + | ENST00000453848; ENST00000005286 | TSF |
| 2% | chr11 | 60694460 | 60694542 | + | chr11 | 60694676 | 60694890 | + | ENST00000453848; ENST00000005286 | TSF |
| 2% | chr19 | 11140024 | 11140045 | + | chr19 | 11141406 | 11141569 | + | ENST00000358026; ENST00000344626; ENST00000429416; ENST00000541122; ENST00000589677; ENST00000444061; ENST00000590574; ENST00000413806; | TSF |

TABLE 38-continued

Transcript fusion for Lung Adenocarcinoma (LUAD) Coordinates of the fusion sequences for which the donor is the TE.

| 1 | 2' | 3' | 4' | 5' | 6' | 7' | 8' | 9' | 10 | 11' |
|---|---|---|---|---|---|---|---|---|---|---|
| 2% | chr19 | 11140024 | 11140045 | + | chr19 | 11141406 | 11141569 | + | ENST00000450717; ENST00000358026; ENST00000344626; ENST00000429416; ENST00000541122; ENST00000589677; ENST00000444061; ENST00000590574; ENST00000413806; | TSF |
| 2% | chr19 | 11140024 | 11140045 | + | chr19 | 11141406 | 11141569 | + | ENST00000450717; ENST00000358026; ENST00000344626; ENST00000429416; ENST00000541122; ENST00000589677; ENST00000444061; ENST00000590574; ENST00000413806; | TSF |
| 2% | chr19 | 11140024 | 11140045 | + | chr19 | 11141406 | 11141569 | + | ENST00000450717; ENST00000358026; ENST00000344626; ENST00000429416; ENST00000541122; ENST00000589677; ENST00000444061; ENST00000590574; ENST00000413806; | TSF |
| 2% | chr19 | 11140024 | 11140045 | + | chr19 | 11141406 | 11141569 | + | ENST00000450717; ENST00000358026; ENST00000344626; ENST00000429416; ENST00000541122; ENST00000589677; ENST00000444061; ENST00000590574; ENST00000413806; | TSF |
| 2% | chr19 | 11140024 | 11140045 | + | chr19 | 11141406 | 11141569 | + | ENST00000450717; ENST00000358026; ENST00000344626; ENST00000429416; ENST00000541122; ENST00000589677; ENST00000444061; ENST00000590574; ENST00000413806; | TSF |
| 2% | chr18 | 71977251 | 71977013 | − | chr18 | 71930712 | 71930584 | − | ENST00000340533; ENST00000494131; ENST00000397914 | TSF |
| 2% | chr18 | 71977251 | 71977013 | − | chr18 | 71930712 | 71930584 | − | ENST00000340533; ENST00000494131; ENST00000397914 | TSF |
| 2% | chr18 | 71977251 | 71977013 | − | chr18 | 71930712 | 71930584 | − | ENST00000340533; ENST00000494131; ENST00000397914 | TSF |
| 2% | chr14 | 92120138 | 92119864 | − | chr14 | 92105594 | 92105440; 92105508 | − | ENST00000256343; ENST00000557036 | TSF |
| 2% | chr14 | 92120138 | 92119864 | − | chr14 | 92105594 | 92105440; 92105508 | − | ENST00000256343; ENST00000557036 | TSF |
| 2% | chr4 | 57560508 | 57559962 | − | chr4 | 57522178 | 57522023; 57522025 | − | ENST00000420433; ENST00000554144; ENST00000508121; ENST00000557328 | TSF |
| 2% | chr4 | 57560508 | 57559962 | − | chr4 | 57522178 | 57522023; 57522025 | − | ENST00000420433; ENST00000554144; ENST00000508121; ENST00000557328 | TSF |
| 2% | chr4 | 57560508 | 57559962 | − | chr4 | 57522178 | 57522023; 57522025 | − | ENST00000420433; ENST00000554144; ENST00000508121; ENST00000557328 | TSF |
| 2% | chr8 | 144691011 | 144690934 | − | chr8 | 144690296 | 144690232 | − | ENST00000220966; ENST00000433751 | TSF |
| 2% | chr8 | 144691011 | 144690934 | − | chr8 | 144690296 | 144690232 | − | ENST00000220966; ENST00000433751 | TSF |
| 2% | chr1 | 23762222 | 23762216 | − | chr1 | 23761111 | 23761026 | − | ENST00000495646; ENST00000336689; ENST00000437606 | TSF |
| 2% | chr7 | 50763323 | 50763289 | − | chr7 | 50742355 | 50742133 | − | ENST00000439599; ENST00000398812; ENST00000403097; ENST00000357271; ENST00000401949; ENST00000439044 | TSF |
| 2% | chr7 | 50763323 | 50763289 | − | chr7 | 50742355 | 50742133 | − | ENST00000439599; ENST00000398812; ENST00000403097; ENST00000357271; ENST00000401949; ENST00000439044 | TSF |
| 2% | chr7 | 50763323 | 50763289 | − | chr7 | 50742355 | 50742133 | − | ENST00000439599; ENST00000398812; ENST00000403097; ENST00000357271; ENST00000401949; ENST00000439044 | TSF |
| 2% | chr15 | 34453644 | 34453416 | − | chr15 | 34446885 | 34446845 | − | ENST00000256544; ENST00000557877; ENST00000560108; ENST00000559515 | TSF |
| 2% | chr15 | 34453644 | 34453416 | − | chr15 | 34446885 | 34446845 | − | ENST00000256544; ENST00000557877; ENST00000560108; ENST00000559515 | TSF |
| 2% | chr15 | 34453644 | 34453416 | − | chr15 | 34446885 | 34446845 | − | ENST00000256544; ENST00000557877; ENST00000560108; ENST00000559515 | TSF |
| 2% | chr15 | 34453644 | 34453416 | − | chr15 | 34446885 | 34446845 | − | ENST00000256544; ENST00000557877; ENST00000560108; ENST00000559515 | TSF |
| 2% | chr12 | 6459191 | 6458996 | − | chr12 | 6458387 | 6458330 | − | ENST00000360168; ENST00000358945; ENST00000540037; ENST00000228916; ENST00000543768 | TSF |
| 2% | chr7 | 95053394 | 95053104 | − | chr7 | 95045609 | 95045554 | − | ENST00000536183; ENST00000455123; ENST00000433091; ENST00000222572 | TSF |
| 2% | chr7 | 95053394 | 95053104 | − | chr7 | 95045609 | 95045554 | − | ENST00000536183; ENST00000455123; ENST00000433091; ENST00000222572 | TSF |
| 2% | chr7 | 95053394 | 95053104 | − | chr7 | 95045609 | 95045554 | − | ENST00000536183; ENST00000455123; ENST00000433091; ENST00000222572 | TSF |
| 2% | chr12 | 58189709 | 58189746 | + | chr12 | 58189960 | 58189980; 58190044; 58190366 | + | ENST00000540550; ENST00000457189; ENST00000454289; ENST00000323833; ENST00000350762 | TSF |
| 2% | chr12 | 58189709 | 58189746 | + | chr12 | 58189960 | 58189980; | + | ENST00000540550; ENST00000457189; | TSF |

TABLE 38-continued

Transcript fusion for Lung Adenocarcinoma (LUAD) Coordinates of the fusion sequences for which the donor is the TE.

| 1 | 2' | 3' | 4' | 5' | 6' | 7' | 8' | 9' | 10 | 11' |
|---|---|---|---|---|---|---|---|---|---|---|
| | | | | | | | 58190044;<br>58190366 | ENST00000454289; ENST00000323833;<br>ENST00000350762 | |
| 2% | chr12 | 58189709 | 58189746 | + | chr12 | 58189960 | 58189980; | + | ENST00000540550; ENST00000457189;<br>ENST00000454289; ENST00000323833;<br>ENST00000350762 | TSF |
| | | | | | | | 58190044;<br>58190366 | | | |
| 2% | chr14 | 70466641 | 70466673 | + | chr14 | 70477471 | 70477663 | + | ENST00000361956; ENST00000381280 | TSF |
| 2% | chr14 | 70466641 | 70466673 | + | chr14 | 70477471 | 70477663 | + | ENST00000361956; ENST00000381280 | TSF |
| 2% | chr10 | 3133726 | 3133857 | + | chr10 | 3141467 | 3141544 | + | ENST00000607886; ENST00000381125;<br>ENST00000381075; ENST00000407806 | TSF |
| 2% | chr10 | 3133726 | 3133857 | + | chr10 | 3141467 | 3141544 | + | ENST00000607886; ENST00000381125;<br>ENST00000381075; ENST00000407806 | TSF |
| 2% | chr10 | 3133726 | 3133857 | + | chr10 | 3141467 | 3141544 | + | ENST00000607886; ENST00000381125;<br>ENST00000381075; ENST00000407806 | TSF |
| 2% | chr10 | 3133726 | 3133857 | + | chr10 | 3141467 | 3141544 | + | ENST00000607886; ENST00000381125;<br>ENST00000381075; ENST00000407806 | TSF |
| 2% | chr7 | 134212336 | 134212386 | + | chr7 | 134215479 | 134215562 | + | ENST00000359579 | TSF |
| 2% | chr2 | 135250933 | 135250213 | − | chr2 | 135223796 | 135223685 | − | ENST00000281924 | TSF |
| 2% | chr7 | 30468250 | 30468120 | − | chr7 | 30465326 | 30465254 | − | ENST00000222823 | TSF |
| 2% | chr17 | 90541 | 90313 | − | chr17 | 69527 | 69414 | − | ENST00000331302; ENST00000323434;<br>ENST00000536489 | TSF |
| 1% | chr7 | 6423751 | 6423803 | + | chr7 | 6426843 | 6426914 | + | ENST00000348035; ENST00000356142 | TSF |
| 1% | chr7 | 6423751 | 6423803 | + | chr7 | 6426843 | 6426914 | + | ENST00000348035; ENST00000356142 | TSF |
| 1% | chr15 | 43431174 | 43431330 | + | chr15 | 43440953 | 43441077 | + | ENST00000564698; ENST00000260403;<br>ENST00000564494 | TSF |
| 1% | chr15 | 43431174 | 43431330 | + | chr15 | 43440953 | 43441077 | + | ENST00000564698; ENST00000260403;<br>ENST00000564494 | TSF |
| 1% | chr15 | 43431174 | 43431330 | + | chr15 | 43440953 | 43441077 | + | ENST00000564698; ENST00000260403;<br>ENST00000564494 | TSF |
| 1% | chr1 | 26595323 | 26595855 | + | chr1 | 26595951 | 26596105 | + | ENST00000451429; ENST00000476272;<br>ENST00000252992; ENST00000453146 | TSF |
| 1% | chr1 | 26595323 | 26595855 | + | chr1 | 26595951 | 26596105 | + | ENST00000451429; ENST00000476272;<br>ENST00000252992; ENST00000453146 | TSF |
| 1% | chr20 | 43561150 | 43561175 | + | chr20 | 43561713 | 43561826 | + | ENST00000255136; ENST00000217073 | TSF |
| 1% | chr2 | 26947307 | 26947428 | + | chr2 | 26950535 | 26951436 | + | ENST00000302909 | TSF |
| 1% | chr10 | 99600727 | 99601513 | + | chr10 | 99619215 | 99619340 | + | ENST00000370602 | TSF |
| 1% | chr20 | 58402976 | 58403213 | + | chr20 | 58411560 | 58411615 | + | ENST00000359926; ENST00000371015;<br>ENST00000395639; ENST00000541461;<br>ENST00000355648; ENST00000361300;<br>ENST00000395636 | TSF |
| 1% | chr7 | 95053394 | 95053140 | − | chr7 | 95045609 | 95045554 | − | ENST00000536183; ENST00000455123;<br>ENST00000433091; ENST00000222572 | TSF |
| 1% | chr7 | 95053394 | 95053140 | − | chr7 | 95045609 | 95045554 | − | ENST00000536183; ENST00000455123;<br>ENST00000433091; ENST00000222572 | TSF |
| 1% | chr7 | 95053394 | 95053140 | − | chr7 | 95045609 | 95045554 | − | ENST00000536183; ENST00000455123;<br>ENST00000433091; ENST00000222572 | TSF |
| 1% | chr10 | 5050548 | 5050220 | − | chr10 | 5043873 | 5043706 | − | ENST00000380753; ENST00000421196;<br>ENST00000407674; ENST00000604507;<br>ENST00000455190 | TSF |
| 1% | chr10 | 5050548 | 5050220 | − | chr10 | 5043873 | 5043706 | − | ENST00000380753; ENST00000421196;<br>ENST00000407674; ENST00000604507;<br>ENST00000455190 | TSF |
| 1% | chr10 | 5050548 | 5050220 | − | chr10 | 5043873 | 5043706 | − | ENST00000380753; ENST00000421196;<br>ENST00000407674; ENST00000604507;<br>ENST00000455190 | TSF |
| 1% | chr10 | 5050548 | 5050220 | − | chr10 | 5043873 | 5043706 | − | ENST00000380753; ENST00000421196;<br>ENST00000407674; ENST00000604507;<br>ENST00000455190 | TSF |
| 1% | chr19 | 50492224 | 50492051 | − | chr19 | 50491749 | 50491625;<br>50491629 | − | ENST00000593919; ENST00000316763;<br>ENST00000377011; ENST00000599538;<br>ENST00000443401; ENST00000601341;<br>ENST00000594948; ENST00000601912;<br>ENST00000594092; ENST00000593912 | TSF |
| 1% | chr19 | 50492224 | 50492051 | − | chr19 | 50491749 | 50491625;<br>50491629 | − | ENST00000593919; ENST00000316763;<br>ENST00000377011; ENST00000599538;<br>ENST00000443401; ENST00000601341;<br>ENST00000594948; ENST00000601912;<br>ENST00000594092; ENST00000593912 | TSF |
| 1% | chr19 | 50492224 | 50492051 | − | chr19 | 50491749 | 50491625;<br>50491629 | − | ENST00000593919; ENST00000316763;<br>ENST00000377011; ENST00000599538;<br>ENST00000443401; ENST00000601341;<br>ENST00000594948; ENST00000601912;<br>ENST00000594092; ENST00000593912 | TSF |
| 1% | chr19 | 50492224 | 50492051 | − | chr19 | 50491749 | 50491625;<br>50491629 | − | ENST00000593919; ENST00000316763;<br>ENST00000377011; ENST00000599538;<br>ENST00000443401; ENST00000601341;<br>ENST00000594948; ENST00000601912; | TSF |

TABLE 38-continued

Transcript fusion for Lung Adenocarcinoma (LUAD) Coordinates of the fusion sequences for which the donor is the TE.

| 1 | 2' | 3' | 4' | 5' | 6' | 7' | 8' | 9' | 10 | 11' |
|---|---|---|---|---|---|---|---|---|---|---|
| 1% | chr10 | 5060345 | 5060092 | − | chr1 | 5043783 | 5043706 | − | ENST00000594092; ENST00000593912 ENST00000380753; ENST00000421196; ENST00000407674; ENST00000604507; ENST00000455190 | TSF |
| 1% | chr10 | 5060345 | 5060092 | − | chr10 | 5043783 | 5043706 | − | ENST00000380753; ENST00000421196; ENST00000407674; ENST00000604507; ENST00000455190 | TSF |
| 1% | chr10 | 5060345 | 5060092 | − | chr10 | 5043783 | 5043706 | − | ENST00000380753; ENST00000421196; ENST00000407674; ENST00000604507; ENST00000455190 | TSF |
| 1% | chr10 | 5060345 | 5060092 | − | chr10 | 5043783 | 5043706 | − | ENST00000380753; ENST00000421196; ENST00000407674; ENST00000604507; ENST00000455190 | TSF |
| 1% | chr14 | 105642036 | 105641815 | − | chr14 | 105639598 | 105639358 | − | ENST00000392568 | TSF |
| 1% | chr5 | 34914125 | 34914032 | − | chr5 | 34913683 | 34913575 | − | ENST00000382038; ENST00000341754 | TSF |
| 1% | chr4 | 39516601 | 39516533 | − | chr4 | 39515804 | 39515703; 39515713 | − | ENST00000316423; ENST00000501493; ENST00000506179; ENST00000515021; ENST00000514106; ENST00000509391; ENST00000505698 | TSF |
| 1% | chr4 | 39516601 | 39516533 | − | chr4 | 39515804 | 39515703; 39515713 | − | ENST00000316423; ENST00000501493; ENST00000506179; ENST00000515021; ENST00000514106; ENST00000509391; ENST00000505698 | TSF |
| 1% | chr4 | 39516601 | 39516533 | − | chr4 | 39515804 | 39515703; 39515713 | − | ENST00000316423; ENST00000501493; ENST00000506179; ENST00000515021; ENST00000514106; ENST00000509391; ENST00000505698 | TSF |
| 1% | chr4 | 39516601 | 39516533 | − | chr4 | 39515804 | 39515703; 39515713 | − | ENST00000316423; ENST00000501493; ENST00000506179; ENST00000515021; ENST00000514106; ENST00000509391; ENST00000505698 | TSF |
| 1% | chr4 | 39516601 | 39516533 | − | chr4 | 39515804 | 39515703; 39515713 | − | ENST00000316423; ENST00000501493; ENST00000506179; ENST00000515021; ENST00000514106; ENST00000509391; ENST00000505698 | TSF |
| 1% | chr4 | 39516601 | 39516533 | − | chr4 | 39515804 | 39515703; 39515713 | − | ENST00000316423; ENST00000501493; ENST00000506179; ENST00000515021; ENST00000514106; ENST00000509391; ENST00000505698 | TSF |
| 1% | chr20 | 44442461 | 44442685 | + | chr20 | 44443023 | 44443109 | + | ENST00000356455; ENST00000405520; ENST00000335046; ENST00000372568 | TSF |
| 1% | chr20 | 44442461 | 44442685 | + | chr20 | 44443023 | 44443109 | + | ENST00000356455; ENST00000405520; ENST00000335046; ENST00000372568 | TSF |
| 1% | chr17 | 66244121 | 66244199 | + | chr17 | 66244785 | 66244846 | + | ENST00000584837 | TSF |
| 1% | chr17 | 17051276 | 17051346 | + | chr17 | 17053458 | 17053547 | + | ENST00000395811; ENST00000444976; ENST00000395804; ENST00000341712; ENST00000584067 | TSF |
| 1% | chr17 | 17051276 | 17051346 | + | chr17 | 17053458 | 17053547 | + | ENST00000395811; ENST00000444976; ENST00000395804; ENST00000341712; ENST00000584067 | TSF |
| 1% | chr2 | 90168849 | 90168893 | + | chr2 | 90193334 | 90193424 | + | ENST00000390275 | TSF |
| 1% | chr19 | 50174724 | 50174836 | + | chr19 | 50176955 | 50177005; 50177034 | + | ENST00000441864; ENST00000246785; ENST00000598306; ENST00000600947 | TSF |
| 1% | chr19 | 50174724 | 50174836 | + | chr19 | 50176955 | 50177005; 50177034 | + | ENST00000441864; ENST00000246785; ENST00000598306; ENST00000600947 | TSF |
| 1% | chr11 | 85339945 | 85340247 | + | chr11 | 85342731 | 85342852 | + | ENST00000358867; ENST00000534341 | TSF |
| 1% | chr11 | 85339945 | 85340247 | + | chr1 | 85342731 | 85342852 | + | ENST00000358867; ENST00000534341 | TSF |
| 1% | chr19 | 17421511 | 17421655 | + | chr19 | 17424832 | 17424912 | + | ENST00000593466; ENST00000359866; ENST00000596582 | TSF |
| 1% | chr3 | 32323981 | 32324151 | + | chr3 | 32398865 | 32399038 | + | ENST00000307526 | TSF |
| 1% | chrX | 107265928 | 107266261 | + | chrX | 107301268 | 107301431 | + | ENST00000415430; ENST00000217957; ENST00000458383 | TSF |
| 1% | chrX | 107265928 | 107266261 | + | chrX | 107301268 | 107301431 | + | ENST00000415430; ENST00000217957; ENST00000458383 | TSF |
| 1% | chrX | 107265928 | 107266261 | + | chrX | 107301268 | 107301431 | + | ENST00000415430; ENST00000217957; ENST00000458383 | TSF |
| 1% | chr2 | 143715736 | 143715823 | + | chr2 | 143718193 | 143718339 | + | ENST00000264170; ENST00000375773; ENST00000409512 | TSF |
| 1% | chr2 | 143715736 | 143715823 | + | chr2 | 143718193 | 143718339 | + | ENST00000264170; ENST00000375773; ENST00000409512 | TSF |
| 1% | chr8 | 98817265 | 98817331 | + | chr8 | 98817581 | 98817692 | + | ENST00000445593; ENST00000521545; ENST00000517924 | TSF |
| 1% | chr8 | 98817265 | 98817331 | + | chr8 | 98817581 | 98817692 | + | ENST00000445593; ENST00000521545; ENST00000517924 | TSF |
| 1% | chr17 | 45698288 | 45698367 | + | chr17 | 45699134 | 45699286 | + | ENST00000530173; ENST00000322157; ENST00000544660; ENST00000528565 | TSF |

TABLE 38-continued

Transcript fusion for Lung Adenocarcinoma (LUAD) Coordinates of the fusion sequences for which the donor is the TE.

| 1 | 2' | 3' | 4' | 5' | 6' | 7' | 8' | 9' | 10 | 11' |
|---|---|---|---|---|---|---|---|---|---|---|
| 1% | chr4 | 40352026 | 40352049 | + | chr4 | 40355996 | 40356537 | + | ENST00000310169 | TSF |
| 1% | chr21 | 39513161 | 39513404 | + | chr21 | 39528398 | 39528496 | + | ENST00000357704; ENST00000400477 | TSF |
| 1% | chr8 | 63314966 | 63315263 | + | chr8 | 63492098 | 63492235 | + | ENST00000523211; ENST00000524201; ENST00000328472 | TSF |
| 1% | chr8 | 63314966 | 63315263 | + | chr8 | 63492098 | 63492235 | + | ENST00000523211; ENST00000524201; ENST00000328472 | TSF |
| 1% | chr12 | 8864869 | 8864879 | + | chr12 | 8866407 | 8866637 | + | ENST00000537189 | TSF |
| 1% | chr7 | 65418154 | 65418399 | + | chr7 | 65419061 | 65419287; 65419400 | + | ENST00000360768; ENST00000434382 | TSF |
| 1% | chr7 | 65418154 | 65418399 | + | chr7 | 65419061 | 65419287; 65419400 | + | ENST00000360768; ENST00000434382 | TSF |
| 1% | chr4 | 186461046 | 186460994 | − | chr22 | 23243156 | 23243475 | + | ENST00000390323 | TSF |
| 1% | chr8 | 140818443 | 140818376 | − | chr8 | 140744445 | 140744222 | − | ENST00000389327; ENST00000389328; ENST00000520857; ENST00000438773 | TSF |
| 1% | chr6 | 39268199 | 39268149 | − | chr6 | 39267513 | 39267203 | − | ENST00000373231 | TSF |
| 1% | chr20 | 25841506 | 25840376 | − | chr20 | 25755948 | 25755497; 25755659 | − | ENST00000376403; ENST00000584071 | TSF |
| 1% | chr20 | 25841506 | 25840376 | − | chr20 | 25755948 | 25755497; 25755659 | − | ENST00000376403; ENST00000584071 | TSF |
| 1% | chr4 | 57560508 | 57559925 | − | chr4 | 57522178 | 57522023; 57522025 | − | ENST00000420433; ENST00000554144; ENST00000508121; ENST00000557328 | TSF |
| 1% | chr4 | 57560508 | 57559925 | − | chr4 | 57522178 | 57522023; 57522025 | − | ENST00000420433; ENST00000554144; ENST00000508121; ENST00000557328 | TSF |
| 1% | chr4 | 57560508 | 57559925 | − | chr4 | 57522178 | 57522023; 57522025 | − | ENST00000420433; ENST00000554144; ENST00000508121; ENST00000557328 | TSF |
| 1% | chr20 | 25843181 | 25842039 | − | chr20 | 25755948 | 25755497; 25755659 | − | ENST00000376403; ENST00000584071 | TSF |
| 1% | chr20 | 25843181 | 25842039 | − | chr20 | 25755948 | 25755497; 25755659 | − | ENST00000376403; ENST00000584071 | TSF |
| 1% | chr19 | 46194689 | 46194670 | − | chr19 | 46191824 | 46191645 | − | ENST00000342669; ENST00000588301; ENST00000590212 | TSF |
| 1% | chr19 | 46194689 | 46194670 | − | chr19 | 46191824 | 46191645 | − | ENST00000342669; ENST00000588301; ENST00000590212 | TSF |
| 1% | chr21 | 38273278 | 38272892 | − | chr21 | 38269431 | 38269160 | − | ENST00000336648; ENST00000399120 | TSF |
| 1% | chr4 | 162586244 | 162585968 | − | chr4 | 162577646 | 162577480 | − | ENST00000306100; ENST00000379164; ENST00000536695; ENST00000427802 | TSF |
| 1% | chr4 | 162586244 | 162585968 | − | chr4 | 162577646 | 162577480 | − | ENST00000306100; ENST00000379164; ENST00000536695; ENST00000427802 | TSF |
| 1% | chr20 | 25844836 | 25843696 | − | chr20 | 25755948 | 25755497; 25755659 | − | ENST00000376403; ENST00000584071 | TSF |
| 1% | chr20 | 25844836 | 25843696 | − | chr20 | 25755948 | 25755497; 25755659 | − | ENST00000376403; ENST00000584071 | TSF |
| 1% | chrX | 138072952 | 138072670 | − | chrX | 137939841 | 137939674 | − | ENST00000370603; ENST00000436198; ENST00000455663; ENST00000448673 | TSF |
| 1% | chrX | 138072952 | 138072670 | − | chrX | 137939841 | 137939674 | − | ENST00000370603; ENST00000436198; ENST00000455663; ENST00000448673 | TSF |
| 1% | chrX | 138072952 | 138072670 | − | chrX | 137939841 | 137939674 | − | ENST00000370603; ENST00000436198; ENST00000455663; ENST00000448673 | TSF |
| 1% | chrX | 138072952 | 138072670 | − | chrX | 137939841 | 137939674 | − | ENST00000370603; ENST00000436198; ENST00000455663; ENST00000448673 | TSF |
| 1% | chr2 | 97561135 | 97560977 | − | chr2 | 97559788 | 97559663 | − | ENST00000327896; ENST00000417561; ENST00000490605 | TSF |
| 1% | chr11 | 60934781 | 60933962 | − | chr11 | 60901679 | 60901508 | − | ENST00000301765; ENST00000538036 | TSF |
| 1% | chr11 | 60934781 | 60933962 | − | chr11 | 60901679 | 60901508 | − | ENST00000301765; ENST00000538036 | TSF |
| 1% | chr9 | 130929922 | 130929818 | − | chr9 | 130929443 | 130929374 | − | ENST00000372954; ENST00000393608; ENST00000541172; ENST00000325721; ENST00000357558; ENST00000538431; ENST00000277465; ENST00000372948; ENST00000372938; ENST00000415526 | TSF |
| 1% | chr10 | 5060345 | 5060040 | − | chr10 | 5043873 | 5043706 | − | ENST00000380753; ENST00000421196; ENST00000407674; ENST00000604507; ENST00000455190 | TSF |
| 1% | chr10 | 5060345 | 5060040 | − | chr10 | 5043873 | 5043706 | − | ENST00000380753; ENST00000421196; ENST00000407674; ENST00000604507; ENST00000455190 | TSF |
| 1% | chr10 | 5060345 | 5060040 | − | chr10 | 5043873 | 5043706 | − | ENST00000380753; ENST00000421196; ENST00000407674; ENST00000604507; ENST00000455190 | TSF |
| 1% | chr10 | 5060345 | 5060040 | − | chr10 | 5043873 | 5043706 | − | ENST00000380753; ENST00000421196; ENST00000407674; ENST00000604507; ENST00000455190 | TSF |
| 1% | chr1 | 156305455 | 156305264 | − | chr1 | 156304709 | 156304659 | − | ENST00000295688; ENST00000368258; ENST00000413555; ENST00000496684; ENST00000478640; ENST00000415548 | TSF |
| 1% | chr1 | 156305455 | 156305264 | − | chr1 | 156304709 | 156304659 | − | ENST00000295688; ENST00000368258; ENST00000413555; ENST00000496684; | TSF |

TABLE 38-continued

Transcript fusion for Lung Adenocarcinoma (LUAD) Coordinates of the fusion sequences for which the donor is the TE.

| 1 | 2' | 3' | 4' | 5' | 6' | 7' | 8' | 9' | 10 | 11' |
|---|---|---|---|---|---|---|---|---|---|---|
| 1% | chr1 | 156305455 | 156305264 | − | chr1 | 156304709 | 156304659 | − | ENST00000478640; ENST00000415548 ENST00000295688; ENST00000368258; ENST00000413555; ENST00000496684; | TSF |
| 1% | chr1 | 156305455 | 156305264 | − | chr1 | 156304709 | 156304659 | − | ENST00000478640; ENST00000415548 ENST00000295688; ENST00000368258; ENST00000413555; ENST00000496684; | TSF |
| 1% | chr1 | 156305455 | 156305264 | − | chr1 | 156304709 | 156304659 | − | ENST00000478640; ENST00000415548 ENST00000295688; ENST00000368258; ENST00000413555; ENST00000496684; | TSF |
| 1% | chr1 | 156305455 | 156305264 | − | chr1 | 156304709 | 156304659 | − | ENST00000478640; ENST00000415548 ENST00000295688; ENST00000368258; ENST00000413555; ENST00000496684; | TSF |

TABLE 39

Transcript fusion for Lung Squamous Cell Carcinoma (LUSC) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 49% | chr12 | 71509738 | 71509630 | − | ENST00000549357 | chr12 | 71504233 | 71503634 | − | TAF |
| 31% | chr10 | 5040939 | 5040817 | − | ENST00000380753; ENST00000421196; ENST00000407674; ENST00000604507 | chr10 | 5002427 | 5002117 | − | TAF |
| 31% | chr10 | 5040939 | 5040817 | − | ENST00000380753; ENST00000421196; ENST00000407674; ENST00000604507 | chr10 | 5002427 | 5002117 | − | TAF |
| 27% | chr5 | 54993786 | 54993674 | − | ENST00000396865; ENST00000539768; ENST00000318672; ENST00000508124; ENST00000511233; ENST00000503891; ENST00000513993; ENST00000505563; ENST00000506624; ENST00000507109 | chr5 | 54993040 | 54992544 | − | TSF |
| 26% | chr3 | 118943092 | 118942905 | − | ENST00000483209; ENST00000467604; ENST00000359213; ENST00000393765; ENST00000480814 | chr3 | 118938512 | 118938188 | − | TAF |
| 23% | chr3 | 196230044 | 196229744 | − | ENST00000318037; ENST00000437070 | chr3 | 196223342 | 196223041 | − | TAF |
| 22% | chrX | 152864474 | 152864420 | − | ENST00000406277 | chrX | 152863164 | 152862704 | − | TAF |
| 20% | chr3 | 182566264 | 182566345 | + | ENST00000323116; ENST00000498086 | chr3 | 182566968 | 182567869 | + | TAF |
| 20% | chr3 | 182566264 | 182566345 | + | ENST00000323116; ENST00000498086 | chr3 | 182566968 | 182567869 | + | TAF |
| 19% | chr10 | 47747112 | 47747132 | + | ENST00000340243; ENST00000374277; ENST00000449464; ENST00000538825 | chr10 | 48278725 | 48278896 | + | TAF |
| 15% | chr1 | 153534067 | 153533988 | − | ENST00000368708; ENST00000487430; ENST00000497140; ENST00000368710; ENST00000368709 | chr1 | 153532853 | 153532704 | − | TAF |
| 15% | chr1 | 153534067 | 153533988 | − | ENST00000368708; ENST00000487430; ENST00000497140; ENST00000368710; ENST00000368709 | chr1 | 153532853 | 153532704 | − | TAF |
| 14% | chr7 | 4026818 | 4026954 | + | ENST00000404826; ENST00000389531 | chr7 | 4027977 | 4028157 | + | TAF |
| 14% | chr20 | 35842163 | 35842268 | + | ENST00000237530; ENST00000373622 | chr20 | 35844460 | 35844765 | + | TAF |
| 14% | chr20 | 35842163 | 35842268 | + | ENST00000237530; ENST00000373622 | chr20 | 35844460 | 35844765 | + | TAF |
| 14% | chrX | 41598709 | 41598637 | − | ENST00000421587; ENST00000318588; ENST00000361962; ENST00000378163; ENST00000378158; ENST00000378166; ENST00000442742; ENST00000378154 | chrX | 41557348 | 41557057 | − | TSF |
| 13% | chr19 | 35612126 | 35612149 | + | ENST00000454903; ENST00000406242; ENST00000604404; ENST00000435734; ENST00000603181; ENST00000604255; ENST00000344013; ENST00000346446; ENST00000603449; ENST00000406988; ENST00000605550; ENST00000604804; ENST00000605552; ENST00000535103; ENST00000603524; ENST00000604621; ENST00000605677 | chr19 | 35613565 | 35613610 | + | TAF |
| 13% | chr19 | 35612126 | 35612149 | + | ENST00000454903; ENST00000406242; ENST00000604404; ENST00000435734; ENST00000603181; ENST00000604255; ENST00000344013; ENST00000346446; ENST00000603449; ENST00000406988; ENST00000605550; ENST00000604804; ENST00000605552; ENST00000535103; ENST00000603524; ENST00000604621; ENST00000605677 | chr19 | 35613565 | 35613610 | + | TAF |
| 13% | chr14 | 104040444 | 104040507 | + | ENST00000409074; ENST00000472726; ENST00000556253; ENST00000247618; | chr14 | 104051201 | 104051490 | + | TAF |

TABLE 39-continued

Transcript fusion for Lung Squamous Cell Carcinoma (LUSC) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|----|----|
| 13% | chr14 | 104040444 | 104040507 | + | ENST00000495778 ENST00000409074; ENST00000472726; ENST00000556253; ENST00000247618; | chr14 | 104051201 | 104051490 | + | TAF |
| 13% | chr14 | 104040444 | 104040507 | + | ENST00000495778 ENST00000409074; ENST00000472726; ENST00000556253; ENST00000247618; ENST00000495778 | chr14 | 104051201 | 104051490 | + | TAF |
| 13% | chr7 | 81964567 | 81964451 | − | ENST00000356860; ENST00000356253; ENST00000423588 | chr7 | 81929467 | 81929190 | − | TSF |
| 12% | chr9 | 33001602; 33001577 | 33001565 | − | ENST00000379825; ENST00000309615; ENST00000397172; ENST00000379819; ENST00000474658; ENST00000476858; ENST00000379812; ENST00000473221; ENST00000464632; ENST00000478279 | chr9 | 32997346 | 32997346 | − | TAF |
| 12% | chr9 | 33001602; 33001577 | 33001565 | − | ENST00000379825; ENST00000309615; ENST00000397172; ENST00000379819; ENST00000474658; ENST00000476858; ENST00000379812; ENST00000473221; ENST00000464632; ENST00000478279 | chr9 | 32997346 | 32997346 | − | TAF |
| 12% | chr6 | 139363856 | 139363999 | + | ENST00000367660 | chr6 | 139372258 | 139372516 | + | TAF |
| 11% | chr3 | 182804576; 182804522; 182804572 | 182804481 | − | ENST00000265594; ENST00000492597; ENST00000497959; ENST00000476176 | chr3 | 182797071 | 182796912 | − | TAF |
| 11% | chr3 | 182804576; 182804522; 182804572 | 182804481 | − | ENST00000265594; ENST00000492597; ENST00000497959; ENST00000476176 | chr3 | 182797071 | 182796912 | − | TAF |
| 11% | chr3 | 182804576; 182804522; 182804572 | 182804481 | − | ENST00000265594; ENST00000492597; ENST00000497959; ENST00000476176 | chr3 | 182797071 | 182796912 | − | TAF |
| 11% | chr3 | 182804576; 182804522; 182804572 | 182804481 | − | ENST00000265594; ENST00000492597; ENST00000497959; ENST00000476176 | chr3 | 182797071 | 182796912 | − | TAF |
| 11% | chr12 | 64833024 | 64833095 | + | ENST00000332707 | chr12 | 64833417 | 64833459 | + | TAF |
| 10% | chr5 | 1802435 | 1802488 | + | ENST00000274137; ENST00000469176 | chr5 | 1811023 | 1811428 | + | TAF |
| 10% | chr4 | 57319769 | 57319927 | + | ENST00000514888; ENST00000264221; ENST00000505164; ENST00000399688; ENST00000512576 | chr4 | 57321183 | 57321327 | + | TSF |
| 10% | chr4 | 57319769 | 57319927 | + | ENST00000514888; ENST00000264221; ENST00000505164; ENST00000399688; ENST00000512576 | chr4 | 57321183 | 57321327 | + | TSF |
| 10% | chr4 | 57319769 | 57319927 | + | ENST00000514888; ENST00000264221; ENST00000505164; ENST00000399688; ENST00000512576 | chr4 | 57321183 | 57321327 | + | TSF |
| 9% | chr3 | 137906397; 137906427 | 137906441 | + | ENST00000469044; ENST00000461600; ENST00000461822; ENST00000470821; ENST00000471709; ENST00000393058; ENST00000538260; ENST00000463485 | chr3 | 137907243 | 137907252 | + | TSF |
| 9% | chr3 | 137906397; 137906427 | 137906441 | + | ENST00000469044; ENST00000461600; ENST00000461822; ENST00000470821; ENST00000471709; ENST00000393058; ENST00000538260; ENST00000463485 | chr3 | 137907243 | 137907252 | + | TSF |
| 7% | chr16 | 16149949 | 16150152 | + | ENST00000399410; ENST00000345148; ENST00000346370; ENST00000349029; ENST00000351154; ENST00000399408; ENST00000572882 | chr16 | 16151288 | 16151380 | + | TSF |
| 7% | chr16 | 16149949 | 16150152 | + | ENST00000399410; ENST00000345148; ENST00000346370; ENST00000349029; ENST00000351154; ENST00000399408; ENST00000572882 | chr16 | 16151288 | 16151380 | + | TSF |
| 7% | chr12 | 102547647 | 102547754 | + | ENST00000327680; ENST00000378128; ENST00000541394; ENST00000358383; ENST00000392911; ENST00000412715; ENST00000417507; ENST00000457614 | chr12 | 102548605 | 102548938 | + | TSF |
| 7% | chr12 | 102547647 | 102547754 | + | ENST00000327680; ENST00000378128; ENST00000541394; ENST00000358383; ENST00000392911; ENST00000412715; ENST00000417507; ENST00000457614 | chr12 | 102548605 | 102548938 | + | TSF |
| 7% | chr12 | 102547647 | 102547754 | + | ENST00000327680; ENST00000378128; ENST00000541394; ENST00000358383; ENST00000392911; ENST00000412715; ENST00000417507; ENST00000457614 | chr12 | 102548605 | 102548938 | + | TSF |
| 7% | chr12 | 102547647 | 102547754 | + | ENST00000327680; ENST00000378128; ENST00000541394; ENST00000358383; ENST00000392911; ENST00000412715; ENST00000417507; ENST00000457614 | chr12 | 102548605 | 102548938 | + | TSF |

TABLE 39-continued

Transcript fusion for Lung Squamous Cell Carcinoma (LUSC) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| | | | | | ENST00000541394; ENST00000358383; ENST00000392911; ENST00000412715; ENST00000417507; ENST00000457614 | | | | | |
| 7% | chr12 | 102547647 | 102547754 | + | ENST00000327680; ENST00000378128; ENST00000541394; ENST00000358383; ENST00000392911; ENST00000412715; ENST00000417507; ENST00000457614 | chr12 | 102548605 | 102548938 | + | TSF |
| 6% | chr3 | 185414451 | 185414400 | − | ENST00000382199; ENST00000421047; ENST00000457616; ENST00000346192 | chr3 | 185411016 | 185410789 | − | TSF |
| 6% | chr3 | 185414451 | 185414400 | − | ENST00000382199; ENST00000421047; ENST00000457616; ENST00000346192 | chr3 | 185411016 | 185410789 | − | TSF |
| 6% | chr1 | 225156461 | 225156576 | + | ENST00000430092; ENST00000400952; ENST00000366849; ENST00000439375 | chr1 | 225157336 | 225158402 | + | TSF |
| 6% | chr1 | 225156461 | 225156576 | + | ENST00000430092; ENST00000400952; ENST00000366849; ENST00000439375 | chr1 | 225157336 | 225158402 | + | TSF |
| 6% | chr22 | 35819207 | 35819334 | + | ENST00000216122; ENST00000382011 | chr22 | 35846150 | 35846200 | + | TSF |
| 6% | chr22 | 35819207 | 35819334 | + | ENST00000216122; ENST00000382011 | chr22 | 35846150 | 35846200 | + | TSF |
| 6% | chr7 | 22532348 | 22532184 | − | ENST00000406890; ENST00000404369; ENST00000424363 | chr7 | 22512853 | 22512669 | − | TSF |
| 6% | chr7 | 22532348 | 22532184 | − | ENST00000406890; ENST00000404369; ENST00000424363 | chr7 | 22512853 | 22512669 | − | TSF |
| 5% | chr12 | 86272123 | 86272347 | + | ENST00000256010 | chr12 | 86274455 | 86274746 | + | TSF |
| 5% | chr5 | 1802435 | 1802488 | + | ENST00000274137; ENST0000469176 | chr5 | 1811082 | 1811428 | + | TSF |
| 5% | chr2 | 176860312; 176860292 | 176860286 | − | ENST00000272748; ENST00000544803; ENST00000392540; ENST00000445472 | chr2 | 176859008 | 176858934 | − | TSF |
| 5% | chr2 | 176860312; 176860292 | 176860286 | − | ENST00000272748; ENST00000544803; ENST00000392540; ENST00000445472 | chr2 | 176859008 | 176858934 | − | TSF |
| 5% | chr8 | 42924698; 42924750 | 42924802 | + | ENST00000534420; ENST00000302279; ENST00000533998; ENST00000342116; ENST00000531266; ENST00000525699; ENST00000529687; ENST00000533336 | chr8 | 42925245 | 42925476 | + | TSF |
| 5% | chr8 | 42924698; 42924750 | 42924802 | + | ENST00000534420; ENST00000302279; ENST00000533998; ENST00000342116; ENST00000531266; ENST00000525699; ENST00000529687; ENST00000533336 | chr8 | 42925245 | 42925476 | + | TSF |
| 5% | chr8 | 42924698; 42924750 | 42924802 | + | ENST00000534420; ENST00000302279; ENST00000533998; ENST00000342116; ENST00000531266; ENST00000525699; ENST00000529687; ENST00000533336 | chr8 | 42925245 | 42925476 | + | TSF |
| 5% | chr8 | 42924698; 42924750 | 42924802 | + | ENST00000534420; ENST00000302279; ENST00000533998; ENST00000342116; ENST00000531266; ENST00000525699; ENST00000529687; ENST00000533336 | chr8 | 42925245 | 42925476 | + | TSF |
| 5% | chr8 | 42924698; 42924750 | 42924802 | + | ENST00000534420; ENST00000302279; ENST00000533998; ENST00000342116; ENST00000531266; ENST00000525699; ENST00000529687; ENST00000533336 | chr8 | 42925245 | 42925476 | + | TSF |
| 5% | chr8 | 42924698; 42924750 | 42924802 | + | ENST00000534420; ENST00000302279; ENST00000533998; ENST00000342116; ENST00000531266; ENST00000525699; ENST00000529687; ENST00000533336 | chr8 | 42925245 | 42925476 | + | TSF |
| 5% | chr12 | 71509738 | 71509630 | − | ENST00000549357 | chr12 | 71507025 | 71506982 | − | TSF |
| 5% | chr1 | 234546277 | 234546191 | − | ENST00000040877 | chr1 | 234545319 | 234545287 | − | TSF |
| 4% | chr1 | 63955889 | 63955754 | − | ENST00000371092; ENST00000271002; ENST00000489099; ENST00000283568 | chr1 | 63952444 | 63951983 | − | TSF |
| 4% | chr1 | 63955889 | 63955754 | − | ENST00000371092; ENST00000271002; ENST00000489099; ENST00000283568 | chr1 | 63952444 | 63951983 | − | TSF |
| 4% | chr3 | 190030825 | 190030661 | − | ENST00000295522 | chr3 | 190030018 | 190029730 | − | TSF |
| 4% | chr7 | 55270210 | 55270401 | + | ENST00000455089 | chr7 | 55272949 | 55272949 | + | TSF |
| 4% | chr20 | 29632611 | 29632721 | + | ENST00000278882; ENST00000358464 | chr20 | 29652086 | 29652324 | + | TSF |
| 4% | chr7 | 95668589 | 95668733 | + | ENST00000447467; ENST00000324972; ENST00000537881; ENST00000437599; ENST00000359388; ENST00000457059 | chr7 | 95670774 | 95671058 | + | TSF |
| 4% | chr7 | 95668589 | 95668733 | + | ENST00000447467; ENST00000324972; ENST00000537881; ENST00000437599; ENST00000359388; | chr7 | 95670774 | 95671058 | + | TSF |

TABLE 39-continued

Transcript fusion for Lung Squamous Cell Carcinoma (LUSC) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 4% | chr7 | 95668589 | 95668733 | + | ENST00000457059 ENST00000447467; ENST00000324972; ENST00000537881; ENST00000437599; ENST00000359388; | chr7 | 95670774 | 95671058 | + | TSF |
| 4% | chr7 | 95668589 | 95668733 | + | ENST00000457059 ENST00000447467; ENST00000324972; ENST00000537881; ENST00000437599; ENST00000359388; | chr7 | 95670774 | 95671058 | + | TSF |
| 4% | chr5 | 80769589 | 80769519 | − | ENST00000457059 ENST00000320672; ENST00000509053; ENST00000514493; ENST00000504985; ENST00000512923; ENST00000505980; ENST00000515395; ENST00000509013 | chr5 | 80769370 | 80769065 | − | TSF |
| 4% | chr5 | 80769589 | 80769519 | − | ENST00000320672; ENST00000509053; ENST00000514493; ENST00000504985; ENST00000512923; ENST00000505980; ENST00000515395; ENST00000509013 | chr5 | 80769370 | 80769065 | − | TSF |
| 4% | chr5 | 80769589 | 80769519 | − | ENST00000320672; ENST00000509053; ENST00000514493; ENST00000504985; ENST00000512923; ENST00000505980; ENST00000515395; ENST00000509013 | chr5 | 80769370 | 80769065 | − | TSF |
| 4% | chr5 | 80769589 | 80769519 | − | ENST00000320672; ENST00000509053; ENST00000514493; ENST00000504985; ENST00000512923; ENST00000505980; ENST00000515395; ENST00000509013 | chr5 | 80769370 | 80769065 | − | TSF |
| 4% | chr5 | 80769589 | 80769519 | − | ENST00000320672; ENST00000509053; ENST00000514493; ENST00000504985; ENST00000512923; ENST00000505980; ENST00000515395; ENST00000509013 | chr5 | 80769370 | 80769065 | − | TSF |
| 3% | chr8 | 109468102 | 109468159 | + | ENST00000220853; ENST00000519642 | chr8 | 109468381 | 109468590 | + | TSF |
| 3% | chr8 | 109468102 | 109468159 | + | ENST00000220853; ENST00000519642 | chr8 | 109468381 | 109468590 | + | TSF |
| 3% | chr9 | 125054028 | 125054119 | + | ENST00000297908; ENST00000344641; ENST00000373723; ENST00000373729; ENST00000394315 | chr9 | 125068067 | 125068171 | + | TSF |
| 3% | chr9 | 125054028 | 125054119 | + | ENST00000297908; ENST00000344641; ENST00000373723; ENST00000373729; ENST00000394315 | chr9 | 125068067 | 125068171 | + | TSF |
| 3% | chr9 | 125054028 | 125054119 | + | ENST00000297908; ENST00000344641; ENST00000373723; ENST00000373729; ENST00000394315 | chr9 | 125068067 | 125068171 | + | TSF |
| 3% | chr19 | 15289752 | 15289634 | − | ENST00000263388; ENST00000601011 | chr19 | 15289244 | 15289201 | − | TSF |
| 3% | chr19 | 15289752 | 15289634 | − | ENST00000263388; ENST00000601011 | chr19 | 15289244 | 15289201 | − | TSF |
| 3% | chr2 | 89160434 | 89160398 | − | ENST00000390239 | chr2 | 89129384 | 89129304 | − | TSF |
| 3% | chr6 | 84772612 | 84772711 | + | ENST00000257776 | chr6 | 84775517 | 84775723 | + | TSF |
| 3% | chr20 | 3614958 | 3615036 | + | ENST00000262919 | chr20 | 3615708 | 3616042 | + | TSF |
| 3% | chr12 | 58024115 | 58023935 | − | ENST00000341156; ENST00000418555; ENST00000552798; ENST00000549391; ENST00000449184; ENST00000550764; ENST00000552350; ENST00000548888 | chr12 | 58023079 | 58022983 | − | TSF |
| 3% | chr12 | 58024115 | 58023935 | − | ENST00000341156; ENST00000418555; ENST00000552798; ENST00000549391; ENST00000449184; ENST00000550764; ENST00000552350; ENST00000548888 | chr12 | 58023079 | 58022983 | − | TSF |
| 3% | chr12 | 58024115 | 58023935 | − | ENST00000341156; ENST00000418555; ENST00000552798; ENST00000549391; ENST00000449184; ENST00000550764; ENST00000552350; ENST00000548888 | chr12 | 58023079 | 58022983 | − | TSF |
| 3% | chr12 | 58024115 | 58023935 | − | ENST00000341156; ENST00000418555; ENST00000552798; ENST00000549391; ENST00000449184; ENST00000550764; ENST00000552350; ENST00000548888 | chr12 | 58023079 | 58022983 | − | TSF |
| 3% | chr19 | 46627413 | 46627143 | − | ENST00000341415 | chr19 | 46623577 | 46622963 | − | TSF |
| 3% | chr7 | 23300075 | 23300392 | + | ENST00000258733; ENST00000381990; ENST00000539136; ENST00000453162 | chr7 | 23300981 | 23301414 | + | TSF |
| 3% | chr7 | 23300075 | 23300392 | + | ENST00000258733; ENST00000381990; ENST00000539136; ENST00000453162 | chr7 | 23300981 | 23301414 | + | TSF |

TABLE 39-continued

Transcript fusion for Lung Squamous Cell Carcinoma (LUSC) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 3% | chr7 | 23300075 | 23300392 | + | ENST00000258733; ENST00000381990; ENST00000539136; ENST00000453162 | chr7 | 23300981 | 23301414 | + | TSF |
| 3% | chr1 | 11115983; 11115877 | 11115838 | − | ENST00000376957; ENST00000490101 | chr1 | 11115464 | 11115178 | − | TSF |
| 3% | chr1 | 11115983; 11115877 | 11115838 | − | ENST00000376957; ENST00000490101 | chr1 | 11115464 | 11115178 | − | TSF |
| 3% | chr12 | 113403549; 113403702 | 113403834 | + | ENST00000228928; ENST00000546973 | chr12 | 113404028 | 113404051 | + | TSF |
| 3% | chr12 | 113403549; 113403702 | 113403834 | + | ENST00000228928; ENST00000546973 | chr12 | 113404028 | 113404051 | + | TSF |
| 3% | chr20 | 60578330 | 60578216 | − | ENST00000252996; ENST00000488539 | chr20 | 60576919 | 60576839 | − | TSF |
| 3% | chr20 | 60578330 | 60578216 | − | ENST00000252996; ENST00000488539 | chr20 | 60576919 | 60576839 | − | TSF |
| 3% | chr1 | 180283857 | 180283827 | − | ENST00000367595 | chr1 | 180281457 | 180281103 | − | TSF |
| 3% | chr16 | 16381600 | 16381719 | + | ENST00000399336; ENST00000263012; ENST00000538468 | chr16 | 16382422 | 16382605 | + | TSF |
| 3% | chr16 | 16381600 | 16381719 | + | ENST00000399336; ENST00000263012; ENST00000538468 | chr16 | 16382422 | 16382605 | + | TSF |
| 3% | chrX | 119708472 | 119708406 | − | ENST00000404115 | chrX | 119705855 | 119705820 | − | TSF |
| 3% | chr6 | 37611719 | 37611585 | − | ENST00000297153; ENST00000434837; ENST00000505425; ENST00000418178 | chr6 | 37611139 | 37611040 | − | TSF |
| 3% | chr6 | 37611719 | 37611585 | − | ENST00000297153; ENST00000434837; ENST00000505425; ENST00000418178 | chr6 | 37611139 | 37611040 | − | TSF |
| 3% | chr6 | 37611719 | 37611585 | − | ENST00000297153; ENST00000434837; ENST00000505425; ENST00000418178 | chr6 | 37611139 | 37611040 | − | TSF |
| 3% | chr1 | 6531697 | 6531548 | − | ENST00000400913; ENST00000340850; ENST00000377748; ENST00000377725; ENST00000377728; ENST00000377732; ENST00000400915; ENST00000377740; ENST00000535355; ENST00000377737; ENST00000537245; ENST00000544978 | chr1 | 6531300 | 6531188 | − | TSF |
| 3% | chr1 | 6531697 | 6531548 | − | ENST00000400913; ENST00000340850; ENST00000377748; ENST00000377725; ENST00000377728; ENST00000377732; ENST00000400915; ENST00000377740; ENST00000535355; ENST00000377737; ENST00000537245; ENST00000544978 | chr1 | 6531300 | 6531188 | − | TSF |
| 3% | chr1 | 6531697 | 6531548 | − | ENST00000400913; ENST00000340850; ENST00000377748; ENST00000377725; ENST00000377728; ENST00000377732; ENST00000400915; ENST00000377740; ENST00000535355; ENST00000377737; ENST00000537245; ENST00000544978 | chr1 | 6531300 | 6531188 | − | TSF |
| 3% | chr1 | 6531697 | 6531548 | − | ENST00000400913; ENST00000340850; ENST00000377748; ENST00000377725; ENST00000377728; ENST00000377732; ENST00000400915; ENST00000377740; ENST00000535355; ENST00000377737; ENST00000537245; ENST00000544978 | chr1 | 6531300 | 6531188 | − | TSF |
| 3% | chr1 | 6531697 | 6531548 | − | ENST00000400913; ENST00000340850; ENST00000377748; ENST00000377725; ENST00000377728; ENST00000377732; ENST00000400915; ENST00000377740; ENST00000535355; ENST00000377737; ENST00000537245; ENST00000544978 | chr1 | 6531300 | 6531188 | − | TSF |
| 3% | chr5 | 31493400 | 31493314 | − | ENST00000511367; ENST00000344624; ENST00000442743; ENST00000513349 | chr5 | 31489188 | 31488661 | − | TSF |
| 3% | chr5 | 31493400 | 31493314 | − | ENST00000511367; ENST00000344624; ENST00000442743; ENST00000513349 | chr5 | 31489188 | 31488661 | − | TSF |
| 2% | chr11 | 60701014 | 60701216 | + | ENST00000453848; ENST00000005286; ENST00000536409 | chr11 | 60701443 | 60701575 | + | TSF |
| 2% | chr11 | 60701014 | 60701216 | + | ENST00000453848; ENST00000005286; ENST00000536409 | chr11 | 60701443 | 60701575 | + | TSF |
| 2% | chr11 | 60701014 | 60701216 | + | ENST00000453848; ENST00000005286; ENST00000536409 | chr11 | 60701443 | 60701575 | + | TSF |
| 2% | chr2 | 231236313 | 231236366 | + | ENST00000444636; ENST00000415673; ENST00000243810; ENST00000396563; ENST00000458341 | chr2 | 231236728 | 231236962 | + | TSF |
| 2% | chr2 | 231236313 | 231236366 | + | ENST00000444636; ENST00000415673; ENST00000243810; ENST00000396563; | chr2 | 231236728 | 231236962 | + | TSF |

TABLE 39-continued

Transcript fusion for Lung Squamous Cell Carcinoma (LUSC) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 2% | chr12 | 71928895 | 71928966 | + | ENST00000458341; ENST00000266674; ENST00000536515; ENST00000540815 | chr12 | 71938771 | 71938901 | + | TSF |
| 2% | chr18 | 61627392 | 61627509 | + | ENST00000408945 | chr18 | 61628870 | 61629168 | + | TSF |
| 2% | chr7 | 135635430 | 135635347 | − | ENST00000393085 | chr7 | 135585557 | 135585512 | − | TSF |
| 2% | chr19 | 53352466; 53352373 | 53352340 | − | ENST00000595646; ENST00000243639; ENST00000597924; ENST00000601847 | chr19 | 53339322 | 53339166 | − | TSF |
| 2% | chr19 | 53352466; 53352373 | 53352340 | − | ENST00000595646; ENST00000243639; ENST00000597924; ENST00000601847 | chr19 | 53339322 | 53339166 | − | TSF |
| 2% | chr3 | 196214449 | 196214270 | − | ENST00000318037 | chr3 | 196213499 | 196213226 | − | TSF |
| 2% | chr7 | 22532348 | 22532184 | − | ENST00000406890; ENST00000404369; ENST00000424363 | chr7 | 22531483 | 22531370 | − | TSF |
| 2% | chr7 | 22532348 | 22532184 | − | ENST00000406890; ENST00000404369; ENST00000424363 | chr7 | 22531483 | 22531370 | − | TSF |
| 2% | chr9 | 94991408 | 94991283 | − | ENST00000375643; ENST00000443024; ENST00000447699 | chr9 | 94990268 | 94989087 | − | TSF |
| 2% | chr9 | 94991408 | 94991283 | − | ENST00000375643; ENST00000443024; ENST00000447699 | chr9 | 94990268 | 94989087 | − | TSF |
| 2% | chr8 | 71619168 | 71619388 | + | ENST00000408926; ENST00000520030 | chr8 | 71625661 | 71625673 | + | TSF |
| 2% | chr4 | 86491695 | 86491874 | + | ENST00000395184; ENST00000503995 | chr4 | 86580201 | 86580368 | + | TSF |
| 2% | chr7 | 23313140 | 23313233 | + | ENST00000258733; ENST00000381990; ENST00000539136; ENST00000453162 | chr7 | 23322924 | 23323223 | + | TSF |
| 2% | chr7 | 23313140 | 23313233 | + | ENST00000258733; ENST00000381990; ENST00000539136; ENST00000453162 | chr7 | 23322924 | 23323223 | + | TSF |
| 2% | chr7 | 23313140 | 23313233 | + | ENST00000258733; ENST00000381990; ENST00000539136; ENST00000453162 | chr7 | 23322924 | 23323223 | + | TSF |
| 2% | chr7 | 23313140 | 23313233 | + | ENST00000258733; ENST00000381990; ENST00000539136; ENST00000453162 | chr7 | 23322924 | 23323223 | + | TSF |
| 2% | chr19 | 40711028 | 40711203 | + | ENST00000253055; ENST00000593502; ENST00000597986 | chr19 | 40711395 | 40711597 | + | TSF |
| 2% | chr19 | 40711028 | 40711203 | + | ENST00000253055; ENST00000593502; ENST00000597986 | chr19 | 40711395 | 40711597 | + | TSF |
| 2% | chr19 | 40711028 | 40711203 | + | ENST00000253055; ENST00000593502; ENST00000597986 | chr19 | 40711395 | 40711597 | + | TSF |
| 2% | chr12 | 93873164 | 93873248 | + | ENST00000549982; ENST00000361630; ENST00000552217; ENST00000393128; ENST00000547098; ENST00000549561; ENST00000548545 | chr12 | 93876129 | 93876286 | + | TSF |
| 2% | chr12 | 93873164 | 93873248 | + | ENST00000549982; ENST00000361630; ENST00000552217; ENST00000393128; ENST00000547098; ENST00000549561; ENST00000548545 | chr12 | 93876129 | 93876286 | + | TSF |
| 2% | chr6 | 20758826 | 20758874 | + | ENST00000274695; ENST00000378624; ENST00000378610 | chr6 | 20772038 | 20772218 | + | TSF |
| 2% | chr6 | 20758826 | 20758874 | + | ENST00000274695; ENST00000378624; ENST00000378610 | chr6 | 20772038 | 20772218 | + | TSF |
| 2% | chr2 | 89513203 | 89512947 | − | ENST00000498435 | chr2 | 89389297 | 89388194 | − | TSF |
| 2% | chr19 | 15289752 | 15289634 | − | ENST00000263388; ENST00000601011 | chr19 | 15289358 | 15289201 | − | TSF |
| 2% | chr19 | 15289752 | 15289634 | − | ENST00000263388; ENST00000601011 | chr19 | 15289358 | 15289201 | − | TSF |
| 2% | chr2 | 153003822 | 153003676 | − | ENST00000263904 | chr2 | 153001350 | 153001066 | − | TSF |
| 2% | chr3 | 48716169 | 48715997 | − | ENST00000341520; ENST00000416649; ENST00000294129; ENST00000413374 | chr3 | 48702393 | 48702198 | − | TSF |
| 2% | chr3 | 48716169 | 48715997 | − | ENST00000341520; ENST00000416649; ENST00000294129; ENST00000413374 | chr3 | 48702393 | 48702198 | − | TSF |
| 2% | chr3 | 48716169 | 48715997 | − | ENST00000341520; ENST00000416649; ENST00000294129; ENST00000413374 | chr3 | 48702393 | 48702198 | − | TSF |
| 2% | chr2 | 197662632 | 197662521 | − | ENST00000263956; ENST00000409364 | chr2 | 197661554 | 197661227 | − | TSF |
| 2% | chr12 | 53862561; 53862564 | 53862616 | + | ENST00000359282; ENST00000437231; ENST00000447282; ENST00000603815; ENST00000549863; ENST00000359462; ENST00000546463; ENST00000552296; ENST00000552819; ENST00000455667; ENST00000439930; ENST00000548933; ENST00000562264; ENST00000553064; ENST00000547859 | chr12 | 53865082 | 53865327 | + | TSF |
| 2% | chr12 | 53862561; 53862564 | 53862616 | + | ENST00000359282; ENST00000437231; ENST00000447282; ENST00000603815; ENST00000549863; ENST00000359462; ENST00000546463; ENST00000552296; ENST00000552819; ENST00000455667; ENST00000439930; ENST00000548933; ENST00000562264; ENST00000553064; ENST00000547859 | chr12 | 53865082 | 53865327 | + | TSF |
| 2% | chr12 | 53862561; 53862564 | 53862616 | + | ENST00000359282; ENST00000437231; ENST00000447282; ENST00000603815; | chr12 | 53865082 | 53865327 | + | TSF |

TABLE 39-continued

Transcript fusion for Lung Squamous Cell Carcinoma (LUSC) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|----|----|
|   |   |   |   |   | ENST00000549863; ENST00000359462; ENST00000546463; ENST00000552296; ENST00000552819; ENST00000455667; ENST00000439930; ENST00000548933; ENST00000562264; ENST00000553064; ENST00000547859 |   |   |   |   |   |
| 2% | chr12 | 53862561; 53862564 | 53862616 | + | ENST00000359282; ENST00000437231; ENST00000447282; ENST00000603815; ENST00000549863; ENST00000359462; ENST00000546463; ENST00000552296; ENST00000552819; ENST00000455667; ENST00000439930; ENST00000548933; ENST00000562264; ENST00000553064; ENST00000547859 | chr12 | 53865082 | 53865327 | + | TSF |
| 2% | chr12 | 53862561; 53862564 | 53862616 | + | ENST00000359282; ENST00000437231; ENST00000447282; ENST00000603815; ENST00000549863; ENST00000359462; ENST00000546463; ENST00000552296; ENST00000552819; ENST00000455667; ENST00000439930; ENST00000548933; ENST00000562264; ENST00000553064; ENST00000547859 | chr12 | 53865082 | 53865327 | + | TSF |
| 2% | chr12 | 53862561; 53862564 | 53862616 | + | ENST00000359282; ENST00000437231; ENST00000447282; ENST00000603815; ENST00000549863; ENST00000359462; ENST00000546463; ENST00000552296; ENST00000552819; ENST00000455667; ENST00000439930; ENST00000548933; ENST00000562264; ENST00000553064; ENST00000547859 | chr12 | 53865082 | 53865327 | + | TSF |
| 2% | chr12 | 53862561; 53862564 | 53862616 | + | ENST00000359282; ENST00000437231; ENST00000447282; ENST00000603815; ENST00000549863; ENST00000359462; ENST00000546463; ENST00000552296; ENST00000552819; ENST00000455667; ENST00000439930; ENST00000548933; ENST00000562264; ENST00000553064; ENST00000547859 | chr12 | 53865082 | 53865327 | + | TSF |
| 2% | chr12 | 53862561; 53862564 | 53862616 | + | ENST00000359282; ENST00000437231; ENST00000447282; ENST00000603815; ENST00000549863; ENST00000359462; ENST00000546463; ENST00000552296; ENST00000552819; ENST00000455667; ENST00000439930; ENST00000548933; ENST00000562264; ENST00000553064; ENST00000547859 | chr12 | 53865082 | 53865327 | + | TSF |
| 2% | chr12 | 53862561; 53862564 | 53862616 | + | ENST00000359282; ENST00000437231; ENST00000447282; ENST00000603815; ENST00000549863; ENST00000359462; ENST00000546463; ENST00000552296; ENST00000552819; ENST00000455667; ENST00000439930; ENST00000548933; ENST00000562264; ENST00000553064; ENST00000547859 | chr12 | 53865082 | 53865327 | + | TSF |
| 2% | chr12 | 53862561; 53862564 | 53862616 | + | ENST00000359282; ENST00000437231; ENST00000447282; ENST00000603815; ENST00000549863; ENST00000359462; ENST00000546463; ENST00000552296; ENST00000552819; ENST00000455667; ENST00000439930; ENST00000548933; ENST00000562264; ENST00000553064; ENST00000547859 | chr12 | 53865082 | 53865327 | + | TSF |
| 2% | chr12 | 53862561; 53862564 | 53862616 | + | ENST00000359282; ENST00000437231; ENST00000447282; ENST00000603815; ENST00000549863; ENST00000359462; ENST00000546463; ENST00000552296; ENST00000552819; ENST00000455667; ENST00000439930; ENST00000548933; ENST00000562264; ENST00000553064; ENST00000547859 | chr12 | 53865082 | 53865327 | + | TSF |
| 2% | chr12 | 53862561; 53862564 | 53862616 | + | ENST00000359282; ENST00000437231; ENST00000447282; ENST00000603815; ENST00000549863; ENST00000359462; ENST00000546463; ENST00000552296; ENST00000552819; ENST00000455667; | chr12 | 53865082 | 53865327 | + | TSF |

TABLE 39-continued

Transcript fusion for Lung Squamous Cell Carcinoma (LUSC) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|----|----|
| 2% | chr16 | 78143675 | 78143732 | + | ENST00000439930; ENST00000548933; ENST00000562264; ENST00000553064; ENST00000547859 ENST00000566780; ENST00000402655; ENST00000406884; ENST00000539474; ENST00000355860; ENST00000408984 | chr16 | 78145717 | 78146057 | + | TSF |
| 2% | chr10 | 75555297 | 75555421 | + | ENST00000604729; ENST00000603114; ENST00000604524; ENST00000398706; ENST00000605216; ENST00000433366; ENST00000492395; ENST00000603187; ENST00000412198; ENST00000604754 | chr10 | 75556079 | 75556138 | + | TSF |
| 2% | chr10 | 75555297 | 75555421 | + | ENST00000604729; ENST00000603114; ENST00000604524; ENST00000398706; ENST00000605216; ENST00000433366; ENST00000492395; ENST00000603187; ENST00000412198; ENST00000604754 | chr10 | 75556079 | 75556138 | + | TSF |
| 2% | chr10 | 75555297 | 75555421 | + | ENST00000604729; ENST00000603114; ENST00000604524; ENST00000398706; ENST00000605216; ENST00000433366; ENST00000492395; ENST00000603187; ENST00000412198; ENST00000604754 | chr10 | 75556079 | 75556138 | + | TSF |
| 2% | chr10 | 75555297 | 75555421 | + | ENST00000604729; ENST00000603114; ENST00000604524; ENST00000398706; ENST00000605216; ENST00000433366; ENST00000492395; ENST00000603187; ENST00000412198; ENST00000604754 | chr10 | 75556079 | 75556138 | + | TSF |
| 2% | chr10 | 75555297 | 75555421 | + | ENST00000604729; ENST00000603114; ENST00000604524; ENST00000398706; ENST00000605216; ENST00000433366; ENST00000492395; ENST00000603187; ENST00000412198; ENST00000604754 | chr10 | 75556079 | 75556138 | + | TSF |
| 2% | chr10 | 75555297 | 75555421 | + | ENST00000604729; ENST00000603114; ENST00000604524; ENST00000398706; ENST00000605216; ENST00000433366; ENST00000492395; ENST00000603187; ENST00000412198; ENST00000604754 | chr10 | 75556079 | 75556138 | + | TSF |
| 2% | chr10 | 75555297 | 75555421 | + | ENST00000604729; ENST00000603114; ENST00000604524; ENST00000398706; ENST00000605216; ENST00000433366; ENST00000492395; ENST00000603187; ENST00000412198; ENST00000604754 | chr10 | 75556079 | 75556138 | + | TSF |
| 2% | chr10 | 75555297 | 75555421 | + | ENST00000604729; ENST00000603114; ENST00000604524; ENST00000398706; ENST00000605216; ENST00000433366; ENST00000492395; ENST00000603187; ENST00000412198; ENST00000604754 | chr10 | 75556079 | 75556138 | + | TSF |
| 2% | chr5 | 41934235 | 41934410 | + | ENST00000296812; ENST00000281623; ENST00000509134 | chr5 | 41935724 | 41936388 | + | |
| 2% | chr2 | 172725333; 172725194 | 172725191 | − | ENST00000422440; ENST00000263812; ENST00000392592; ENST00000426896; ENST00000475360 | chr2 | 172723793 | 172722363 | − | TSF |
| 2% | chr2 | 172725333; 172725194 | 172725191 | − | ENST00000422440; ENST00000263812; ENST00000392592; ENST00000426896; ENST00000475360 | chr2 | 172723793 | 172722363 | − | TSF |
| 2% | chr2 | 172725333; 172725194 | 172725191 | − | ENST00000422440; ENST00000263812; ENST00000392592; ENST00000426896; ENST00000475360 | chr2 | 172723793 | 172722363 | − | TSF |
| 2% | chr19 | 16024719 | 16024559 | − | ENST00000248041; ENST00000402119; ENST00000591841 | chr19 | 16023994 | 16023778 | − | TSF |
| 2% | chr19 | 16024719 | 16024559 | − | ENST00000248041; ENST00000402119; ENST00000591841 | chr19 | 16023994 | 16023778 | − | TSF |
| 2% | chr19 | 46627413 | 46627143 | − | ENST00000341415 | chr19 | 46623564 | 46622963 | − | TSF |
| 2% | chr8 | 141762086 | 141762002 | − | ENST00000524202 | chr8 | 141760508 | 141760403 | − | TSF |
| 2% | chr10 | 5037676 | 5037511 | − | ENST00000380753; ENST00000421196; ENST00000407674 | chr10 | 5023140 | 5022655 | − | TSF |
| 2% | chr10 | 5037676 | 5037511 | − | ENST00000380753; ENST00000421196; ENST00000407674 | chr10 | 5023140 | 5022655 | − | TSF |
| 2% | chr13 | 114157811 | 114157903 | + | ENST00000434316; ENST00000375391 | chr13 | 114159741 | 114159770 | + | TSF |
| 2% | chr7 | 23300075 | 23300392 | + | ENST00000258733; ENST00000381990; ENST00000539136; ENST00000453162 | chr7 | 23301185 | 23301414 | + | TSF |
| 2% | chr7 | 23300075 | 23300392 | + | ENST00000258733; ENST00000381990; ENST00000539136; ENST00000453162 | chr7 | 23301185 | 23301414 | + | TSF |
| 2% | chr7 | 23300075 | 23300392 | + | ENST00000258733; ENST00000381990; ENST00000539136; ENST00000453162 | chr7 | 23301185 | 23301414 | + | TSF |

TABLE 39-continued

Transcript fusion for Lung Squamous Cell Carcinoma (LUSC) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 2% | chr17 | 36288631 | 36288740 | + | ENST00000327454; ENST00000378174; ENST00000505415; ENST00000539424 | chr17 | 36289142 | 36289609 | + | TSF |
| 2% | chr17 | 36288631 | 36288740 | + | ENST00000327454; ENST00000378174; ENST00000505415; ENST00000539424 | chr17 | 36289142 | 36289609 | + | TSF |
| 2% | chr11 | 65222908 | 65223052 | + | ENST00000309775 | chr11 | 65223772 | 65224450 | + | TSF |
| 2% | chr8 | 42932359 | 42932507 | + | ENST00000302279; ENST00000342116; ENST00000529687; ENST00000533336 | chr8 | 42934165 | 42935743 | + | TSF |
| 2% | chr8 | 42932359 | 42932507 | + | ENST00000302279; ENST00000342116; ENST00000529687; ENST00000533336 | chr8 | 42934165 | 42935743 | + | TSF |
| 2% | chr8 | 42932359 | 42932507 | + | ENST00000302279; ENST00000342116; ENST00000529687; ENST00000533336 | chr8 | 42934165 | 42935743 | + | TSF |
| 2% | chr8 | 42932359 | 42932507 | + | ENST00000302279; ENST00000342116; ENST00000529687; ENST00000533336 | chr8 | 42934165 | 42935743 | + | TSF |
| 2% | chr12 | 28605411; 28605475 | 28605587 | + | ENST00000536154; ENST00000539107; ENST00000545336; ENST00000381256; ENST00000381259; ENST00000306172; ENST00000535212; ENST00000542801 | chr12 | 28624332 | 28624630 | + | TSF |
| 2% | chr12 | 28605411; 28605475 | 28605587 | + | ENST00000536154; ENST00000539107; ENST00000545336; ENST00000381256; ENST00000381259; ENST00000306172; ENST00000535212; ENST00000542801 | chr12 | 28624332 | 28624630 | + | TSF |
| 2% | chr12 | 28605411; 28605475 | 28605587 | + | ENST00000536154; ENST00000539107; ENST00000545336; ENST00000381256; ENST00000381259; ENST00000306172; ENST00000535212; ENST00000542801 | chr12 | 28624332 | 28624630 | + | TSF |
| 2% | chr12 | 28605411; 28605475 | 28605587 | + | ENST00000536154; ENST00000539107; ENST00000545336; ENST00000381256; ENST00000381259; ENST00000306172; ENST00000535212; ENST00000542801 | chr12 | 28624332 | 28624630 | + | TSF |
| 2% | chr12 | 28605411; 28605475 | 28605587 | + | ENST00000536154; ENST00000539107; ENST00000545336; ENST00000381256; ENST00000381259; ENST00000306172; ENST00000535212; ENST00000542801 | chr12 | 28624332 | 28624630 | + | TSF |
| 2% | chr12 | 28605411; 28605475 | 28605587 | + | ENST00000536154; ENST00000539107; ENST00000545336; ENST00000381256; ENST00000381259; ENST00000306172; ENST00000535212; ENST00000542801 | chr12 | 28624332 | 28624630 | + | TSF |
| 2% | chr19 | 3869015; 3869013 | 3868963 | − | ENST00000262961; ENST00000438164; ENST00000587212; ENST00000586578; ENST00000439086 | chr19 | 3855694 | 3855445 | − | TSF |
| 2% | chr19 | 3869015; 3869013 | 3868963 | − | ENST00000262961; ENST00000438164; ENST00000587212; ENST00000586578; ENST00000439086 | chr19 | 3855694 | 3855445 | − | TSF |
| 2% | chr10 | 127483547 | 127483449 | − | ENST00000368797; ENST00000368786 | chr10 | 127473829 | 127473633 | − | TSF |
| 2% | chr16 | 88873689 | 88873890 | + | ENST00000301019 | chr16 | 88875475 | 88875490 | + | TSF |
| 2% | chr19 | 55178148; 55178145 | 55178200 | + | ENST00000391736; ENST00000270452; ENST00000430952; ENST00000391734; ENST00000391733; ENST00000434286 | chr19 | 55178294 | 55178458 | + | TSF |
| 2% | chr19 | 55178148; 55178145 | 55178200 | + | ENST00000391736; ENST00000270452; ENST00000430952; ENST00000391734; ENST00000391733; ENST00000434286 | chr19 | 55178294 | 55178458 | + | TSF |
| 2% | chr19 | 55178148; 55178145 | 55178200 | + | ENST00000391736; ENST00000270452; ENST00000430952; ENST00000391734; ENST00000391733; ENST00000434286 | chr19 | 55178294 | 55178458 | + | TSF |
| 2% | chr10 | 126205749 | 126205840 | + | ENST00000368842 | chr10 | 126251911 | 126252288 | + | TSF |
| 2% | chr12 | 113623819 | 113623826 | + | ENST00000552495 | chr12 | 113623998 | 113624117 | + | TSF |
| 2% | chr17 | 75303223 | 75303279 | + | ENST00000427177 | chr17 | 75307415 | 75307459 | + | TSF |
| 2% | chr15 | 74219125 | 74220226 | + | ENST00000566011; ENST0000261921 | chr15 | 74234853 | 74234966 | + | TSF |
| 2% | chr9 | 5689959 | 5690038 | + | ENST00000251879; ENST00000414202; ENST00000381532; ENST00000418622; ENST00000449720; ENST00000545641 | chr9 | 5712361 | 5712559 | + | TSF |
| 2% | chr9 | 5689959 | 5690038 | + | ENST00000251879; ENST00000414202; ENST00000381532; ENST00000418622; ENST00000449720; ENST00000545641 | chr9 | 5712361 | 5712559 | + | TSF |

TABLE 39-continued

Transcript fusion for Lung Squamous Cell Carcinoma (LUSC) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 2% | chr9 | 5689959 | 5690038 | + | ENST00000251879; ENST00000414202; ENST00000381532; ENST00000418622; ENST00000449720; ENST00000545641 | chr9 | 5712361 | 5712559 | + | TSF |
| 2% | chr1 | 25891664 | 25891698 | + | ENST00000374338 | chr1 | 25916660 | 25916675 | + | TSF |
| 2% | chrX | 117900807 | 117900939 | + | ENST00000371666 | chrX | 117902549 | 117902902 | + | TSF |
| 2% | chr4 | 56230241 | 56230438 | + | ENST00000264228 | chr4 | 56252510 | 56252750 | + | TSF |
| 2% | chr19 | 19313690; 19313653 | 19313600 | − | ENST00000420605; ENST00000331552; ENST00000544883; ENST00000538165; ENST00000539678 | chr19 | 19313030 | 19312992 | − | TSF |
| 2% | chr19 | 19313690; 19313653 | 19313600 | − | ENST00000420605; ENST00000331552; ENST00000544883; ENST00000538165; ENST00000539678 | chr19 | 19313030 | 19312992 | − | TSF |
| 2% | chr17 | 36343995 | 36343886 | − | ENST00000518551; ENST00000354664; ENST00000339023; ENST00000519532; ENST00000537432 | chr17 | 36343484 | 36343017 | − | TSF |
| 2% | chr17 | 36343995 | 36343886 | − | ENST00000518551; ENST00000354664; ENST00000339023; ENST00000519532; ENST00000537432 | chr17 | 36343484 | 36343017 | − | TSF |
| 2% | chr12 | 56742407 | 56742313 | − | ENST00000314128; ENST00000557235 | chr12 | 56740986 | 56740975 | − | TSF |
| 2% | chr12 | 56742407 | 56742313 | − | ENST00000314128; ENST00000557235 | chr12 | 56740986 | 56740975 | − | TSF |
| 1% | chr8 | 120220779 | 120220844 | + | ENST00000276681 | chr8 | 120233190 | 120233225 | + | TSF |
| 1% | chr22 | 35819207 | 35819334 | + | ENST00000216122; ENST00000382011 | chr22 | 35822985 | 35823438 | + | TSF |
| 1% | chr22 | 35819207 | 35819334 | + | ENST00000216122; ENST00000382011 | chr22 | 35822985 | 35823438 | + | TSF |
| 1% | chr3 | 196443740; 196443729 | 196443792 | + | ENST00000426755; ENST00000392391; ENST00000314118; ENST00000296333; ENST00000457284; ENST00000453218; ENST00000421265; ENST00000415832; ENST00000451319 | chr3 | 196444680 | 196444763 | + | TSF |
| 1% | chr3 | 196443740; 196443729 | 196443792 | + | ENST00000426755; ENST00000392391; ENST00000314118; ENST00000296333; ENST00000457284; ENST00000453218; ENST00000421265; ENST00000415832; ENST00000451319 | chr3 | 196444680 | 196444763 | + | TSF |
| 1% | chr3 | 196443740; 196443729 | 196443792 | + | ENST00000426755; ENST00000392391; ENST00000314118; ENST00000296333; ENST00000457284; ENST00000453218; ENST00000421265; ENST00000415832; ENST00000451319 | chr3 | 196444680 | 196444763 | + | TSF |
| 1% | chr11 | 65222908 | 65223052 | + | ENST00000309775 | chr11 | 65224109 | 65224450 | + | TSF |
| 1% | chrX | 153786747; 153786750 | 153786865 | + | ENST00000440286; ENST00000422680; ENST00000369609; ENST00000369607; ENST00000369606; ENST00000413620; ENST00000263518; ENST00000470142; ENST00000393549; ENST00000455588; ENST00000369602; ENST00000424839; ENST00000369601 | chrX | 153788357 | 153788357 | + | TSF |
| 1% | chrX | 153786747; 153786750 | 153786865 | + | ENST00000440286; ENST00000422680; ENST00000369609; ENST00000369607; ENST00000369606; ENST00000413620; ENST00000263518; ENST00000470142; ENST00000393549; ENST00000455588; ENST00000369602; ENST00000424839; ENST00000369601 | chrX | 153788357 | 153788357 | + | TSF |
| 1% | chrX | 153786747; 153786750 | 153786865 | + | ENST00000440286; ENST00000422680; ENST00000369609; ENST00000369607; ENST00000369606; ENST00000413620; ENST00000263518; ENST00000470142; ENST00000393549; ENST00000455588; ENST00000369602; ENST00000424839; ENST00000369601 | chrX | 153788357 | 153788357 | + | TSF |
| 1% | chrX | 153786747; 153786750 | 153786865 | + | ENST00000440286; ENST00000422680; ENST00000369609; ENST00000369607; ENST00000369606; ENST00000413620; ENST00000263518; ENST00000470142; ENST00000393549; ENST00000455588; ENST00000369602; ENST00000424839; ENST00000369601 | chrX | 153788357 | 153788357 | + | TSF |
| 1% | chrX | 153786747; 153786750 | 153786865 | + | ENST00000440286; ENST00000422680; ENST00000369609; ENST00000369607; ENST00000369606; ENST00000413620; ENST00000263518; ENST00000470142; ENST00000393549; ENST00000455588; ENST00000369602; ENST00000424839; ENST00000369601 | chrX | 153788357 | 153788357 | + | TSF |

TABLE 39-continued

Transcript fusion for Lung Squamous Cell Carcinoma (LUSC) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 1% | chr2 | 110671988 | 110672054 | + | ENST00000553749 | chr2 | 110672249 | 110672374 | + | TSF |
| 1% | chr16 | 57115439 | 57115522 | + | ENST00000262510; ENST00000308149; ENST00000539144 | chr16 | 57116257 | 57116272 | + | TSF |
| 1% | chr16 | 57115439 | 57115522 | + | ENST00000262510; ENST00000308149; ENST00000539144 | chr16 | 57116257 | 57116272 | + | TSF |
| 1% | chr1 | 32560385 | 32560572 | + | ENST00000336294; ENST00000373634; ENST00000427288 | chr1 | 32561261 | 32561358 | + | TSF |
| 1% | chr1 | 32560385 | 32560572 | + | ENST00000336294; ENST00000373634; ENST00000427288 | chr1 | 32561261 | 32561358 | + | TSF |
| 1% | chr1 | 32560385 | 32560572 | + | ENST00000336294; ENST00000373634; ENST00000427288 | chr1 | 32561261 | 32561358 | + | TSF |
| 1% | chr5 | 23976106 | 23976159 | + | ENST00000512559; ENST00000507936 | chr5 | 24177946 | 24178380 | + | TSF |
| 1% | chr4 | 169086398 | 169086477 | + | ENST00000359299 | chr4 | 169090666 | 169090754 | + | TSF |
| 1% | chr11 | 20981978 | 20982106 | + | ENST00000298925; ENST00000357134; ENST00000325319; ENST00000532434 | chr11 | 21041136 | 21041271 | + | TSF |
| 1% | chr11 | 20981978 | 20982106 | + | ENST00000298925; ENST00000357134; ENST00000325319; ENST00000532434 | chr11 | 21041136 | 21041271 | + | TSF |
| 1% | chr11 | 20981978 | 20982106 | + | ENST00000298925; ENST00000357134; ENST00000325319; ENST00000532434 | chr11 | 21041136 | 21041271 | + | TSF |
| 1% | chr5 | 179315312 | 179315103 | − | ENST00000355235; ENST00000356834 | chr5 | 179312136 | 179312132 | − | TSF |
| 1% | chr11 | 10050104 | 10049999 | − | ENST00000256190 | chr11 | 10038326 | 10038049 | − | TSF |
| 1% | chr4 | 139135783 | 139135739 | − | ENST00000280612; ENST00000509248 | chr4 | 139120225 | 139120178 | − | TSF |
| 1% | chr4 | 139135783 | 139135739 | − | ENST00000280612; ENST00000509248 | chr4 | 139120225 | 139120178 | − | TSF |
| 1% | chr22 | 32802748 | 32802649 | − | ENST00000216038; ENST00000451746 | chr22 | 32801674 | 32801574 | − | TSF |
| 1% | chr16 | 69418613; 69418553; 69418599 | 69418483 | − | ENST00000254942; ENST00000603068; ENST00000566750; ENST00000569542; ENST00000566257; ENST00000567296; ENST00000567841 | chr16 | 69413560 | 69413452 | − | TSF |
| 1% | chr16 | 69418613; 69418553; 69418599 | 69418483 | − | ENST00000254942; ENST00000603068; ENST00000566750; ENST00000569542; ENST00000566257; ENST00000567296; ENST00000567841 | chr16 | 69413560 | 69413452 | − | TSF |
| 1% | chr16 | 69418613; 69418553; 69418599 | 69418483 | − | ENST00000254942; ENST00000603068; ENST00000566750; ENST00000569542; ENST00000566257; ENST00000567296; ENST00000567841 | chr16 | 69413560 | 69413452 | − | TSF |
| 1% | chr16 | 69418613; 69418553; 69418599 | 69418483 | − | ENST00000254942; ENST00000603068; ENST00000566750; ENST00000569542; ENST00000566257; ENST00000567296; ENST00000567841 | chr16 | 69413560 | 69413452 | − | TSF |
| 1% | chr16 | 69418613; 69418553; 69418599 | 69418483 | − | ENST00000254942; ENST00000603068; ENST00000566750; ENST00000569542; ENST00000566257; ENST00000567296; ENST00000567841 | chr16 | 69413560 | 69413452 | − | TSF |
| 1% | chr17 | 26105817 | 26105716 | − | ENST00000313735 | chr17 | 26105322 | 26105316 | − | TSF |
| 1% | chr2 | 111214673 | 111214607 | − | ENST00000603767; ENST00000447537 | chr2 | 111214412 | 111214287 | − | TSF |
| 1% | chr4 | 1696567 | 1696501 | − | ENST00000429429; ENST00000489418; ENST00000318386; ENST00000483348; ENST00000488267 | chr4 | 1692954 | 1692622 | − | TSF |
| 1% | chr4 | 1696567 | 1696501 | − | ENST00000429429; ENST00000489418; ENST00000318386; ENST00000483348; ENST00000488267 | chr4 | 1692954 | 1692622 | − | TSF |
| 1% | chr4 | 1696567 | 1696501 | − | ENST00000429429; ENST00000489418; ENST00000318386; ENST00000483348; ENST00000488267 | chr4 | 1692954 | 1692622 | − | TSF |
| 1% | chr4 | 1696567 | 1696501 | − | ENST00000429429; ENST00000489418; ENST00000318386; ENST00000483348; ENST00000488267 | chr4 | 1692954 | 1692622 | − | TSF |
| 1% | chr4 | 1696567 | 1696501 | − | ENST00000429429; ENST00000489418; ENST00000318386; ENST00000483348; ENST00000488267 | chr4 | 1692954 | 1692622 | − | TSF |
| 1% | chr16 | 16225646 | 16225792 | + | ENST00000399410; ENST00000345148; ENST00000346370; ENST00000349029; ENST00000351154; ENST00000399408; ENST00000572882 | chr16 | 16227957 | 16228051 | + | TSF |
| 1% | chr16 | 16225646 | 16225792 | + | ENST00000399410; ENST00000345148; ENST00000346370; ENST00000349029; ENST00000351154; ENST00000399408; ENST00000572882 | chr16 | 16227957 | 16228051 | + | TSF |
| 1% | chr16 | 16225646 | 16225792 | + | ENST00000399410; ENST00000345148; ENST00000346370; ENST00000349029; | chr16 | 16227957 | 16228051 | + | TSF |

TABLE 39-continued

Transcript fusion for Lung Squamous Cell Carcinoma (LUSC) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 1% | chr16 | 16225646 | 16225792 | + | ENST00000351154; ENST00000399408; ENST00000572882 ENST00000399410; ENST00000345148; ENST00000346370; ENST00000349029; | chr16 | 16227957 | 16228051 | + | TSF |
| 1% | chr16 | 16225646 | 16225792 | + | ENST00000351154; ENST00000399408; ENST00000572882 ENST00000399410; ENST00000345148; ENST00000346370; ENST00000349029; | chr16 | 16227957 | 16228051 | + | TSF |
| 1% | chr16 | 16225646 | 16225792 | + | ENST00000351154; ENST00000399408; ENST00000572882 ENST00000399410; ENST00000345148; ENST00000346370; ENST00000349029; | chr16 | 16227957 | 16228051 | + | TSF |
| 1% | chr4 | 146617711 | 146617784 | + | ENST00000438731; ENST00000511965 | chr4 | 146620339 | 146620424 | + | TSF |
| 1% | chr4 | 146617711 | 146617784 | + | ENST00000438731; ENST00000511965 | chr4 | 146620339 | 146620424 | + | TSF |
| 1% | chr19 | 38872757 | 38872868 | + | ENST00000215071; ENST00000602911; ENST00000592561; ENST00000592035 | chr19 | 38873037 | 38873046 | + | TSF |
| 1% | chr19 | 38872757 | 38872868 | + | ENST00000215071; ENST00000602911; ENST00000592561; ENST00000592035 | chr19 | 38873037 | 38873046 | + | TSF |
| 1% | chr19 | 38872757 | 38872868 | + | ENST00000215071; ENST00000602911; ENST00000592561; ENST00000592035 | chr19 | 38873037 | 38873046 | + | TSF |
| 1% | chr19 | 38872757 | 38872868 | + | ENST00000215071; ENST00000602911; ENST00000592561; ENST00000592035 | chr19 | 38873037 | 38873046 | + | TSF |
| 1% | chr1 | 151537001 | 151537090 | + | ENST00000353024; ENST00000368849; ENST00000368848; ENST00000538902 | chr1 | 151537646 | 151537693 | + | TSF |
| 1% | chr1 | 151537001 | 151537090 | + | ENST00000353024; ENST00000368849; ENST00000368848; ENST00000538902 | chr1 | 151537646 | 151537693 | + | TSF |
| 1% | chr1 | 151537001 | 151537090 | + | ENST00000353024; ENST00000368849; ENST00000368848; ENST00000538902 | chr1 | 151537646 | 151537693 | + | TSF |
| 1% | chr1 | 151537001 | 151537090 | + | ENST00000353024; ENST00000368849; ENST00000368848; ENST00000538902 | chr1 | 151537646 | 151537693 | + | TSF |
| 1% | chr6 | 20781376 | 20781496 | + | ENST00000274695; ENST00000378624; ENST00000378610 | chr6 | 20805885 | 20806219 | + | TSF |
| 1% | chr6 | 20781376 | 20781496 | + | ENST00000274695; ENST00000378624; ENST00000378610 | chr6 | 20805885 | 20806219 | + | TSF |
| 1% | chr9 | 17143286 | 17143374 | + | ENST00000380647; ENST00000262360; ENST00000425824; ENST00000380641 | chr9 | 17166816 | 17167136 | + | TSF |
| 1% | chr5 | 1802435 | 1802488 | + | ENST00000274137; ENST00000469176 | chr5 | 1811112 | 1811428 | + | TSF |
| 1% | chr22 | 38321668; 38321854 | 38322050 | + | ENST00000215957; ENST00000454685 | chr22 | 38322963 | 38322967 | + | TSF |
| 1% | chr22 | 38321668; 38321854 | 38322050 | + | ENST00000215957; ENST00000454685 | chr22 | 38322963 | 38322967 | + | TSF |
| 1% | chr2 | 217366064 | 217366082 | + | ENST00000491306; ENST00000456586 | chr2 | 217393993 | 217394327 | + | TSF |
| 1% | chr2 | 217366064 | 217366082 | + | ENST00000491306; ENST00000456586 | chr2 | 217393993 | 217394327 | + | TSF |
| 1% | chr2 | 47690170 | 47690293 | + | ENST00000233146; ENST00000543555; ENST00000406134 | chr2 | 47691419 | 47691669 | + | TSF |
| 1% | chr2 | 47690170 | 47690293 | + | ENST00000233146; ENST00000543555; ENST00000406134 | chr2 | 47691419 | 47691669 | + | TSF |
| 1% | chr7 | 150065992 | 150066030 | + | ENST00000466559; ENST00000475514; ENST00000488943; ENST00000467980; ENST00000518514; ENST00000522266 | chr7 | 150067849 | 150067901 | + | TSF |
| 1% | chr6 | 20781376 | 20781496 | + | ENST00000274695; ENST00000378624; ENST00000378610 | chr6 | 20797829 | 20797991 | + | TSF |
| 1% | chr6 | 20781376 | 20781496 | + | ENST00000274695; ENST00000378624; ENST00000378610 | chr6 | 20797829 | 20797991 | + | TSF |
| 1% | chr8 | 126194345 | 126194498 | + | ENST00000523741; ENST00000517532; ENST00000287437; ENST00000522563; ENST00000517315 | chr8 | 126207297 | 126207395 | + | TSF |
| 1% | chr8 | 126194345 | 126194498 | + | ENST00000523741; ENST00000517532; ENST00000287437; ENST00000522563; ENST00000517315 | chr8 | 126207297 | 126207395 | + | TSF |
| 1% | chr22 | 22786497 | 22786736 | + | ENST00000390301 | chr22 | 22832893 | 22833352 | + | TSF |
| 1% | chr2 | 89417128 | 89416936 | − | ENST00000490686 | chr2 | 89370042 | 89366766 | − | TSF |
| 1% | chr8 | 42302280 | 42302164 | − | ENST00000342228; ENST00000520262; ENST00000520179 | chr8 | 42301552 | 42301149 | − | TSF |
| 1% | chr14 | 106092403 | 106092109 | − | ENST00000390543 | chr14 | 105470421 | 105470286 | − | TSF |
| 1% | chr6 | 65098733 | 65098583 | − | ENST00000503581; ENST00000370621; ENST00000370616 | chr6 | 65097495 | 65097442 | − | TSF |
| 1% | chr1 | 40313763; 40313769; 40313673; 40313734 | 40313658 | − | ENST00000441669; ENST0000462797; ENST00000316891; ENST00000372818; ENST00000537223; ENST00000537440; ENST00000545233 | chr1 | 40313419 | 40313374 | − | TSF |
| 1% | chr1 | 40313763; | 40313658 | − | ENST00000441669; ENST00000462797; | chr1 | 40313419 | 40313374 | − | TSF |

TABLE 39-continued

Transcript fusion for Lung Squamous Cell Carcinoma (LUSC) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 1% | chr1 | 40313769; 40313673; 40313734 40313763; 40313769; 40313673; 40313734 | 40313658 | − | ENST00000316891; ENST00000372818; ENST00000537223; ENST00000537440; ENST00000545233 ENST00000441669; ENST00000462797; ENST00000316891; ENST00000372818; ENST00000537223; ENST00000537440; ENST00000545233 | chr1 | 40313419 | 40313374 | − | TSF |
| 1% | chr1 | 40313763; 40313769; 40313673; 40313734 | 40313658 | − | ENST00000441669; ENST00000462797; ENST00000316891; ENST00000372818; ENST00000537223; ENST00000537440; ENST00000545233 | chr1 | 40313419 | 40313374 | − | TSF |
| 1% | chr1 | 180283857 | 180283827 | − | ENST00000367595 | chr1 | 180281120 | 180281103 | − | TSF |
| 1% | chr17 | 80656472 | 80656331 | − | ENST00000571995; ENST00000538809 | chr17 | 80634662 | 80634498 | − | TSF |
| 1% | chr21 | 46306817 | 46306651 | − | ENST00000397852; ENST00000397857; ENST00000397854; ENST00000355153; ENST00000397850; ENST00000302347 | chr21 | 46302588 | 46302215 | − | TSF |
| 1% | chr21 | 46306817 | 46306651 | − | ENST00000397852; ENST00000397857; ENST00000397854; ENST00000355153; ENST00000397850; ENST00000302347 | chr21 | 46302588 | 46302215 | − | TSF |
| 1% | chr4 | 1102192 | 1102131 | − | ENST00000382968; ENST00000433731; ENST00000511620; ENST00000510715; ENST00000333673 | chr4 | 1101132 | 1100845 | − | TSF |
| 1% | chr3 | 194325174; 194325170 | 194325016 | − | ENST00000392432; ENST00000273580; ENST00000432352; ENST00000381975; ENST00000347147; ENST00000473092; ENST00000452358 | chr3 | 194296178 | 194295847 | − | TSF |
| 1% | chr3 | 194325174; 194325170 | 194325016 | − | ENST00000392432; ENST00000273580; ENST00000432352; ENST00000381975; ENST00000347147; ENST00000473092; ENST00000452358 | chr3 | 194296178 | 194295847 | − | TSF |
| 1% | chr3 | 194325174; 194325170 | 194325016 | − | ENST00000392432; ENST00000273580; ENST00000432352; ENST00000381975; ENST00000347147; ENST00000473092; ENST00000452358 | chr3 | 194296178 | 194295847 | − | TSF |
| 1% | chr3 | 194325174; 194325170 | 194325016 | − | ENST00000392432; ENST00000273580; ENST00000432352; ENST00000381975; ENST00000347147; ENST00000473092; ENST00000452358 | chr3 | 194296178 | 194295847 | − | TSF |
| 1% | chr5 | 176830398 | 176830255 | − | ENST00000253496 | chr5 | 176829864 | 176829767 | − | TSF |
| 1% | chr6 | 99781423 | 99781227 | − | ENST00000389677 | chr6 | 99774039 | 99774006 | − | TSF |
| 1% | chr19 | 49335016 | 49334925 | − | ENST00000263278; ENST00000595764 | chr19 | 49322122 | 49322095 | − | TSF |
| 1% | chr19 | 49335016 | 49334925 | − | ENST00000263278; ENST00000595764 | chr19 | 49322122 | 49322095 | − | TSF |
| 1% | chr2 | 27610025 | 27609956 | − | ENST00000344034; ENST00000350803 | chr2 | 27609703 | 27609426 | − | TSF |
| 1% | chr1 | 40319740 | 40319642 | − | ENST00000462797; ENST00000316891; ENST00000372818; ENST00000492612; ENST00000489945; ENST00000469476; ENST00000544981 | chr1 | 40318623 | 40318602 | − | TSF |
| 1% | chr1 | 40319740 | 40319642 | − | ENST00000462797; ENST00000316891; ENST00000372818; ENST00000492612; ENST00000489945; ENST00000469476; ENST00000544981 | chr1 | 40318623 | 40318602 | − | TSF |
| 1% | chr1 | 40319740 | 40319642 | − | ENST00000462797; ENST00000316891; ENST00000372818; ENST00000492612; ENST00000489945; ENST00000469476; ENST00000544981 | chr1 | 40318623 | 40318602 | − | TSF |

TABLE 40

Transcript fusion for Lung Squamous Cell Carcinoma (LUSC) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 60% | chr11 | 93468219 | 93468129 | − | chr11 | 93467826 | 93467791; 93467814 | − | ENST00000393259; ENST00000527169 | TAF |
| 60% | chr11 | 93468219 | 93468129 | − | chr11 | 93467826 | 93467791; 93467814 | − | ENST00000393259; ENST00000527169 | TAF |
| 51% | chr12 | 122430912 | 122431615 | + | chr12 | 122437622 | 122437850 | + | ENST00000288912 | TAF |

TABLE 40-continued

Transcript fusion for Lung Squamous Cell Carcinoma (LUSC) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 48% | chr7 | 116364854 | 116364901 | + | chr7 | 116371722 | 116371913 | + | ENST00000397752; ENST00000318493; ENST00000436117 | TAF |
| 48% | chr7 | 116364854 | 116364901 | + | chr7 | 116371722 | 116371913 | + | ENST00000397752; ENST00000318493; ENST00000436117 | TAF |
| 48% | chr7 | 116364854 | 116364901 | + | chr7 | 116371722 | 116371913 | + | ENST00000397752; ENST00000318493; ENST00000436117 | TAF |
| 42% | chr8 | 104389530 | 104389551 | + | chr8 | 104390255 | 104390471 | + | ENST00000330295; ENST00000520337 | TAF |
| 40% | chr12 | 86274449 | 86274547 | + | chr12 | 86276001 | 86276153 | + | ENST00000551529; ENST00000256010 | TAF |
| 36% | chr3 | 185411133 | 185410965 | − | chr3 | 185410550 | 185410487 | − | ENST00000382199; ENST00000421047; ENST00000457616; ENST00000346192 | TAF |
| 36% | chr3 | 185411133 | 185410965 | − | chr3 | 185410550 | 185410487 | − | ENST00000382199; ENST00000421047; ENST00000457616; ENST00000346192 | TAF |
| 34% | chr7 | 73098299 | 73098330 | + | chr7 | 73100966 | 73101061 | + | ENST00000265758; ENST00000432522; ENST00000421744; ENST00000428163; ENST00000423166; ENST00000423497 | TAF |
| 34% | chr7 | 73098299 | 73098330 | + | chr7 | 73100966 | 73101061 | + | ENST00000265758; ENST00000432522; ENST00000421744; ENST00000428163; ENST00000423166; ENST00000423497 | TAF |
| 34% | chr7 | 73098299 | 73098330 | + | chr7 | 73100966 | 73101061 | + | ENST00000265758; ENST00000432522; ENST00000421744; ENST00000428163; ENST00000423166; ENST00000423497 | TAF |
| 34% | chr7 | 73098299 | 73098330 | + | chr7 | 73100966 | 73101061 | + | ENST00000265758; ENST00000432522; ENST00000421744; ENST00000428163; ENST00000423166; ENST00000423497 | TAF |
| 34% | chr7 | 73098299 | 73098330 | + | chr7 | 73100966 | 73101061 | + | ENST00000265758; ENST00000432522; ENST00000421744; ENST00000428163; ENST00000423166; ENST00000423497 | TAF |
| 32% | chr12 | 64687157 | 64687061 | − | chr12 | 64679840 | 64679734 | − | ENST00000543942; ENST00000333722 | TAF |
| 32% | chr2 | 38983894 | 38983253 | − | chr2 | 38977336 | 38977156 | − | ENST00000313117; ENST00000425778; ENST00000425941; ENST00000446327; ENST00000409276; ENST00000431066; ENST00000443213 | TSF |
| 32% | chr2 | 38983894 | 38983253 | − | chr2 | 38977336 | 38977156 | − | ENST00000313117; ENST00000425778; ENST00000425941; ENST00000446327; ENST00000409276; ENST00000431066; ENST00000443213 | TSF |
| 32% | chr2 | 38983894 | 38983253 | − | chr2 | 38977336 | 38977156 | − | ENST00000313117; ENST00000425778; ENST00000425941; ENST00000446327; ENST00000409276; ENST00000431066; ENST00000443213 | TSF |
| 32% | chr2 | 38983894 | 38983253 | − | chr2 | 38977336 | 38977156 | − | ENST00000313117; ENST00000425778; ENST00000425941; ENST00000446327; ENST00000409276; ENST00000431066; ENST00000443213 | TSF |
| 32% | chr2 | 38983894 | 38983253 | − | chr2 | 38977336 | 38977156 | − | ENST00000313117; ENST00000425778; ENST00000425941; ENST00000446327; ENST00000409276; ENST00000431066; ENST00000443213 | TSF |
| 31% | chr12 | 122387836 | 122388242 | + | chr12 | 122389386 | 122389436 | + | ENST00000288912; ENST00000397454 | TSF |
| 31% | chr12 | 122387836 | 122388242 | + | chr12 | 122389386 | 122389436 | + | ENST00000288912; ENST00000397454 | TSF |
| 30% | chr17 | 80440912 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |
| 30% | chr17 | 80440912 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |
| 30% | chr17 | 80440912 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |
| 30% | chr17 | 80440912 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |
| 30% | chr6 | 80022917 | 80022085 | − | chr6 | 79924739 | 79924689 | − | ENST00000275036; ENST00000344726 | TSF |
| 30% | chr6 | 80022917 | 80022085 | − | chr6 | 79924739 | 79924689 | − | ENST00000275036; ENST00000344726 | TSF |
| 29% | chr19 | 49121994 | 49121817 | − | chr19 | 49121134 | 49121048 | − | ENST00000549920; ENST00000547897; ENST00000084795; ENST00000550645; ENST00000549370; ENST00000549273 | TAF |
| 29% | chr19 | 49121994 | 49121817 | − | chr19 | 49121134 | 49121048 | − | ENST00000549920; ENST00000547897; ENST00000084795; ENST00000550645; ENST00000549370; ENST00000549273 | TAF |
| 29% | chr19 | 49121994 | 49121817 | − | chr19 | 49121134 | 49121048 | − | ENST00000549920; ENST00000547897; | TAF |

TABLE 40-continued

Transcript fusion for Lung Squamous Cell Carcinoma (LUSC) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 29% | chr19 | 49121994 | 49121817 | − | chr19 | 49121134 | 49121048 | − | ENST00000084795; ENST00000550645; ENST00000549370; ENST00000549273 ENST00000549920; ENST00000547897; | TAF |
| 29% | chr19 | 49121994 | 49121817 | − | chr19 | 49121134 | 49121048 | − | ENST00000084795; ENST00000550645; ENST00000549370; ENST00000549273 ENST00000549920; ENST00000547897; | TAF |
| 29% | chr9 | 123165858 | 123165594 | − | chr9 | 123165349 | 123165084 | − | ENST00000359309; ENST00000360822; ENST00000349780; ENST00000360190; ENST00000416449; ENST00000425647 | TAF |
| 27% | chr17 | 30771499 | 30771536 | + | chr17 | 30773963 | 30774064 | + | ENST00000261712; ENST00000457654; ENST00000579451 | TAF |
| 27% | chr17 | 30771499 | 30771536 | + | chr17 | 30773963 | 30774064 | + | ENST00000261712; ENST00000457654; ENST00000579451 | TAF |
| 24% | chr21 | 19289273 | 19289717 | + | chr21 | 19628826 | 19629135 | + | ENST00000299295; ENST00000543733 | TAF |
| 24% | chr12 | 6602868 | 6602840 | − | chr12 | 6602138 | 6602028 | − | ENST00000229238 | TAF |
| 24% | chr12 | 122387836 | 122388242 | + | chr12 | 122392026 | 122392240 | + | ENST00000288912; ENST00000397454 | TSF |
| 24% | chr12 | 122387836 | 122388242 | + | chr12 | 122392026 | 122392240 | + | ENST00000288912; ENST00000397454 | TSF |
| 19% | chr3 | 180632728 | 180632783 | + | chr3 | 180651122 | 180651174 | + | ENST00000357559; ENST00000445140; ENST00000480918; ENST00000484042 | TAF |
| 19% | chr3 | 180632728 | 180632783 | + | chr3 | 180651122 | 180651174 | + | ENST00000357559; ENST00000445140; ENST00000480918; ENST00000484042 | TAF |
| 19% | chr3 | 180632728 | 180632783 | + | chr3 | 180651122 | 180651174 | + | ENST00000357559; ENST00000445140; ENST00000480918; ENST00000484042 | TAF |
| 19% | chr10 | 5077666 | 5077808 | + | chr10 | 5138602 | 5138769 | + | ENST00000602997; ENST00000605149; ENST00000380554 | TAF |
| 19% | chr10 | 5077666 | 5077808 | + | chr10 | 5138602 | 5138769 | + | ENST00000602997; ENST00000605149; ENST00000380554 | TAF |
| 18% | chr11 | 752380 | 752481 | + | chr11 | 755879 | 756002 | + | ENST00000319006; ENST00000528097; ENST00000530440 | TAF |
| 18% | chr11 | 752380 | 752481 | + | chr11 | 755879 | 756002 | + | ENST00000319006; ENST00000528097; ENST00000530440 | TAF |
| 18% | chr11 | 752380 | 752481 | + | chr11 | 755879 | 756002 | + | ENST00000319006; ENST00000528097; ENST00000530440 | TAF |
| 17% | chr17 | 79214190 | 79214239 | + | chr17 | 79214787 | 79214816; 79214953 | + | ENST00000431388; ENST00000576002 | TAF |
| 17% | chr17 | 79214190 | 79214239 | + | chr17 | 79214787 | 79214816; 79214953 | + | ENST00000431388; ENST00000576002 | TAF |
| 17% | chr7 | 99747312 | 99747315 | + | chr7 | 99751023 | 99751140; 99751352 | + | ENST00000341942; ENST00000441173 | TAF |
| 17% | chr7 | 99747312 | 99747315 | + | chr7 | 99751023 | 99751140; 99751352 | + | ENST00000341942; ENST00000441173 | TAF |
| 17% | chr11 | 87906665 | 87906580 | − | chr11 | 87883123 | 87882843 | − | ENST00000243662; ENST00000526372 | TAF |
| 17% | chr2 | 38983894 | 38983132 | − | chr2 | 38977336 | 38977156 | − | ENST00000313117; ENST00000425778; ENST00000425941; ENST00000446327; ENST00000409276; ENST00000431066; ENST00000443213 | TAF |
| 17% | chr2 | 38983894 | 38983132 | − | chr2 | 38977336 | 38977156 | − | ENST00000313117; ENST00000425778; ENST00000425941; ENST00000446327; ENST00000409276; ENST00000431066; ENST00000443213 | TAF |
| 17% | chr2 | 38983894 | 38983132 | − | chr2 | 38977336 | 38977156 | − | ENST00000313117; ENST00000425778; ENST00000425941; ENST00000446327; ENST00000409276; ENST00000431066; ENST00000443213 | TAF |
| 17% | chr2 | 38983894 | 38983132 | − | chr2 | 38977336 | 38977156 | − | ENST00000313117; ENST00000425778; ENST00000425941; ENST00000446327; ENST00000409276; ENST00000431066; ENST00000443213 | TAF |
| 17% | chr2 | 38983894 | 38983132 | − | chr2 | 38977336 | 38977156 | − | ENST00000313117; ENST00000425778; ENST00000425941; ENST00000446327; ENST00000409276; ENST00000431066; ENST00000443213 | TAF |
| 16% | chr2 | 65243329 | 65243368 | + | chr2 | 65243574 | 65243807 | + | ENST00000234256 | TSF |
| 16% | chr5 | 76107394 | 76108135 | + | chr5 | 76128515 | 76129626 | + | ENST00000296677 | TSF |
| 16% | chr19 | 56811235 | 56811344 | + | chr19 | 56813337 | 56813464 | + | ENST00000588026 | TSF |
| 15% | chr6 | 138423138 | 138423021 | − | chr6 | 138417631 | 138417491 | − | ENST00000421351 | TAF |
| 15% | chr11 | 60694460 | 60694542 | + | chr11 | 60694676 | 60694890 | + | ENST00000453848; ENST00000005286 | TSF |
| 15% | chr11 | 60694460 | 60694542 | + | chr11 | 60694676 | 60694890 | + | ENST00000453848; ENST00000005286 | TSF |
| 14% | chr7 | 56018506 | 56018522 | + | chr7 | 56020872 | 56021011 | + | ENST00000426595 | TSF |
| 13% | chr5 | 1811001 | 1811176 | + | chr5 | 1814453 | 1814575; 1814785 | + | ENST00000274137; ENST00000469176 | TAF |
| 13% | chr5 | 1811001 | 1811176 | + | chr5 | 1814453 | 1814575; 1814785 | + | ENST00000274137; ENST00000469176 | TAF |
| 13% | chr4 | 15791827 | 15792541 | + | chr4 | 15818134 | 15818263 | + | ENST00000502843; ENST00000226279 | TAF |
| 13% | chr4 | 15791827 | 15792541 | + | chr4 | 15818134 | 15818263 | + | ENST00000502843; ENST00000226279 | TAF |
| 13% | chr5 | 823586 | 823504 | − | chr5 | 822010 | 821976 | − | ENST00000424784; ENST00000283441 | TAF |
| 12% | chr1 | 171237955 | 171238225 | + | chr1 | 171244485 | 171244647 | + | ENST00000433267; ENST00000367750; ENST00000402921; ENST00000354841 | TAF |
| 12% | chr1 | 171237955 | 171238225 | + | chr1 | 171244485 | 171244647 | + | ENST00000433267; ENST00000367750; | TAF |

TABLE 40-continued

Transcript fusion for Lung Squamous Cell Carcinoma (LUSC) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 12% | chr3 | 197680391 | 197680531 | + | chr3 | 197680874 | 197681018; 197680991 | + | ENST00000402921; ENST00000354841 ENST00000464167; ENST00000448864; ENST00000442341 | TAF |
| 12% | chr3 | 197680391 | 197680531 | + | chr3 | 197680874 | 197681018; 197680991 | + | ENST00000464167; ENST00000448864; ENST00000442341 | TAF |
| 12% | chr3 | 141642134 | 141642345 | + | chr3 | 141644373 | 141644543 | + | ENST00000286371; ENST00000462082 | TAF |
| 12% | chr3 | 183973543 | 183973607 | + | chr3 | 183975261 | 183975544 | + | ENST00000324557; ENST00000402825 | TSF |
| 12% | chr3 | 183973543 | 183973607 | + | chr3 | 183975261 | 183975544 | + | ENST00000324557; ENST00000402825 | TSF |
| 11% | chr11 | 424193 | 423942 | − | chr11 | 421198 | 421141 | − | ENST00000332826 | TAF |
| 11% | chr19 | 39347374 | 39346206 | − | chr19 | 39338074 | 39337956 | − | ENST00000221419; ENST00000601449; ENST00000600233; ENST00000601813 | TSF |
| 11% | chr19 | 39347374 | 39346206 | − | chr19 | 39338074 | 39337956 | − | ENST00000221419; ENST00000601449; ENST00000600233; ENST00000601813 | TSF |
| 11% | chr19 | 39347374 | 39346206 | − | chr19 | 39338074 | 39337956 | − | ENST00000221419; ENST00000601449; ENST00000600233; ENST00000601813 | TSF |
| 11% | chr19 | 39347374 | 39346430 | − | chr19 | 39338074 | 39337956 | − | ENST00000221419; ENST00000601449; ENST00000600233; ENST00000601813 | TSF |
| 11% | chr19 | 39347374 | 39346430 | − | chr19 | 39338074 | 39337956 | − | ENST00000221419; ENST00000601449; ENST00000600233; ENST00000601813 | TSF |
| 11% | chr19 | 39347374 | 39346430 | − | chr19 | 39338074 | 39337956 | − | ENST00000221419; ENST00000601449; ENST00000600233; ENST00000601813 | TSF |
| 11% | chr22 | 22899971 | 22899965 | − | chr22 | 22893511 | 22893189; 22893185; 22893481; 22893274 | − | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |
| 11% | chr22 | 22899971 | 22899965 | − | chr22 | 22893511 | 22893189; 22893185; 22893481; 22893274 | − | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |
| 11% | chr22 | 22899971 | 22899965 | − | chr22 | 22893511 | 22893189; 22893185; 22893481; 22893274 | − | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |
| 11% | chr22 | 22899971 | 22899965 | − | chr22 | 22893511 | 22893189; 22893185; 22893481; 22893274 | − | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |
| 11% | chr22 | 22899971 | 22899965 | − | chr22 | 22893511 | 22893189; 22893185; 22893481; 22893274 | − | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |
| 11% | chr22 | 22899971 | 22899965 | − | chr22 | 22893511 | 22893189; 22893185; 22893481; 22893274 | − | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |
| 10% | chr3 | 183371827 | 183371877 | + | chr3 | 183381246 | 183381430 | + | ENST00000242810; ENST00000454652; ENST00000476808 | TAF |
| 10% | chr3 | 183371827 | 183371877 | + | chr3 | 183381246 | 183381430 | + | ENST00000242810; ENST00000454652; ENST00000476808 | TAF |
| 10% | chr1 | 165863702 | 165863816 | + | chr1 | 165865427 | 165865569 | + | ENST00000367879 | TAF |
| 10% | chr20 | 33191661 | 33190934 | − | chr20 | 33176411 | 33176257; 33176344 | − | ENST00000217446; ENST00000374820; ENST00000452740; ENST00000438215 | TAF |
| 10% | chr20 | 33191661 | 33190934 | − | chr20 | 33176411 | 33176257; 33176344 | − | ENST00000217446; ENST00000374820; ENST00000452740; ENST00000438215 | TAF |
| 10% | chr20 | 33191661 | 33190934 | − | chr20 | 33176411 | 33176257; 33176344 | − | ENST00000217446; ENST00000374820; ENST00000452740; ENST00000438215 | TAF |

TABLE 40-continued

Transcript fusion for Lung Squamous Cell Carcinoma (LUSC) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 10% | chr19 | 51854024 | 51853970 | – | chr19 | 51853645 | 51853583 | – | ENST00000354232; ENST00000309244; ENST00000596253 | TAF |
| 10% | chr19 | 51854024 | 51853970 | – | chr19 | 51853645 | 51853583 | – | ENST00000354232; ENST00000309244; ENST00000596253 | TAF |
| 10% | chr1 | 6380703 | 6380649 | – | chr1 | 6378638 | 6378552 | – | ENST00000608083; ENST00000377842; ENST00000377845; ENST00000377855; ENST00000377860; ENST00000418124; ENST00000545482; ENST00000361521; ENST00000473466; ENST00000541130 | TAF |
| 10% | chr1 | 6380703 | 6380649 | – | chr1 | 6378638 | 6378552 | – | ENST00000608083; ENST00000377842; ENST00000377845; ENST00000377855; ENST00000377860; ENST00000418124; ENST00000545482; ENST00000361521; ENST00000473466; ENST00000541130 | TAF |
| 10% | chr1 | 6380703 | 6380649 | – | chr1 | 6378638 | 6378552 | – | ENST00000608083; ENST00000377842; ENST00000377845; ENST00000377855; ENST00000377860; ENST00000418124; ENST00000545482; ENST00000361521; ENST00000473466; ENST00000541130 | TAF |
| 10% | chr1 | 6380703 | 6380649 | – | chr1 | 6378638 | 6378552 | – | ENST00000608083; ENST00000377842; ENST00000377845; ENST00000377855; ENST00000377860; ENST00000418124; ENST00000545482; ENST00000361521; ENST00000473466; ENST00000541130 | TAF |
| 10% | chr1 | 6380703 | 6380649 | – | chr1 | 6378638 | 6378552 | – | ENST00000608083; ENST00000377842; ENST00000377845; ENST00000377855; ENST00000377860; ENST00000418124; ENST00000545482; ENST00000361521; ENST00000473466; ENST00000541130 | TAF |
| 10% | chr9 | 123165858 | 123165577 | – | chr9 | 123165349 | 123165084 | – | ENST00000359309; ENST00000360822; ENST00000349780; ENST00000360190; ENST00000416449; ENST00000425647 | TSF |
| 10% | chr9 | 123165858 | 123165617 | – | chr9 | 123165349 | 123165084 | – | ENST00000359309; ENST00000360822; ENST00000349780; ENST00000360190; ENST00000416449; ENST00000425647 | TSF |
| 9% | chrX | 151410500 | 151410406 | – | chrX | 151393317 | 151393235 | – | ENST00000370314; ENST00000535043 | TSF |
| 9% | chr22 | 29117574 | 29117506 | – | chr22 | 29115473 | 29115383; 29115458 | – | ENST00000348295; ENST00000382566; ENST00000382578; ENST00000404276; ENST00000328354; ENST00000405598; ENST00000382580; ENST00000433728; ENST00000448511; ENST00000402731; ENST00000403642; ENST00000439200 | TSF |
| 9% | chr22 | 29117574 | 29117506 | – | chr22 | 29115473 | 29115383; 29115458 | – | ENST00000348295; ENST00000382566; ENST00000382578; ENST00000404276; ENST00000328354; ENST00000405598; ENST00000382580; ENST00000433728; ENST00000448511; ENST00000402731; ENST00000403642; ENST00000439200 | TSF |
| 9% | chr22 | 29117574 | 29117506 | – | chr22 | 29115473 | 29115383; 29115458 | – | ENST00000348295; ENST00000382566; ENST00000382578; ENST00000404276; ENST00000328354; ENST00000405598; ENST00000382580; ENST00000433728; ENST00000448511; ENST00000402731; ENST00000403642; ENST00000439200 | TSF |
| 9% | chr22 | 29117574 | 29117506 | – | chr22 | 29115473 | 29115383; 29115458 | – | ENST00000348295; ENST00000382566; ENST00000382578; ENST00000404276; ENST00000328354; ENST00000405598; ENST00000382580; ENST00000433728; ENST00000448511; ENST00000402731; ENST00000403642; ENST00000439200 | TSF |
| 9% | chr22 | 29117574 | 29117506 | – | chr22 | 29115473 | 29115383; 29115458 | – | ENST00000348295; ENST00000382566; ENST00000382578; ENST00000404276; ENST00000328354; ENST00000405598; ENST00000382580; ENST00000433728; ENST00000448511; ENST00000402731; ENST00000403642; ENST00000439200 | TSF |
| 8% | chr10 | 5057417 | 5057095 | – | chr10 | 5043873 | 5043706 | – | ENST00000380753; ENST00000421196; ENST00000407674; ENST00000604507; ENST00000455190 | TSF |
| 8% | chr10 | 5057417 | 5057095 | – | chr10 | 5043873 | 5043706 | – | ENST00000380753; ENST00000421196; ENST00000407674; ENST00000604507; ENST00000455190 | TSF |
| 8% | chr10 | 5057417 | 5057095 | – | chr10 | 5043873 | 5043706 | – | ENST00000380753; ENST00000421196; ENST00000407674; ENST00000604507; ENST00000455190 | TSF |

TABLE 40-continued

Transcript fusion for Lung Squamous Cell Carcinoma (LUSC) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 8% | chr10 | 5057417 | 5057095 | − | chr10 | 5043873 | 5043706 | − | ENST00000380753; ENST00000421196; ENST00000407674; ENST00000604507; ENST00000455190 | TSF |
| 8% | chr12 | 122430912 | 122432103 | + | chr12 | 122437622 | 122437850 | + | ENST00000288912 | TSF |
| 8% | chr12 | 122430912 | 122431795 | + | chr12 | 122437622 | 122437850 | + | ENST00000288912 | TSF |
| 8% | chr7 | 134212336 | 134212386 | + | chr7 | 134215479 | 134215562 | + | ENST00000359579 | TSF |
| 7% | chrX | 134954053 | 134953756 | − | chrX | 134950187 | 134950078 | − | ENST00000420087; ENST00000463085; ENST00000370724; ENST00000491480 | TSF |
| 7% | chrX | 134954053 | 134953756 | − | chrX | 134950187 | 134950078 | − | ENST00000420087; ENST00000463085; ENST00000370724; ENST00000491480 | TSF |
| 7% | chrX | 134971303 | 134971006 | − | chrX | 134950187 | 134950078 | − | ENST00000420087; ENST00000463085; ENST00000370724; ENST00000491480 | TSF |
| 7% | chrX | 134971303 | 134971006 | − | chrX | 134950187 | 134950078 | − | ENST00000420087; ENST00000463085; ENST00000370724; ENST00000491480 | TSF |
| 7% | chrX | 134971303 | 134971006 | − | chrX | 134967437 | 134967328 | − | ENST00000491002; ENST00000448053; ENST00000472834 | TSF |
| 7% | chr7 | 23290404 | 23290481 | + | chr7 | 23292926 | 23293078 | + | ENST00000258733; ENST00000381990; ENST00000409458; ENST00000453162 | TSF |
| 7% | chr7 | 23290404 | 23290481 | + | chr7 | 23292926 | 23293078 | + | ENST00000258733; ENST00000381990; ENST00000409458; ENST00000453162 | TSF |
| 7% | chr7 | 23290404 | 23290481 | + | chr7 | 23292926 | 23293078 | + | ENST00000258733; ENST00000381990; ENST00000409458; ENST00000453162 | TSF |
| 7% | chr7 | 23290404 | 23290481 | + | chr7 | 23292926 | 23293078 | + | ENST00000258733; ENST00000381990; ENST00000409458; ENST00000453162 | TSF |
| 7% | chr15 | 40187476 | 40186733 | − | chr15 | 40099459 | 40099207 | − | ENST00000561100; ENST00000543580 | TSF |
| 7% | chr10 | 5060345 | 5060092 | − | chr10 | 5043777 | 5043706 | − | ENST00000380753; ENST00000421196; ENST00000407674; ENST00000604507; ENST00000455190 | TSF |
| 7% | chr10 | 5060345 | 5060092 | − | chr10 | 5043777 | 5043706 | − | ENST00000380753; ENST00000421196; ENST00000407674; ENST00000604507; ENST00000455190 | |
| 7% | chr10 | 5060345 | 5060092 | − | chr10 | 5043777 | 5043706 | − | ENST00000380753; ENST00000421196; ENST00000407674; ENST00000604507; ENST00000455190 | |
| 7% | chr10 | 5060345 | 5060092 | − | chr10 | 5043777 | 5043706 | − | ENST00000380753; ENST00000421196; ENST00000407674; ENST00000604507; ENST00000455190 | |
| 7% | chrX | 134866155 | 134866452 | + | chrX | 134870023 | 134870132 | + | ENST00000370736; ENST00000471213; ENST00000495729 | TSF |
| 7% | chrX | 134866155 | 134866452 | + | chrX | 134887292 | 134887401 | + | ENST00000370734; ENST00000485366; ENST00000443882 | TSF |
| 7% | chrX | 134883429 | 134883726 | + | chrX | 134887292 | 134887401 | + | ENST00000370734; ENST00000485366; ENST00000443882 | TSF |
| 7% | chr12 | 58023123 | 58023062 | − | chr12 | 58022929 | 58022831; 58022905 | − | ENST00000341156; ENST00000418555; ENST00000552798; ENST00000549391 | TSF |
| 7% | chr12 | 58023123 | 58023062 | − | chr12 | 58022929 | 58022831; 58022905 | − | ENST00000341156; ENST00000418555; ENST00000552798; ENST00000549391 | TSF |
| 7% | chrX | 134954053 | 134953756 | − | chrX | 134932924 | 134932815 | − | ENST00000487941; ENST00000434966; ENST00000494421 | TSF |
| 7% | chrX | 134936794 | 134936497 | − | chrX | 134932924 | 134932815 | − | ENST00000487941; ENST00000434966; ENST00000494421 | TSF |
| 7% | chr2 | 143794737 | 143794842 | + | chr2 | 143797997 | 143798227 | + | ENST00000264170; ENST00000409512 | TSF |
| 7% | chr17 | 39974832 | 39974893 | + | chr17 | 39975462 | 39975651 | + | ENST00000321562 | TSF |
| 7% | chr20 | 634541 | 634468 | − | chr20 | 629561 | 629358; 629500 | − | ENST00000381962; ENST00000488788 | TSF |
| 7% | chr20 | 634541 | 634468 | − | chr20 | 629561 | 629358; 629500 | − | ENST00000381962; ENST00000488788 | TSF |
| 6% | chrX | 134971303 | 134971006 | − | chrX | 134932924 | 134932815 | − | ENST00000487941; ENST00000434966; ENST00000494421 | TSF |
| 6% | chr3 | 184749371 | 184749503 | + | chr3 | 184766267 | 184766347 | + | ENST00000287546; ENST00000437079; ENST00000436792; ENST00000446204 | TSF |
| 6% | chrX | 154534914 | 154534817 | − | chrX | 154528458 | 154528349 | − | ENST00000369449; ENST00000321926 | TSF |
| 6% | chrX | 154534914 | 154534817 | − | chrX | 154528458 | 154528349 | − | ENST00000369449; ENST00000321926 | TSF |
| 6% | chr6 | 161637963 | 161637691 | − | chr6 | 161587449 | 161587280; 161587148 | − | ENST00000320285; ENST00000366908; ENST00000436279; ENST00000366905 | TSF |
| 6% | chr6 | 161637963 | 161637691 | − | chr6 | 161587449 | 161587280; 161587148 | − | ENST00000320285; ENST00000366908; ENST00000436279; ENST00000366905 | TSF |
| 6% | chr6 | 161637963 | 161637691 | − | chr6 | 161587449 | 161587280; 161587148 | − | ENST00000320285; ENST00000366908; ENST00000436279; ENST00000366905 | TSF |
| 6% | chr10 | 125606103 | 125605751 | − | chr10 | 125602004 | 125601865 | − | ENST00000241305 | TSF |
| 6% | chr10 | 5060345 | 5060040 | − | chr10 | 5043873 | 5043706 | − | ENST00000380753; ENST00000421196; ENST00000407674; ENST00000604507; ENST00000455190 | TSF |
| 6% | chr10 | 5060345 | 5060040 | − | chr10 | 5043873 | 5043706 | − | ENST00000380753; ENST00000421196; ENST00000407674; ENST00000604507; ENST00000455190 | TSF |
| 6% | chr10 | 5060345 | 5060040 | − | chr10 | 5043873 | 5043706 | − | ENST00000380753; ENST00000421196; | TSF |

TABLE 40-continued

Transcript fusion for Lung Squamous Cell Carcinoma (LUSC) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 6% | chr10 | 5060345 | 5060040 | − | chr10 | 5043873 | 5043706 | − | ENST00000407674; ENST00000604507; ENST00000455190 ENST00000380753; ENST00000421196; ENST00000407674; ENST00000604507; ENST00000455190 | TSF |
| 6% | chr9 | 131902050 | 131902148 | + | chr9 | 131904724 | 131904831; 131905179 | + | ENST00000358994; ENST00000393370; ENST00000337738; ENST00000348141; ENST00000452489; ENST00000357197; ENST00000347048; ENST00000355007; ENST00000417728; ENST00000411917; ENST00000423100; ENST00000524946; ENST00000436883; ENST00000414510; ENST00000432124; ENST00000435305; ENST00000419582; ENST00000432651; ENST00000435132; ENST00000434095 | TSF |
| 6% | chr9 | 131902050 | 131902148 | + | chr9 | 131904724 | 131904831; 131905179 | + | ENST00000358994; ENST00000393370; ENST00000337738; ENST00000348141; ENST00000452489; ENST00000357197; ENST00000347048; ENST00000355007; ENST00000417728; ENST00000411917; ENST00000423100; ENST00000524946; ENST00000436883; ENST00000414510; ENST00000432124; ENST00000435305; ENST00000419582; ENST00000432651; ENST00000435132; ENST00000434095 | TSF |
| 6% | chr9 | 131902050 | 131902148 | + | chr9 | 131904724 | 131904831; 131905179 | + | ENST00000358994; ENST00000393370; ENST00000337738; ENST00000348141; ENST00000452489; ENST00000357197; ENST00000347048; ENST00000355007; ENST00000417728; ENST00000411917; ENST00000423100; ENST00000524946; ENST00000436883; ENST00000414510; ENST00000432124; ENST00000435305; ENST00000419582; ENST00000432651; ENST00000435132; ENST00000434095 | TSF |
| 6% | chr9 | 131902050 | 131902148 | + | chr9 | 131904724 | 131904831; 131905179 | + | ENST00000358994; ENST00000393370; ENST00000337738; ENST00000348141; ENST00000452489; ENST00000357197; ENST00000347048; ENST00000355007; ENST00000417728; ENST00000411917; ENST00000423100; ENST00000524946; ENST00000436883; ENST00000414510; ENST00000432124; ENST00000435305; ENST00000419582; ENST00000432651; ENST00000435132; ENST00000434095 | TSF |
| 6% | chr9 | 131902050 | 131902148 | + | chr9 | 131904724 | 131904831; 131905179 | + | ENST00000358994; ENST00000393370; ENST00000337738; ENST00000348141; ENST00000452489; ENST00000357197; ENST00000347048; ENST00000355007; ENST00000417728; ENST00000411917; ENST00000423100; ENST00000524946; ENST00000436883; ENST00000414510; ENST00000432124; ENST00000435305; ENST00000419582; ENST00000432651; ENST00000435132; ENST00000434095 | TSF |
| 6% | chr12 | 122430912 | 122432282 | + | chr12 | 122437622 | 122437850 | + | ENST00000288912 | TSF |
| 6% | chr12 | 6602868 | 6602754 | − | chr12 | 6602138 | 6602028 | − | ENST00000229238 | TSF |
| 5% | chr6 | 37326936 | 37327118 | + | chr6 | 37328222 | 37328350 | + | ENST00000373479; ENST00000229866; ENST00000394443; ENST00000469316; ENST00000469731 | TSF |
| 5% | chr6 | 37326936 | 37327118 | + | chr6 | 37328222 | 37328350 | + | ENST00000373479; ENST00000229866; ENST00000394443; ENST00000469316; ENST00000469731 | TSF |
| 5% | chr6 | 37326936 | 37327118 | + | chr6 | 37328222 | 37328350 | + | ENST00000373479; ENST00000229866; ENST00000394443; ENST00000469316; ENST00000469731 | TSF |
| 5% | chr6 | 37326936 | 37327118 | + | chr6 | 37328222 | 37328350 | + | ENST00000373479; ENST00000229866; ENST00000394443; ENST00000469316; ENST00000469731 | TSF |
| 5% | chr1 | 165854440 | 165854616 | + | chr1 | 165859441 | 165859600 | + | ENST00000367879; ENST00000372212 | TSF |
| 5% | chr1 | 165854440 | 165854616 | + | chr1 | 165859441 | 165859600 | + | ENST00000367879; ENST00000372212 | TSF |
| 5% | chr20 | 45337040 | 45337192 | + | chr20 | 45353680 | 45354963 | + | ENST00000359271 | TSF |
| 5% | chr21 | 19399995 | 19400289 | + | chr21 | 19628826 | 19629135 | + | ENST00000299295; ENST00000543733 | TSF |
| 5% | chr1 | 41465686 | 41465756 | + | chr1 | 41466701 | 41466789 | + | ENST00000372621; ENST00000541520; ENST00000372616 | TSF |

TABLE 40-continued

Transcript fusion for Lung Squamous Cell Carcinoma (LUSC) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 5% | chr5 | 76107394 | 76108212 | + | chr5 | 76128515 | 76129626 | + | ENST00000296677 | TSF |
| 5% | chr9 | 117824597 | 117824593 | − | chr9 | 117822281 | 117822009 | − | ENST00000350763; ENST00000341037; ENST00000423613 | TSF |
| 5% | chr9 | 117824597 | 117824593 | − | chr9 | 117822281 | 117822009 | − | ENST00000350763; ENST00000341037; ENST00000423613 | TSF |
| 5% | chr9 | 117824597 | 117824593 | − | chr9 | 117822281 | 117822009 | − | ENST00000350763; ENST00000341037; ENST00000423613 | TSF |
| 5% | chr10 | 79700435 | 79700428 | − | chr10 | 79628955 | 79628887 | − | ENST00000372391; ENST00000372388; ENST00000468332 | TSF |
| 5% | chr10 | 79700435 | 79700428 | − | chr10 | 79628955 | 79628887 | − | ENST00000372391; ENST00000372388; ENST00000468332 | TSF |
| 5% | chr10 | 79700435 | 79700428 | − | chr10 | 79628955 | 79628887 | − | ENST00000372391; ENST00000372388; ENST00000468332 | TSF |
| 5% | chr8 | 39759879 | 39759967 | + | chr8 | 39775394 | 39775489; 39775448 | + | ENST00000518804; ENST00000519154; ENST00000522495; ENST00000522840; ENST00000518237; ENST00000253513 | TSF |
| 5% | chr8 | 39759879 | 39759967 | + | chr8 | 39775394 | 39775489; 39775448 | + | ENST00000518804; ENST00000519154; ENST00000522495; ENST00000522840; ENST00000518237; ENST00000253513 | TSF |
| 5% | chr8 | 39759879 | 39759967 | + | chr8 | 39775394 | 39775489; 39775448 | + | ENST00000518804; ENST00000519154; ENST00000522495; ENST00000522840; ENST00000518237; ENST00000253513 | TSF |
| 5% | chr8 | 39759879 | 39759967 | + | chr8 | 39775394 | 39775489; 39775448 | + | ENST00000518804; ENST00000519154; ENST00000522495; ENST00000522840; ENST00000518237; ENST00000253513 | TSF |
| 5% | chr8 | 39759879 | 39759967 | + | chr8 | 39775394 | 39775489; 39775448 | + | ENST00000518804; ENST00000519154; ENST00000522495; ENST00000522840; ENST00000518237; ENST00000253513 | TSF |
| 5% | chr3 | 183460031 | 183460733 | + | chr3 | 183465460 | 183465504 | + | ENST00000305135 | TSF |
| 5% | chr6 | 124669760 | 124669850 | + | chr6 | 124676413 | 124676493 | + | ENST00000368416; ENST00000368417; ENST00000546092; ENST00000545433 | TSF |
| 5% | chr6 | 124669760 | 124669850 | + | chr6 | 124676413 | 124676493 | + | ENST00000368416; ENST00000368417; ENST00000546092; ENST00000545433 | TSF |
| 5% | chr6 | 124669760 | 124669850 | + | chr6 | 124676413 | 124676493 | + | ENST00000368416; ENST00000368417; ENST00000546092; ENST00000545433 | TSF |
| 5% | chr6 | 124669760 | 124669850 | + | chr6 | 124676413 | 124676493 | + | ENST00000368416; ENST00000368417; ENST00000546092; ENST00000545433 | TSF |
| 5% | chr17 | 39976225 | 39976301 | + | chr17 | 39976521 | 39976713 | + | ENST00000321562; ENST00000455106; ENST00000544340 | TSF |
| 5% | chr19 | 46194689 | 46194670 | − | chr19 | 46191824 | 46191645 | − | ENST00000342669; ENST00000588301; ENST00000590212 | TSF |
| 5% | chr19 | 46194689 | 46194670 | − | chr19 | 46191824 | 46191645 | − | ENST00000342669; ENST00000588301; ENST00000590212 | TSF |
| 4% | chr12 | 96340433 | 96341255 | + | chr12 | 96346495 | 96346601 | + | ENST00000266736; ENST00000548310 | TSF |
| 4% | chr12 | 96340433 | 96341255 | + | chr12 | 96346495 | 96346601 | + | ENST00000266736; ENST00000548310 | TSF |
| 4% | chr8 | 104389530 | 104389536 | + | chr8 | 104390255 | 104390471 | + | ENST00000330295; ENST00000520337 | TSF |
| 4% | chr1 | 45988716 | 45988450 | − | chr1 | 45981479 | 45981326 | − | ENST00000262746; ENST00000319248; ENST00000447184; ENST00000424390 | TSF |
| 4% | chr1 | 45988716 | 45988450 | − | chr1 | 45981479 | 45981326 | − | ENST00000262746; ENST00000319248; ENST00000447184; ENST00000424390 | TSF |
| 4% | chr10 | 5060345 | 5060092 | − | chr10 | 5040939 | 5040817 | − | ENST00000380753; ENST00000421196; ENST00000407674; ENST00000604507 | TSF |
| 4% | chr10 | 5060345 | 5060092 | − | chr10 | 5040939 | 5040817 | − | ENST00000380753; ENST00000421196; ENST00000407674; ENST00000604507 | TSF |
| 4% | chr2 | 38983894 | 38983086 | − | chr2 | 38977336 | 38977156 | − | ENST00000313117; ENST00000425778; ENST00000425941; ENST00000446327; ENST00000409276; ENST00000431066; ENST00000443213 | TSF |
| 4% | chr2 | 38983894 | 38983086 | − | chr2 | 38977336 | 38977156 | − | ENST00000313117; ENST00000425778; ENST00000425941; ENST00000446327; ENST00000409276; ENST00000431066; ENST00000443213 | TSF |
| 4% | chr2 | 38983894 | 38983086 | − | chr2 | 38977336 | 38977156 | − | ENST00000313117; ENST00000425778; ENST00000425941; ENST00000446327; ENST00000409276; ENST00000431066; ENST00000443213 | TSF |
| 4% | chr2 | 38983894 | 38983086 | − | chr2 | 38977336 | 38977156 | − | ENST00000313117; ENST00000425778; ENST00000425941; ENST00000446327; ENST00000409276; ENST00000431066; ENST00000443213 | TSF |
| 4% | chr2 | 38983894 | 38983086 | − | chr2 | 38977336 | 38977156 | − | ENST00000313117; ENST00000425778; ENST00000425941; ENST00000446327; ENST00000409276; ENST00000431066; ENST00000443213 | TSF |
| 4% | chrX | 154534914 | 154534773 | − | chrX | 154528458 | 154528349 | − | ENST00000369449; ENST00000321926 | TSF |

TABLE 40-continued

Transcript fusion for Lung Squamous Cell Carcinoma (LUSC) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 4% | chrX | 154534914 | 154534773 | − | chrX | 154528458 | 154528349 | − | ENST00000369449; ENST00000321926 | TSF |
| 4% | chr12 | 28565851 | 28565871 | + | chr12 | 28603094 | 28603186 | + | ENST00000540794; ENST00000539107; ENST00000536442; ENST00000545336; ENST00000545737; ENST00000381256; ENST00000381259; ENST00000306172 | TSF |
| 4% | chr12 | 28565851 | 28565871 | + | chr12 | 28603094 | 28603186 | + | ENST00000540794; ENST00000539107; ENST00000536442; ENST00000545336; ENST00000545737; ENST00000381256; ENST00000381259; ENST00000306172 | TSF |
| 4% | chr12 | 28565851 | 28565871 | + | chr12 | 28603094 | 28603186 | + | ENST00000540794; ENST00000539107; ENST00000536442; ENST00000545336; ENST00000545737; ENST00000381256; ENST00000381259; ENST00000306172 | TSF |
| 4% | chr12 | 28565851 | 28565871 | + | chr12 | 28603094 | 28603186 | + | ENST00000540794; ENST00000539107; ENST00000536442; ENST00000545336; ENST00000545737; ENST00000381256; ENST00000381259; ENST00000306172 | TSF |
| 4% | chr11 | 60694460 | 60694539 | + | chr11 | 60694676 | 60694890 | + | ENST00000453848; ENST00000005286 | TSF |
| 4% | chr11 | 60694460 | 60694539 | + | chr11 | 60694676 | 60694890 | + | ENST00000453848; ENST00000005286 | TSF |
| 4% | chr3 | 115829645 | 115827368 | − | chr3 | 115805403 | 115805171 | − | ENST00000490035; ENST00000333617; ENST00000539563; ENST00000474851 | TSF |
| 4% | chr3 | 115829645 | 115827368 | − | chr3 | 115805403 | 115805171 | − | ENST00000490035; ENST00000333617; ENST00000539563; ENST00000474851 | TSF |
| 4% | chr3 | 115829645 | 115827368 | − | chr3 | 115805403 | 115805171 | − | ENST00000490035; ENST00000333617; ENST00000539563; ENST00000474851 | TSF |
| 4% | chr9 | 123165858 | 123165677 | − | chr9 | 123165349 | 123165084 | − | ENST00000359309; ENST00000360822; ENST00000349780; ENST00000360190; ENST00000416449; ENST00000425647 | TSF |
| 4% | chr9 | 132580720 | 132580632 | − | chr9 | 132576501 | 132576251 | − | ENST00000351698 | TSF |
| 4% | chr3 | 191873117 | 191872988 | − | chr3 | 191861916 | 191861798; 191861849 | − | ENST00000445105; ENST00000264730; ENST00000454309; ENST00000440901; ENST00000450716; ENST00000430714; ENST00000448795 | TSF |
| 4% | chr3 | 191873117 | 191872988 | − | chr3 | 191861916 | 191861798; 191861849 | − | ENST00000445105; ENST00000264730; ENST00000454309; ENST00000440901; ENST00000450716; ENST00000430714; ENST00000448795 | TSF |
| 4% | chr12 | 122387836 | 122388242 | + | chr12 | 122394980 | 122395174 | + | ENST00000288912; ENST00000397454 | TSF |
| 4% | chr12 | 122387836 | 122388242 | + | chr12 | 122394980 | 122395174 | + | ENST00000288912; ENST00000397454 | TSF |
| 4% | chr1 | 31218846 | 31218765 | − | chr1 | 31215396 | 31215303 | − | ENST00000294507 | TSF |
| 4% | chr7 | 44158417 | 44158351 | − | chr7 | 44157663 | 44157542 | − | ENST00000406581; ENST00000223361; ENST00000452185; ENST00000433715; ENST00000456038; ENST00000418438 | TSF |
| 4% | chr7 | 44158417 | 44158351 | − | chr7 | 44157663 | 44157542 | − | ENST00000406581; ENST00000223361; ENST00000452185; ENST00000433715; ENST00000456038; ENST00000418438 | TSF |
| 4% | chr7 | 44158417 | 44158351 | − | chr7 | 44157663 | 44157542 | − | ENST00000406581; ENST00000223361; ENST00000452185; ENST00000433715; ENST00000456038; ENST00000418438 | TSF |
| 4% | chr7 | 44158417 | 44158351 | − | chr7 | 44157663 | 44157542 | − | ENST00000406581; ENST00000223361; ENST00000452185; ENST00000433715; ENST00000456038; ENST00000418438 | TSF |
| 4% | chr7 | 44158417 | 44158351 | − | chr7 | 44157663 | 44157542 | − | ENST00000406581; ENST00000223361; ENST00000452185; ENST00000433715; ENST00000456038; ENST00000418438 | TSF |
| 4% | chr3 | 197640178 | 197640160 | − | chr3 | 197639620 | 197639546 | − | ENST00000265239; ENST00000455191 | TSF |
| 4% | chr8 | 130855946 | 130855855 | − | chr8 | 130854451 | 130854388 | − | ENST00000519824; ENST00000522746; ENST00000523509; ENST00000401979; ENST00000519110; ENST00000522250; ENST00000517654; ENST00000519540; ENST00000522941 | TSF |
| 4% | chr16 | 83989605 | 83989746 | + | chr16 | 83991245 | 83991255; 83991343 | + | ENST00000561552; ENST00000343939 | TSF |
| 4% | chr16 | 83989605 | 83989746 | + | chr16 | 83991245 | 83991255; 83991343 | + | ENST00000561552; ENST00000343939 | TSF |
| 4% | chr7 | 56020443 | 56020541 | + | chr7 | 56020872 | 56021011 | + | ENST00000426595 | TSF |
| 4% | chr10 | 5060345 | 5060092 | − | chr10 | 5043783 | 5043706 | − | ENST00000380753; ENST00000421196; ENST00000407674; ENST00000604507; ENST00000455190 | TSF |
| 4% | chr10 | 5060345 | 5060092 | − | chr10 | 5043783 | 5043706 | − | ENST00000380753; ENST00000421196; ENST00000407674; ENST00000604507; ENST00000455190 | TSF |
| 4% | chr10 | 5060345 | 5060092 | − | chr10 | 5043783 | 5043706 | − | ENST00000380753; ENST00000421196; ENST00000407674; ENST00000604507; ENST00000455190 | TSF |
| 4% | chr10 | 5060345 | 5060092 | − | chr10 | 5043783 | 5043706 | − | ENST00000380753; ENST00000421196; ENST00000407674; ENST00000604507; | TSF |

TABLE 40-continued

Transcript fusion for Lung Squamous Cell Carcinoma (LUSC) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 3% | chr1 | 59980221 | 59980497 | + | chr1 | 60019796 | 60019899 | + | ENST00000455190 ENST00000371218; ENST00000303721; ENST00000430447; ENST00000371212 | TSF |
| 3% | chr1 | 59980221 | 59980497 | + | chr1 | 60019796 | 60019899 | + | ENST00000371218; ENST00000303721; ENST00000430447; ENST00000371212 | TSF |
| 3% | chr1 | 59980221 | 59980497 | + | chr1 | 60019796 | 60019899 | + | ENST00000371218; ENST00000303721; ENST00000430447; ENST00000371212 | TSF |
| 3% | chr7 | 56018506 | 56018522 | + | chr7 | 56022602 | 56022871; 56022865 | + | ENST00000426595; ENST00000285298; ENST00000443449 | TSF |
| 3% | chr7 | 56018506 | 56018522 | + | chr7 | 56022602 | 56022871; 56022865 | + | ENST00000426595; ENST00000285298; ENST00000443449 | TSF |
| 3% | chr3 | 190065748 | 190065532 | − | chr3 | 190030825 | 190030661 | − | ENST00000295522 | TSF |
| 3% | chr11 | 93468219 | 93468129 | − | chr11 | 93466563 | 93466528 | − | ENST00000393259 | TSF |
| 3% | chrX | 154751709 | 154751612 | − | chrX | 154528458 | 154528349 | − | ENST00000369449; ENST00000321926 | TSF |
| 3% | chrX | 154751709 | 154751612 | − | chrX | 154528458 | 154528349 | − | ENST00000369449; ENST00000321926 | TSF |
| 3% | chr14 | 51360331 | 51362440 | + | chr14 | 51368547 | 51368629 | + | ENST00000337334; ENST00000353130; ENST00000395752 | TSF |
| 3% | chr1 | 1422590 | 1422685 | + | chr1 | 1423243 | 1423294 | + | ENST00000308647 | TSF |
| 3% | chr1 | 168348640 | 168349020 | + | chr1 | 168549301 | 168549415 | + | ENST00000367818 | TSF |
| 3% | chr1 | 1562829 | 1562926 | + | chr1 | 1563053 | 1563209 | + | ENST00000520777; ENST00000357210; ENST00000360522; ENST00000378710; ENST00000355826; ENST00000518681; ENST00000505820; ENST00000487053; ENST00000378712; ENST00000504599; ENST00000378708; ENST00000514234 | TSF |
| 3% | chr1 | 1562829 | 1562926 | + | chr1 | 1563053 | 1563209 | + | ENST00000520777; ENST00000357210; ENST00000360522; ENST00000378710; ENST00000355826; ENST00000518681; ENST00000505820; ENST00000487053; ENST00000378712; ENST00000504599; ENST00000378708; ENST00000514234 | TSF |
| 3% | chr1 | 1562829 | 1562926 | + | chr1 | 1563053 | 1563209 | + | ENST00000520777; ENST00000357210; ENST00000360522; ENST00000378710; ENST00000355826; ENST00000518681; ENST00000505820; ENST00000487053; ENST00000378712; ENST00000504599; ENST00000378708; ENST00000514234 | TSF |
| 3% | chr7 | 33006587 | 33006627 | + | chr7 | 33014229 | 33014374 | + | ENST00000242209; ENST00000538336 | TSF |
| 3% | chr1 | 1562829 | 1562875 | + | chr1 | 1563053 | 1563209 | + | ENST00000520777; ENST00000357210; ENST00000360522; ENST00000378710; ENST00000355826; ENST00000518681; ENST00000505820; ENST00000487053; ENST00000378712; ENST00000504599; ENST00000378708; ENST00000514234 | TSF |
| 3% | chr1 | 1562829 | 1562875 | + | chr1 | 1563053 | 1563209 | + | ENST00000520777; ENST00000357210; ENST00000360522; ENST00000378710; ENST00000355826; ENST00000518681; ENST00000505820; ENST00000487053; ENST00000378712; ENST00000504599; ENST00000378708; ENST00000514234 | TSF |
| 3% | chr1 | 1562829 | 1562875 | + | chr1 | 1563053 | 1563209 | + | ENST00000520777; ENST00000357210; ENST00000360522; ENST00000378710; ENST00000355826; ENST00000518681; ENST00000505820; ENST00000487053; ENST00000378712; ENST00000504599; ENST00000378708; ENST00000514234 | TSF |
| 3% | chr2 | 17876171 | 17876059 | − | chr2 | 17865030 | 17864905 | − | ENST00000448223; ENST00000351948; ENST00000381272; ENST00000402989 | TSF |
| 3% | chr7 | 48039730 | 48039725 | − | chr7 | 48035743 | 48035628 | − | ENST00000453071; ENST00000297325; ENST00000412371; ENST00000412142; ENST00000395572; ENST00000453192; ENST00000438771 | TSF |
| 3% | chr7 | 48039730 | 48039725 | − | chr7 | 48035743 | 48035628 | − | ENST00000453071; ENST00000297325; ENST00000412371; ENST00000412142; ENST00000395572; ENST00000453192; ENST00000438771 | TSF |
| 3% | chr7 | 48039730 | 48039725 | − | chr7 | 48035743 | 48035628 | − | ENST00000453071; ENST00000297325; ENST00000412371; ENST00000412142; ENST00000395572; ENST00000453192; ENST00000438771 | TSF |
| 3% | chr19 | 48654965 | 48654725 | − | chr19 | 48654596 | 48654489 | − | ENST00000263274; ENST00000601091; ENST00000542460 | TSF |
| 3% | chr19 | 48654965 | 48654725 | − | chr19 | 48654596 | 48654489 | − | ENST00000263274; ENST00000601091; ENST00000542460 | TSF |
| 3% | chr19 | 48654965 | 48654725 | − | chr19 | 48654596 | 48654489 | − | ENST00000263274; ENST00000601091; | TSF |

TABLE 40-continued

Transcript fusion for Lung Squamous Cell Carcinoma (LUSC) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 3% | chr2 | 29353781 | 29353921 | + | chr2 | 29354124 | 29354263 | + | ENST00000542460 ENST00000401605; ENST00000415891; ENST00000404424; ENST00000456385; ENST00000320081; ENST00000449202 | TSF |
| 3% | chr2 | 29353781 | 29353921 | + | chr2 | 29354124 | 29354263 | + | ENST00000401605; ENST00000415891; ENST00000404424; ENST00000456385; ENST00000320081; ENST00000449202 | TSF |
| 3% | chr2 | 29353781 | 29353921 | + | chr2 | 29354124 | 29354263 | + | ENST00000401605; ENST00000415891; ENST00000404424; ENST00000456385; ENST00000320081; ENST00000449202 | TSF |
| 3% | chr2 | 29353781 | 29353921 | + | chr2 | 29354124 | 29354263 | + | ENST00000401605; ENST00000415891; ENST00000404424; ENST00000456385; ENST00000320081; ENST00000449202 | TSF |
| 3% | chr2 | 29353781 | 29353921 | + | chr2 | 29354124 | 29354263 | + | ENST00000401605; ENST00000415891; ENST00000404424; ENST00000456385; ENST00000320081; ENST00000449202 | TSF |
| 3% | chrX | 134847126 | 134847423 | + | chrX | 134852761 | 134852870 | + | ENST00000370741; ENST00000497301; ENST00000482795 | TSF |
| 3% | chr17 | 66244121 | 66244199 | + | chr17 | 66244785 | 66244846 | + | ENST00000584837 | TSF |
| 3% | chr1 | 169819657 | 169819707 | + | chr1 | 169820958 | 169821077 | + | ENST00000359326; ENST00000286031 | TSF |
| 3% | chr17 | 45698288 | 45698367 | + | chr17 | 45699134 | 45699286 | + | ENST00000530173; ENST00000322157; ENST00000544660; ENST00000528565 | TSF |
| 3% | chr10 | 5120335 | 5120493 | + | chr10 | 5138602 | 5138769 | + | ENST00000602997; ENST00000605149; ENST00000380554 | TSF |
| 3% | chr10 | 5120335 | 5120493 | + | chr10 | 5138602 | 5138769 | + | ENST00000602997; ENST00000605149; ENST00000380554 | TSF |
| 3% | chrX | 134847126 | 134847423 | + | chrX | 134887292 | 134887401 | + | ENST00000370734; ENST00000485366; ENST00000443882 | TSF |
| 3% | chr7 | 55464873 | 55464924 | + | chr7 | 55466116 | 55466323 | + | ENST00000254770 | TSF |
| 3% | chrX | 134847126 | 134847423 | + | chrX | 134870023 | 134870132 | + | ENST00000370736; ENST00000471213; ENST00000495729 | TSF |
| 3% | chr3 | 196453456 | 196453642 | + | chr3 | 196454798 | 196455007; 196455051; 196454981 | + | ENST00000426755; ENST00000392391; ENST00000314118; ENST00000296333; ENST00000421265; ENST00000451319 | TSF |
| 3% | chr3 | 196453456 | 196453642 | + | chr3 | 196454798 | 196455007; 196455051; 196454981 | + | ENST00000426755; ENST00000392391; ENST00000314118; ENST00000296333; ENST00000421265; ENST00000451319 | TSF |
| 3% | chr3 | 196453456 | 196453642 | + | chr3 | 196454798 | 196455007; 196455051; 196454981 | + | ENST00000426755; ENST00000392391; ENST00000314118; ENST00000296333; ENST00000421265; ENST00000451319 | TSF |
| 3% | chr3 | 196453456 | 196453642 | + | chr3 | 196454798 | 196455007; 196455051; 196454981 | + | ENST00000426755; ENST00000392391; ENST00000314118; ENST00000296333; ENST00000421265; ENST00000451319 | TSF |
| 3% | chr3 | 196453456 | 196453642 | + | chr3 | 196454798 | 196455007; 196455051; 196454981 | + | ENST00000426755; ENST00000392391; ENST00000314118; ENST00000296333; ENST00000421265; ENST00000451319 | TSF |
| 3% | chr2 | 9695192 | 9695025 | − | chr2 | 9683414 | 9683282 | − | ENST00000310823; ENST00000497134 | TSF |
| 3% | chr2 | 9695192 | 9695025 | − | chr2 | 9683414 | 9683282 | − | ENST00000310823; ENST00000497134 | TSF |
| 3% | chr12 | 58023123 | 58023062 | − | chr12 | 58022686 | 58022496; 58022484 | − | ENST00000341156; ENST00000418555; ENST00000449184 | TSF |
| 3% | chr12 | 58023123 | 58023062 | − | chr12 | 58022686 | 58022496; 58022484 | − | ENST00000341156; ENST00000418555; ENST00000449184 | TSF |
| 3% | chr6 | 117763870 | 117763597 | − | chr6 | 117739669 | 117739625 | − | ENST00000368507; ENST00000368508 | TSF |
| 3% | chr6 | 117763870 | 117763597 | − | chr6 | 117739669 | 117739625 | − | ENST00000368507; ENST00000368508 | TSF |
| 3% | chr12 | 97286062 | 97286334 | + | chr12 | 97303530 | 97303673 | + | ENST00000554226; ENST00000557644 | TSF |
| 3% | chr12 | 97286062 | 97286334 | + | chr12 | 97303530 | 97303673 | + | ENST00000554226; ENST00000557644 | TSF |
| 3% | chr16 | 16100474 | 16100650 | + | chr16 | 16101673 | 16101849 | + | ENST00000399410; ENST00000345148; ENST00000346370; ENST00000349029; ENST00000351154; ENST00000399408 | TSF |
| 3% | chr16 | 16100474 | 16100650 | + | chr16 | 16101673 | 16101849 | + | ENST00000399410; ENST00000345148; ENST00000346370; ENST00000349029; ENST00000351154; ENST00000399408 | TSF |
| 3% | chr16 | 16100474 | 16100650 | + | chr16 | 16101673 | 16101849 | + | ENST00000399410; ENST00000345148; ENST00000346370; ENST00000349029; ENST00000351154; ENST00000399408 | TSF |
| 3% | chr16 | 16100474 | 16100650 | + | chr16 | 16101673 | 16101849 | + | ENST00000399410; ENST00000345148; ENST00000346370; ENST00000349029; ENST00000351154; ENST00000399408 | TSF |
| 3% | chr16 | 16100474 | 16100650 | + | chr16 | 16101673 | 16101849 | + | ENST00000399410; ENST00000345148; ENST00000346370; ENST00000349029; ENST00000351154; ENST00000399408 | TSF |
| 3% | chr16 | 16100474 | 16100650 | + | chr16 | 16101673 | 16101849 | + | ENST00000399410; ENST00000345148; ENST00000346370; ENST00000349029; ENST00000351154; ENST00000399408 | TSF |

TABLE 40-continued

Transcript fusion for Lung Squamous Cell Carcinoma (LUSC) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 3% | chr1 | 1562829 | 1562973 | + | chr1 | 1563053 | 1563209 | + | ENST00000520777; ENST00000360522; ENST00000355826; ENST00000505820; ENST00000378712; ENST00000378708; | ENST00000357210; ENST00000378710; ENST00000518681; ENST00000487053; ENST00000504599; ENST00000514234 | TSF |
| 3% | chr1 | 1562829 | 1562973 | + | chr1 | 1563053 | 1563209 | + | ENST00000520777; ENST00000360522; ENST00000355826; ENST00000505820; ENST00000378712; ENST00000378708; | ENST00000357210; ENST00000378710; ENST00000518681; ENST00000487053; ENST00000504599; ENST00000514234 | TSF |
| 3% | chr1 | 1562829 | 1562973 | + | chr1 | 1563053 | 1563209 | + | ENST00000520777; ENST00000360522; ENST00000355826; ENST00000505820; ENST00000378712; ENST00000378708; | ENST00000357210; ENST00000378710; ENST00000518681; ENST00000487053; ENST00000504599; ENST00000514234 | TSF |
| 3% | chr10 | 5060345 | 5060092 | − | chr10 | 5042858 | 5042742 | − | ENST00000380753; ENST00000407674; ENST00000455190 | ENST00000421196; ENST00000604507; | TSF |
| 3% | chr10 | 5060345 | 5060092 | − | chr10 | 5042858 | 5042742 | − | ENST00000380753; ENST00000407674; ENST00000455190 | ENST00000421196; ENST00000604507; | TSF |
| 3% | chr10 | 5060345 | 5060092 | − | chr10 | 5042858 | 5042742 | − | ENST00000380753; ENST00000407674; ENST00000455190 | ENST00000421196; ENST00000604507; | TSF |
| 3% | chr10 | 5060345 | 5060092 | − | chr10 | 5042858 | 5042742 | − | ENST00000380753; ENST00000407674; ENST00000455190 | ENST00000421196; ENST00000604507; | TSF |
| 3% | chr10 | 5060345 | 5060092 | − | chr10 | 5034105 | 5034023 | − | ENST00000380753; ENST00000407674 | ENST00000421196; | TSF |
| 3% | chr17 | 70713894 | 70713885 | − | chr17 | 70645407 | 70645309 | − | ENST00000255559; ENST00000582769 | ENST00000542342; | TSF |
| 3% | chr17 | 70713894 | 70713885 | − | chr17 | 70645407 | 70645309 | − | ENST00000255559; ENST00000582769 | ENST00000542342; | TSF |
| 3% | chr10 | 5000323 | 5000656 | + | chr10 | 5008106 | 5008273 | + | ENST00000434459; ENST00000380859 | ENST00000380872; | TSF |
| 3% | chr10 | 5000323 | 5000656 | + | chr10 | 5008106 | 5008273 | + | ENST00000434459; ENST00000380859 | ENST00000380872; | TSF |
| 3% | chr17 | 80544496 | 80544753 | + | chr17 | 80544939 | 80545148; 80545255 | + | ENST00000473637; ENST00000575578 | ENST00000335255; | TSF |
| 3% | chr17 | 80544496 | 80544753 | + | chr17 | 80544939 | 80545148; 80545255 | + | ENST00000473637; ENST00000575578 | ENST00000335255; | TSF |
| 3% | chr17 | 80544496 | 80544753 | + | chr17 | 80544939 | 80545148; 80545255 | + | ENST00000473637; ENST00000575578 | ENST00000335255; | TSF |
| 3% | chr6 | 20673784 | 20674067 | + | chr6 | 20739750 | 20739846 | + | ENST00000274695; ENST00000378610 | ENST00000378624; | TSF |
| 3% | chr6 | 20673784 | 20674067 | + | chr6 | 20739750 | 20739846 | + | ENST00000274695; ENST00000378610 | ENST00000378624; | TSF |
| 3% | chr11 | 70006969 | 70007088 | + | chr11 | 70007267 | 70007468 | + | ENST00000355303; ENST00000538023; ENST00000530676; ENST00000531300 | ENST00000398543; ENST00000316296; ENST00000531349; | TSF |
| 3% | chr11 | 70006969 | 70007088 | + | chr11 | 70007267 | 70007468 | + | ENST00000355303; ENST00000538023; ENST00000530676; ENST00000531300 | ENST00000398543; ENST00000316296; ENST00000531349; | TSF |
| 3% | chr11 | 70006969 | 70007088 | + | chr11 | 70007267 | 70007468 | + | ENST00000355303; ENST00000538023; ENST00000530676; ENST00000531300 | ENST00000398543; ENST00000316296; ENST00000531349; | TSF |
| 3% | chr22 | 22542244 | 22542331 | + | chr22 | 22550370 | 22550770 | + | ENST00000390285 | | TSF |
| 3% | chr15 | 74004214 | 74004264 | + | chr15 | 74005275 | 74005297 | + | ENST00000318443; ENST00000318424; ENST00000561176; ENST00000559073 | ENST00000537340; ENST00000564751; | TSF |
| 3% | chrX | 134866155 | 134866469 | + | chrX | 134870023 | 134870132 | + | ENST00000370736; ENST00000495729 | ENST00000471213; | TSF |
| 3% | chr4 | 186461046 | 186460994 | − | chr22 | 23243156 | 23243475 | + | ENST00000390323 | | TSF |
| 3% | chr4 | 22097850 | 22097560 | − | chr4 | 21764655 | 21764612 | − | ENST00000515786 | | TSF |
| 3% | chr10 | 5050548 | 5050220 | − | chr10 | 5043873 | 5043706 | − | ENST00000380753; ENST00000407674; ENST00000455190 | ENST00000421196; ENST00000604507; | TSF |
| 3% | chr10 | 5050548 | 5050220 | − | chr10 | 5043873 | 5043706 | − | ENST00000380753; ENST00000407674; | ENST00000421196; ENST00000604507; | |

TABLE 40-continued

Transcript fusion for Lung Squamous Cell Carcinoma (LUSC) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 3% | chr10 | 5050548 | 5050220 | − | chr10 | 5043873 | 5043706 | − | ENST00000380753; ENST00000421196; ENST00000407674; ENST00000604507; ENST00000455190 | TSF |
| 3% | chr10 | 5050548 | 5050220 | − | chr10 | 5043873 | 5043706 | − | ENST00000380753; ENST00000421196; ENST00000407674; ENST00000604507; ENST00000455190 | TSF |
| 3% | chrX | 134971303 | 134970989 | − | chrX | 134967437 | 134967328 | − | ENST00000491002; ENST00000448053; ENST00000472834 | TSF |
| 3% | chrX | 134954053 | 134953739 | − | chrX | 134950187 | 134950078 | − | ENST00000420087; ENST00000463085; ENST00000370724; ENST00000491480 | TSF |
| 3% | chrX | 134954053 | 134953739 | − | chrX | 134950187 | 134950078 | − | ENST00000420087; ENST00000463085; ENST00000370724; ENST00000491480 | TSF |
| 3% | chr3 | 195593372 | 195593261 | − | chr3 | 195591058 | 195591052 | − | ENST00000416152; ENST00000381916; ENST00000333602; ENST00000428187; ENST00000392400 | TSF |
| 3% | chrX | 134971303 | 134970989 | − | chrX | 134950187 | 134950078 | − | ENST00000420087; ENST00000463085; ENST00000370724; ENST00000491480 | TSF |
| 3% | chrX | 134971303 | 134970989 | − | chrX | 134950187 | 134950078 | − | ENST00000420087; ENST00000463085; ENST00000370724; ENST00000491480 | TSF |
| 3% | chrX | 138072952 | 138072670 | − | chrX | 137939841 | 137939674 | − | ENST00000370603; ENST00000436198; ENST00000455663; ENST00000448673 | TSF |
| 3% | chrX | 138072952 | 138072670 | − | chrX | 137939841 | 137939674 | − | ENST00000370603; ENST00000436198; ENST00000455663; ENST00000448673 | TSF |
| 3% | chrX | 138072952 | 138072670 | − | chrX | 137939841 | 137939674 | − | ENST00000370603; ENST00000436198; ENST00000455663; ENST00000448673 | TSF |
| 3% | chrX | 138072952 | 138072670 | − | chrX | 137939841 | 137939674 | − | ENST00000370603; ENST00000436198; ENST00000455663; ENST00000448673 | TSF |
| 3% | chr20 | 10628319 | 10628254 | − | chr20 | 10627751 | 10627587 | − | ENST00000254958; ENST00000423891 | TSF |
| 3% | chr19 | 48627094 | 48627044 | − | chr19 | 48626575 | 48626431 | − | ENST00000263274; ENST00000536218; ENST00000594759; ENST00000427526; ENST00000601091 | TSF |
| 3% | chr19 | 48627094 | 48627044 | − | chr19 | 48626575 | 48626431 | − | ENST00000263274; ENST00000536218; ENST00000594759; ENST00000427526; ENST00000601091 | TSF |
| 3% | chr8 | 91107662 | 91105645 | − | chr8 | 91094330 | 91094254 | − | ENST00000265431 | TSF |
| 3% | chr2 | 101024262 | 101024202 | − | chr2 | 101023169 | 101023038 | − | ENST00000542617; ENST00000448989 | TSF |
| 3% | chr2 | 101024262 | 101024202 | − | chr2 | 101023169 | 101023038 | − | ENST00000542617; ENST00000448989 | TSF |
| 3% | chr5 | 34914125 | 34914032 | − | chr5 | 34913683 | 34913575 | − | ENST00000382038; ENST00000341754 | TSF |
| 3% | chr1 | 156305455 | 156305264 | − | chr1 | 156304709 | 156304659 | − | ENST00000295688; ENST00000368258; ENST00000413555; ENST00000496684; ENST00000478640; ENST00000415548 | TSF |
| 3% | chr1 | 156305455 | 156305264 | − | chr1 | 156304709 | 156304659 | − | ENST00000295688; ENST00000368258; ENST00000413555; ENST00000496684; ENST00000478640; ENST00000415548 | TSF |
| 3% | chr1 | 156305455 | 156305264 | − | chr1 | 156304709 | 156304659 | − | ENST00000295688; ENST00000368258; ENST00000413555; ENST00000496684; ENST00000478640; ENST00000415548 | TSF |
| 3% | chr1 | 156305455 | 156305264 | − | chr1 | 156304709 | 156304659 | − | ENST00000295688; ENST00000368258; ENST00000413555; ENST00000496684; ENST00000478640; ENST00000415548 | TSF |
| 3% | chr1 | 156305455 | 156305264 | | chr1 | 156304709 | 156304659 | − | ENST00000295688; ENST00000368258; ENST00000413555; ENST00000496684; ENST00000478640; ENST00000415548 | TSF |
| 3% | chr1 | 156305455 | 156305264 | − | chr1 | 156304709 | 156304659 | − | ENST00000295688; ENST00000368258; ENST00000413555; ENST00000496684; ENST00000478640; ENST00000415548 | TSF |
| 2% | chr12 | 97286062 | 97286334 | + | chr12 | 97311399 | 97311515; 97311469 | + | ENST00000266742; ENST00000429527; ENST00000554226; ENST00000557478; ENST00000557092; ENST00000557644 | TSF |
| 2% | chr12 | 97286062 | 97286334 | + | chr12 | 97311399 | 97311515; 97311469 | + | ENST00000266742; ENST00000429527; ENST00000554226; ENST00000557478; ENST00000557092; ENST00000557644 | TSF |
| 2% | chr12 | 97286062 | 97286334 | + | chr12 | 97311399 | 97311515; 97311469 | + | ENST00000266742; ENST00000429527; ENST00000554226; ENST00000557478; ENST00000557092; ENST00000557644 | TSF |
| 2% | chr12 | 97286062 | 97286334 | + | chr12 | 97311399 | 97311515; 97311469 | + | ENST00000266742; ENST00000429527; ENST00000554226; ENST00000557478; ENST00000557092; ENST00000557644 | TSF |
| 2% | chr2 | 217519962 | 217520258 | + | chr2 | 217525280 | 217525509 | + | ENST00000233809; ENST00000456764 | TSF |
| 2% | chr3 | 130586141 | 130586877 | + | chr3 | 130649260 | 130649370 | + | ENST00000393221; ENST00000533801; ENST00000510168; ENST00000508532; ENST00000505072; ENST00000509662; ENST00000328560; ENST00000428331; ENST00000359644; ENST00000422190 | TSF |

TABLE 40-continued

Transcript fusion for Lung Squamous Cell Carcinoma (LUSC) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 2% | chr3 | 130586141 | 130586877 | + | chr3 | 130649260 | 130649370 | + | ENST00000393221; ENST00000533801; ENST00000510168; ENST00000508532; ENST00000505072; ENST00000509662; ENST00000328560; ENST00000428331; ENST00000359644; ENST00000422190 | TSF |
| 2% | chr3 | 130586141 | 130586877 | + | chr3 | 130649260 | 130649370 | + | ENST00000393221; ENST00000533801; ENST00000510168; ENST00000508532; ENST00000505072; ENST00000509662; ENST00000328560; ENST00000428331; ENST00000359644; ENST00000422190 | TSF |
| 2% | chr3 | 130586141 | 130586877 | + | chr3 | 130649260 | 130649370 | + | ENST00000393221; ENST00000533801; ENST00000510168; ENST00000508532; ENST00000505072; ENST00000509662; ENST00000328560; ENST00000428331; ENST00000359644; ENST00000422190 | TSF |
| 2% | chr3 | 130586141 | 130586877 | + | chr3 | 130649260 | 130649370 | + | ENST00000393221; ENST00000533801; ENST00000510168; ENST00000508532; ENST00000505072; ENST00000509662; ENST00000328560; ENST00000428331; ENST00000359644; ENST00000422190 | TSF |
| 2% | chr3 | 130586141 | 130586877 | + | chr3 | 130649260 | 130649370 | + | ENST00000393221; ENST00000533801; ENST00000510168; ENST00000508532; ENST00000505072; ENST00000509662; ENST00000328560; ENST00000428331; ENST00000359644; ENST00000422190 | TSF |
| 2% | chr3 | 130586141 | 130586877 | + | chr3 | 130649260 | 130649370 | + | ENST00000393221; ENST00000533801; ENST00000510168; ENST00000508532; ENST00000505072; ENST00000509662; ENST00000328560; ENST00000428331; ENST00000359644; ENST00000422190 | TSF |
| 2% | chr19 | 1114930 | 1114676 | − | chr19 | 1114421 | 1114230 | − | ENST00000361757; ENST00000587024; ENST00000438103 | TSF |
| 2% | chr8 | 91102885 | 91102521 | − | chr8 | 91094330 | 91094254 | − | ENST00000265431 | TSF |
| 2% | chr19 | 47343471 | 47343373 | − | chr19 | 47342835 | 47342722 | − | ENST00000352203; ENST00000601498; ENST00000599990; ENST00000593442; ENST00000263270; ENST00000597020 | TSF |
| 2% | chr1 | 33251116 | 33251115 | − | chr1 | 33248140 | 33248005 | − | ENST00000373477 | TSF |
| 2% | chr11 | 60934781 | 60933962 | − | chr11 | 60901679 | 60901508 | − | ENST00000301765; ENST00000538036 | TSF |
| 2% | chr11 | 60934781 | 60933962 | − | chr11 | 60901679 | 60901508 | − | ENST00000301765; ENST00000538036 | TSF |
| 2% | chr12 | 110306235 | 110306193 | − | chr12 | 110296546 | 110296488 | − | ENST00000318348; ENST00000544393; ENST00000540772; ENST00000536390; ENST00000537066 | TSF |
| 2% | chr12 | 110306235 | 110306193 | − | chr12 | 110296546 | 110296488 | − | ENST00000318348; ENST00000544393; ENST00000540772; ENST00000536390; ENST00000537066 | TSF |
| 2% | chr12 | 110306235 | 110306193 | − | chr12 | 110296546 | 110296488 | − | ENST00000318348; ENST00000544393; ENST00000540772; ENST00000536390; ENST00000537066 | TSF |
| 2% | chr12 | 110306235 | 110306193 | − | chr12 | 110296546 | 110296488 | − | ENST00000318348; ENST00000544393; ENST00000540772; ENST00000536390; ENST00000537066 | TSF |
| 2% | chr9 | 123159676 | 123159573 | − | chr9 | 123156916 | 123156790 | − | ENST00000359309; ENST00000360822; ENST00000349780; ENST00000360190; ENST00000416449; ENST00000425647 | TSF |
| 2% | chr3 | 184639788 | 184640271 | + | chr3 | 184642650 | 184642769 | + | ENST00000287546; ENST00000437079; ENST00000436792; ENST00000446204 | TSF |
| 2% | chrX | 134866155 | 134866469 | + | chrX | 134887292 | 134887401 | + | ENST00000370734; ENST00000485366; ENST00000443882 | TSF |
| 2% | chrX | 134883429 | 134883743 | + | chrX | 134887292 | 134887401 | + | ENST00000370734; ENST00000485366; ENST00000443882 | TSF |
| 2% | chr20 | 60878087 | 60878105 | + | chr20 | 60878775 | 60878837 | + | ENST00000253003 | TSF |
| 2% | chr1 | 15562769 | 15563257 | + | chr1 | 15578196 | 15578373 | + | ENST00000433640 | TSF |
| 2% | chr12 | 54862718 | 54862609 | − | chr12 | 54858951 | 54858851 | − | ENST00000546931; ENST00000552397; ENST00000305879 | TSF |
| 2% | chr12 | 54862718 | 54862609 | − | chr12 | 54858951 | 54858851 | − | ENST00000546931; ENST00000552397; ENST00000305879 | TSF |
| 2% | chr16 | 48451457 | 48450727 | − | chr16 | 48396341 | 48395491 | − | ENST00000356721 | TSF |
| 2% | chr15 | 91529041 | 91528993 | − | chr15 | 91528055 | 91527923 | − | ENST00000394249; ENST00000361919; ENST00000361188; ENST00000442656; ENST00000557905; ENST00000559811 | TSF |
| 2% | chr15 | 91529041 | 91528993 | − | chr15 | 91528055 | 91527923 | − | ENST00000394249; ENST00000361919; ENST00000361188; ENST00000442656; ENST00000557905; ENST00000559811 | TSF |
| 2% | chr15 | 91529041 | 91528993 | − | chr15 | 91528055 | 91527923 | − | ENST00000394249; ENST00000361919; ENST00000361188; ENST00000442656; | TSF |

TABLE 40-continued

Transcript fusion for Lung Squamous Cell Carcinoma (LUSC) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 2% | chr15 | 91529041 | 91528993 | − | chr15 | 91528055 | 91527923 | − | | ENST00000557905; ENST00000559811; ENST00000394249; ENST00000361919;TSF ENST00000361188; ENST00000442656; |
| 2% | chr15 | 91529041 | 91528993 | − | chr15 | 91528055 | 91527923 | − | | ENST00000557905; ENST00000559811; ENST00000394249; ENST00000361919;TSF ENST00000361188; ENST00000442656; |
| 2% | chr15 | 91529041 | 91528993 | − | chr15 | 91528055 | 91527923 | − | | ENST00000557905; ENST00000559811; ENST00000394249; ENST00000361919;TSF ENST00000361188; ENST00000442656; |
| 2% | chr17 | 17816540 | 17815566 | − | chr17 | 17810845 | 17810761 | − | | ENST00000581396; ENST00000379504;TSF ENST00000318094; ENST00000395739; ENST00000535933; ENST00000540946; ENST00000542206 |
| 2% | chr17 | 17816540 | 17815566 | − | chr17 | 17810845 | 17810761 | − | | ENST00000581396; ENST00000379504;TSF ENST00000318094; ENST00000395739; ENST00000535933; ENST00000540946; ENST00000542206 |
| 2% | chr17 | 17816540 | 17815566 | − | chr17 | 17810845 | 17810761 | − | | ENST00000581396; ENST00000379504;TSF ENST00000318094; ENST00000395739; ENST00000535933; ENST00000540946; ENST00000542206 |
| 2% | chr17 | 17816540 | 17815566 | − | chr17 | 17810845 | 17810761 | − | | ENST00000581396; ENST00000379504;TSF ENST00000318094; ENST00000395739; ENST00000535933; ENST00000540946; ENST00000542206 |
| 2% | chr17 | 17816540 | 17815566 | − | chr17 | 17810845 | 17810761 | − | | ENST00000581396; ENST00000379504;TSF ENST00000318094; ENST00000395739; ENST00000535933; ENST00000540946; ENST00000542206 |
| 2% | chr17 | 17816540 | 17815566 | − | chr17 | 17810845 | 17810761 | − | | ENST00000581396; ENST00000379504;TSF ENST00000318094; ENST00000395739; ENST00000535933; ENST00000540946; ENST00000542206 |
| 2% | chr19 | 50167252 | 50167184 | − | chr19 | 50166771 | 50166600; 50166728; 50166630 | − | | ENST00000309877; ENST00000600911;TSF ENST00000601291; ENST00000377139; ENST00000597198; ENST00000597636; ENST00000599223; ENST00000377135; ENST00000596756; ENST00000598108; ENST00000593337; ENST00000601809; ENST00000596788; ENST00000600453 |
| 2% | chr19 | 50167252 | 50167184 | − | chr19 | 50166771 | 50166600; 50166728; 50166630 | − | | ENST00000309877; ENST00000600911;TSF ENST00000601291; ENST00000377139; ENST00000597198; ENST00000597636; ENST00000599223; ENST00000377135; ENST00000596756; ENST00000598108; ENST00000593337; ENST00000601809; ENST00000596788; ENST00000600453 |
| 2% | chr19 | 50167252 | 50167184 | − | chr19 | 50166771 | 50166600; 50166728; 50166630 | − | | ENST00000309877; ENST00000600911;TSF ENST00000601291; ENST00000377139; ENST00000597198; ENST00000597636; ENST00000599223; ENST00000377135; ENST00000596756; ENST00000598108; ENST00000593337; ENST00000601809; ENST00000596788; ENST00000600453 |
| 2% | chr19 | 50167252 | 50167184 | − | chr19 | 50166771 | 50166600; 50166728; 50166630 | − | | ENST00000309877; ENST00000600911;TSF ENST00000601291; ENST00000377139; ENST00000597198; ENST00000597636; ENST00000599223; ENST00000377135; ENST00000596756; ENST00000598108; ENST00000593337; ENST00000601809; ENST00000596788; ENST00000600453 |
| 2% | chr19 | 50167252 | 50167184 | − | chr19 | 50166771 | 50166600; 50166728; 50166630 | − | | ENST00000309877; ENST00000600911;TSF ENST00000601291; ENST00000377139; ENST00000597198; ENST00000597636; ENST00000599223; ENST00000377135; ENST00000596756; ENST00000598108; ENST00000593337; ENST00000601809; ENST00000596788; ENST00000600453 |
| 2% | chr19 | 50167252 | 50167184 | − | chr19 | 50166771 | 50166600; 50166728; 50166630 | − | | ENST00000309877; ENST00000600911;TSF ENST00000601291; ENST00000377139; ENST00000597198; ENST00000597636; ENST00000599223; ENST00000377135; ENST00000596756; ENST00000598108; ENST00000593337; ENST00000601809; |

TABLE 40-continued

Transcript fusion for Lung Squamous Cell Carcinoma (LUSC) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 2% | chr19 | 50167252 | 50167184 | − | chr19 | 50166771 | 50166600; 50166728; 50166630 | − | ENST00000596788; ENST00000600453 ENST00000309877; ENST00000600911; ENST00000601291; ENST00000377139; ENST00000597198; ENST00000597636; ENST00000599223; ENST00000377135; ENST00000596756; ENST00000598108; ENST00000593337; ENST00000601809; | TSF |
| 2% | chr19 | 50167252 | 50167184 | − | chr19 | 50166771 | 50166600; 50166728; 50166630 | − | ENST00000596788; ENST00000600453 ENST00000309877; ENST00000600911; ENST00000601291; ENST00000377139; ENST00000597198; ENST00000597636; ENST00000599223; ENST00000377135; ENST00000596756; ENST00000598108; ENST00000593337; ENST00000601809; | TSF |
| 2% | chr19 | 50167252 | 50167184 | − | chr19 | 50166771 | 50166600; 50166728; 50166630 | − | ENST00000596788; ENST00000600453 ENST00000309877; ENST00000600911; ENST00000601291; ENST00000377139; ENST00000597198; ENST00000597636; ENST00000599223; ENST00000377135; ENST00000596756; ENST00000598108; ENST00000593337; ENST00000601809; | TSF |
| 2% | chr19 | 50167252 | 50167184 | − | chr19 | 50166771 | 50166600; 50166728; 50166630 | − | ENST00000596788; ENST00000600453 ENST00000309877; ENST00000600911; ENST00000601291; ENST00000377139; ENST00000597198; ENST00000597636; ENST00000599223; ENST00000377135; ENST00000596756; ENST00000598108; ENST00000593337; ENST00000601809; | TSF |
| 2% | chr19 | 50167252 | 50167184 | − | chr19 | 50166771 | 50166600; 50166728; 50166630 | − | ENST00000596788; ENST00000600453 ENST00000309877; ENST00000600911; ENST00000601291; ENST00000377139; ENST00000597198; ENST00000597636; ENST00000599223; ENST00000377135; ENST00000596756; ENST00000598108; ENST00000593337; ENST00000601809; | TSF |
| 2% | chr19 | 35613389 | 35613502 | + | chr19 | 35613669 | 35613862; 35613743; 35613858 | + | ENST00000406242; ENST00000604404; ENST00000435734; ENST00000603181; ENST00000604255; ENST00000344013; ENST00000346446; ENST00000406988; ENST00000605550; ENST00000604804; ENST00000535103; ENST00000603524; ENST00000604621; ENST00000605677 | TSF |
| 2% | chr19 | 35613389 | 35613502 | + | chr19 | 35613669 | 35613862; 35613743; 35613858 | + | ENST00000406242; ENST00000604404; ENST00000435734; ENST00000603181; ENST00000604255; ENST00000344013; ENST00000346446; ENST00000406988; ENST00000605550; ENST00000604804; ENST00000535103; ENST00000603524; ENST00000604621; ENST00000605677 | TSF |
| 2% | chr19 | 35613389 | 35613502 | + | chr19 | 35613669 | 35613862; 35613743; 35613858 | + | ENST00000406242; ENST00000604404; ENST00000435734; ENST00000603181; ENST00000604255; ENST00000344013; ENST00000346446; ENST00000406988; ENST00000605550; ENST00000604804; ENST00000535103; ENST00000603524; ENST00000604621; ENST00000605677 | TSF |
| 2% | chr19 | 35613389 | 35613502 | + | chr19 | 35613669 | 35613862; 35613743; 35613858 | + | ENST00000406242; ENST00000604404; ENST00000435734; ENST00000603181; ENST00000604255; ENST00000344013; ENST00000346446; ENST00000406988; ENST00000605550; ENST00000604804; ENST00000535103; ENST00000603524; ENST00000604621; ENST00000605677 | TSF |
| 2% | chr22 | 24967426 | 24967475 | + | chr22 | 24967884 | 24967945 | + | ENST00000215829; ENST00000404603 | TSF |
| 2% | chr2 | 26666337 | 26666354 | + | chr2 | 26667090 | 26667224; 26667126 | + | ENST00000288710; ENST00000442810 | TSF |
| 2% | chr2 | 26666337 | 26666354 | + | chr2 | 26667090 | 26667224; 26667126 | + | ENST00000288710; ENST00000442810 | TSF |
| 2% | chr3 | 126601624 | 126602182 | + | chr3 | 126633523 | 126633593 | + | ENST00000290913; ENST00000508789; ENST00000513253 | TSF |
| 2% | chr3 | 126601624 | 126602182 | + | chr3 | 126633523 | 126633593 | + | ENST00000290913; ENST00000508789; ENST00000513253 | TSF |
| 2% | chr3 | 126601624 | 126602182 | + | chr3 | 126633523 | 126633593 | + | ENST00000290913; ENST00000508789; ENST00000513253 | TSF |
| 2% | chr16 | 53866877 | 53867152 | + | chr16 | 53878067 | 53878210; 53878156 | + | ENST00000471389; ENST00000464071 | TSF |

TABLE 40-continued

Transcript fusion for Lung Squamous Cell Carcinoma (LUSC) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 2% | chr16 | 53866877 | 53867152 | + | chr16 | 53878067 | 53878210; 53878156 | + | ENST00000471389; ENST00000464071 | TSF |
| 2% | chr16 | 16227557 | 16227839 | + | chr16 | 16228207 | 16228365 | + | ENST00000399410; ENST00000345148; ENST00000346370; ENST00000349029; ENST00000351154; ENST00000399408; ENST00000572882 | TSF |
| 2% | chr16 | 16227557 | 16227839 | + | chr16 | 16228207 | 16228365 | + | ENST00000399410; ENST00000345148; ENST00000346370; ENST00000349029; ENST00000351154; ENST00000399408; ENST00000572882 | TSF |
| 2% | chr1 | 27158561 | 27158563 | + | chr1 | 27158938 | 27159098 | + | ENST00000374142 | TSF |
| 2% | chr20 | 8624404 | 8625147 | + | chr20 | 8626749 | 8626828 | + | ENST00000378641; ENST00000338037; ENST00000378637; ENST00000404098 | TSF |
| 2% | chr20 | 8624404 | 8625147 | + | chr20 | 8626749 | 8626828 | + | ENST00000378641; ENST00000338037; ENST00000378637; ENST00000404098 | TSF |
| 2% | chr20 | 8624404 | 8625147 | + | chr20 | 8626749 | 8626828 | + | ENST00000378641; ENST00000338037; ENST00000378637; ENST00000404098 | TSF |
| 2% | chr2 | 216976986 | 216977153 | + | chr2 | 216977739 | 216977852 | + | ENST00000392133; ENST00000392132 | TSF |
| 2% | chr7 | 134215952 | 134215973 | + | chr7 | 134216660 | 134216776 | + | ENST00000359579 | TSF |
| 2% | chr6 | 30844573 | 30844673 | + | chr6 | 30856465 | 30856591 | + | ENST00000508312; ENST00000503495 | TSF |
| 2% | chr6 | 30844573 | 30844673 | + | chr6 | 30856465 | 30856591 | + | ENST00000508312; ENST00000503495 | TSF |
| 2% | chr12 | 96302230 | 96301326 | − | chr12 | 96300229 | 96300165 | − | ENST00000344280 | TSF |
| 2% | chr3 | 183680609 | 183680541 | − | chr3 | 183679442 | 183679299 | − | ENST00000334444; ENST00000265586 | TSF |
| 2% | chr3 | 183680609 | 183680541 | − | chr3 | 183679442 | 183679299 | − | ENST00000334444; ENST00000265586 | TSF |
| 2% | chr18 | 51273 | 49727 | − | chr18 | 49237 | 49129 | − | ENST00000308911 | TSF |
| 2% | chr1 | 180281096 | 180280936 | − | chr1 | 180257652 | 180257498 | − | ENST00000367595 | TSF |
| 2% | chr18 | 33076776 | 33076739 | − | chr18 | 33060527 | 33060417 | − | ENST00000592173; ENST00000334598; ENST00000441607; ENST00000591139 | TSF |
| 2% | chr18 | 33076776 | 33076739 | − | chr18 | 33060527 | 33060417 | − | ENST00000592173; ENST00000334598; ENST00000441607; ENST00000591139 | TSF |
| 2% | chr18 | 33076776 | 33076739 | − | chr18 | 33060527 | 33060417 | − | ENST00000592173; ENST00000334598; ENST00000441607; ENST00000591139 | TSF |
| 2% | chr1 | 156716197 | 156716133 | − | chr1 | 156715165 | 156715089 | − | ENST00000357325; ENST00000537739; ENST00000368209; ENST00000368206 | TSF |
| 2% | chr10 | 5060345 | 5060092 | − | chr10 | 5038057 | 5037948; 5038026 | − | ENST00000380753; ENST00000421196; ENST00000407674; ENST00000604507 | TSF |
| 2% | chr10 | 5060345 | 5060092 | − | chr10 | 5038057 | 5037948; 5038026 | − | ENST00000380753; ENST00000421196; ENST00000407674; ENST00000604507 | TSF |
| 2% | chr8 | 119918965 | 119919242 | + | chr8 | 120101919 | 120101990 | + | ENST00000332843 | TSF |
| 2% | chr18 | 20590293 | 20590383 | + | chr18 | 20596791 | 20596887 | + | ENST00000327155; ENST00000399722; ENST00000360790; ENST00000583057 | TSF |
| 2% | chr18 | 20590293 | 20590383 | + | chr18 | 20596791 | 20596887 | + | ENST00000327155; ENST00000399722; ENST00000360790; ENST00000583057 | TSF |
| 2% | chr3 | 130586141 | 130586917 | + | chr3 | 130649260 | 130649370 | + | ENST00000393221; ENST00000533801; ENST00000510168; ENST00000508532; ENST00000505072; ENST00000509662; ENST00000328560; ENST00000428331; ENST00000359644; ENST00000422190 | TSF |
| 2% | chr3 | 130586141 | 130586917 | + | chr3 | 130649260 | 130649370 | + | ENST00000393221; ENST00000533801; ENST00000510168; ENST00000508532; ENST00000505072; ENST00000509662; ENST00000328560; ENST00000428331; ENST00000359644; ENST00000422190 | TSF |
| 2% | chr3 | 130586141 | 130586917 | + | chr3 | 130649260 | 130649370 | + | ENST00000393221; ENST00000533801; ENST00000510168; ENST00000508532; ENST00000505072; ENST00000509662; ENST00000328560; ENST00000428331; ENST00000359644; ENST00000422190 | TSF |
| 2% | chr3 | 130586141 | 130586917 | + | chr3 | 130649260 | 130649370 | + | ENST00000393221; ENST00000533801; ENST00000510168; ENST00000508532; ENST00000505072; ENST00000509662; ENST00000328560; ENST00000428331; ENST00000359644; ENST00000422190 | TSF |
| 2% | chr3 | 130586141 | 130586917 | + | chr3 | 130649260 | 130649370 | + | ENST00000393221; ENST00000533801; ENST00000510168; ENST00000508532; ENST00000505072; ENST00000509662; ENST00000328560; ENST00000428331; ENST00000359644; ENST00000422190 | TSF |
| 2% | chr3 | 130586141 | 130586917 | + | chr3 | 130649260 | 130649370 | + | ENST00000393221; ENST00000533801; ENST00000510168; ENST00000508532; ENST00000505072; ENST00000509662; ENST00000328560; ENST00000428331; ENST00000359644; ENST00000422190 | TSF |
| 2% | chr3 | 130586141 | 130586917 | + | chr3 | 130649260 | 130649370 | + | ENST00000393221; ENST00000533801; ENST00000510168; ENST00000508532; ENST00000505072; ENST00000509662; | TSF |

TABLE 40-continued

Transcript fusion for Lung Squamous Cell Carcinoma (LUSC) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 2% | chr12 | 50491053 | 50491120 | + | chr12 | 50492497 | 50492598 | + | ENST00000328560; ENST00000428331; ENST00000359644; ENST00000422190 ENST00000394963; ENST00000381513; ENST00000548573; ENST00000549274 | TSF |
| 2% | chr1 | 44446234 | 44446286 | + | chr1 | 44446781 | 44447145 | + | ENST00000309519 | TSF |
| 2% | chr20 | 110606 | 110697 | + | chr20 | 126056 | 126333 | + | ENST00000382398 | TSF |
| 2% | chr8 | 97343998 | 97344068 | + | chr8 | 97345685 | 97345794; 97345714 | + | ENST00000517309; ENST00000455950; ENST00000522072 | TSF |
| 2% | chr8 | 97343998 | 97344068 | + | chr8 | 97345685 | 97345794; 97345714 | + | ENST00000517309; ENST00000455950; ENST00000522072 | TSF |
| 2% | chr10 | 3133726 | 3133857 | + | chr10 | 3141467 | 3141544 | + | ENST00000607886; ENST00000381125; ENST00000381075; ENST00000407806 | TSF |
| 2% | chr10 | 3133726 | 3133857 | + | chr10 | 3141467 | 3141544 | + | ENST00000607886; ENST00000381125; ENST00000381075; ENST00000407806 | TSF |
| 2% | chr10 | 3133726 | 3133857 | + | chr10 | 3141467 | 3141544 | + | ENST00000607886; ENST00000381125; ENST00000381075; ENST00000407806 | TSF |
| 2% | chr10 | 3133726 | 3133857 | + | chr10 | 3141467 | 3141544 | + | ENST00000607886; ENST00000381125; ENST00000381075; ENST00000407806 | TSF |
| 2% | chr16 | 16233187 | 16233287 | + | chr16 | 16235030 | 16235138 | + | ENST00000399410; ENST00000345148; ENST00000346370; ENST00000349029; ENST00000351154; ENST00000399408; ENST00000572882 | TSF |
| 2% | chr8 | 120050383 | 120050389 | + | chr8 | 120101919 | 120101990 | + | ENST00000332843 | TSF |
| 2% | chr1 | 12002791 | 12002835 | + | chr1 | 12008033 | 12008124 | + | ENST00000449038; ENST00000376369; ENST00000429000; ENST00000196061 | TSF |
| 2% | chr1 | 12002791 | 12002835 | + | chr1 | 12008033 | 12008124 | + | ENST00000449038; ENST00000376369; ENST00000429000; ENST00000196061 | TSF |
| 2% | chr1 | 12002791 | 12002835 | + | chr1 | 12008033 | 12008124 | + | ENST00000449038; ENST00000376369; ENST00000429000; ENST00000196061 | TSF |
| 2% | chr5 | 1475119 | 1475076 | − | chr5 | 1474800 | 1474675 | − | ENST00000475622; ENST00000283415 | TSF |
| 2% | chr15 | 83667946 | 83667078 | − | chr15 | 83660798 | 83660684 | − | ENST00000451195 | TSF |
| 2% | chr1 | 8924664 | 8924519 | − | chr1 | 8924151 | 8923950 | − | ENST00000234590 | TSF |
| 2% | chr8 | 91108096 | 91107732 | − | chr8 | 91094330 | 91094254 | − | ENST00000265431 | TSF |
| 2% | chr1 | 203191927 | 203191877 | − | chr1 | 203191453 | 203191330 | − | ENST00000367229; ENST00000491855; ENST00000255427; ENST00000535569; ENST00000503786 | TSF |
| 2% | chr1 | 203191927 | 203191877 | − | chr1 | 203191453 | 203191330 | − | ENST00000367229; ENST00000491855; ENST00000255427; ENST00000535569; ENST00000503786 | TSF |
| 2% | chr1 | 203191927 | 203191877 | − | chr1 | 203191453 | 203191330 | − | ENST00000367229; ENST00000491855; ENST00000255427; ENST00000535569; ENST00000503786 | TSF |
| 2% | chr12 | 92826976 | 92826686 | − | chr12 | 92814949 | 92814786 | − | ENST00000378487; ENST00000538965 | TSF |
| 2% | chr1 | 23762222 | 23762216 | − | chr1 | 23761111 | 23761026 | − | ENST00000495646; ENST00000336689; ENST00000437606 | TSF |
| 2% | chr3 | 113450271 | 113449590 | − | chr3 | 113442939 | 113442806; 113442828 | − | ENST00000240922; ENST00000477813; ENST00000497255; ENST00000481432; ENST00000493900; ENST00000478020 | TSF |
| 2% | chr3 | 113450271 | 113449590 | − | chr3 | 113442939 | 113442806; 113442828 | − | ENST00000240922; ENST00000477813; ENST00000497255; ENST00000481432; ENST00000493900; ENST00000478020 | TSF |
| 2% | chr3 | 113450271 | 113449590 | − | chr3 | 113442939 | 113442806; 113442828 | − | ENST00000240922; ENST00000477813; ENST00000497255; ENST00000481432; ENST00000493900; ENST00000478020 | TSF |
| 2% | chr3 | 113450271 | 113449590 | − | chr3 | 113442939 | 113442806; 113442828 | − | ENST00000240922; ENST00000477813; ENST00000497255; ENST00000481432; ENST00000493900; ENST00000478020 | TSF |
| 2% | chr3 | 113450271 | 113449590 | − | chr3 | 113442939 | 113442806; 113442828 | − | ENST00000240922; ENST00000477813; ENST00000497255; ENST00000481432; ENST00000493900; ENST00000478020 | TSF |
| 2% | chr12 | 96302230 | 96301454 | − | chr12 | 96300229 | 96300165 | − | ENST00000344280 | TSF |
| 2% | chr10 | 4952037 | 4952123 | + | chr10 | 5014908 | 5014941; 5014939 | + | ENST00000434459; ENST00000380872; ENST00000442997 | TSF |
| 2% | chr10 | 4952037 | 4952123 | + | chr10 | 5014908 | 5014941; 5014939 | + | ENST00000434459; ENST00000380872; ENST00000442997 | TSF |
| 2% | chr7 | 6423751 | 6423803 | + | chr7 | 6426843 | 6426914 | + | ENST00000348035; ENST00000356142 | TSF |
| 2% | chr7 | 6423751 | 6423803 | + | chr7 | 6426843 | 6426914 | + | ENST00000348035; ENST00000356142 | TSF |
| 2% | chr20 | 62647199 | 62647374 | + | chr20 | 62648076 | 62648198 | + | ENST00000535781; ENST00000266079 | TSF |
| 2% | chr20 | 62647199 | 62647374 | + | chr20 | 62648076 | 62648198 | + | ENST00000535781; ENST00000266079 | TSF |
| 2% | chr1 | 162768504 | 162768725 | + | chr1 | 162769533 | 162769727 | + | ENST00000367917; ENST00000254521 | TSF |
| 2% | chr1 | 162768504 | 162768725 | + | chr1 | 162769533 | 162769727 | + | ENST00000367917; ENST00000254521 | TSF |
| 2% | chr2 | 143763612 | 143763709 | + | chr2 | 143787196 | 143787248 | + | ENST00000264170; ENST00000409512 | TSF |
| 2% | chr22 | 38182207 | 38182899 | + | chr22 | 38206034 | 38206164 | + | ENST00000323205; ENST00000248924; ENST00000445195; ENST00000451984 | TSF |
| 2% | chr22 | 38182207 | 38182899 | + | chr22 | 38206034 | 38206164 | + | ENST00000323205; ENST00000248924; | TSF |

TABLE 40-continued

Transcript fusion for Lung Squamous Cell Carcinoma (LUSC) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 2% | chr22 | 38182207 | 38182899 | + | chr22 | 38206034 | 38206164 | + | ENST00000445195; ENST00000451984 ENST00000323205; ENST00000248924; ENST00000445195; ENST00000451984 | TSF |
| 2% | chr14 | 70466641 | 70466673 | + | chr14 | 70477471 | 70477663 | + | ENST00000361956; ENST00000381280 | TSF |
| 2% | chr14 | 70466641 | 70466673 | + | chr14 | 70477471 | 70477663 | + | ENST00000361956; ENST00000381280 | TSF |
| 2% | chr5 | 52897435; 52897700 | 52897704 | + | chr5 | 52899282 | 52899360 | + | ENST00000502423; ENST00000296684; ENST00000506974; ENST00000506765 | TSF |
| 2% | chr5 | 52897435; 52897700 | 52897704 | + | chr5 | 52899282 | 52899360 | + | ENST00000502423; ENST00000296684; ENST00000506974; ENST00000506765 | TSF |
| 2% | chr5 | 52897435; 52897700 | 52897704 | + | chr5 | 52899282 | 52899360 | + | ENST00000502423; ENST00000296684; ENST00000506974; ENST00000506765 | TSF |
| 2% | chr5 | 52897435; 52897700 | 52897704 | + | chr5 | 52899282 | 52899360 | + | ENST00000502423; ENST00000296684; ENST00000506974; ENST00000506765 | TSF |
| 2% | chr5 | 52897435; 52897700 | 52897704 | + | chr5 | 52899282 | 52899360 | + | ENST00000502423; ENST00000296684; ENST00000506974; ENST00000506765 | TSF |
| 2% | chr5 | 52897435; 52897700 | 52897704 | + | chr5 | 52899282 | 52899360 | + | ENST00000502423; ENST00000296684; ENST00000506974; ENST00000506765 | TSF |
| 2% | chr5 | 52897435; 52897700 | 52897704 | + | chr5 | 52899282 | 52899360 | + | ENST00000502423; ENST00000296684; ENST00000506974; ENST00000506765 | TSF |
| 2% | chr5 | 52897435; 52897700 | 52897704 | + | chr5 | 52899282 | 52899360 | + | ENST00000502423; ENST00000296684; ENST00000506974; ENST00000506765 | TSF |
| 2% | chr19 | 40709427 | 40709625 | + | chr19 | 40710392 | 40710540 | + | ENST00000253055; ENST00000597986 | TSF |
| 2% | chr19 | 40709427 | 40709625 | + | chr19 | 40710392 | 40710540 | + | ENST00000253055; ENST00000597986 | TSF |
| 2% | chr2 | 217506021 | 217506062 | + | chr2 | 217525280 | 217525509 | + | ENST00000233809; ENST00000456764 | TSF |
| 2% | chr4 | 99926272 | 99927003 | + | chr4 | 99950018 | 99950069 | + | ENST00000296411; ENST00000510107 | TSF |
| 2% | chr4 | 99926272 | 99927003 | + | chr4 | 99950018 | 99950069 | + | ENST00000296411; ENST00000510107 | TSF |
| 2% | chr12 | 97251345 | 97251620 | + | chr12 | 97303530 | 97303673 | + | ENST00000554226; ENST00000557644 | TSF |
| 2% | chr12 | 97251345 | 97251620 | + | chr12 | 97303530 | 97303673 | + | ENST00000554226; ENST00000557644 | TSF |
| 2% | chr8 | 128749913 | 128749923 | + | chr8 | 128750494 | 128751265 | + | ENST00000377970 | TSF |
| 2% | chr12 | 86274449 | 86274547 | + | chr12 | 86276010 | 86276153 | + | ENST00000551529; ENST00000256010 | TSF |
| 2% | chr7 | 96798362 | 96798524 | + | chr7 | 96810324 | 96810527 | + | ENST00000432641 | TSF |
| 2% | chr12 | 122430912 | 122431578 | + | chr12 | 122439403 | 122439504 | + | ENST00000288912 | TSF |
| 2% | chr11 | 66354487 | 66355279 | + | chr11 | 66361113 | 66361185 | + | ENST00000533244; ENST00000530961 | TSF |
| 2% | chr11 | 66354487 | 66355279 | + | chr11 | 66361113 | 66361185 | + | ENST00000533244; ENST00000530961 | TSF |
| 2% | chr4 | 185620772 | 185620691 | − | chr4 | 185618957 | 185618801; 185618919 | − | ENST00000281453; ENST00000510146 | TSF |
| 2% | chr4 | 185620772 | 185620691 | − | chr4 | 185618957 | 185618801; 185618919 | − | ENST00000281453; ENST00000510146 | TSF |
| 2% | chrX | 134936794 | 134936480 | − | chrX | 134932924 | 134932815 | − | ENST00000487941; ENST00000434966; ENST00000494421 | TSF |
| 2% | chr15 | 74475607 | 74475594 | − | chr15 | 74474801 | 74474684 | − | ENST00000395105; ENST00000423167; ENST00000323940; ENST00000449139; ENST00000416286; ENST00000535552; ENST00000563965; ENST00000574278; ENST00000572785 | TSF |
| 2% | chr15 | 74475607 | 74475594 | − | chr15 | 74474801 | 74474684 | − | ENST00000395105; ENST00000423167; ENST00000323940; ENST00000449139; ENST00000416286; ENST00000535552; ENST00000563965; ENST00000574278; ENST00000572785 | TSF |
| 2% | chr1 | 31744147 | 31744121 | − | chr1 | 31742087 | 31742005 | − | ENST00000263694; ENST00000373720; ENST00000446633 | TSF |
| 2% | chr1 | 31744147 | 31744121 | − | chr1 | 31742087 | 31742005 | − | ENST00000263694; ENST00000373720; ENST00000446633 | TSF |
| 2% | chr13 | 73295985 | 73295918 | − | chr13 | 73293235 | 73293090 | − | ENST00000377818 | TSF |
| 2% | chr21 | 38273278 | 38272892 | − | chr21 | 38269431 | 38269160 | − | ENST00000336648; ENST00000399120 | TSF |
| 2% | chr3 | 191873117 | 191873032 | − | chr3 | 191861916 | 191861798; 191861849 | − | ENST00000445105; ENST00000264730; ENST00000454309; ENST00000440901; ENST00000450716; ENST00000430714; ENST00000448795 | TSF |
| 2% | chr3 | 191873117 | 191873032 | − | chr3 | 191861916 | 191861798; 191861849 | − | ENST00000445105; ENST00000264730; ENST00000454309; ENST00000440901; ENST00000450716; ENST00000430714; ENST00000448795 | TSF |
| 2% | chrX | 134971303 | 134970989 | − | chrX | 134932924 | 134932815 | − | ENST00000487941; ENST00000434966; ENST00000494421 | TSF |
| 2% | chr21 | 30382014 | 30381948 | − | chr21 | 30380942 | 30380716 | − | ENST00000493196 | TSF |
| 2% | chrX | 134954053 | 134953739 | − | chrX | 134932924 | 134932815 | − | ENST00000487941; ENST00000434966; ENST00000494421 | TSF |
| 2% | chr1 | 52322378 | 52322114 | − | chr1 | 52306186 | 52305898 | − | ENST00000352171; ENST00000354831 | TSF |
| 2% | chr1 | 52322378 | 52322114 | − | chr1 | 52306186 | 52305898 | − | ENST00000352171; ENST00000354831 | TSF |
| 1% | chr18 | 33274343 | 33274542 | + | chr18 | 33282861 | 33282959 | + | ENST00000269195; ENST00000537549 | TSF |
| 1% | chr14 | 51360331 | 51360476 | + | chr14 | 51368547 | 51368629 | + | ENST00000337334; ENST00000353130; ENST00000395752 | TSF |
| 1% | chr2 | 28630786 | 28630878 | + | chr2 | 28631626 | 28631733 | + | ENST00000379619; ENST00000264716 | TSF |

TABLE 40-continued

Transcript fusion for Lung Squamous Cell Carcinoma (LUSC) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 1% | chr2 | 28630786 | 28630878 | + | chr2 | 28631626 | 28631733 | + | ENST00000436647; ENST00000545753 ENST00000379619; ENST00000264716; | TSF |
| 1% | chr2 | 28630786 | 28630878 | + | chr2 | 28631626 | 28631733 | + | ENST00000436647; ENST00000545753 ENST00000379619; ENST00000264716; | TSF |
| 1% | chr3 | 187088030 | 187088050 | + | chr3 | 187088576 | 187089161 | + | ENST00000259030 | TSF |
| 1% | chr10 | 27470588 | 27470654 | + | chr10 | 27475308 | 27475465 | + | ENST00000375946; ENST00000375940; ENST00000342386 | TSF |
| 1% | chr15 | 69718867 | 69718995 | + | chr15 | 69721450 | 69721552 | + | ENST00000559279; ENST00000395392; ENST00000352331; ENST00000260363; ENST00000558585; ENST00000559283; ENST00000537891 | TSF |
| 1% | chr15 | 69718867 | 69718995 | + | chr15 | 69721450 | 69721552 | + | ENST00000559279; ENST00000395392; ENST00000352331; ENST00000260363; ENST00000558585; ENST00000559283; ENST00000537891 | TSF |
| 1% | chr15 | 69718867 | 69718995 | + | chr15 | 69721450 | 69721552 | + | ENST00000559279; ENST00000395392; ENST00000352331; ENST00000260363; ENST00000558585; ENST00000559283; ENST00000537891 | TSF |
| 1% | chr15 | 69718867 | 69718995 | + | chr15 | 69721450 | 69721552 | + | ENST00000559279; ENST00000395392; ENST00000352331; ENST00000260363; ENST00000558585; ENST00000559283; ENST00000537891 | TSF |
| 1% | chr17 | 7479605 | 7479718 | + | chr17 | 7479842 | 7480008; 7480010; 7479924 | + | ENST00000582169; ENST00000293831; ENST00000585024; ENST00000583802; ENST00000581544; ENST00000577269; ENST00000584784; ENST00000582746; ENST00000584860; ENST00000581384 | TSF |
| 1% | chr17 | 7479605 | 7479718 | + | chr17 | 7479842 | 7480008; 7480010; 7479924 | + | ENST00000582169; ENST00000293831; ENST00000585024; ENST00000583802; ENST00000581544; ENST00000577269; ENST00000584784; ENST00000582746; ENST00000584860; ENST00000581384 | TSF |
| 1% | chr17 | 7479605 | 7479718 | + | chr17 | 7479842 | 7480008; 7480010; 7479924 | + | ENST00000582169; ENST00000293831; ENST00000585024; ENST00000583802; ENST00000581544; ENST00000577269; ENST00000584784; ENST00000582746; ENST00000584860; ENST00000581384 | TSF |
| 1% | chr17 | 7479605 | 7479718 | + | chr17 | 7479842 | 7480008; 7480010; 7479924 | + | ENST00000582169; ENST00000293831; ENST00000585024; ENST00000583802; ENST00000581544; ENST00000577269; ENST00000584784; ENST00000582746; ENST00000584860; ENST00000581384 | TSF |
| 1% | chr17 | 7479605 | 7479718 | + | chr17 | 7479842 | 7480008; 7480010; 7479924 | + | ENST00000582169; ENST00000293831; ENST00000585024; ENST00000583802; ENST00000581544; ENST00000577269; ENST00000584784; ENST00000582746; ENST00000584860; ENST00000581384 | TSF |
| 1% | chr17 | 7479605 | 7479718 | + | chr17 | 7479842 | 7480008; 7480010; 7479924 | + | ENST00000582169; ENST00000293831; ENST00000585024; ENST00000583802; ENST00000581544; ENST00000577269; ENST00000584784; ENST00000582746; ENST00000584860; ENST00000581384 | TSF |
| 1% | chr17 | 7479605 | 7479718 | + | chr17 | 7479842 | 7480008; 7480010; 7479924 | + | ENST00000582169; ENST00000293831; ENST00000585024; ENST00000583802; ENST00000581544; ENST00000577269; ENST00000584784; ENST00000582746; ENST00000584860; ENST00000581384 | TSF |
| 1% | chr17 | 7479605 | 7479718 | + | chr17 | 7479842 | 7480008; 7480010; 7479924 | + | ENST00000582169; ENST00000293831; ENST00000585024; ENST00000583802; ENST00000581544; ENST00000577269; ENST00000584784; ENST00000582746; ENST00000584860; ENST00000581384 | TSF |
| 1% | chr17 | 7479605 | 7479718 | + | chr17 | 7479842 | 7480008; 7480010; 7479924 | + | ENST00000582169; ENST00000293831; ENST00000585024; ENST00000583802; ENST00000581544; ENST00000577269; ENST00000584784; ENST00000582746; ENST00000584860; ENST00000581384 | TSF |
| 1% | chr3 | 155605105 | 155605320 | + | chr3 | 155611307 | 155611488 | + | ENST00000496455 | TSF |

TABLE 40-continued

Transcript fusion for Lung Squamous Cell Carcinoma (LUSC) Coordinates of the fusion sequences for which the donor is the TE.

| 1 | 2' | 3' | 4' | 5' | 6' | 7' | 8' | 9' | 10' | 11' |
|---|----|----|----|----|----|----|----|----|-----|-----|
| 1% | chr4 | 15791827 | 15792504 | + | chr4 | 15818134 | 15818263 | + | ENST00000502843; ENST00000226279 | TSF |
| 1% | chr4 | 15791827 | 15792504 | + | chr4 | 15818134 | 15818263 | + | ENST00000502843; ENST00000226279 | TSF |
| 1% | chr9 | 134363954 | 134364268 | + | chr9 | 134366812 | 134366967 | + | ENST00000405995; ENST00000357304; ENST00000458550; ENST00000372249; ENST00000320547 | TSF |
| 1% | chr9 | 134363954 | 134364268 | + | chr9 | 134366812 | 134366967 | + | ENST00000405995; ENST00000357304; ENST00000458550; ENST00000372249; ENST00000320547 | TSF |
| 1% | chr5 | 147155750 | 147156045 | + | chr5 | 147261009 | 147261211 | + | ENST00000296694 | TSF |
| 1% | chr3 | 184083167 | 184083362 | + | chr3 | 184084505 | 184084588 | + | ENST00000456318; ENST00000438240; ENST00000455712; ENST00000452961; ENST00000296223; ENST00000429568 | TSF |
| 1% | chr3 | 184083167 | 184083362 | + | chr3 | 184084505 | 184084588 | + | ENST00000456318; ENST00000438240; ENST00000455712; ENST00000452961; ENST00000296223; ENST00000429568 | TSF |
| 1% | chr3 | 184083167 | 184083362 | + | chr3 | 184084505 | 184084588 | + | ENST00000456318; ENST00000438240; ENST00000455712; ENST00000452961; ENST00000296223; ENST00000429568 | TSF |
| 1% | chr7 | 134215952 | 134215973 | + | chr7 | 134217756 | 134217833 | + | ENST00000359579 | TSF |
| 1% | chr4 | 57321042 | 57321258 | + | chr4 | 57325538 | 57325704; 57325665 | + | ENST00000514888; ENST00000264221; ENST00000505164; ENST00000399688; ENST00000512576 | TSF |
| 1% | chr4 | 57321042 | 57321258 | + | chr4 | 57325538 | 57325704; 57325665 | + | ENST00000514888; ENST00000264221; ENST00000505164; ENST00000399688; ENST00000512576 | TSF |
| 1% | chr7 | 2287707 | 2287861 | + | chr7 | 2289492 | 2289637 | + | ENST00000356714; ENST00000397049; ENST00000397046; ENST00000397048; ENST00000339737; ENST00000343985 | TSF |
| 1% | chr11 | 118959557 | 118959558 | + | chr11 | 118959927 | 118959982 | + | ENST00000278715; ENST00000536813; ENST00000537841; ENST00000542729; ENST00000546302; ENST00000442944; ENST00000544387; ENST00000543090; ENST00000539986; ENST00000535253; ENST00000392841 | TSF |
| 1% | chr11 | 118959557 | 118959558 | + | chr11 | 118959927 | 118959982 | + | ENST00000278715; ENST00000536813; ENST00000537841; ENST00000542729; ENST00000546302; ENST00000442944; ENST00000544387; ENST00000543090; ENST00000539986; ENST00000535253; ENST00000392841 | TSF |
| 1% | chr11 | 118959557 | 118959558 | + | chr11 | 118959927 | 118959982 | + | ENST00000278715; ENST00000536813; ENST00000537841; ENST00000542729; ENST00000546302; ENST00000442944; ENST00000544387; ENST00000543090; ENST00000539986; ENST00000535253; ENST00000392841 | TSF |
| 1% | chr11 | 118959557 | 118959558 | + | chr11 | 118959927 | 118959982 | + | ENST00000278715; ENST00000536813; ENST00000537841; ENST00000542729; ENST00000546302; ENST00000442944; ENST00000544387; ENST00000543090; ENST00000539986; ENST00000535253; ENST00000392841 | TSF |
| 1% | chr11 | 118959557 | 118959558 | + | chr11 | 118959927 | 118959982 | + | ENST00000278715; ENST00000536813; ENST00000537841; ENST00000542729; ENST00000546302; ENST00000442944; ENST00000544387; ENST00000543090; ENST00000539986; ENST00000535253; ENST00000392841 | TSF |
| 1% | chr11 | 118959557 | 118959558 | + | chr11 | 118959927 | 118959982 | + | ENST00000278715; ENST00000536813; ENST00000537841; ENST00000542729; ENST00000546302; ENST00000442944; ENST00000544387; ENST00000543090; ENST00000539986; ENST00000535253; ENST00000392841 | TSF |
| 1% | chr8 | 39766308 | 39766549 | + | chr8 | 39775394 | 39775489; 39775448 | + | ENST00000518804; ENST00000519154; ENST00000522495; ENST00000522840; ENST00000518237; ENST00000253513 | TSF |
| 1% | chr8 | 39766308 | 39766549 | + | chr8 | 39775394 | 39775489; 39775448 | + | ENST00000518804; ENST00000519154; ENST00000522495; ENST00000522840; ENST00000518237; ENST00000253513 | TSF |
| 1% | chr8 | 39766308 | 39766549 | + | chr8 | 39775394 | 39775489; 39775448 | + | ENST00000518804; ENST00000519154; ENST00000522495; ENST00000522840; ENST00000518237; ENST00000253513 | TSF |
| 1% | chr8 | 39766308 | 39766549 | + | chr8 | 39775394 | 39775489; 39775448 | + | ENST00000518804; ENST00000519154; ENST00000522495; ENST00000522840; | TSF |

TABLE 40-continued

Transcript fusion for Lung Squamous Cell Carcinoma (LUSC) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 1% | chr8 | 39766308 | 39766549 | + | chr8 | 39775394 | 39775489; 39775448 | + | ENST00000518237; ENST00000253513 ENST00000518804; ENST00000519154; ENST00000522495; ENST00000522840; ENST00000518237; ENST00000253513 | TSF |
| 1% | chr12 | 53865082 | 53865132 | + | chr12 | 53865422 | 53865591 | + | ENST00000359282; ENST00000437231; ENST00000447282; ENST00000603815; ENST00000549863; ENST00000359462; ENST00000546463; ENST00000552296; ENST00000552819; ENST00000455667; ENST00000439930; ENST00000548933; ENST00000562264; ENST00000553064; ENST00000547859 | TSF |
| 1% | chr12 | 53865082 | 53865132 | + | chr12 | 53865422 | 53865591 | + | ENST00000359282; ENST00000437231; ENST00000447282; ENST00000603815; ENST00000549863; ENST00000359462; ENST00000546463; ENST00000552296; ENST00000552819; ENST00000455667; ENST00000439930; ENST00000548933; ENST00000562264; ENST00000553064; ENST00000547859 | TSF |
| 1% | chr1 | 23397020 | 23397118 | + | chr1 | 23397718 | 23397852 | + | ENST00000356634; ENST00000400181; ENST00000542151 | TSF |
| 1% | chr8 | 42014292 | 42014390 | + | chr8 | 42015459 | 42015630; 42015603 | + | ENST00000518421; ENST00000174653; ENST00000396926; ENST00000530375; ENST00000522288; ENST00000517922; ENST00000517499 | TSF |
| 1% | chr8 | 42014292 | 42014390 | + | chr8 | 42015459 | 42015630; 42015603 | + | ENST00000518421; ENST00000174653; ENST00000396926; ENST00000530375; ENST00000522288; ENST00000517922; ENST00000517499 | TSF |
| 1% | chr8 | 42014292 | 42014390 | + | chr8 | 42015459 | 42015630; 42015603 | + | ENST00000518421; ENST00000174653; ENST00000396926; ENST00000530375; ENST00000522288; ENST00000517922; ENST00000517499 | TSF |
| 1% | chr8 | 42014292 | 42014390 | + | chr8 | 42015459 | 42015630; 42015603 | + | ENST00000518421; ENST00000174653; ENST00000396926; ENST00000530375; ENST00000522288; ENST00000517922; ENST00000517499 | TSF |
| 1% | chr8 | 42014292 | 42014390 | + | chr8 | 42015459 | 42015630; 42015603 | + | ENST00000518421; ENST00000174653; ENST00000396926; ENST00000530375; ENST00000522288; ENST00000517922; ENST00000517499 | TSF |
| 1% | chr7 | 74480763 | 74480881 | + | chr7 | 74528191 | 74528329 | + | ENST00000356115; ENST00000430511; ENST00000312575; ENST00000423666 | TSF |
| 1% | chr7 | 74480763 | 74480881 | + | chr7 | 74528191 | 74528329 | + | ENST00000356115; ENST00000430511; ENST00000312575; ENST00000423666 | TSF |
| 1% | chr7 | 74480763 | 74480881 | + | chr7 | 74528191 | 74528329 | + | ENST00000356115; ENST00000430511; ENST00000312575; ENST00000423666 | TSF |
| 1% | chr12 | 49659927 | 49660025 | + | chr12 | 49663248 | 49663470; 49663252 | + | ENST00000541364; ENST00000552125; ENST00000301072; ENST00000549183 | TSF |
| 1% | chr12 | 49659927 | 49660025 | + | chr12 | 49663248 | 49663470; 49663252 | + | ENST00000541364; ENST00000552125; ENST00000301072; ENST00000549183 | TSF |
| 1% | chr12 | 49659927 | 49660025 | + | chr12 | 49663248 | 49663470; 49663252 | + | ENST00000541364; ENST00000552125; ENST00000301072; ENST00000549183 | TSF |
| 1% | chr3 | 11645847 | 11645798 | − | chr3 | 11643496 | 11643307 | − | ENST00000273038; ENST00000430365; ENST00000404339; ENST00000445411; ENST00000418000; ENST00000458499; ENST00000417206; ENST00000419541 | TSF |
| 1% | chr3 | 11645847 | 11645798 | − | chr3 | 11643496 | 11643307 | − | ENST00000273038; ENST00000430365; ENST00000404339; ENST00000445411; ENST00000418000; ENST00000458499; ENST00000417206; ENST00000419541 | TSF |
| 1% | chr3 | 11645847 | 11645798 | − | chr3 | 11643496 | 11643307 | − | ENST00000273038; ENST00000430365; ENST00000404339; ENST00000445411; ENST00000418000; ENST00000458499; ENST00000417206; ENST00000419541 | TSF |
| 1% | chr3 | 11645847 | 11645798 | − | chr3 | 11643496 | 11643307 | − | ENST00000273038; ENST00000430365; ENST00000404339; ENST00000445411; ENST00000418000; ENST00000458499; ENST00000417206; ENST00000419541 | TSF |
| 1% | chr3 | 11645847 | 11645798 | − | chr3 | 11643496 | 11643307 | − | ENST00000273038; ENST00000430365; ENST00000404339; ENST00000445411; ENST00000418000; ENST00000458499; ENST00000417206; ENST00000419541 | TSF |
| 1% | chr3 | 11645847 | 11645798 | − | chr3 | 11643496 | 11643307 | − | ENST00000273038; ENST00000430365; | TSF |

TABLE 40-continued

Transcript fusion for Lung Squamous Cell Carcinoma (LUSC) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 1% | chr9 | 119603649 | 119602972 | − | chr9 | 119583062 | 119582896 | − | ENST00000404339; ENST00000445411; ENST00000418000; ENST00000458499; ENST00000417206; ENST00000419541 ENST00000373996; ENST00000313400; ENST00000373986; ENST00000361209 | TSF |
| 1% | chr9 | 130929922 | 130929818 | − | chr9 | 130929443 | 130929374 | − | ENST00000372954; ENST00000393608; ENST00000541172; ENST00000325721; ENST00000357558; ENST00000538431; ENST00000277465; ENST00000372948; ENST00000372938; ENST00000415526 | TSF |
| 1% | chr3 | 195798106 | 195797990 | − | chr3 | 195796439 | 195796326 | − | ENST00000420415; ENST00000360110; ENST00000392396 | TSF |
| 1% | chr17 | 30244937 | 30244908 | − | chr17 | 30226749 | 30226665 | − | ENST00000261708 | TSF |
| 1% | chr1 | 45988716 | 45988450 | − | chr1 | 45980667 | 45980545 | − | ENST00000262746; ENST00000319248; ENST00000447184; ENST00000424390 | TSF |
| 1% | chr1 | 45988716 | 45988450 | − | chr1 | 45980667 | 45980545 | − | ENST00000262746; ENST00000319248; ENST00000447184; ENST00000424390 | TSF |
| 1% | chr3 | 182833330 | 182833262 | − | chr3 | 182812393 | 182812347 | − | ENST00000265594; ENST00000497830; ENST00000495767; ENST00000476176; ENST00000487634; ENST00000466650; ENST00000486226 | TSF |
| 1% | chr3 | 182833330 | 182833262 | − | chr3 | 182812393 | 182812347 | − | ENST00000265594; ENST00000497830; ENST00000495767; ENST00000476176; ENST00000487634; ENST00000466650; ENST00000486226 | TSF |
| 1% | chr3 | 182833330 | 182833262 | − | chr3 | 182812393 | 182812347 | − | ENST00000265594; ENST00000497830; ENST00000495767; ENST00000476176; ENST00000487634; ENST00000466650; ENST00000486226 | TSF |
| 1% | chr3 | 182833330 | 182833262 | − | chr3 | 182812393 | 182812347 | − | ENST00000265594; ENST00000497830; ENST00000495767; ENST00000476176; ENST00000487634; ENST00000466650; ENST00000486226 | TSF |
| 1% | chr1 | 6366296 | 6365480 | − | chr1 | 6355040 | 6354924 | − | ENST00000608083; ENST00000377842; ENST00000377845; ENST00000377855; ENST00000377860; ENST00000418124; ENST00000545482; ENST00000361521; ENST00000473466 | TSF |
| 1% | chr1 | 6366296 | 6365480 | − | chr1 | 6355040 | 6354924 | − | ENST00000608083; ENST00000377842; ENST00000377845; ENST00000377855; ENST00000377860; ENST00000418124; ENST00000545482; ENST00000361521; ENST00000473466 | TSF |
| 1% | chr1 | 6366296 | 6365480 | − | chr1 | 6355040 | 6354924 | − | ENST00000608083; ENST00000377842; ENST00000377845; ENST00000377855; ENST00000377860; ENST00000418124; ENST00000545482; ENST00000361521; ENST00000473466 | TSF |
| 1% | chr1 | 6366296 | 6365480 | − | chr1 | 6355040 | 6354924 | − | ENST00000608083; ENST00000377842; ENST00000377845; ENST00000377855; ENST00000377860; ENST00000418124; ENST00000545482; ENST00000361521; ENST00000473466 | TSF |
| 1% | chr9 | 123165858 | 123165590 | − | chr9 | 123165349 | 123165084 | − | ENST00000359309; ENST00000360822; ENST00000349780; ENST00000360190; ENST00000416449; ENST00000425647 | TSF |
| 1% | chr5 | 72167664 | 72167716 | + | chr5 | 72168466 | 72168547; 72168521 | + | ENST00000337273; ENST00000454282; ENST00000447967; ENST00000520850; ENST00000523768; ENST00000506351 | TSF |
| 1% | chr5 | 72167664 | 72167716 | + | chr5 | 72168466 | 72168547; 72168521 | + | ENST00000337273; ENST00000454282; ENST00000447967; ENST00000520850; ENST00000523768; ENST00000506351 | TSF |
| 1% | chr12 | 97286062 | 97286334 | + | chr12 | 97328754 | 97328983; 97328758 | + | ENST00000266742; ENST00000429527; ENST00000557478; ENST00000411739; ENST00000553609; ENST00000557644; ENST00000457368 | TSF |
| 1% | chr12 | 97286062 | 97286334 | + | chr12 | 97328754 | 97328983; 97328758 | + | ENST00000266742; ENST00000429527; ENST00000557478; ENST00000411739; ENST00000553609; ENST00000557644; ENST00000457368 | TSF |
| 1% | chr12 | 97286062 | 97286334 | + | chr12 | 97328754 | 97328983; 97328758 | + | ENST00000266742; ENST00000429527; | TSF |

TABLE 40-continued

Transcript fusion for Lung Squamous Cell Carcinoma (LUSC) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
|  |  |  |  |  |  |  |  |  | ENST00000557478; ENST00000411739; ENST00000553609; ENST00000557644; ENST00000457368 |  |
| 1% | chr3 | 100461913 | 100462018 | + | chr3 | 100463677 | 100463775 | + | ENST00000418917; ENST00000490574; ENST00000240851; ENST00000476228 | TSF |
| 1% | chr19 | 55501071 | 55501120 | + | chr19 | 55501390 | 55501560; 55501464 | + | ENST00000543010; ENST00000391721; ENST00000339757; ENST00000448584; ENST00000537859; ENST00000427260; ENST00000538819; ENST00000263437; ENST00000543277 | TSF |
| 1% | chr19 | 55501071 | 55501120 | + | chr19 | 55501390 | 55501560; 55501464 | + | ENST00000543010; ENST00000391721; ENST00000339757; ENST00000448584; ENST00000537859; ENST00000427260; ENST00000538819; ENST00000263437; ENST00000543277 | TSF |
| 1% | chr22 | 43552142 | 43552306 | + | chr22 | 43557058 | 43557196 | + | ENST00000337554; ENST00000428336; ENST00000329563 | TSF |
| 1% | chr22 | 43552142 | 43552306 | + | chr22 | 43557058 | 43557196 | + | ENST00000337554; ENST00000428336; ENST00000329563 | TSF |
| 1% | chr8 | 39778739 | 39778956 | + | chr8 | 39780071 | 39780173; 39780170; 39780150 | + | ENST00000519154; ENST00000522495; ENST00000518237; ENST00000253513 | TSF |
| 1% | chr8 | 39778739 | 39778956 | + | chr8 | 39780071 | 39780173; 39780170; 39780150 | + | ENST00000519154; ENST00000522495; ENST00000518237; ENST00000253513 | TSF |
| 1% | chr8 | 39778739 | 39778956 | + | chr8 | 39780071 | 39780173; 39780170; 39780150 | + | ENST00000519154; ENST00000522495; ENST00000518237; ENST00000253513 | TSF |
| 1% | chr7 | 134213194 | 134213199 | + | chr7 | 134215395 | 134215562 | + | ENST00000359579 | TSF |
| 1% | chr12 | 56110428 | 56110523 | + | chr12 | 56112875 | 56113007; 56112894; 56113085 | + | ENST00000257899; ENST00000551946; ENST00000550412; ENST00000548925; ENST00000549147; ENST00000553100 | TSF |
| 1% | chr12 | 56110428 | 56110523 | + | chr12 | 56112875 | 56113007; 56112894; 56113085 | + | ENST00000257899; ENST00000551946; ENST00000550412; ENST00000548925; ENST00000549147; ENST00000553100 | TSF |
| 1% | chr12 | 56110428 | 56110523 | + | chr12 | 56112875 | 56113007; 56112894; 56113085 | + | ENST00000257899; ENST00000551946; ENST00000550412; ENST00000548925; ENST00000549147; ENST00000553100 | TSF |
| 1% | chr12 | 56110428 | 56110523 | + | chr12 | 56112875 | 56113007; 56112894; 56113085 | + | ENST00000257899; ENST00000551946; ENST00000550412; ENST00000548925; ENST00000549147; ENST00000553100 | TSF |
| 1% | chr15 | 43889497 | 43889601 | + | chr15 | 43990212 | 43990346 | + | ENST00000434505; ENST00000413453 | TSF |
| 1% | chr2 | 238935895 | 238935906 | + | chr2 | 238939197 | 238939220; 238939254; 238939236; 238939204 | + | ENST00000441728; ENST00000272930; ENST00000448502; ENST00000416292; ENST00000409633; ENST00000449891; ENST00000455999; ENST00000445676; ENST00000414443; ENST00000409953; ENST00000409332; ENST00000434655; ENST00000434137 | TSF |
| 1% | chr2 | 238935895 | 238935906 | + | chr2 | 238939197 | 238939220; 238939254; 238939236; 238939204 | + | ENST00000441728; ENST00000272930; ENST00000448502; ENST00000416292; ENST00000409633; ENST00000449891; ENST00000455999; ENST00000445676; ENST00000414443; ENST00000409953; ENST00000409332; ENST00000434655; ENST00000434137 | TSF |
| 1% | chr2 | 238935895 | 238935906 | + | chr2 | 238939197 | 238939220; 238939254; 238939236; 238939204 | + | ENST00000441728; ENST00000272930; ENST00000448502; ENST00000416292; ENST00000409633; ENST00000449891; ENST00000455999; ENST00000445676; ENST00000414443; ENST00000409953; ENST00000409332; ENST00000434655; ENST00000434137 | TSF |
| 1% | chr2 | 238935895 | 238935906 | + | chr2 | 238939197 | 238939220; 238939254; 238939236; 238939204 | + | ENST00000441728; ENST00000272930; ENST00000448502; ENST00000416292; ENST00000409633; ENST00000449891; ENST00000455999; ENST00000445676; ENST00000414443; ENST00000409953; ENST00000409332; ENST00000434655; ENST00000434137 | TSF |
| 1% | chr2 | 238935895 | 238935906 | + | chr2 | 238939197 | 238939220; 238939254; 238939236; 238939204 | + | ENST00000441728; ENST00000272930; ENST00000448502; ENST00000416292; ENST00000409633; ENST00000449891; ENST00000455999; ENST00000445676; ENST00000414443; ENST00000409953; ENST00000409332; ENST00000434655; ENST00000434137 | TSF |
| 1% | chr2 | 238935895 | 238935906 | + | chr2 | 238939197 | 238939220; 238939254; | + | ENST00000441728; ENST00000272930; | TSF |

TABLE 40-continued

Transcript fusion for Lung Squamous Cell Carcinoma (LUSC) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| | | | | | | | 238939236; 238939204 | | ENST00000448502; ENST00000416292; ENST00000409633; ENST00000449891; ENST00000455999; ENST00000445676; ENST00000414443; ENST00000409953; ENST00000409332; ENST00000434655; ENST00000434137 | |
| 1% | chr2 | 238935895 | 238935906 | + | chr2 | 238939197 | 238939220; 238939254; 238939236; 238939204 | + | ENST00000441728; ENST00000272930; ENST00000448502; ENST00000416292; ENST00000409633; ENST00000449891; ENST00000455999; ENST00000445676; ENST00000414443; ENST00000409953; ENST00000409332; ENST00000434655; ENST00000434137 | TSF |
| 1% | chr2 | 238935895 | 238935906 | + | chr2 | 238939197 | 238939220; 238939254; 238939236; 238939204 | + | ENST00000441728; ENST00000272930; TSF ENST00000448502; ENST00000416292; ENST00000409633; ENST00000449891; ENST00000455999; ENST00000445676; ENST00000414443; ENST00000409953; ENST00000409332; ENST00000434655; ENST00000434137 | |
| 1% | chr3 | 40465676 | 40465763 | + | chr3 | 40468763 | 40468999 | + | ENST00000301825; ENST00000456402 | TSF |
| 1% | chr11 | 66953459 | 66954052 | + | chr11 | 66974981 | 66975159 | + | ENST00000398645; ENST00000529006 | TSF |
| 1% | chr11 | 66953459 | 66954052 | + | chr11 | 66974981 | 66975159 | + | ENST00000398645; ENST00000529006 | TSF |
| 1% | chr19 | 36105129 | 36105133 | + | chr19 | 36105944 | 36106049 | + | ENST00000587439; ENST00000203166; ENST00000379045 | TSF |
| 1% | chr19 | 36105129 | 36105133 | + | chr19 | 36105944 | 36106049 | + | ENST00000587439; ENST00000203166; ENST00000379045 | TSF |
| 1% | chr8 | 82194688 | 82194723 | + | chr8 | 82195601 | 82195773 | + | ENST00000297258 | TSF |
| 1% | chr1 | 53070435 | 53070501 | + | chr1 | 53072356 | 53072617 | + | ENST00000361314 | TSF |
| 1% | chr22 | 22512559 | 22512867 | + | chr22 | 22516765 | 22517074 | + | ENST00000390284 | TSF |
| 1% | chr5 | 108341955 | 108342193 | + | chr5 | 108373123 | 108373179 | + | ENST00000281092; ENST00000438717 | TSF |
| 1% | chr12 | 58189709 | 58189746 | + | chr12 | 58189960 | 58190366; 58189980; 58190044 | + | ENST00000454289; ENST00000540550; ENST00000323833; ENST00000350762; ENST00000457189 | TSF |
| 1% | chr12 | 58189709 | 58189746 | + | chr12 | 58189960 | 58190366; 58189980; 58190044 | + | ENST00000454289; ENST00000540550; ENST00000323833; ENST00000350762; ENST00000457189 | TSF |
| 1% | chr12 | 58189709 | 58189746 | + | chr12 | 58189960 | 58190366; 58189980; 58190044 | + | ENST00000454289; ENST00000540550; ENST00000323833; ENST00000350762; ENST00000457189 | TSF |
| 1% | chr14 | 106258982 | 106258725 | − | chr14 | 106209234 | 106209114 | − | ENST00000390548; ENST00000390549; ENST00000390542 | TSF |
| 1% | chr14 | 106258982 | 106258725 | − | chr14 | 106209234 | 106209114 | − | ENST00000390548; ENST00000390549; ENST00000390542 | TSF |
| 1% | chr14 | 106258982 | 106258725 | − | chr14 | 106209234 | 106209114 | − | ENST00000390548; ENST00000390549; ENST00000390542 | TSF |
| 1% | chr3 | 169042432 | 169042361 | − | chr3 | 168861620 | 168861486 | − | ENST00000264674; ENST00000494292 | TSF |
| 1% | chr3 | 169042432 | 169042361 | − | chr3 | 168861620 | 168861486 | − | ENST00000264674; ENST00000494292 | TSF |
| 1% | chr3 | 185370915 | 185370866 | − | chr3 | 185369956 | 185369882 | − | ENST00000382199; ENST00000421047; ENST00000457616; ENST00000346192 | TSF |
| 1% | chr14 | 106258982 | 106258725 | − | chr14 | 106237569 | 106237449 | − | ENST00000390551 | TSF |
| 1% | chr19 | 282715 | 282661 | − | chr19 | 282310 | 282134; 282122 | − | ENST00000269812; ENST00000434325; ENST00000327790; ENST00000586998 | TSF |
| 1% | chr19 | 282715 | 282661 | − | chr19 | 282310 | 282134; 282122 | − | ENST00000269812; ENST00000434325; ENST00000327790; ENST00000586998 | |
| 1% | chr11 | 89098177 | 89098143 | − | chr11 | 89088211 | 89088130 | − | ENST00000535633; ENST00000424319; ENST00000343727; ENST00000534731; ENST00000263317; ENST00000532825; ENST00000527956; ENST00000542487; ENST00000527626; ENST00000528341; ENST00000413594; ENST00000375979; ENST00000531342 | TSF |
| 1% | chr11 | 89098177 | 89098143 | − | chr11 | 89088211 | 89088130 | − | ENST00000535633; ENST00000424319; ENST00000343727; ENST00000534731; ENST00000263317; ENST00000532825; ENST00000527956; ENST00000542487; ENST00000527626; ENST00000528341; ENST00000413594; ENST00000375979; ENST00000531342 | TSF |
| 1% | chr11 | 89098177 | 89098143 | − | chr11 | 89088211 | 89088130 | − | ENST00000535633; ENST00000424319; ENST00000343727; ENST00000534731; ENST00000263317; ENST00000532825; ENST00000527956; ENST00000542487; ENST00000527626; ENST00000528341; | TSF |

TABLE 40-continued

Transcript fusion for Lung Squamous Cell Carcinoma (LUSC) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| | | | | | | | | | ENST00000413594; ENST00000375979; ENST00000531342 | |
| 1% | chr22 | 21355965 | 21355835 | − | chr22 | 21355700 | 21355545 | − | ENST00000215742; ENST00000399133 | TSF |
| 1% | chr9 | 130732697 | 130732597 | − | chr9 | 130716204 | 130716084 | − | ENST00000373095 | TSF |
| 1% | chr2 | 89238917 | 89238677 | − | chr2 | 89157196 | 89156874 | − | ENST00000390237 | TSF |
| 1% | chr7 | 50763323 | 50763289 | − | chr7 | 50742355 | 50742133 | − | ENST00000439599; ENST00000398812; ENST00000403097; ENST00000357271; ENST00000401949; ENST00000439044 | TSF |
| 1% | chr7 | 50763323 | 50763289 | − | chr7 | 50742355 | 50742133 | − | ENST00000439599; ENST00000398812; ENST00000403097; ENST00000357271; ENST00000401949; ENST00000439044 | TSF |
| 1% | chr7 | 50763323 | 50763289 | − | chr7 | 50742355 | 50742133 | − | ENST00000439599; ENST00000398812; ENST00000403097; ENST00000357271; ENST00000401949; ENST00000439044 | TSF |
| 1% | chr15 | 83667946 | 83667078 | − | chr15 | 83657580 | 83657392 | − | ENST00000514272 | TSF |
| 1% | chr3 | 115829645 | 115829500 | − | chr3 | 115805403 | 115805171 | − | ENST00000490035; ENST00000333617; ENST00000539563; ENST00000474851 | TSF |
| 1% | chr3 | 115829645 | 115829500 | − | chr3 | 115805403 | 115805171 | − | ENST00000490035; ENST00000333617; ENST00000539563; ENST00000474851 | TSF |
| 1% | chr3 | 115829645 | 115829500 | − | chr3 | 115805403 | 115805171 | − | ENST00000490035; ENST00000333617; ENST00000539563; ENST00000474851 | TSF |
| 1% | chr3 | 139245547 | 139245400 | − | chr3 | 139237364 | 139237263 | − | ENST00000232219 | TSF |
| 1% | chr3 | 183966288 | 183966210 | − | chr3 | 183963600 | 183963501; 183963562 | − | ENST00000397676; ENST00000445626; ENST00000455059; ENST00000423996 | TSF |
| 1% | chr3 | 183966288 | 183966210 | − | chr3 | 183963600 | 183963501; 183963562 | − | ENST00000397676; ENST00000445626; ENST00000455059; ENST00000423996 | TSF |
| 1% | chrX | 133098739 | 133098673 | − | chrX | 133087238 | 133087077 | − | ENST00000370818; ENST00000394299 | TSF |
| 1% | chrX | 133098739 | 133098673 | − | chrX | 133087238 | 133087077 | − | ENST00000370818; ENST00000394299 | TSF |
| 1% | chr7 | 100850556 | 100850506 | − | chr7 | 100850185 | 100850060 | − | ENST00000454310; ENST00000223127 | TSF |
| 1% | chr19 | 47343471 | 47343460 | − | chr19 | 47342835 | 47342722 | − | ENST00000352203; ENST00000601498; ENST00000599990; ENST00000593442; ENST00000263270; ENST00000597020 | TSF |
| 1% | chr9 | 75580673 | 75580323 | − | chr9 | 75555168 | 75555064 | − | ENST00000297785; ENST00000376939; ENST00000419959; ENST00000446946 | TSF |
| 1% | chr9 | 75580673 | 75580323 | − | chr9 | 75555168 | 75555064 | − | ENST00000297785; ENST00000376939; ENST00000419959; ENST00000446946 | TSF |
| 1% | chr9 | 75580673 | 75580323 | − | chr9 | 75555168 | 75555064 | − | ENST00000297785; ENST00000376939; ENST00000419959; ENST00000446946 | TSF |
| 1% | chr9 | 75580673 | 75580323 | − | chr9 | 75555168 | 75555064 | − | ENST00000297785; ENST00000376939; ENST00000419959; ENST00000446946 | TSF |
| 1% | chr10 | 27051731 | 27051669 | − | chr10 | 27048164 | 27047991 | − | ENST00000376170; ENST00000359188; ENST00000376142; ENST00000376139; ENST00000376160; ENST00000376166; ENST00000376138; ENST00000346832; ENST00000355394; ENST00000376134; ENST00000376140 | TSF |
| 1% | chr10 | 27051731 | 27051669 | − | chr10 | 27048164 | 27047991 | − | ENST00000376170; ENST00000359188; ENST00000376142; ENST00000376139; ENST00000376160; ENST00000376166; ENST00000376138; ENST00000346832; ENST00000355394; ENST00000376134; ENST00000376140 | TSF |
| 1% | chr1 | 17371820 | 17371636 | − | chr1 | 17371383 | 17371256 | − | ENST00000375499 | TSF |
| 1% | chr12 | 48058419 | 48058373 | − | chr12 | 48057373 | 48057288 | − | ENST00000005386; ENST00000432584; ENST00000380650 | TSF |
| 1% | chr3 | 139086428 | 139086379 | − | chr3 | 139085987 | 139085857; 139085942 | − | ENST00000333188; ENST00000507777; ENST00000512309 | TSF |
| 1% | chr3 | 139086428 | 139086379 | − | chr3 | 139085987 | 139085857; 139085942 | − | ENST00000333188; ENST00000507777; ENST00000512309 | TSF |

TABLE 41

Transcript fusion for Mesothelioma (MESO) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 79% | chr10 | 47747112 | 47747132 | + | ENST00000340243;ENST00000374277;ENST00000449464; ENST00000538825 | chr10 | 48278725 | 48278896 | + | TAF |
| 53% | chr20 | 48124601 | 48124521 | − | ENST00000244043 | chr20 | 48123357 | 48123321 | − | TAF |
| 44% | chrX | 152730513 | 152730446 | − | ENST00000370211;ENST00000370212;ENST00000370210 | chrX | 152728559 | 152728505 | − | TAF |
| 44% | chrX | 152730513 | 152730446 | − | ENST00000370211;ENST00000370212;ENST00000370210 | chrX | 152728559 | 152728505 | − | TAF |

TABLE 41-continued

Transcript fusion for Mesothelioma (MESO) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 34% | chr4 | 110723127 | 110723071 | − | ENST00000394635;ENST00000394634;ENST00000512148; ENST00000510800 | chr4 | 110715581 | 110714981 | − | TAF |
| 31% | chr7 | 76144362 | 76144473 | + | ENST00000334348;ENST00000448265;ENST00000419923; ENST00000443097;ENST00000257632;ENST00000394849 | chr7 | 76648226 | 76648393 | + | TSF |
| 31% | chr7 | 76144362 | 76144473 | + | ENST00000334348;ENST00000448265;ENST00000419923; ENST00000443097;ENST00000257632;ENST00000394849 | chr7 | 76648226 | 76648393 | + | TSF |
| 31% | chr7 | 76144362 | 76144473 | + | ENST00000334348;ENST00000448265;ENST00000419923; ENST00000443097;ENST00000257632;ENST00000394849 | chr7 | 76648226 | 76648393 | + | TSF |
| 30% | chr20 | 53092486 | 53092551 | + | ENST00000262593 | chr20 | 53111339 | 53111426 | + | TAF |
| 30% | chr7 | 76144362 | 76144473 | + | ENST00000334348;ENST00000448265;ENST00000419923; ENST00000443097;ENST00000257632;ENST00000394849 | chr7 | 76676146 | 76676313 | + | TSF |
| 30% | chr7 | 76144362 | 76144473 | + | ENST00000334348;ENST00000448265;ENST00000419923; ENST00000443097;ENST00000257632;ENST00000394849 | chr7 | 76676146 | 76676313 | + | TSF |
| 30% | chr7 | 76144362 | 76144473 | + | ENST00000334348;ENST00000448265;ENST00000419923; ENST00000443097;ENST00000257632;ENST00000394849 | chr7 | 76676146 | 76676313 | + | TSF |
| 29% | chr3 | 124839669; 124839530; 124839525 | 124839443 | − | ENST00000430155;ENST00000393469;ENST00000423114; ENST00000469902;ENST00000314584;ENST00000479826 | chr3 | 124838735 | 124838686 | − | TAF |
| 29% | chr3 | 124839669; 124839530; 124839525 | 124839443 | − | ENST00000430155;ENST00000393469;ENST00000423114; ENST00000469902;ENST00000314584;ENST00000479826 | chr3 | 124838735 | 124838686 | − | TAF |
| 29% | chr3 | 124839669; 124839530; 124839525 | 124839443 | − | ENST00000430155;ENST00000393469;ENST00000423114; ENST00000469902;ENST00000314584;ENST00000479826 | chr3 | 124838735 | 124838686 | − | TAF |
| 29% | chr3 | 124839669; 124839530; 124839525 | 124839443 | − | ENST00000430155;ENST00000393469;ENST00000423114; ENST00000469902;ENST00000314584;ENST00000479826 | chr3 | 124838735 | 124838686 | − | TAF |
| 29% | chr3 | 124839669; 124839530; 124839525 | 124839443 | − | ENST00000430155;ENST00000393469;ENST00000423114; ENST00000469902;ENST00000314584;ENST00000479826 | chr3 | 124838735 | 124838686 | − | TAF |
| 26% | chr20 | 48184653 | 48184580 | − | ENST00000244043 | chr20 | 48177475 | 48177085 | − | TSF |
| 25% | chr3 | 118943092 | 118942905 | − | ENST00000483209;ENST00000467604;ENST00000359213; ENST00000393765;ENST00000480814 | chr3 | 118938512 | 118938188 | − | TAF |
| 24% | chr16 | 29916173 | 29916286 | + | ENST00000563177;ENST00000483405;ENST00000308748; ENST00000414952;ENST00000566693 | chr16 | 29930852 | 29930945 | + | TSF |
| 24% | chr16 | 29916173 | 29916286 | + | ENST00000563177;ENST00000483405;ENST00000308748; ENST00000414952;ENST00000566693 | chr16 | 29930852 | 29930945 | + | TSF |
| 22% | chr5 | 82554349 | 82554496 | + | ENST00000282268;ENST00000338635;ENST00000396027; ENST00000511817 | chr5 | 82606608 | 82606935 | + | TAF |
| 21% | chr8 | 74939024 | 74939076 | + | ENST00000284818;ENST00000518893 | chr8 | 74944554 | 74944936 | + | TAF |
| 21% | chr8 | 74939024 | 74939076 | + | ENST00000284818;ENST00000518893 | chr8 | 74944554 | 74944936 | + | TAF |
| 20% | chr9 | 101984828 | 101984925 | + | ENST00000223641 | chr9 | 101986374 | 101986588 | + | TAF |
| 20% | chr15 | 58957396 | 58957296 | − | ENST00000260408 | chr15 | 58947615 | 58947395 | − | TAF |
| 18% | chr15 | 84611655 | 84611834 | + | ENST00000286744;ENST00000567476 | chr15 | 84630325 | 84630701 | + | TAF |
| 18% | chr6 | 53778652 | 53778767 | + | ENST00000370888 | chr6 | 53783822 | 53783822 | + | TSF |
| 17% | chr6 | 10749855; 10749898 | 10749931 | + | ENST00000379542;ENST00000473166;ENST00000463448; ENST00000460341;ENST00000480294;ENST00000473807; ENST00000461342;ENST00000475942;ENST00000379530; ENST00000463100;ENST00000481240;ENST00000467317; ENST00000478732 | chr6 | 10829240 | 10829256 | + | TAF |
| 17% | chr6 | 10749855; 10749898 | 10749931 | + | ENST00000379542;ENST00000473166;ENST00000463448; ENST00000460341;ENST00000480294;ENST00000473807; ENST00000461342;ENST00000475942;ENST00000379530; ENST00000463100;ENST00000481240;ENST00000467317; ENST00000478732 | chr6 | 10829240 | 10829256 | + | TAF |
| 16% | chr7 | 1037440 | 1037282 | − | ENST00000357429;ENST00000397100;ENST00000397098; ENST00000412051;ENST00000444428;ENST00000491163 | chr7 | 1018697 | 1018446 | − | TAF |
| 16% | chr7 | 1037440 | 1037282 | − | ENST00000357429;ENST00000397100;ENST00000397098; ENST00000412051;ENST00000444428;ENST00000491163 | chr7 | 1018697 | 1018446 | − | TAF |
| 16% | chr7 | 1037440 | 1037282 | − | ENST00000357429;ENST00000397100;ENST00000397098; ENST00000412051;ENST00000444428;ENST00000491163 | chr7 | 1018697 | 1018446 | − | TAF |
| 16% | chr1 | 160854667 | 160854610 | − | ENST00000326245 | chr1 | 160853933 | 160853823 | − | TSF |
| 14% | chr3 | 49927493 | 49927357 | − | ENST00000296474;ENST00000344206 | chr3 | 49927248 | 49927204 | − | TAF |
| 14% | chr3 | 49927493 | 49927357 | − | ENST00000296474;ENST00000344206 | chr3 | 49927248 | 49927204 | − | TAF |
| 13% | chr4 | 47583977 | 47584081 | + | ENST00000273859 | chr4 | 47584886 | 47585171 | + | TAF |
| 13% | chr8 | 27516013 | 27517056 | + | ENST00000337221;ENST00000301904 | chr8 | 27555709 | 27555926 | + | TAF |
| 13% | chr16 | 29913136; 29912293 | 29913241 | + | ENST00000563177;ENST00000483405;ENST00000308748; ENST00000414952;ENST00000566693 | chr16 | 29930852 | 29930945 | + | TSF |
| 13% | chr16 | 29913136; 29912293 | 29913241 | + | ENST00000563177;ENST00000483405;ENST00000308748; ENST00000414952;ENST00000566693 | chr16 | 29930852 | 29930945 | + | TSF |
| 11% | chr2 | 220239744 | 220239577 | − | ENST00000273075;ENST00000373972;ENST00000523282 | chr2 | 220227530 | 220227195 | − | TAF |
| 11% | chr2 | 220239744 | 220239577 | − | ENST00000273075;ENST00000373972;ENST00000523282 | chr2 | 220227530 | 220227195 | − | TAF |
| 11% | chr2 | 220239744 | 220239577 | − | ENST00000273075;ENST00000373972;ENST00000523282 | chr2 | 220227530 | 220227195 | − | TAF |
| 11% | chr15 | 79054907 | 79054745 | − | ENST00000388820 | chr15 | 79054428 | 79054400 | − | TAF |
| 10% | chr16 | 81142298 | 81142167 | − | ENST00000533478;ENST00000525539 | chr16 | 81141929 | 81141855 | − | TAF |

TABLE 41-continued

Transcript fusion for Mesothelioma (MESO) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 10% | chr16 | 81142298 | 81142167 | − | ENST00000533478;ENST00000525539 | chr16 | 81141929 | 81141855 | − | TAF |
| 9% | chr16 | 29913136; 29912293 | 29913241 | + | ENST00000563177;ENST00000483405;ENST00000308748; ENST00000414952;ENST00000566693 | chr16 | 29915825 | 29915953 | + | TSF |
| 9% | chr16 | 29913136; 29912293 | 29913241 | + | ENST00000563177;ENST00000483405;ENST00000308748; ENST00000414952;ENST00000566693 | chr16 | 29915825 | 29915953 | + | TSF |
| 9% | chr19 | 3869015; 3869013 | 3868963 | − | ENST00000262961;ENST00000438164;ENST00000587212; ENST00000586578;ENST00000439086 | chr19 | 3855694 | 3855445 | − | TSF |
| 9% | chr19 | 3869015; 3869013 | 3868963 | − | ENST00000262961;ENST00000438164;ENST00000587212; ENST00000586578;ENST00000439086 | chr19 | 3855694 | 3855445 | − | TSF |
| 9% | chr1 | 11115983; 11115877 | 11115838 | − | ENST00000376957;ENST00000490101 | chr1 | 11115464 | 11115178 | − | TSF |
| 9% | chr1 | 11115983; 11115877 | 11115838 | − | ENST00000376957;ENST00000490101 | chr1 | 11115464 | 11115178 | − | TSF |
| 9% | chr5 | 121405863 | 121405748 | − | ENST00000231004 | chr5 | 121403052 | 121403016 | − | TSF |
| 8% | chr6 | 150239520 | 150239310 | − | ENST00000367360 | chr6 | 150238660 | 150237927 | − | TSF |
| 7% | chr10 | 47173918 | 47173898 | − | ENST00000358140;ENST00000359178;ENST00000545298; ENST00000414655 | chr10 | 47151097 | 47150900 | − | TSF |

TABLE 42

Transcript fusion for Mesothelioma (MESO) Coordinates of the fusion sequences for which the donor is the TE.

| 1 | 2' | 3' | 4' | 5' | 6' |
|---|---|---|---|---|---|
| 59% | chr2 | 174982998 | 174982711 | − | chr2 |
| 59% | chr2 | 174982998 | 174982711 | − | chr2 |
| 54% | chr16 | 29915789 | 29915910 | + | chr16 |
| 54% | chr16 | 29915789 | 29915910 | + | chr16 |
| 52% | chr3 | 124842655 | 124842374 | − | chr3 |
| 52% | chr3 | 124842655 | 124842374 | − | chr3 |
| 46% | chr2 | 174982998 | 174982666 | − | chr2 |
| 46% | chr2 | 174982998 | 174982666 | − | chr2 |
| 46% | chr7 | 33006587 | 33006627 | + | chr7 |
| 44% | chr1 | 44018824 | 44019043 | + | chr1 |
| 44% | chr1 | 44018824 | 44019043 | + | chr1 |
| 44% | chr1 | 44018824 | 44019043 | + | chr1 |
| 43% | chr8 | 104389530 | 104389551 | + | chr8 |
| 38% | chr7 | 100878007 | 100877907 | − | chr7 |
| 38% | chr7 | 100878007 | 100877907 | − | chr7 |
| 34% | chr7 | 100878007 | 100877859 | − | chr7 |
| 34% | chr7 | 100878007 | 100877859 | − | chr7 |
| 31% | chr1 | 160854025 | 160853835 | − | chr1 |
| 28% | chr7 | 98974090 | 98974197 | + | chr7 |
| 26% | chr4 | 38103597 | 38103648 | + | chr4 |
| 26% | chr4 | 38103597 | 38103648 | + | chr4 |
| 25% | chr3 | 124690942 | 124690838 | − | chr3 |
| 25% | chr19 | 4454954 | 4454819 | − | chr19 |
| 25% | chr19 | 4454954 | 4454819 | − | chr19 |
| 25% | chr19 | 4454954 | 4454819 | − | chr19 |
| 22% | chr3 | 69286305 | 69286248 | − | chr3 |
| 22% | chr3 | 69286305 | 69286248 | − | chr3 |
| 22% | chr3 | 69286305 | 69286248 | − | chr3 |
| 22% | chr3 | 69286305 | 69286248 | − | chr3 |
| 21% | chr5 | 135398466 | 135398602 | + | chr5 |
| 21% | chr5 | 135398466 | 135398602 | + | chr5 |
| 21% | chr7 | 150938296 | 150938250 | − | chr7 |
| 21% | chr1 | 183600359 | 183599874 | − | chr1 |
| 21% | chr1 | 183600359 | 183599874 | − | chr1 |
| 18% | chr7 | 2289080 | 2289115 | + | chr7 |
| 18% | chr14 | 102691697 | 102691432 | − | chr14 |
| 18% | chr2 | 86512770 | 86512698 | − | chr2 |
| 18% | chr2 | 86512770 | 86512698 | − | chr2 |
| 18% | chr2 | 86512770 | 86512698 | − | chr2 |
| 17% | chr14 | 24631729 | 24631779 | + | chr14 |
| 17% | chr14 | 24631729 | 24631779 | + | chr14 |
| 17% | chr14 | 24631729 | 24631779 | + | chr14 |
| 17% | chr11 | 24631729 | 24631779 | + | chr14 |
| 16% | chr7 | 130127044 | 130127065 | + | chr7 |
| 16% | chr7 | 130127044 | 270613015 | + | chr7 |
| 15% | chr11 | 114177915 | 114178747 | + | chr11 |

TABLE 42-continued

Transcript fusion for Mesothelioma (MESO) Coordinates of the fusion sequences for which the donor is the TE.

| | | | | |
|---|---|---|---|---|
| 15% | chr20 | 33850895 | 33851310 + | chr20 |
| 15% | chr11 | 322262 | 322206 − | chr11 |
| 15% | chr11 | 321450 | 321426 − | chr11 |
| 15% | chr11 | 321638 | 321543 − | chr11 |
| 15% | chr11 | 321638 | 321504 − | chr11 |
| 15% | chr11 | 321488 | 321465 − | chr11 |
| 15% | chr11 | 322580 | 322557 − | chr11 |
| 15% | chr11 | 321410 | 321387 − | chr11 |
| 15% | chr11 | 321638 | 321582 − | chr11 |
| 15% | chr11 | 321716 | 321660 − | chr11 |
| 15% | chr11 | 322067 | 322011 − | chr11 |
| 15% | chr11 | 322457 | 322401 | chr11 |
| 15% | chr11 | 321911 | 321855 − | chr11 |
| 14% | chr9 | 131189761 | 131190058 + | chr9 |
| 14% | chr9 | 131189761 | 131190058 + | chr9 |
| 14% | chr13 | 22253799 | 22254080 + | chr13 |
| 14% | chr11 | 93468219 | 93468129 − | chr11 |
| 14% | chr11 | 93468219 | 93468129 − | chr11 |
| 14% | chr15 | 76298180 | 76298078 − | chr15 |
| 14% | chr7 | 100877200 | 100877154 − | chr7 |
| 14% | chr7 | 100877200 | 100877154 − | chr7 |
| 14% | chr7 | 100877200 | 100877154 − | chr7 |
| 13% | chr17 | 79214190 | 79214239 + | chr17 |
| 13% | chr17 | 79214190 | 79214239 + | chr17 |
| 13% | chr2 | 56146377 | 56145988 − | chr2 |
| 13% | chr2 | 56146377 | 56145988 − | chr2 |
| 13% | chr2 | 56146377 | 56145988 − | chr2 |
| 13% | chr2 | 56146377 | 56145988 − | chr2 |
| 13% | chr2 | 56146377 | 56145988 − | chr2 |
| 13% | chr2 | 56146377 | 56145988 − | chr2 |
| 13% | chr2 | 174982998 | 174982866 − | chr2 |
| 13% | chr2 | 174982998 | 174982866 − | chr2 |
| 11% | chr17 | 48164136 | 48164357 + | chr17 |
| 11% | chr17 | 48164136 | 48164357 + | chr17 |
| 11% | chr9 | 123237538 | 123237484 − | chr9 |
| 11% | chr9 | 123237538 | 123237484 − | chr9 |
| 11% | chr9 | 123237538 | 123237484 − | chr9 |
| 11% | chr9 | 123237538 | 123237484 − | chr9 |
| 11% | chr9 | 123237538 | 123237484 − | chr9 |
| 11% | chr3 | 149090578 | 149090421 − | chr3 |
| 11% | chr3 | 149090578 | 149090421 − | chr3 |
| 11% | chr3 | 149090578 | 149090421 − | chr3 |
| 10% | chr5 | 92920103 | 92920128 + | chr5 |
| 10% | chr16 | 88878506 | 88878500 − | chr16 |
| 10% | chr16 | 88878506 | 88878500 − | chr16 |
| 10% | chr16 | 88878506 | 88878500 − | chr16 |
| 10% | chr16 | 88878506 | 88878500 − | chr16 |
| 10% | chr16 | 88878506 | 88878500 − | chr16 |
| 10% | chr16 | 88878506 | 88878500 − | chr16 |
| 10% | chr5 | 171488028 | 171487971 − | chr5 |
| 10% | chr5 | 171488028 | 171487971 − | chr5 |
| 10% | chr1 | 198208121 | 198208232 + | chr1 |
| 10% | chr1 | 198208121 | 198208232 + | chr1 |
| 10% | chr1 | 198208121 | 198208232 + | chr1 |
| 10% | chr1 | 198208121 | 198208232 + | chr1 |
| 10% | chr1 | 198208121 | 198208232 + | chr1 |
| 10% | chr4 | 56493122 | 56492923 − | chr4 |
| 10% | chr4 | 56493122 | 56492923 − | chr4 |
| 10% | chr4 | 56493122 | 56492923 − | chr4 |
| 9% | chr11 | 60694460 | 60694542 + | chr11 |
| 9% | chr11 | 60694460 | 60694542 + | chr11 |
| 9% | chr7 | 129960758 | 129960856 + | chr7 |
| 9% | chr19 | 13148192 | 13148316 + | chr19 |
| 9% | chr19 | 13148192 | 13148316 + | chr19 |
| 9% | chr19 | 13148192 | 13148316 + | chr19 |
| 9% | chr19 | 13148192 | 13148316 + | chr19 |
| 9% | chr19 | 13148192 | 13148316 + | chr19 |
| 9% | chr3 | 124842655 | 124842374 − | chr3 |
| 9% | chr3 | 124842655 | 124842374 − | chr3 |
| 9% | chr3 | 124842655 | 124842374 − | chr3 |
| 9% | chr3 | 124838831 | 124838710 − | chr3 |
| 9% | chr3 | 124838831 | 124838710 − | chr3 |
| 9% | chr3 | 124838831 | 124838710 − | chr3 |
| 8% | chr1 | 3424070 | 3423998 − | chr1 |
| 8% | chr1 | 3424070 | 3423998 − | chr1 |
| 8% | chr1 | 3424070 | 3423998 − | chr1 |

TABLE 42-continued

Transcript fusion for Mesothelioma (MESO) Coordinates of the fusion sequences for which the donor is the TE.

| 7' | 8' | 9' | 10' | 11' |
|---|---|---|---|---|
| 174946792 | 174946652; 174946738 | − | ENST00000284719;ENST00000344357;ENST00000409546;ENST0 0000429575 | TAF |
| 174946792 | 174946652; 174946738 | − | ENST00000284719;ENST00000344357;ENST00000409546;ENST0 0000429575 | TAF |
| 29916173 | 29916286 | + | ENST00000563177;ENST00000483405;ENST00000308748;ENST0 0000414952;ENST00000566693 | TAF |
| 29916173 | 29916286 | + | ENST00000563177;ENST00000483405;ENST00000308748;ENST0 0000414952;ENST00000566693 | TAF |
| 124839530 | 124839443 | − | ENST00000430155;ENST00000393469;ENST00000423114;ENST0 0000469902;ENST00000479826 | TAF |
| 124839530 | 124839443 | − | ENST00000430155;ENST00000393469;ENST00000423114;ENST0 0000469902;ENST00000479826 | TAF |
| 174946792 | 174946652; 174946738 | − | ENST00000284719;ENST00000344357;ENST00000409546;ENST0 0000429575 | TAF |
| 174946792 | 174946652; 174946738 | − | ENST00000284719;ENST00000344357;ENST00000409546;ENST0 0000429575 | TAF |
| 33014229 | 33014374 | + | ENST00000242209;ENST00000538336 | TSF |
| 44019163 | 44019308 | + | ENST00000359947;ENST00000438120;ENST00000372413;ENST0 0000372414;ENST00000437607 | TAF |
| 44019163 | 44019308 | + | ENST00000359947;ENST00000438120;ENST00000372413;ENST0 0000372414;ENST00000437607 | TAF |
| 44019163 | 44019308 | + | ENST00000359947;ENST00000438120;ENST00000372413;ENST0 0000372414;ENST00000437607 | TAF |
| 104390255 | 104390471 | + | ENST00000330295;ENST00000520337 | TAF |
| 100877723 | 100877559 | − | ENST00000308344;ENST00000401528;ENST00000433833 | TSF |
| 100877723 | 100877559 | − | ENST00000308344;ENST00000401528;ENST00000433833 | TSF |
| 100877723 | 100877559 | − | ENST00000308344;ENST00000401528;ENST00000433833 | TAF |
| 100877723 | 100877559 | − | ENST00000308344;ENST00000401528;ENST00000433833 | TAF |
| 160853316 | 160853218 | − | ENST00000326245 | TSF |
| 98983325 | 98983401 | + | ENST00000432884 | TAF |
| 38104620 | 38104778 | + | ENST00000508802;ENST00000261439 | TAF |
| 38104620 | 38104778 | + | ENST00000508802;ENST00000261439 | TAF |
| 124689645 | 124689496 | − | ENST00000311127;ENST00000487661 | TAF |
| 4454090 | 4453927 | − | ENST00000591919;ENST00000301281;ENST00000592515 | TSF |
| 4454090 | 4453927 | − | ENST00000591919;ENST00000301281;ENST00000592515 | TSF |
| 4454090 | 4453927 | − | ENST00000591919;ENST00000301281;ENST00000592515 | TSF |
| 69273841 | 69273758; 69273834 | − | ENST00000398540;ENST00000542259;ENST00000493880;ENST0 0000473029;ENST00000460709 | TAF |
| 69273841 | 69273758; 69273834 | − | ENST00000398540;ENST00000542259;ENST00000493880;ENST0 0000473029;ENST00000460709 | TAF |
| 69273841 | 69273758; 69273834 | − | ENST00000398540;ENST00000542259;ENST00000493880;ENST0 0000473029;ENST00000460709 | TAF |
| 69273841 | 69273758; 69273834 | − | ENST00000398540;ENST00000542259;ENST00000493880;ENST0 0000473029;ENST00000460709 | TAF |
| 135398875 | 135398915; 135398898 | + | ENST00000442011;ENST00000305126;ENST00000514554;ENST0 0000508076;ENST00000503087 | TAF |
| 135398875 | 135398915; 135398898 | + | ENST00000442011;ENST00000305126;ENST00000514554;ENST0 0000508076;ENST00000503087 | TAF |
| 150937608 | 150937511 | − | ENST00000262188;ENST00000392811;ENST00000356800 | TAF |
| 183599772 | 183599596 | − | ENST00000367534;ENST00000359856;ENST00000294742 | TAF |
| 183599772 | 183599596 | − | ENST00000367534;ENST00000359856;ENST00000294742 | TAF |
| 2289492 | 2289637 | + | ENST00000356714;ENST00000397049;ENST00000397046;ENST0 0000397048;ENST00000339737;ENST00000343985 | TAF |
| 102691131 | 102691116 | − | ENST00000559838 | TAF |
| 86509365 | 86509293 | − | ENST00000165698;ENST00000541910;ENST00000538924;ENST0 0000437769;ENST00000453231 | TSF |
| 86509365 | 86509293 | − | ENST00000165698;ENST00000541910;ENST00000538924;ENST0 0000437769;ENST00000453231 | TSF |
| 86509365 | 86509293 | − | ENST00000165698;ENST00000541910;ENST00000538924;ENST0 0000437769;ENST00000453231 | TSF |
| 86509365 | 86509293 | − | ENST00000165698;ENST00000541910;ENST00000538924;ENST0 0000437769;ENST00000453231 | TSF |
| 24632175 | 24632358; 24632191 | + | ENST00000396864;ENST00000561342;ENST00000559284;ENST0 0000560275;ENST00000560852 | TAF |
| 24632175 | 24632358; 24632191 | + | ENST00000396864;ENST00000561342;ENST00000559284;ENST0 0000560275;ENST00000560852 | TAF |
| 24632175 | 24632358; 24632191 | + | ENST00000396864;ENST00000561342;ENST00000559284;ENST0 0000560275;ENST00000560852 | TAF |
| 24632175 | 24632358; 24632191 | + | ENST00000396864;ENST00000561342;ENST00000559284;ENST0 0000560275;ENST00000560852 | TAF |
| 130135209 | 130135363 | + | ENST00000223215;ENST00000437945 | TAF |
| 130135209 | 130135363 | + | ENST00000223215;ENST00000437945 | TAF |

TABLE 42-continued

Transcript fusion for Mesothelioma (MESO) Coordinates of the fusion sequences for which the donor is the TE.

| | | | | |
|---|---|---|---|---|
| 114182767 | 114183199 | + | ENST00000535401;ENST00000299964 | TAF |
| 33851594 | 33851755 | + | ENST00000246186 | TAF |
| 320772 | 320565 | − | ENST00000399808 | TAF |
| 320772 | 320565 | − | ENST00000399808 | TAF |
| 320772 | 320565 | − | ENST00000399808 | TAF |
| 320772 | 320565 | − | ENST00000399808 | TAF |
| 320772 | 320565 | − | ENST00000399808 | TAF |
| 320772 | 320565 | − | ENST00000399808 | TAF |
| 320772 | 320565 | − | ENST00000399808 | TAF |
| 320772 | 320565 | − | ENST00000399808 | TAF |
| 320772 | 320565 | | ENST00000399808 | TAF |
| 320772 | 320565 | − | ENST00000399808 | TAF |
| 320772 | 320565 | − | ENST00000399808 | TAF |
| 320772 | 320565 | − | ENST00000399808 | TAF |
| 131190581 | 131190702 131190700; | + | ENST00000372842;ENST00000420512;ENST00000372838 | TAF |
| 131190581 | 131190700; 131190702 | + | ENST00000372842;ENST00000420512;ENST00000372838 | TAF |
| 22255181 | 22255284 | + | ENST00000382353 | TAF |
| 93467826 | 93467791; 93467814 | − | ENST00000393259;ENST00000527169 | TAF |
| 93467826 | 93467791; 93467814 | − | ENST00000393259;ENST00000527169 | TAF |
| 76261565 | 76261559 | − | ENST00000472094;ENST00000568073;ENST00000562114;ENST0 0000567936;ENST00000498750;ENST00000567126 | TAF |
| 100876195 | 100876114 | − | ENST00000308344;ENST00000401528;ENST00000414035;ENST0 0000412417 | TSF |
| 100876195 | 100876114 | − | ENST00000308344;ENST00000401528;ENST00000414035;ENST0 0000412417 | TSF |
| 100876195 | 100876114 | − | ENST00000308344;ENST00000401528;ENST00000414035;ENST0 0000412417 | TSF |
| 79214787 | 79214816; 79214953 | + | ENST00000431388;ENST00000576002 | TAF |
| 79214787 | 79214816; 79214953 | + | ENST00000431388;ENST00000576002 | TAF |
| 56145402 | 56145354 | − | ENST00000394555;ENST00000394554;ENST00000355426;ENST0 0000438672;ENST00000439193;ENST00000440439;ENST0000042 9909;ENST00000452337;ENST00000421664 | TAF |
| 56145402 | 56145354 | − | ENST00000394555;ENST00000394554;ENST00000355426;ENST0 0000438672;ENST00000439193;ENST00000440439;ENST0000042 9909;ENST00000452337;ENST00000421664 | TAF |
| 56145402 | 56145354 | − | ENST00000394555;ENST00000394554;ENST00000355426;ENST0 0000438672;ENST00000439193;ENST00000440439;ENST0000042 9909;ENST00000452337;ENST00000421664 | TAF |
| 56145402 | 56145354 | − | ENST00000394555;ENST00000394554;ENST00000355426;ENST0 0000438672;ENST00000439193;ENST00000440439;ENST0000042 9909;ENST00000452337;ENST00000421664 | TAF |
| 56145402 | 56145354 | − | ENST00000394555;ENST00000394554;ENST00000355426;ENST0 0000438672;ENST00000439193;ENST00000440439;ENST0000042 9909;ENST00000452337;ENST00000421664 | TAF |
| 56145402 | 56145354 | − | ENST00000394555;ENST00000394554;ENST00000355426;ENST0 0000438672;ENST00000439193;ENST00000440439;ENST0000042 9909;ENST00000452337;ENST00000421664 | TAF |
| 174946792 | 174946652; 174946738 | − | ENST00000284719;ENST00000344357;ENST00000409546;ENST0 0000429575 | TSF |
| 174946792 | 174946652; 174946738 | − | ENST00000284719;ENST00000344357;ENST00000409546;ENST0 0000429575 | TSF |
| 48165108 | 48165233 | + | ENST00000320031;ENST00000007722 | TAF |
| 48165108 | 48165233 | + | ENST00000320031;ENST00000007722 | TAF |
| 123234156 | 123234026 | − | ENST00000359309;ENST00000360822;ENST00000349780;ENST0 0000360190;ENST00000480112;ENST00000416449 | TAF |
| 123234156 | 123234026 | − | ENST00000359309;ENST00000360822;ENST00000349780;ENST0 0000360190;ENST00000480112;ENST00000416449 | TAF |
| 123234156 | 123234026 | − | ENST00000359309;ENST00000360822;ENST00000349780;ENST0 0000360190;ENST00000480112;ENST00000416449 | TAF |
| 123234156 | 123234026 | − | ENST00000359309;ENST00000360822;ENST00000349780;ENST0 0000360190;ENST00000480112;ENST00000416449 | TAF |
| 123234156 | 123234026 | − | ENST00000359309;ENST00000360822;ENST00000349780;ENST0 0000360190;ENST00000480112;ENST00000416449 | TAF |
| 149089654 | 149089474; 149089447; | − | ENST00000305366;ENST00000472441;ENST00000493348 | TSF |

TABLE 42-continued

Transcript fusion for Mesothelioma (MESO) Coordinates of the fusion sequences for which the donor is the TE.

| | | | | |
|---|---|---|---|---|
| 149089654 | 149089616 149089474; 149089447; 149089616 | | ENST00000305366;ENST00000472441;ENST00000493348 | TSF |
| 149089654 | 149089474; 149089447; 149089616 | – | ENST00000305366;ENST00000472441;ENST00000493348 | TSF |
| 92921107 | 92921192 | + | ENST00000327111 | TAF |
| 88878064 | 88877958; 88877905 | – | ENST00000378364;ENST00000567713;ENST00000426324;ENST0 0000567391;ENST00000568319;ENST00000563655;ENST0000056 9616 | TAF |
| 88878064 | 88877958; 88877905 | – | ENST00000378364;ENST00000567713;ENST00000426324;ENST0 0000567391;ENST00000568319;ENST00000563655;ENST0000056 9616 | TAF |
| 88878064 | 88877958; 88877905 | – | ENST00000378364;ENST00000567713;ENST00000426324;ENST0 0000567391;ENST00000568319;ENST00000563655;ENST0000056 9616 | TAF |
| 88878064 | 88877958; 88877905 | – | ENST00000378364;ENST00000567713;ENST00000426324;ENST0 0000567391;ENST00000568319;ENST00000563655;ENST0000056 9616 | TAF |
| 88878064 | 88877958; 88877905 | – | ENST00000378364;ENST00000567713;ENST00000426324;ENST0 0000567391;ENST00000568319;ENST00000563655;ENST0000056 9616 | TAF |
| 88878064 | 88877958; 88877905 | – | ENST00000378364;ENST00000567713;ENST00000426324;ENST0 0000567391;ENST00000568319;ENST00000563655;ENST0000056 9616 | TAF |
| 171484477 | 171484353 | – | ENST00000176763;ENST00000520476 | TAF |
| 171484477 | 171484353 | – | ENST00000176763;ENST00000520476 | TAF |
| 198222170 | 198222310; 198222208; 198222298 | + | ENST00000367385;ENST00000442588;ENST00000538004;ENST0 0000367383;ENST00000544035;ENST00000391974 | TSF |
| 198222170 | 198222310; 198222208; 198222298 | + | ENST00000367385;ENST00000442588;ENST00000538004;ENST0 0000367383;ENST00000544035;ENST00000391974 | TSF |
| 198222170 | 198222310; 198222208; 198222298 | + | ENST00000367385;ENST00000442588;ENST00000538004;ENST0 0000367383;ENST00000544035;ENST00000391974 | TSF |
| 198222170 | 198222310; 198222208; 198222298 | + | ENST00000367385;ENST00000442588;ENST00000538004;ENST0 0000367383;ENST00000544035;ENST00000391974 | TSF |
| 198222170 | 198222310; 198222208; 198222298 | + | ENST00000367385;ENST00000442588;ENST00000538004;ENST0 0000367383;ENST00000544035;ENST00000391974 | TSF |
| 56482552 | 56482505 | – | ENST00000264218;ENST00000505262;ENST00000507338 | TSF |
| 56482552 | 56482505 | – | ENST00000264218;ENST00000505262;ENST00000507338 | TSF |
| 56482552 | 56482505 | – | ENST00000264218;ENST00000505262;ENST00000507338 | TSF |
| 60694676 | 60694890 | + | ENST00000453848;ENST00000005286 | TSF |
| 60694676 | 60694890 | + | ENST00000453848;ENST00000005286 | TSF |
| 129962329 | 129962516 | + | ENST00000445470;ENST00000222482;ENST00000493259 | TSF |
| 13183861 | 13183923 | + | ENST00000397661;ENST00000592199;ENST00000585382;ENST0 0000587760;ENST00000585575;ENST00000360105;ENST0000058 8228;ENST00000587260;ENST00000358552 | TSF |
| 13183861 | 13183923 | + | ENST00000397661;ENST00000592199;ENST00000585382;ENST0 0000587760;ENST00000585575;ENST00000360105;ENST0000058 8228;ENST00000587260;ENST00000358552 | TSF |
| 13183861 | 13183923 | + | ENST00000397661;ENST00000592199;ENST00000585382;ENST0 0000587760;ENST00000585575;ENST00000360105;ENST0000058 8228;ENST00000587260;ENST00000358552 | TSF |
| 13183861 | 13183923 | + | ENST00000397661;ENST00000592199;ENST00000585382;ENST0 0000587760;ENST00000585575;ENST00000360105;ENST0000058 8228;ENST00000587260;ENST00000358552 | TSF |
| 13183861 | 13183923 | + | ENST00000397661;ENST00000592199;ENST00000585382;ENST0 0000587760;ENST00000585575;ENST00000360105;ENST0000058 8228;ENST00000587260;ENST00000358552 | TSF |
| 124829179 | 124829033; 124829116 | – | ENST00000430155;ENST00000393469;ENST00000423114;ENST0 0000469902;ENST00000314584;ENST00000479826 | TSF |
| 124829179 | 124829033; 124829116 | – | ENST00000430155;ENST00000393469;ENST00000423114;ENST0 0000469902;ENST00000314584;ENST00000479826 | TSF |
| 124829179 | 124829033; 124829116 | – | ENST00000430155;ENST00000393469;ENST00000423114;ENST0 0000469902;ENST00000314584;ENST00000479826 | TSF |
| 124837700 | 124837613 | – | ENST00000430155;ENST00000393469;ENST00000423114;ENST0 0000469902;ENST00000314584;ENST00000479826 | TSF |
| 124837700 | 124837613 | – | ENST00000430155;ENST00000393469;ENST00000423114;ENST0 0000469902;ENST00000314584;ENST00000479826 | TSF |
| 124837700 | 124837613 | – | ENST00000430155;ENST00000393469;ENST00000423114;ENST0 0000469902;ENST00000314584;ENST00000479826 | TSF |
| 3422800 | 3422672 | – | ENST00000294599;ENST00000356575;ENST00000485002 | TSF |

TABLE 42-continued

Transcript fusion for Mesothelioma (MESO) Coordinates of the fusion sequences for which the donor is the TE.

| 3422800 | 3422672 | − | ENST00000294599;ENST00000356575;ENST00000485002 | TSF |
| 3422800 | 3422672 | − | ENST00000294599;ENST00000356575;ENST00000485002 | TSF |

TABLE 43

Transcript fusion for avarian cancer (OV) Coordinates of the fusion sequences for whichich the donor is the exon.

| 1 | 2 | 3 | 4 | 5 | 6 |
|---|---|---|---|---|---|
| 84% | chr20 | 53092486 | 53092551 | + | ENST00000262593 |
| 84% | chr19 | 45323962 | 45324032 | + | ENST00000270233 |
| 51% | chr1 | 32696528 | 32696620 | + | ENST00000373586 |
| 50% | chr6 | 74228333 | 74228077 | − | ENST00000316292;ENST00000309268;ENST00000331523 |
| 40% | chr20 | 47768284 | 47768119 | − | ENST00000371828;ENST00000340954;ENST00000347458;ENST00000360426;ENST00000371792;ENST00000371802;ENST00000371856;ENST00000437404;ENST00000456866 |
| 40% | chr20 | 47768284 | 47768119 | − | ENST00000371828;ENST00000340954;ENST00000347458;ENST00000360426;ENST00000371792;ENST00000371802;ENST00000371856;ENST00000437404;ENST00000456866 |
| 40% | chr20 | 47768284 | 47768119 | − | ENST00000371828;ENST00000340954;ENST00000347458;ENST00000360426;ENST00000371792;ENST00000371802;ENST00000371856;ENST00000437404;ENST00000456866 |
| 38% | chr6 | 10749855; 10749898 | 10749931 | + | ENST00000379542;ENST00000473166;ENST00000463448;ENST00000460341;ENST00000480294;ENST00000473807;ENST00000461342;ENST00000475942;ENST00000379530;ENST00000463100;ENST00000481240;ENST00000467317;ENST00000478732 |
| 38% | chr6 | 10749855; 10749898 | 10749931 | + | ENST00000379542;ENST00000473166;ENST00000463448;ENST00000460341;ENST00000480294;ENST00000473807;ENST00000461342;ENST00000475942;ENST00000379530;ENST00000463100;ENST00000481240;ENST00000467317;ENST00000478732 |
| 38% | chr12 | 113623819 | 113623826 | + | ENST00000552495 |
| 36% | chr12 | 124810916 | 124810737 | − | ENST00000405201;ENST00000404621;ENST00000356219;ENST00000397355;ENST00000404121;ENST00000429285;ENST00000418829;ENST00000443451;ENST00000413172 |
| 36% | chr12 | 124810916 | 124810737 | − | ENST00000405201;ENST00000404621;ENST00000356219;ENST00000397355;ENST00000404121;ENST00000429285;ENST00000418829;ENST00000443451;ENST00000413172 |
| 36% | chr12 | 124810916 | 124810737 | − | ENST00000405201;ENST00000404621;ENST00000356219;ENST00000397355;ENST00000404121;ENST00000429285;ENST00000418829;ENST00000443451;ENST00000413172 |
| 36% | chr12 | 124810916 | 124810737 | − | ENST00000405201;ENST00000404621;ENST00000356219;ENST00000397355;ENST00000404121;ENST00000429285;ENST00000418829;ENST00000443451;ENST00000413172 |
| 36% | chr12 | 124810916 | 124810737 | − | ENST00000405201;ENST00000404621;ENST00000356219;ENST00000397355;ENST00000404121;ENST00000429285;ENST00000418829;ENST00000443451;ENST00000413172 |
| 36% | chr12 | 124810916 | 124810737 | − | ENST00000405201;ENST00000404621;ENST00000356219;ENST00000397355;ENST00000404121;ENST00000429285;ENST00000418829;ENST00000443451;ENST00000413172 |
| 36% | chr12 | 124810916 | 124810737 | − | ENST00000405201;ENST00000404621;ENST00000356219;ENST00000397355;ENST00000404121;ENST00000429285;ENST00000418829;ENST00000443451;ENST00000413172 |
| 36% | chr12 | 124810916 | 124810737 | − | ENST00000405201;ENST00000404621;ENST00000356219;ENST00000397355;ENST00000404121;ENST00000429285;ENST00000418829;ENST00000443451;ENST00000413172 |
| 36% | chr12 | 124810916 | 124810737 | − | ENST00000405201;ENST00000404621;ENST00000356219;ENST00000397355;ENST00000404121;ENST00000429285;ENST00000418829;ENST00000443451;ENST00000413172 |
| 35% | chr1 | 224544627 | 224544695 | + | ENST00000465271;ENST00000366858;ENST00000366857;ENST00000366856 |
| 31% | chr14 | 31922550 | 31922481 | − | ENST00000549185;ENST00000547378;ENST00000310850;ENST00000356180 |
| 30% | chr8 | 144102731 | 144102850 | + | ENST00000292494;ENST00000429120;ENST00000521699;ENST00000520531;ENST00000520466;ENST00000521003;ENST00000522971;ENST00000519611;ENST00000519546;ENST00000523847;ENST00000522024 |
| 30% | chr12 | 6463721 | 6463604 | − | ENST00000360168;ENST00000358945;ENST00000540037;ENST00000228916;ENST00000396966;ENST00000543768 |
| 30% | chr12 | 6463721 | 6463604 | − | ENST00000360168;ENST00000358945;ENST00000540037;ENST00000228916;ENST00000396966;ENST00000543768 |
| 30% | chr12 | 6463721 | 6463604 | − | ENST00000360168;ENST00000358945;ENST00000540037;ENST00000228916;ENST00000396966;ENST00000543768 |
| 30% | chr12 | 6463721 | 6463604 | − | ENST00000360168;ENST00000358945;ENST00000540037;ENST00000228916;ENST00000396966;ENST00000543768 |
| 29% | chr19 | 45322839 | 45322879 | + | ENST00000589651;ENST00000270233 |
| 27% | chr20 | 43881792 | 43881643 | − | ENST00000338380 |
| 26% | chr11 | 118888255 | 118888078 | − | ENST00000527673 |
| 25% | chr2 | 26624858 | 26625012 | + | ENST00000288710;ENST00000421869 |

TABLE 43-continued

| | | | | |
|---|---|---|---|---|
| 24% | chr9 | 91150350 | 91150651 + | ENST00000375854;ENST0000375855 |
| 24% | chr19 | 45315735 | 45315805 + | ENST00000589651;ENST0000270233;ENST00000591520 |
| 24% | chr19 | 45315735 | 45315805 + | ENST00000589651;ENST0000270233;ENST00000591520 |
| 21% | chr19 | 35996667 | 35996620 − | ENST00000434389;ENST00000402589;ENST00000339686;ENST00000436012;ENST00000414866;ENST00000480502;ENST00000467637;ENST00000429837;ENST00000419602;ENST00000443640;ENST00000597212;ENST00000472252;ENST00000492341;ENST00000602781;ENST00000602679;ENST00000474928;ENST00000488892;ENST00000461300;ENST00000447113;ENST00000392206;ENST00000440396;ENST00000458071;ENST00000418261;ENST00000424570;ENST00000451297;ENST00000450261 |
| 21% | chr19 | 35996667 | 35996620 − | ENST00000434389;ENST00000402589;ENST00000339686;ENST00000436012;ENST00000414866;ENST00000480502;ENST00000467637;ENST00000429837;ENST00000419602;ENST00000443640;ENST00000597212;ENST00000472252;ENST00000492341;ENST00000602781;ENST00000602679;ENST00000474928;ENST00000488892;ENST00000461300;ENST00000447113;ENST00000392206;ENST00000440396;ENST00000458071;ENST00000418261;ENST00000424570;ENST00000451297;ENST00000450261 |
| 21% | chr19 | 35996667 | 35996620 − | ENST00000434389;ENST00000402589;ENST00000339686;ENST00000436012;ENST00000414866;ENST00000480502;ENST00000467637;ENST00000429837;ENST00000419602;ENST00000443640;ENST00000597212;ENST00000472252;ENST00000492341;ENST00000602781;ENST00000602679;ENST00000474928;ENST00000488892;ENST00000461300;ENST00000447113;ENST00000392206;ENST00000440396;ENST00000458071;ENST00000418261;ENST00000424570;ENST00000451297;ENST00000450261 |
| 21% | chr19 | 35996667 | 35996620 − | ENST00000434389;ENST00000402589;ENST00000339686;ENST00000436012;ENST00000414866;ENST00000480502;ENST00000467637;ENST00000429837;ENST00000419602;ENST00000443640;ENST00000597212;ENST00000472252;ENST00000492341;ENST00000602781;ENST00000602679;ENST00000474928;ENST00000488892;ENST00000461300;ENST00000447113;ENST00000392206;ENST00000440396;ENST00000458071;ENST00000418261;ENST00000424570;ENST00000451297;ENST00000450261 |
| 21% | chr19 | 35996667 | 35996620 − | ENST00000434389;ENST00000402589;ENST00000339686;ENST00000436012;ENST00000414866;ENST00000480502;ENST00000467637;ENST00000429837;ENST00000419602;ENST00000443640;ENST00000597212;ENST00000472252;ENST00000492341;ENST00000602781;ENST00000602679;ENST00000474928;ENST00000488892;ENST00000461300;ENST00000447113;ENST00000392206;ENST00000440396;ENST00000458071;ENST00000418261;ENST00000424570;ENST00000451297;ENST00000450261 |
| 21% | chr19 | 35996667 | 35996620 − | ENST00000434389;ENST00000402589;ENST00000339686;ENST00000436012;ENST00000414866;ENST00000480502;ENST00000467637;ENST00000429837;ENST00000419602;ENST00000443640;ENST00000597212;ENST00000472252;ENST00000492341;ENST00000602781;ENST00000602679;ENST00000474928;ENST00000488892;ENST00000461300;ENST00000447113;ENST00000392206;ENST00000440396;ENST00000458071;ENST00000418261;ENST00000424570;ENST00000451297;ENST00000450261 |
| 21% | chr19 | 35996667 | 35996620 − | ENST00000434389;ENST00000402589;ENST00000339686;ENST00000436012;ENST00000414866;ENST00000480502;ENST00000467637;ENST00000429837;ENST00000419602;ENST00000443640;ENST00000597212;ENST00000472252;ENST00000492341;ENST00000602781;ENST00000602679;ENST00000474928;ENST00000488892;ENST00000461300;ENST00000447113;ENST00000392206;ENST00000440396;ENST00000458071;ENST00000418261;ENST00000424570;ENST00000451297;ENST00000450261 |
| 21% | chr19 | 35996667 | 35996620 − | ENST00000434389;ENST00000402589;ENST00000339686;ENST00000436012;ENST00000414866;ENST00000480502;ENST00000467637;ENST00000429837;ENST00000419602;ENST00000443640;ENST00000597212;ENST00000472252;ENST00000492341;ENST00000602781;ENST00000602679;ENST00000474928;ENST00000488892;ENST00000461300;ENST00000447113;ENST00000392206;ENST00000440396;ENST00000458071;ENST00000418261;ENST00000424570;ENST00000451297;ENST00000450261 |
| 21% | chr19 | 35996667 | 35996620 − | ENST00000434389;ENST00000402589;ENST00000339686;ENST00000436012;ENST00000414866;ENST00000480502;ENST00000467637;ENST00000429837;ENST00000419602;ENST00000443640;ENST00000597212;ENST00000472252;ENST00000492341;ENST00000602781;ENST00000602679;ENST00000474928;ENST00000488892;ENST00000461300;ENST00000447113;ENST00000392206;ENST00000440396;ENST00000458071;ENST00000418261;ENST00000424570;ENST00000451297;ENST00000450261 |
| 21% | chr19 | 35996667 | 35996620 − | ENST00000434389;ENST00000402589;ENST00000339686;ENST00000436012;ENST00000414866;ENST00000480502;ENST00000467637;ENST00000429837;ENST00000419602;ENST00000443640;ENST00000597212;ENST00000472252;ENST00000492341;ENST00000602781;ENST00000602679;ENST00000474928;ENST00000488892;ENST00000461300;ENST00000447113;ENST00000392206;ENST00000440396;ENST00000458071;ENST00000418261;ENST00000424570;ENST00000451297;ENST00000450261 |
| 21% | chr19 | 35996667 | 35996620 − | ENST00000434389;ENST00000402589;ENST00000339686;ENST00000436012;ENST00000414866;ENST00000480502;ENST00000467637;ENST00000429837;ENST00000419602;ENST00000443640;ENST00000597212;ENST00000472252;ENST00000492341;ENST00000602781;ENST00000602679;ENST00000474928;ENST00000488892;ENST00000461300;ENST00000447113;ENST00000392206;ENST00000440396;ENST00000458071;ENST00000418261;ENST00000424570;ENST00000451297;ENST00000450261 |
| 21% | chr19 | 35996667 | 35996620 − | ENST00000434389;ENST00000402589;ENST00000339686;ENST00000436012;ENST00000414866;ENST00000480502;ENST00000467637;ENST00000429837;ENST00000419602;ENST00000443640;ENST00000597212;ENST00000472252;ENST00000492341;ENST00000602781;ENST00000602679;ENST00000474928;ENST00000488892;ENST00000461300;ENST00000447113;ENST00000392206;ENST00000440396;ENST00000458 |

TABLE 43-continued

| | | | | |
|---|---|---|---|---|
| 21% | chr19 | 35996667 | 35996620 − | 071;ENST00000418261;ENST00000424570;ENST00000451297;ENST00000450261 ENST00000434389;ENST00000402589;ENST00000339686;ENST00000436012;ENST00000414866;ENST00000480502;ENST00000467637;ENST00000429837;ENST00000419602;ENST00000443640;ENST00000597212;ENST00000472252;ENST00000492341;ENST00000602781;ENST00000602679;ENST00000474928;ENST00000488892;ENST00000461300;ENST00000447113;ENST00000392206;ENST00000440396;ENST00000458071;ENST00000418261;ENST00000424570;ENST00000451297;ENST00000450261 |
| 21% | chr19 | 35996667 | 35996620 − | ENST00000434389;ENST00000402589;ENST00000339686;ENST00000436012;ENST00000414866;ENST00000480502;ENST00000467637;ENST00000429837;ENST00000419602;ENST00000443640;ENST00000597212;ENST00000472252;ENST00000492341;ENST00000602781;ENST00000602679;ENST00000474928;ENST00000488892;ENST00000461300;ENST00000447113;ENST00000392206;ENST00000440396;ENST00000458071;ENST00000418261;ENST00000424570;ENST00000451297;ENST00000450261 |
| 21% | chr19 | 35996667 | 35996620 − | ENST00000434389;ENST00000402589;ENST00000339686;ENST00000436012;ENST00000414866;ENST00000480502;ENST00000467637;ENST00000429837;ENST00000419602;ENST00000443640;ENST00000597212;ENST00000472252;ENST00000492341;ENST00000602781;ENST00000602679;ENST00000474928;ENST00000488892;ENST00000461300;ENST00000447113;ENST00000392206;ENST00000440396;ENST00000458071;ENST00000418261;ENST00000424570;ENST00000451297;ENST00000450261 |
| 20% | chr11 | 18536388 | 18536225 − | ENST00000536719;ENST00000251968 |
| 20% | chr15 | 66995597 | 66996413 + | ENST00000288840;ENST00000457357;ENST00000557916 |
| 20% | chr10 | 120905865 | 120905748 − | ENST00000355697;ENST00000330036 |
| 20% | chr10 | 120905865 | 120905748 − | ENST00000355697;ENST00000330036 |
| 19% | chr7 | 91771800 | 91771777 − | ENST00000435873 |
| 18% | chr19 | 13869914; 13869931; 13869925 | 13870086 + | ENST00000586600;ENST00000221554;ENST00000586666;ENST00000588809;ENST00000585844 |
| 18% | chr19 | 13869914; 13869931; 13869925 | 13870086 + | ENST00000586600;ENST00000221554;ENST00000586666;ENST00000588809;ENST00000585844 |
| 18% | chr19 | 13869914; 13869931; 13869925 | 13870086 + | ENST00000586600;ENST00000221554;ENST00000586666;ENST00000588809;ENST00000585844 |
| 18% | chr19 | 13869914; 13869931; 13869925 | 13870086 + | ENST00000586600;ENST00000221554;ENST00000586666;ENST00000588809;ENST00000585844 |
| 18% | chr15 | 82726234 | 82726553 + | ENST00000300515 |
| 18% | chr15 | 83102759 | 83103078 + | ENST00000561062;ENST00000358583 |
| 17% | chr8 | 27516013 | 27517056 + | ENST00000337221;ENST00000301904 |
| 17% | chr19 | 51452029 | 51451896 − | ENST00000391809;ENST00000336334;ENST00000593428 |
| 17% | chr9 | 133352258 | 133352273 − | ENST00000352480;ENST00000372394;ENST00000372393 |
| 17% | chr19 | 16204346; 16204382 | 16204408 + | ENST00000344824;ENST00000538887;ENST00000300933;ENST00000588032;ENST00000592822 |
| 17% | chr19 | 16204346; 16204382 | 16204408 + | ENST00000344824;ENST00000538887;ENST00000300933;ENST00000588032;ENST00000592822 |
| 17% | chr19 | 16204346; 16204382 | 16204408 + | ENST00000344824;ENST00000538887;ENST00000300933;ENST00000588032;ENST00000592822 |
| 17% | chr19 | 16204346; 16204382 | 16204408 + | ENST00000344824;ENST00000538887;ENST00000300933;ENST00000588032;ENST00000592822 |
| 15% | chr1 | 33272212 | 33272083 − | ENST00000373477 |
| 15% | chr19 | 46498683 | 46498762 + | ENST00000263284 |
| 15% | chr6 | 34386201 | 34386146 − | ENST00000605528;ENST00000344700;ENST00000326199 |
| 14% | chr4 | 17625224 | 17625417 + | ENST00000237380;ENST00000503945 |
| 14% | chr4 | 17625224 | 17625417 + | ENST00000237380;ENST00000503945 |
| 14% | chr12 | 71509738 | 71509630 − | ENST00000549357 |
| 14% | chr7 | 27582719 | 27582586 − | ENST00000265395;ENST00000425715 |
| 14% | chr7 | 27582719 | 27582586 − | ENST00000265395;ENST00000425715 |
| 14% | chr9 | 91150350 | 91150651 + | ENST00000375854;ENST00000375855 |
| 14% | chr11 | 66008898; 66008919 | 66008937 + | ENST00000320580;ENST00000529757;ENST00000529677 |
| 14% | chr11 | 66008898; 66008919 | 66008937 + | ENST00000320580;ENST00000529757;ENST00000529677 |
| 14% | chr11 | 66008898; 66008919 | 66008937 + | ENST00000320580;ENST00000529757;ENST00000529677 |
| 14% | chr11 | 66008898; 66008919 | 66008937 + | ENST00000320580;ENST00000529757;ENST00000529677 |
| 13% | chr2 | 132249597 | 132249449 − | ENST00000427024;ENST00000309451 |
| 13% | chr2 | 132249597 | 132249449 − | ENST00000427024;ENST00000309451 |
| 13% | chr6 | 42980766 | 42980664 − | ENST00000244711 |
| 12% | chr19 | 35514331 | 35514451 + | ENST00000599564;ENST00000317991;ENST00000504615;ENST00000411896 |
| 12% | chr19 | 35514331 | 35514451 + | ENST00000599564;ENST00000317991;ENST00000504615;ENST00000411896 |
| 12% | chr19 | 35514331 | 35514451 + | ENST00000599564;ENST00000317991;ENST00000504615;ENST00000411896 |
| 12% | chr19 | 35514331 | 35514451 + | ENST00000599564;ENST00000317991;ENST00000504615;ENST00000411896 |
| 12% | chr6 | 35314915 | 35314927 + | ENST00000448077 |
| 12% | chr18 | 33767503 | 33767644 + | ENST00000261326 |
| 12% | chr6 | 34210489 | 34210572 + | ENST00000447654;ENST00000311487;ENST00000347617;ENST00000401473;ENST00000374116 |
| 12% | chr6 | 34210489 | 34210572 + | ENST00000447654;ENST00000311487;ENST00000347617;ENST00000401473;ENST00000374116 |

TABLE 43-continued

| | | | | |
|---|---|---|---|---|
| 12% | chr8 | 42924698; 42924750 | 42924802 + | ENST00000534420;ENST00000302279;ENST00000533998;ENST00000342116;ENST00000531266;ENST00000525699;ENST00000529687;ENST00000533336 |
| 12% | chr8 | 42924698; 42924750 | 42924802 + | ENST00000534420;ENST00000302279;ENST00000533998;ENST00000342116;ENST00000531266;ENST00000525699;ENST00000529687;ENST00000533336 |
| 12% | chr8 | 42924698; 42924750 | 42924802 + | ENST00000534420;ENST00000302279;ENST00000533998;ENST00000342116;ENST00000531266;ENST00000525699;ENST00000529687;ENST00000533336 |
| 12% | chr8 | 42924698; 42924750 | 42924802 + | ENST00000534420;ENST00000302279;ENST00000533998;ENST00000342116;ENST00000531266;ENST00000525699;ENST00000529687;ENST00000533336 |
| 12% | chr8 | 42924698; 42924750 | 42924802 + | ENST00000534420;ENST00000302279;ENST00000533998;ENST00000342116;ENST00000531266;ENST00000525699;ENST00000529687;ENST00000533336 |
| 12% | chr8 | 42924698; 42924750 | 42924802 + | ENST00000534420;ENST00000302279;ENST00000533998;ENST00000342116;ENST00000531266;ENST00000525699;ENST00000529687;ENST00000533336 |
| 12% | chr1 | 153662760 | 153662858 + | ENST00000368680 |
| 12% | chr1 | 55319285 | 55319152 − | ENST00000371269;ENST00000436604;ENST00000537443;ENST00000535035 |
| 12% | chr1 | 55319285 | 55319152 − | ENST00000371269;ENST00000436604;ENST00000537443;ENST00000535035 |
| 12% | chr1 | 55319285 | 55319152 − | ENST00000371269;ENST00000436604;ENST00000537443;ENST00000535035 |
| 12% | chr1 | 55319285 | 55319152 − | ENST00000371269;ENST00000436604;ENST00000537443;ENST00000535035 |
| 11% | chr2 | 242275390; 242275258 | 222475513 + | ENST00000391973;ENST00000428282;ENST00000360051;ENST00000407017;ENST00000391971;ENST00000401990;ENST00000407971;ENST00000436795;ENST00000411484;ENST00000402092;ENST00000443492;ENST00000437066;ENST00000449239;ENST00000457874 |
| 11% | chr2 | 242275390; 242275258 | 222475513 + | ENST00000391973;ENST00000428282;ENST00000360051;ENST00000407017;ENST00000391971;ENST00000401990;ENST00000407971;ENST00000436795;ENST00000411484;ENST00000402092;ENST00000443492;ENST00000437066;ENST00000449239;ENST00000457874 |
| 11% | chr2 | 242275390; 242275258 | 222475513 + | ENST00000391973;ENST00000428282;ENST00000360051;ENST00000407017;ENST00000391971;ENST00000401990;ENST00000407971;ENST00000436795;ENST00000411484;ENST00000402092;ENST00000443492;ENST00000437066;ENST00000449239;ENST00000457874 |
| 11% | chr2 | 242275390; 242275258 | 222475513 + | ENST00000391973;ENST00000428282;ENST00000360051;ENST00000407017;ENST00000391971;ENST00000401990;ENST00000407971;ENST00000436795;ENST00000411484;ENST00000402092;ENST00000443492;ENST00000437066;ENST00000449239;ENST00000457874 |
| 11% | chr2 | 242275390; 242275258 | 222475513 + | ENST00000391973;ENST00000428282;ENST00000360051;ENST00000407017;ENST00000391971;ENST00000401990;ENST00000407971;ENST00000436795;ENST00000411484;ENST00000402092;ENST00000443492;ENST00000437066;ENST00000449239;ENST00000457874 |
| 11% | chr9 | 15506635 | 15506559 − | ENST00000380738;ENST00000380733;ENST00000380715;ENST00000380716;ENST00000397519 |
| 11% | chr12 | 57060050 | 57059988 − | ENST00000262033;ENST00000414274;ENST00000436399;ENST00000456859 |
| 11% | chr12 | 57060050 | 57059988 − | ENST00000262033;ENST00000414274;ENST00000436399;ENST00000456859 |
| 11% | chr12 | 57060050 | 57059988 − | ENST00000262033;ENST00000414274;ENST00000436399;ENST00000456859 |
| 11% | chr12 | 57060050 | 57059988 − | ENST00000262033;ENST00000414274;ENST00000436399;ENST00000456859 |
| 11% | chr19 | 14063948 | 14063931 − | ENST00000538517;ENST00000538371;ENST00000585607 |
| 11% | chr19 | 45316507 | 45316603 + | ENST00000589651;ENST00000270233;ENST00000591520 |
| 11% | chr19 | 45316507 | 45316603 + | ENST00000589651;ENST00000270233;ENST00000591520 |
| 11% | chr1 | 225156461 | 225156576 + | ENST00000430092;ENST00000400952;ENST00000366849;ENST00000439375 |
| 11% | chr1 | 225156461 | 225156576 + | ENST00000430092;ENST00000400952;ENST00000366849;ENST00000439375 |
| 11% | chr1 | 11805860 | 11805894 + | ENST00000476512;ENST00000400895;ENST00000376629;ENST00000376627;ENST00000314340;ENST00000452018;ENST00000510878 |
| 11% | chr1 | 11805860 | 11805894 + | ENST00000476512;ENST00000400895;ENST00000376629;ENST00000376627;ENST00000314340;ENST00000452018;ENST00000510878 |
| 11% | chr19 | 3869015; 3869013 | 3868963 − | ENST00000262961;ENST00000438164;ENST00000587212;ENST00000586578;ENST0000439086 |
| 11% | chr19 | 3869015; 3869013 | 3868963 − | ENST00000262961;ENST00000438164;ENST00000587212;ENST00000586578;ENST0000439086 |
| 11% | chr1 | 987108 | 987195 + | ENST00000379370;ENST00000419249 |
| 11% | chr1 | 987108 | 987195 + | ENST00000379370;ENST00000419249 |
| 11% | chr19 | 49497169 | 494971 + | ENST00000595090;ENST00000595811;ENST00000596247;ENST00000221413;ENST00000593570 |
| 11% | chr5 | 54993786 | 54993674 − | ENST00000396865;ENST00000539768;ENST00000318672;ENST00000508124;ENST00000511233;ENST00000503891;ENST00000513993;ENST00000505563;ENST00000506624;ENST00000507109 |
| 10% | chr6 | 10751366; 10751403 | 10751467 + | ENST00000379542;ENST00000475942;ENST00000467317;ENST00000478732;ENST00000467229 |
| 10% | chr6 | 10751366; 10751403 | 10751467 + | ENST00000379542;ENST00000475942;ENST00000467317;ENST00000478732;ENST00000467229 |
| 10% | chr6 | 10751366; 10751403 | 10751467 + | ENST00000379542;ENST00000475942;ENST00000467317;ENST00000478732;ENST00000467229 |
| 10% | chr6 | 42980766 | 48980664 − | ENST00000244711 |
| 10% | chr1 | 151239649 | 151239815 + | ENST00000368884;ENST00000368881;ENST00000445776;ENST00000453615 |
| 10% | chr1 | 151239649 | 151239815 + | ENST00000368884;ENST00000368881;ENST00000445776;ENST00000453615 |
| 10% | chr1 | 151239649 | 151239815 + | ENST00000368884;ENST00000368881;ENST00000445776;ENST00000453615 |
| 10% | chr1 | 151239649 | 151239815 + | ENST00000368884;ENST00000368881;ENST00000445776;ENST00000453615 |
| 10% | chr17 | 7214669 | 7214800 + | ENST00000336452;ENST00000336458;ENST00000576930;ENST00000572815;ENST00000573542;ENST00000419711;ENST00000571955;ENST00000573714;ENST00000416016 |
| 10% | chr17 | 7214669 | 7214800 + | ENST00000336452;ENST00000336458;ENST00000576930;ENST00000572815;ENST00000573542;ENST00000419711;ENST00000571955;ENST00000573714;ENST00000416016 |

TABLE 43-continued

| | | | | |
|---|---|---|---|---|
| 9% | chr2 | 133426110; 133426006 | 133425973 − | ENST00000397463;ENST00000345008 |
| 9% | chr2 | 133426110; 133426006 | 133425973 − | ENST00000397463;ENST00000345008 |
| 9% | chr12 | 71928895 | 71928966 + | ENST00000266674;ENST00000536515;ENST00000540815 |
| 9% | chr14 | 66096210; 66096217 | 66096324 + | ENST00000360689;ENST00000394586;ENST00000342677;ENST00000557164;ENST00000394585;ENST00000358307 |
| 9% | chr14 | 66096210; 66096217 | 66096324 + | ENST00000360689;ENST00000394586;ENST00000342677;ENST00000557164;ENST00000394585;ENST00000358307 |
| 9% | chr14 | 66096210; 66096217 | 66096324 + | ENST00000360689;ENST00000394586;ENST00000342677;ENST00000557164;ENST00000394585;ENST00000358307 |
| 8% | chr1 | 155036300 | 152036412 + | ENST00000368409;ENST00000359751;ENST00000556931;ENST00000505139;ENST00000427683 |
| 8% | chr18 | 72176075 | 72176163 + | ENST00000324262;ENST00000580672;ENST00000579847;ENST00000583785 |
| 8% | chr18 | 72176075 | 72176163 + | ENST00000324262;ENST00000580672;ENST00000579847;ENST00000583785 |
| 8% | chr12 | 102547647 | 102547754 + | ENST00000327680;ENST00000378128;ENST00000541394;ENST00000358383;ENST00000392911;ENST00000412715;ENST00000417507;ENST00000457614 |
| 8% | chr12 | 102547647 | 102547754 + | ENST00000327680;ENST00000378128;ENST00000541394;ENST00000358383;ENST00000392911;ENST00000412715;ENST00000417507;ENST00000457614 |
| 8% | chr12 | 102547647 | 102547754 + | ENST00000327680;ENST00000378128;ENST00000541394;ENST00000358383;ENST00000392911;ENST00000412715;ENST00000417507;ENST00000457614 |
| 8% | chr12 | 102547647 | 102547754 + | ENST00000327680;ENST00000378128;ENST00000541394;ENST00000358383;ENST00000392911;ENST00000412715;ENST00000417507;ENST00000457614 |
| 8% | chr12 | 102547647 | 102547754 + | ENST00000327680;ENST00000378128;ENST00000541394;ENST00000358383;ENST00000392911;ENST00000412715;ENST00000417507;ENST00000457614 |
| 8% | chr19 | 15289752 | 15289634 − | ENST00000263388;ENST00000601011 |
| 8% | chr19 | 15289752 | 15289634 − | ENST00000263388;ENST00000601011 |
| 8% | chr2 | 10671988 | 110672054 + | ENST00000553749 |
| 8% | chr22 | 36661197; 36661246 | 36661833 + | ENST00000397278;ENST00000422706;ENST00000426053;ENST00000319136;ENST00000347595;ENST00000397279 |
| 8% | chr22 | 36661197; 36661246 | 36661833 + | ENST00000397278;ENST00000422706;ENST00000426053;ENST00000319136;ENST00000347595;ENST00000397279 |
| 8% | chr22 | 36661197; 36661246 | 36661833 + | ENST00000397278;ENST00000422706;ENST00000426053;ENST00000319136;ENST00000347595;ENST00000397279 |
| 8% | chr22 | 36661197; 36661246 | 36661833 + | ENST00000397278;ENST00000422706;ENST00000426053;ENST00000319136;ENST00000347595;ENST00000397279 |
| 7% | chr19 | 45323962 | 45324032 + | ENST00000270233 |
| 7% | chr2 | 111214673 | 111214907 | ENST00000603767;ENST00000447537 |
| 7% | chr16 | 2867802; 2867880 | 2867967 + | ENST00000455114;ENST00000450020;ENST00000005995;ENST00000574813;ENST00000574265 |
| 7% | chr16 | 2867802; 2867880 | 2867967 + | ENST00000455114;ENST00000450020;ENST00000005995;ENST00000574813;ENST00000574265 |
| 7% | chr16 | 2867802; 2867880 | 2867967 + | ENST00000455114;ENST00000450020;ENST00000005995;ENST00000574813;ENST00000574265 |
| 7% | chr19 | 45322839 | 45322983 + | ENST00000589651;ENST00000270233 |
| 7% | chr19 | 45323962 | 45324032 + | ENST00000270233 |
| 7% | chr16 | 2825557; 2825626 | 2825452 − | ENST00000262306;ENST00000409906;ENST00000409477;ENST00000494946 |
| 7% | chr16 | 2825557; 2825626 | 2825452 − | ENST00000262306;ENST00000409906;ENST00000409477;ENST00000494946 |
| 7% | chr16 | 2825557; 2825626 | 2825452 − | ENST00000262306;ENST00000409906;ENST00000409477;ENST00000494946 |
| 7% | chr3 | 48716169 | 48715997 | ENST00000341520;ENST00000416649;ENST00000294129;ENST00000413374 |
| 7% | chr3 | 48716169 | 48715997 | ENST00000341520;ENST00000416649;ENST00000294129;ENST00000413374 |
| 7% | chr3 | 48716169 | 48715997 | ENST00000341520;ENST00000416649;ENST00000294129;ENST00000413374 |
| 7% | chr19 | 45317861 | 45318010 + | ENST00000589651;ENST00000270233 |
| 7% | chr7 | 76144362 | 76144473 + | ENST00000334348;ENST00000448265;ENST00000419923;ENST00000443097;ENST00000257632;ENST00000394849 |
| 7% | chr7 | 76144362 | 76144473 + | ENST00000334348;ENST00000448265;ENST00000419923;ENST00000443097;ENST00000257632;ENST00000394849 |
| 7% | chr7 | 76144362 | 76144473 + | ENST00000334348;ENST00000448265;ENST00000419923;ENST00000443097;ENST00000257632;ENST00000394849 |
| 7% | chr2 | 217366064 | 217366082 + | ENST00000491306;ENST00000456586 |
| 7% | chr2 | 217366064 | 217366082 + | ENST00000491306;ENST00000456586 |
| 6% | chr17 | 7214669 | 7214719 + | ENST00000336452;ENST00000336458;ENST00000576930;ENST00000572815;ENST00000573542;ENST00000419711;ENST00000571955;ENST00000573714;ENST00000416016 |
| 6% | chr17 | 7214669 | 7214719 + | ENST00000336452;ENST00000336458;ENST00000576930;ENST00000572815;ENST00000573542;ENST00000419711;ENST00000571955;ENST00000573714;ENST00000416016 |
| 6% | chr7 | 76144362 | 76144473 + | ENST00000334348;ENST00000448265;ENST00000419923;ENST00000443097;ENST00000257632;ENST00000394849 |
| 6% | chr7 | 76144362 | 76144473 + | ENST00000334348;ENST00000448265;ENST00000419923;ENST00000443097;ENST00000257632;ENST00000394849 |
| 6% | chr7 | 76144362 | 76144473 + | ENST00000334348;ENST00000448265;ENST00000419923;ENST00000443097;ENST00000257632;ENST00000394849 |
| 6% | chr7 | 76143264 | 76143393 + | ENST00000334348;ENST00000448265;ENST00000419923;ENST00000443097;ENST00000257632;ENST00000394849 |
| 6% | chr7 | 76143264 | 76143393 + | ENST00000334348;ENST00000448265;ENST00000419923;ENST00000443097;ENST00000257632;ENST00000394849 |

TABLE 43-continued

| | | | | |
|---|---|---|---|---|
| 6% | chr7 | 76143264 | 76143393 + | ENST00000334348;ENST00000448265;ENST00000419923;ENST00000443097;ENST00000257632;ENST00000394849 |
| 6% | chr20 | 29632611 | 29632721 + | ENST00000278882;ENST00000358464 |
| 6% | chr7 | 76143264 | 76143393 + | ENST00000334348;ENST00000448265;ENST00000419923;ENST00000443097;ENST00000257632;ENST00000394849 |
| 6% | chr7 | 76143264 | 76143393 + | ENST00000334348;ENST00000448265;ENST00000419923;ENST00000443097;ENST00000257632;ENST00000394849 |
| 6% | chr7 | 76143264 | 76143393 + | ENST00000334348;ENST00000448265;ENST00000419923;ENST00000443097;ENST00000257632;ENST00000394849 |
| 6% | chr1 | 183441756 | 183441784 + | ENST00000440812;ENST00000444547;ENST00000347615;ENST00000507469;ENST00000515829 |
| 6% | chr11 | 101937216; 101937273 | 101937382 + | ENST00000434758;ENST00000526781;ENST00000529204 |
| 6% | chr11 | 101937216; 101937273 | 101937382 + | ENST00000434758;ENST00000526781;ENST00000529204 |
| 6% | chr6 | 10755375 | 10755465 + | ENST00000379542;ENST00000461342;ENST00000475942;ENST00000379530;ENST00000473276;ENST00000481240;ENST00000467317;ENST00000467229 |
| 6% | chr6 | 10755375 | 10755465 + | ENST00000379542;ENST00000461342;ENST00000475942;ENST00000379530;ENST00000473276;ENST00000481240;ENST00000467317;ENST00000467229 |
| 6% | chr6 | 10755375 | 10755465 + | ENST00000379542;ENST00000461342;ENST00000475942;ENST00000379530;ENST00000473276;ENST00000481240;ENST00000467317;ENST00000467229 |
| 6% | chr6 | 10755375 | 10755465 + | ENST00000379542;ENST00000461342;ENST00000475942;ENST00000379530;ENST00000473276;ENST00000481240;ENST00000467317;ENST00000467229 |
| 6% | chr7 | 74168178 | 74168361 + | ENST00000324896;ENST00000346152;ENST00000353920;ENST00000416070 |
| 6% | chr7 | 74168178 | 74168361 + | ENST00000324896;ENST00000346152;ENST00000353920;ENST00000416070 |
| 6% | chr7 | 74168178 | 74168361 + | ENST00000324896;ENST00000346152;ENST00000353920;ENST00000416070 |
| 6% | chr7 | 74168178 | 74168361 + | ENST00000324896;ENST00000346152;ENST00000353920;ENST00000416070 |
| 6% | chr12 | 56744672 | 56744613 − | ENST00000314128;ENST00000557235;ENST00000418572 |
| 6% | chr12 | 56744672 | 56744613 − | ENST00000314128;ENST00000557235;ENST00000418572 |
| 5% | chr19 | 45349783 | 45349870 + | ENST00000252485;ENST00000252483 |
| 5% | chr3 | 185414451 | 185414400 − | ENST00000382199;ENST00000421047;ENST00000457616;ENST00000346192 |
| 5% | chr3 | 185414451 | 185414400 − | ENST00000382199;ENST00000421047;ENST00000457616;ENST00000346192 |
| 5% | chr22 | 36661197; 36661246 | 36661580 + | ENST00000397278;ENST00000422706;ENST00000426053;ENST00000319136;ENST00000347595;ENST00000397279 |
| 5% | chr22 | 36661197; 36661246 | 36661580 + | ENST00000397278;ENST00000422706;ENST00000426053;ENST00000319136;ENST00000347595;ENST00000397279 |
| 5% | chr22 | 36661197; 36661246 | 36661580 + | ENST00000397278;ENST00000422706;ENST00000426053;ENST00000319136;ENST00000347595;ENST00000397279 |
| 5% | chr22 | 36661197; 36661246 | 36661580 + | ENST00000397278;ENST00000422706;ENST00000426053;ENST00000319136;ENST00000347595;ENST00000397279 |
| 5% | chr9 | 3856184 | 3856009 − | ENST00000324333;ENST00000381971 |
| 5% | chr9 | 3856184 | 3856009 − | ENST00000324333;ENST00000381971 |
| 5% | chr1 | 1255909 | 1255836 − | ENST00000435064;ENST00000540437;ENST00000450926;ENST00000545578;ENST00000528879;ENST00000434694;ENST00000526797;ENST00000527719;ENST00000530031;ENST00000534345;ENST00000498476 |
| 5% | chr1 | 1255909 | 1255836 − | ENST00000435064;ENST00000540437;ENST00000450926;ENST00000545578;ENST00000528879;ENST00000434694;ENST00000526797;ENST00000527719;ENST00000530031;ENST00000534345;ENST00000498476 |
| 5% | chr1 | 1255909 | 1255836 − | ENST00000435064;ENST00000540437;ENST00000450926;ENST00000545578;ENST00000528879;ENST00000434694;ENST00000526797;ENST00000527719;ENST00000530031;ENST00000534345;ENST00000498476 |
| 5% | chr1 | 1255909 | 1255836 − | ENST00000435064;ENST00000540437;ENST00000450926;ENST00000545578;ENST00000528879;ENST00000434694;ENST00000526797;ENST00000527719;ENST00000530031;ENST00000534345;ENST00000498476 |
| 5% | chr1 | 1255909 | 1255836 − | ENST00000435064;ENST00000540437;ENST00000450926;ENST00000545578;ENST00000528879;ENST00000434694;ENST00000526797;ENST00000527719;ENST00000530031;ENST00000534345;ENST00000498476 |
| 5% | chr1 | 1255909 | 1255836 − | ENST00000435064;ENST00000540437;ENST00000450926;ENST00000545578;ENST00000528879;ENST00000434694;ENST00000526797;ENST00000527719;ENST00000530031;ENST00000534345;ENST00000498476 |
| 5% | chr4 | 1102192 | 1102131 − | ENST00000382968;ENST00000433731;ENST00000511620;ENST00000510715;ENST00000333673 |
| 5% | chr9 | 19378916 | 19378898 − | ENST00000380394;ENST00000380384;ENST00000315377 |
| 5% | chr9 | 19378916 | 19378898 − | ENST00000380394;ENST00000380384;ENST00000315377 |
| 5% | chr6 | 29910534 | 29910757 + | ENST00000396634;ENST00000376806;ENST00000376809;ENST00000376802 |
| 5% | chr1 | 40313763; 40313769; 40313673; 40313734 | 40313658 − | ENST00000441669;ENST00000462797;ENST00000316891;ENST00000372818;ENST00000537223;ENST00000537440;ENST00000545233 |
| 5% | chr1 | 40313763; 40313769; 40313673; 40313734 | 40313658 − | ENST00000441669;ENST00000462797;ENST00000316891;ENST00000372818;ENST00000537223;ENST00000537440;ENST00000545233 |
| 5% | chr1 | 40313763; 40313769; 40313673; 40313734 | 40313658 − | ENST00000441669;ENST00000462797;ENST00000316891;ENST00000372818;ENST00000537223;ENST00000537440;ENST00000545233 |
| 5% | chr1 | 40313763; 40313769; 40313673; | 40313658 − | ENST00000441669;ENST00000462797;ENST00000316891;ENST00000372818;ENST00000537223;ENST00000537440;ENST00000545233 |

TABLE 43-continued

| | | | | |
|---|---|---|---|---|
| | | 40313734 | | |
| 5% | chr1 | 44804994; 44804988 | 44804717 | − | ENST00000372257;ENST00000457571 |
| 5% | chr1 | 44804994; 44804988 | 44804717 | − | ENST00000372257;ENST00000457571 |
| 5% | chr1 | 20979220 | 20979114 | − | ENST00000602624;ENST00000375048;ENST00000415136 |
| 5% | chr1 | 20979220 | 20979114 | − | ENST00000602624;ENST00000375048;ENST00000415136 |
| 5% | chr1 | 20979220 | 20979114 | − | ENST00000602624;ENST00000375048;ENST00000415136 |
| 5% | chr20 | 3842901 | 3843060 | + | ENST00000416600;ENST00000428216 |
| 5% | chr20 | 3842901 | 3843060 | + | ENST00000416600;ENST00000428216 |
| 5% | chr8 | 71619168 | 71619388 | + | ENST00000408926;ENST00000520030 |
| 5% | chr17 | 7214669 | 7214719 | + | ENST00000336452;ENST00000336458;ENST00000576930;ENST00000572815;ENST00000573542;ENST00000419711;ENST00000571955;ENST00000573714;ENST00000416016 |
| 5% | chr17 | 7214669 | 7214719 | + | ENST00000336452;ENST00000336458;ENST00000576930;ENST00000572815;ENST00000573542;ENST00000419711;ENST00000571955;ENST00000573714;ENST00000416016 |
| 5% | chr19 | 45323962 | 45324053 | + | ENST00000270233 |
| 5% | chr16 | 2868684; 2868678 | 2868970 | + | ENST00000455114;ENST00000450020;ENST00000005995;ENST00000574813;ENST00000574265 |
| 5% | chr16 | 2868684; 2868678 | 2868970 | + | ENST00000455114;ENST00000450020;ENST00000005995;ENST00000574813;ENST00000574265 |
| 5% | chr16 | 2868684; 2868678 | 2868970 | + | ENST00000455114;ENST00000450020;ENST00000005995;ENST00000574813;ENST00000574265 |
| 5% | chr16 | 2868684; 2868678 | 2868970 | + | ENST00000455114;ENST00000450020;ENST00000005995;ENST00000574813;ENST00000574265 |
| 5% | chr18 | 72176075 | 72176163 | + | ENST00000324262;ENST00000580672;ENST00000579847;ENST00000583785 |
| 5% | chr18 | 72176075 | 72176163 | + | ENST00000324262;ENST00000580672;ENST00000579847;ENST00000583785 |
| 5% | chr10 | 75555297 | 75555421 | + | ENST00000604729;ENST00000603114;ENST00000604524;ENST00000398706;ENST00000605216;ENST00000433366;ENST00000492395;ENST00000603187;ENST00000412198;ENST00000604754 |
| 5% | chr10 | 75555297 | 75555421 | + | ENST00000604729;ENST00000603114;ENST00000604524;ENST00000398706;ENST00000605216;ENST00000433366;ENST00000492395;ENST00000603187;ENST00000412198;ENST00000604754 |
| 5% | chr10 | 75555297 | 75555421 | + | ENST00000604729;ENST00000603114;ENST00000604524;ENST00000398706;ENST00000605216;ENST00000433366;ENST00000492395;ENST00000603187;ENST00000412198;ENST00000604754 |
| 5% | chr10 | 75555297 | 75555421 | + | ENST00000604729;ENST00000603114;ENST00000604524;ENST00000398706;ENST00000605216;ENST00000433366;ENST00000492395;ENST00000603187;ENST00000412198;ENST00000604754 |
| 5% | chr10 | 75555297 | 75555421 | + | ENST00000604729;ENST00000603114;ENST00000604524;ENST00000398706;ENST00000605216;ENST00000433366;ENST00000492395;ENST00000603187;ENST00000412198;ENST00000604754 |
| 5% | chr10 | 75555297 | 75555421 | + | ENST00000604729;ENST00000603114;ENST00000604524;ENST00000398706;ENST00000605216;ENST00000433366;ENST00000492395;ENST00000603187;ENST00000412198;ENST00000604754 |
| 5% | chr10 | 75555297 | 75555421 | + | ENST00000604729;ENST00000603114;ENST00000604524;ENST00000398706;ENST00000605216;ENST00000433366;ENST00000492395;ENST00000603187;ENST00000412198;ENST00000604754 |
| 5% | chr10 | 75555297 | 75555421 | + | ENST00000604729;ENST00000603114;ENST00000604524;ENST00000398706;ENST00000605216;ENST00000433366;ENST00000492395;ENST00000603187;ENST00000412198;ENST00000604754 |
| 5% | chr1 | 33138392 | 33138502 | + | ENST00000414241;ENST00000373493;ENST00000544435;ENST00000373485;ENST00000458695;ENST00000475321;ENST00000463378;ENST00000460669;ENST00000481 2190 |
| 5% | chr1 | 33138392 | 33138502 | + | ENST00000414241;ENST00000373493;ENST00000544435;ENST00000373485;ENST00000458695;ENST00000475321;ENST00000463378;ENST00000460669;ENST00000481 2190 |
| 5% | chr1 | 33138392 | 33138502 | + | ENST00000414241;ENST00000373493;ENST00000544435;ENST00000373485;ENST00000458695;ENST00000475321;ENST00000463378;ENST00000460669;ENST00000481 2190 |
| 5% | chr1 | 33138392 | 33138502 | + | ENST00000414241;ENST00000373493;ENST00000544435;ENST00000373485;ENST00000458695;ENST00000475321;ENST00000463378;ENST00000460669;ENST00000481 2190 |
| 5% | chr1 | 33138392 | 33138502 | + | ENST00000414241;ENST00000373493;ENST00000544435;ENST00000373485;ENST00000458695;ENST00000475321;ENST00000463378;ENST00000460669;ENST00000481 2190 |
| 5% | chr1 | 33138392 | 33138502 | + | ENST00000414241;ENST00000373493;ENST00000544435;ENST00000373485;ENST00000458695;ENST00000475321;ENST00000463378;ENST00000460669;ENST00000481 2190 |
| 5% | chr1 | 33138392 | 33138502 | + | ENST00000414241;ENST00000373493;ENST00000544435;ENST00000373485;ENST00000458695;ENST00000475321;ENST00000463378;ENST00000460669;ENST00000481 2190 |
| 5% | chr1 | 33138392 | 33138502 | + | ENST00000414241;ENST00000373493;ENST00000544435;ENST00000373485;ENST00000458695;ENST00000475321;ENST00000463378;ENST00000460669;ENST00000481 2190 |
| 5% | chr19 | 53352466; 53352373 | 53352340 | − | ENST00000595646;ENST00000243639;ENST00000597924;ENST00000601847 |
| 5% | chr19 | 53352466; 53352373 | 53352340 | − | ENST00000595646;ENST00000243639;ENST00000597924;ENST00000601847 |

TABLE 43-continued

| | | | | |
|---|---|---|---|---|
| 5% | chr4 | 289322 | 299227 − | ENST00000419098 |
| 4% | chr14 | 93813615 | 938134740 + | ENST00000342144 |
| 4% | chr3 | 50153339 | 50153413 + | ENST00000347869 |
| 4% | chr3 | 137906397;<br>137906427 | 137906441 + | ENST00000469044;ENST00000461600;ENST00000461822;ENST00000470821;ENST00000471709;ENST00000393058;ENST00000538260;ENST00000463485 |
| 4% | chr3 | 137906397;<br>137906427 | 137906441 + | ENST00000469044;ENST00000461600;ENST00000461822;ENST00000470821;ENST00000471709;ENST00000393058;ENST00000538260;ENST00000463485 |
| 4% | chr19 | 17387632;<br>17387623 | 17387718 + | ENST00000598188;ENST00000359435;ENST00000596542;ENST00000447614;ENST00000601043;ENST00000595632;ENST00000601232 |
| 4% | chr19 | 17387632;<br>17387623 | 17387718 + | ENST00000598188;ENST00000359435;ENST00000596542;ENST00000447614;ENST00000601043;ENST00000595632;ENST00000601232 |
| 4% | chr19 | 17387632;<br>17387623 | 17387718 + | ENST00000598188;ENST00000359435;ENST00000596542;ENST00000447614;ENST00000601043;ENST00000595632;ENST00000601232 |
| 4% | chr19 | 17387632;<br>17387623 | 17387718 + | ENST00000598188;ENST00000359435;ENST00000596542;ENST00000447614;ENST00000601043;ENST00000595632;ENST00000601232 |
| 4% | chr19 | 17387632;<br>17387623 | 17387718 + | ENST00000598188;ENST00000359435;ENST00000596542;ENST00000447614;ENST00000601043;ENST00000595632;ENST00000601232 |
| 4% | chr19 | 45323962 | 45324032 + | ENST00000270233 |
| 4% | chr15 | 89456550 | 89456478 − | ENST00000558018;ENST00000268151;ENST00000268150;ENST00000566497;ENST00000542878;ENST00000558029 |
| 4% | chr9 | 5164265 | 5164179 − | ENST00000381641 |
| 4% | chr11 | 64088133 | 64808189 + | ENST00000265462 |
| 4% | chr19 | 18685867;<br>18685680;<br>18685913 | 18685937 + | ENST00000596304;ENST00000430157;ENST00000596273;ENST00000442744;ENST00000595683;ENST00000595158;ENST00000598780;ENST00000599551;ENST00000597451;ENST00000599595;ENST00000596272;ENST00000594527 |
| 4% | chr19 | 18685867;<br>18685680;<br>18685913 | 18685937 + | ENST00000596304;ENST00000430157;ENST00000596273;ENST00000442744;ENST00000595683;ENST00000595158;ENST00000598780;ENST00000599551;ENST00000597451;ENST00000599595;ENST00000596272;ENST00000594527 |
| 4% | chr19 | 18685867;<br>18685680;<br>18685913 | 18685937 + | ENST00000596304;ENST00000430157;ENST00000596273;ENST00000442744;ENST00000595683;ENST00000595158;ENST00000598780;ENST00000599551;ENST00000597451;ENST00000599595;ENST00000596272;ENST00000594527 |
| 4% | chr12 | 21445270 | 21445098 − | ENST00000307378;ENST00000452078;ENST00000458504;ENST00000537524;ENST00000390670 |
| 4% | chr12 | 21445270 | 21445098 − | ENST00000307378;ENST00000452078;ENST00000458504;ENST00000537524;ENST00000390670 |
| 4% | chr12 | 21445270 | 21445098 − | ENST00000307378;ENST00000452078;ENST00000458504;ENST00000537524;ENST00000390670 |
| 4% | chr7 | 116593595 | 116593745 + | ENST00000393446;ENST00000265437;ENST00000393451;ENST00000438863;ENST00000323984;ENST00000393449;ENST00000443979;ENST00000446490 |
| 4% | chr2 | 217364672 | 217364754 + | ENST00000491306;ENST00000600880;ENST00000446558;ENST00000456586;ENST00000598925;ENST00000427280;ENST00000441179 |
| 4% | chr2 | 217364672 | 217364754 + | ENST00000491306;ENST00000600880;ENST00000446558;ENST00000456586;ENST00000598925;ENST00000427280;ENST00000441179 |
| 4% | chr15 | 82726234 | 82726553 + | ENST00000300515 |
| 4% | chr19 | 39888097;<br>39888167 | 39888183 + | ENST00000315588;ENST00000594368;ENST00000599213;ENST00000596297 |
| 4% | chr19 | 39888097;<br>39888167 | 39888183 + | ENST00000315588;ENST00000594368;ENST00000599213;ENST00000596297 |
| 4% | chr19 | 39888097;<br>39888167 | 39888183 + | ENST00000315588;ENST00000594368;ENST00000599213;ENST00000596297 |
| 4% | chr19 | 39888097;<br>39888167 | 39888183 + | ENST00000315588;ENST00000594368;ENST00000599213;ENST00000596297 |
| 4% | chr1 | 54389620 | 54389577 − | ENST00000371378;ENST00000194214;ENST00000371377 |
| 4% | chr1 | 156721221 | 156721135 − | ENST00000357325;ENST00000537739 |
| 4% | chr19 | 58386594 | 58386524 − | ENST00000597348;ENST00000435989 |
| 4% | chr1 | 153701111 | 153701260 + | ENST00000318967;ENST00000435409 |
| 3% | chr19 | 45315735 | 45315805 + | ENST00000589651;ENST00000270233;ENST00000591520 |
| 3% | chr19 | 45315735 | 45315805 + | ENST00000589651;ENST00000270233;ENST00000591520 |
| 3% | chr5 | 23976106 | 23976159 + | ENST00000512559;ENST00000507936 |
| 3% | chr1 | 32696528 | 32696620 + | ENST00000373586 |
| 3% | chr12 | 52639196 | 52639416 + | ENST00000331817 |
| 3% | chr7 | 81964567 | 81964451 − | ENST00000356860;ENST00000356253;ENST00000423588 |
| 3% | chr7 | 75617128 | 75617036 − | ENST00000493111 |
| 3% | chr9 | 130213596 | 130213560 − | ENST00000361436;ENST00000536368 |
| 3% | chr1 | 32560385 | 32560572 + | ENST00000336294;ENST00000373634;ENST00000427288 |
| 3% | chr1 | 32560385 | 32560572 + | ENST00000336294;ENST00000373634;ENST00000427288 |
| 3% | chr1 | 32560385 | 32560572 + | ENST00000336294;ENST00000373634;ENST00000427288 |
| 3% | chr20 | 45644820;<br>45644887 | 45644936 + | ENST00000327619;ENST00000357410;ENST00000497062;ENST00000317304;ENST00000458636 |
| 3% | chr20 | 45644820;<br>45644887 | 45644936 + | ENST00000327619;ENST00000357410;ENST00000497062;ENST00000317304;ENST00000458636 |
| 3% | chr20 | 45644820;<br>45644887 | 45644936 + | ENST00000327619;ENST00000357410;ENST00000497062;ENST00000317304;ENST00000458636 |
| 3% | chr1 | 25891664 | 25891698 + | ENST00000374338 |
| 3% | chr4 | 17623210 | 17623322 + | ENST00000237380;ENST00000503945 |
| 3% | chr4 | 17623210 | 17623322 + | ENST00000237380;ENST00000503945 |
| 3% | chr19 | 17556093 | 17556008 − | ENST00000341130;ENST00000594663 |
| 3% | chr19 | 17556093 | 17556008 − | ENST00000341130;ENST00000594663 |
| 3% | chrX | 151996474 | 151996436 − | ENST00000370277 |
| 3% | chr19 | 11553201 | 11553248 + | ENST00000591462;ENST00000252455;ENST00000412601;ENST00000592741;ENST0 |

TABLE 43-continued

| | | | | |
|---|---|---|---|---|
| | | | | 0000587327;ENST00000589838 |
| 3% | chr8 | 144102731 | 144102850 + | ENST00000292494;ENST00000429120;ENST00000521699;ENST00000520531;ENST00000520466;ENST00000521003;ENST00000522971;ENST00000519611;ENST00000519546;ENST00000523847;ENST00000522024 |
| 3% | chr12 | 15087927 | 15087790 − | ENST00000266397 |
| 3% | chr20 | 36768056 | 36767968 − | ENST00000361475;ENST00000536701;ENST00000536724 |
| 3% | chr20 | 36768056 | 36767968 − | ENST00000361475;ENST00000536701;ENST00000536724 |
| 3% | chr20 | 36768056 | 36767968 − | ENST00000361475;ENST00000536701;ENST00000536724 |
| 3% | chr1 | 6531697 | 6531548 − | ENST00000400913;ENST00000340850;ENST00000377748;ENST00000377725;ENST00000377728;ENST00000377732;ENST00000400915;ENST00000377740;ENST00000535355;ENST00000377737;ENST00000537245;ENST00000544978 |
| 3% | chr1 | 6531697 | 6531548 − | ENST00000400913;ENST00000340850;ENST00000377748;ENST00000377725;ENST00000377728;ENST00000377732;ENST00000400915;ENST00000377740;ENST00000535355;ENST00000377737;ENST00000537245;ENST00000544978 |
| 3% | chr1 | 6531697 | 6531548 − | ENST00000400913;ENST00000340850;ENST00000377748;ENST00000377725;ENST00000377728;ENST00000377732;ENST00000400915;ENST00000377740;ENST00000535355;ENST00000377737;ENST00000537245;ENST00000544978 |
| 3% | chr1 | 6531697 | 6531548 − | ENST00000400913;ENST00000340850;ENST00000377748;ENST00000377725;ENST00000377728;ENST00000377732;ENST00000400915;ENST00000377740;ENST00000535355;ENST00000377737;ENST00000537245;ENST00000544978 |
| 3% | chr1 | 6531697 | 6531548 − | ENST00000400913;ENST00000340850;ENST00000377748;ENST00000377725;ENST00000377728;ENST00000377732;ENST00000400915;ENST00000377740;ENST00000535355;ENST00000377737;ENST00000537245;ENST00000544978 |
| 3% | chr1 | 6531697 | 6531548 − | ENST00000400913;ENST00000340850;ENST00000377748;ENST00000377725;ENST00000377728;ENST00000377732;ENST00000400915;ENST00000377740;ENST00000535355;ENST00000377737;ENST00000537245;ENST00000544978 |
| 3% | chr8 | 27461912 | 27461808 | ENST00000316403;ENST00000546343;ENST00000560366;ENST00000405140;ENST00000523500;ENST00000522098 |
| 3% | chr8 | 27461912 | 27461808 | ENST00000316403;ENST00000546343;ENST00000560366;ENST00000405140;ENST00000523500;ENST00000522098 |
| 3% | chr8 | 27461912 | 27461808 | ENST00000316403;ENST00000546343;ENST00000560366;ENST00000405140;ENST00000523500;ENST00000522098 |
| 3% | chr8 | 27461912 | 27461808 | ENST00000316403;ENST00000546343;ENST00000560366;ENST00000405140;ENST00000523500;ENST00000522098 |
| 3% | chr7 | 91771800 | 91771777 − | ENST00000435873 |
| 3% | chr3 | 419501 | 419625 + | ENST00000256509;ENST00000397491 |
| 3% | chr3 | 419501 | 419625 + | ENST00000256509;ENST00000397491 |
| 3% | chr10 | 128594087 | 128594132 + | ENST00000280333 |
| 3% | chr20 | 45725724 | 45725807 + | ENST00000327619;ENST00000357410;ENST00000317304;ENST00000458636 |
| 3% | chr20 | 45725724 | 45725807 + | ENST00000327619;ENST00000357410;ENST00000317304;ENST00000458636 |
| 3% | chr19 | 45323962 | 453240553 + | ENST00000270233 |
| 3% | chr19 | 45322603 | 45322747 + | ENST00000589651;ENST00000270233 |
| 3% | chrX | 1505652 | 1505528 − | ENST00000381401 |
| 3% | chr7 | 135635430 | 135635347 − | ENST00000393085 |
| 3% | chr19 | 58427779 | 58427747 − | ENST00000312026;ENST00000595559 |
| 3% | chr7 | 74867341 | 74867229 − | ENST00000426327 |
| 3% | chr5 | 149782875 | 149782749 − | ENST00000518797;ENST00000009530 |
| 3% | chr5 | 149782875 | 149782749 − | ENST00000518797;ENST00000009530 |
| 2% | chr10 | 114207132 | 114207225 + | ENST00000432306;ENST00000393077 |
| 2% | chr11 | 76834734 | 76834775 + | ENST00000278559;ENST00000529629;ENST00000456580 |
| 2% | chr11 | 76834734 | 76834775 + | ENST00000278559;ENST00000529629;ENST00000456580 |
| 2% | chr14 | 75904624; 75904601 | 75904758 + | ENST00000419727;ENST00000559060;ENST00000437176;ENST00000435893;ENST00000267569 |
| 2% | chr14 | 75904624; 75904601 | 75904758 + | ENST00000419727;ENST00000559060;ENST00000437176;ENST00000435893;ENST00000267569 |
| 2% | chr7 | 150065992 | 150066030 + | ENST00000466559;ENST00000475514;ENST00000488943;ENST00000467980;ENST00000518514;ENST00000522266 |
| 2% | chr9 | 5689959 | 5690038 + | ENST00000251879;ENST00000414202;ENST00000381532;ENST00000418622;ENST00000449720;ENST00000545641 |
| 2% | chr9 | 5689959 | 5690038 + | ENST00000251879;ENST00000414202;ENST00000381532;ENST00000418622;ENST00000449720;ENST00000545641 |
| 2% | chr9 | 5689959 | 5690038 + | ENST00000251879;ENST00000414202;ENST00000381532;ENST00000418622;ENST00000449720;ENST00000545641 |
| 2% | chr19 | 45322839 | 45322864 + | ENST00000589651;ENST00000270233 |
| 2% | chr17 | 7214669 | 7214719 + | ENST00000336452;ENST00000336458;ENST00000576930;ENST00000572815;ENST00000573542;ENST00000419711;ENST00000571955;ENST00000573714;ENST00000416016 |
| 2% | chr17 | 7214669 | 7214719 + | ENST00000336452;ENST00000336458;ENST00000576930;ENST00000572815;ENST00000573542;ENST00000419711;ENST00000571955;ENST00000573714;ENST00000416016 |
| 2% | chr7 | 91509397 | 91509369 − | ENST00000351870;ENST00000442961 |
| 2% | chr17 | 80404572 | 80404499 − | ENST00000306645;ENST00000437807;ENST00000434650;ENST00000583617;ENST00000577436;ENST00000585064;ENST00000577732;ENST00000578919;ENST000005817 5080;ENST00000577888;ENST00000578913;ENST00000584408;ENST00000577696;ENST00000577471;ENST00000577834;ENST00000582545 |
| 2% | chr17 | 80404572 | 80404499 − | ENST00000306645;ENST00000437807;ENST00000434650;ENST00000583617;ENST00000577436;ENST00000585064;ENST00000577732;ENST00000578919;ENST000005817 5080;ENST00000577888;ENST00000578913;ENST00000584408;ENST00000577696;E |

TABLE 43-continued

| | | | | |
|---|---|---|---|---|
| 2% | chr17 | 80404572 | 80404499 − | NST00000577471;ENST00000577834;ENST00000582545 ENST00000306645;ENST00000437807;ENST00000434650;ENST00000583617;ENST00000577436;ENST00000585064;ENST00000577732;ENST00000578919; ENST000005817 5080;ENST00000577888;ENST00000578913;ENST00000584408;ENST00000577696;ENST00000577471;ENST00000577834;ENST00000582545 |
| 2% | chr4 | 25759228 | 25759156 − | ENST00000399878;ENST00000264868;ENST00000502949;ENST00000510448 |
| 2% | chr4 | 25759228 | 25759156 − | ENST00000399878;ENST00000264868;ENST00000502949;ENST00000510448 |
| 2% | chr4 | 25759228 | 25759156 − | ENST00000399878;ENST00000264868;ENST00000502949;ENST00000510448 |
| 2% | chr6 | 30459314 | 30459396 + | ENST00000376630 |
| 2% | chr4 | 107237705 | 107237751 + | ENST00000394701 |
| 2% | chr1 | 230203028 | 230203153 + | ENST00000366672 |
| 2% | chr8 | 117950483 | 117950806 + | ENST00000378279 |
| 2% | chr1 | 70820635 | 70820794 + | ENST00000359875;ENST00000370940;ENST00000531950;ENST00000432224 |
| 2% | chr5 | 70858101 | 70858347 + | ENST00000358731;ENST00000525844 |
| 2% | chr5 | 70858101 | 70858347 + | ENST00000358731;ENST00000525844 |
| 2% | chr19 | 2151333 | 2151238 − | ENST00000355272;ENST00000356926;ENST00000350812;ENST00000345016 |
| 2% | chr1 | 63955889 | 63955754 − | ENST00000371092;ENST00000271002;ENST00000489099;ENST00000283568 |
| 2% | chr1 | 63955889 | 63955754 − | ENST00000371092;ENST00000271002;ENST00000489099;ENST00000283568 |
| 2% | chr5 | 10748383 | 10748287 − | ENST00000230895;ENST00000432074 |
| 2% | chr6 | 110567463 | 110567335 − | ENST00000338882 |
| 2% | chr1 | 1255909 | 1255836 − | ENST00000435064;ENST00000540437;ENST00000450926;ENST00000545578;ENST00000528879;ENST00000434694;ENST00000526797;ENST00000527719;ENST00000530031;ENST00000534345;ENST00000498476 |
| 2% | chr1 | 1255909 | 1255836 − | ENST00000435064;ENST00000540437;ENST00000450926;ENST00000545578;ENST00000528879;ENST00000434694;ENST00000526797;ENST00000527719;ENST00000530031;ENST00000534345;ENST00000498476 |
| 2% | chr1 | 1255909 | 1255836 − | ENST00000435064;ENST00000540437;ENST00000450926;ENST00000545578;ENST00000528879;ENST00000434694;ENST00000526797;ENST00000527719;ENST00000530031;ENST00000534345;ENST00000498476 |
| 2% | chr1 | 1255909 | 1255836 − | ENST00000435064;ENST00000540437;ENST00000450926;ENST00000545578;ENST00000528879;ENST00000434694;ENST00000526797;ENST00000527719;ENST00000530031;ENST00000534345;ENST00000498476 |
| 2% | chr1 | 1255909 | 1255836 − | ENST00000435064;ENST00000540437;ENST00000450926;ENST00000545578;ENST00000528879;ENST00000434694;ENST00000526797;ENST00000527719;ENST00000530031;ENST00000534345;ENST00000498476 |
| 2% | chr1 | 1255909 | 1255836 − | ENST00000435064;ENST00000540437;ENST00000450926;ENST00000545578;ENST00000528879;ENST00000434694;ENST00000526797;ENST00000527719;ENST00000530031;ENST00000534345;ENST00000498476 |
| 2% | chr6 | 51609340 | 51609183 − | ENST00000371117;ENST00000340994 |
| 2% | chr11 | 118888255 | 118888078 − | ENST00000527673 |
| 2% | chr8 | 109240620 | 109240496 − | ENST00000522352;ENST00000220849;ENST00000519030;ENST00000519627 |
| 2% | chr8 | 109240620 | 109240496 − | ENST00000522352;ENST00000220849;ENST00000519030;ENST00000519627 |
| 2% | chr8 | 109240620 | 109240496 − | ENST00000522352;ENST00000220849;ENST00000519030;ENST00000519627 |
| 2% | chr8 | 109240620 | 109240496 − | ENST00000522352;ENST00000220849;ENST00000519030;ENST00000519627 |
| 2% | chr17 | 27244467 | 27244303 − | ENST00000332830;ENST00000577226;ENST00000378879;ENST00000268756 |
| 2% | chr20 | 48184653 | 48184580 − | ENST00000244043 |
| 2% | chr8 | 11704677 | 11704561 − | ENST00000434271;ENST00000353047;ENST00000530640;ENST00000531089;ENST00000453527;ENST00000345125;ENST00000533455;ENST00000534510 |
| 2% | chr10 | 71990155 | 71990097 − | ENST00000373232;ENST00000373230;ENST00000608321 |
| 2% | chr9 | 7799734 | 7799461 − | ENST00000358227 |
| 2% | chr19 | 35505093 | 35505291 + | ENST00000599564;ENST00000317991;ENST00000504615;ENST00000411896 |
| 2% | chr19 | 35505093 | 35505291 + | ENST00000599564;ENST00000317991;ENST00000504615;ENST00000411896 |
| 2% | chr19 | 35505093 | 35505291 + | ENST00000599564;ENST00000317991;ENST00000504615;ENST00000411896 |
| 2% | chr19 | 35505093 | 35505291 + | ENST00000599564;ENST00000317991;ENST00000504615;ENST00000411896 |
| 2% | chr6 | 10759172 | 10759294 + | ENST00000481240;ENST00000467317 |
| 2% | chr6 | 10759172 | 10759294 + | ENST00000481240;ENST00000467317 |
| 2% | chr19 | 45322839 | 45322983 + | ENST00000589651;ENST00000270233 |
| 2% | chr2 | 219204752 | 219204864 + | ENST00000273077;ENST00000258362;ENST00000436005 |
| 2% | chr2 | 219204752 | 219204864 + | ENST00000273077;ENST00000258362;ENST00000436005 |
| 2% | chr2 | 219204752 | 219204864 + | ENST00000273077;ENST00000258362;ENST00000436005 |
| 2% | chr12 | 56503641 | 56503719 + | ENST00000303305;ENST00000552766 |
| 2% | chr22 | 47071365 | 47071449 + | ENST00000406902;ENST00000361034;ENST00000408031 |
| 2% | chr22 | 47071365 | 47071449 + | ENST00000406902;ENST00000361034;ENST00000408031 |
| 2% | chr3 | 32280465 | 32280611 + | ENST00000458535;ENST00000307526 |
| 2% | chr15 | 74219125 | 74220226 + | ENST00000566011;ENST00000261921 |
| 2% | chr6 | 30458914 | 30459146 + | ENST00000376630 |
| 2% | chr6 | 30458914 | 30459146 + | ENST00000376630 |
| 2% | chr16 | 2811562; 2817723 | 2818262 + | ENST00000301740;ENST00000572883 |
| 2% | chr16 | 2811562; 2817723 | 2818262 + | ENST00000301740;ENST00000572883 |
| 2% | chr11 | 113857547; 113857240 | 113857768 + | ENST00000504030;ENST00000355556;ENST00000375498;ENST00000506841;ENST00000535865;ENST00000299961 |
| 2% | chr11 | 113857547; 113857240 | 113857768 + | ENST00000504030;ENST00000355556;ENST00000375498;ENST00000506841;ENST00000535865;ENST00000299961 |
| 2% | chr11 | 113857547; 113857240 | 113857768 + | ENST00000504030;ENST00000355556;ENST00000375498;ENST00000506841;ENST00000535865;ENST00000299961 |
| 2% | chr11 | 113857547; | 113857768 + | ENST00000504030;ENST00000355556;ENST00000375498;ENST00000506841;ENST0 |

TABLE 43-continued

| | | | | |
|---|---|---|---|---|
| 2% | | 113857240 | | 0000535865;ENST00000299961 |
| 2% | chr11 | 113857547; 113857240 | 113857768 + | ENST00000504030;ENST00000355556;ENST00000375498;ENST00000506841;ENST0 0000535865;ENST00000299961 |
| 2% | chr11 | 113857547; 113857240 | 113857768 + | ENST00000504030;ENST00000355556;ENST00000375498;ENST00000506841;ENST0 0000535865;ENST00000299961 |
| 2% | chrX | 153284238; 153284089 | 153284050 − | ENST00000369980;ENST00000369974;ENST00000393682;ENST00000369973;ENST0 0000393687;ENST00000429936;ENST00000443220 |
| 2% | chrX | 153284238; 153284089 | 153284050 − | ENST00000369980;ENST00000369974;ENST00000393682;ENST00000369973;ENST0 0000393687;ENST00000429936;ENST00000443220 |
| 2% | chrX | 153284238; 153284089 | 153284050 − | ENST00000369980;ENST00000369974;ENST00000393682;ENST00000369973;ENST0 0000393687;ENST00000429936;ENST00000443220 |
| 2% | chr1 | 117712793 | 117712729 − | ENST00000359008;ENST00000328189;ENST00000369458 |
| 2% | chr1 | 117712793 | 117712729 − | ENST00000359008;ENST00000328189;ENST00000369458 |
| 2% | chr1 | 55341720 | 55341615 − | ENST00000371269;ENST00000535035 |
| 2% | chr1 | 55341720 | 55341615 − | ENST00000371269;ENST00000535035 |
| 2% | chr17 | 74622000 | 74621901 − | ENST00000156626 |
| 2% | chr1 | 55331119 | 55330976 − | ENST00000371269;ENST00000535035 |
| 2% | chr1 | 55331119 | 55330976 − | ENST00000371269;ENST00000535035 |
| 2% | chr19 | 58423461; 58423535; 58423557; 58423554 | 58423428 − | ENST00000602124;ENST00000594396;ENST00000312026;ENST00000595559;ENST0 0000597515;ENST00000598526;ENST00000598629;ENST00000599251 |
| 2% | chr19 | 58423461; 58423535; 58423557; 58423554 | 58423428 − | ENST00000602124;ENST00000594396;ENST00000312026;ENST00000595559;ENST0 0000597515;ENST00000598526;ENST00000598629;ENST00000599251 |
| 2% | chr19 | 58423461; 58423535; 58423557; 58423554 | 58423428 − | ENST00000602124;ENST00000594396;ENST00000312026;ENST00000595559;ENST0 0000597515;ENST00000598526;ENST00000598629;ENST00000599251 |
| 2% | chr19 | 58423461; 58423535; 58423557; 58423554 | 58423428 − | ENST00000602124;ENST00000594396;ENST00000312026;ENST00000595559;ENST0 0000597515;ENST00000598526;ENST00000598629;ENST00000599251 |
| 2% | chr19 | 40328483 | 40328341 − | ENST00000595545;ENST00000221801;ENST00000597224;ENST00000601274;ENST0 0000597634 |
| 2% | chr19 | 40328483 | 40328341 − | ENST00000595545;ENST00000221801;ENST00000597224;ENST00000601274;ENST0 0000597634 |
| 2% | chr19 | 40328483 | 40328341 − | ENST00000595545;ENST00000221801;ENST00000597224;ENST00000601274;ENST0 0000597634 |
| 2% | chr19 | 40328483 | 40328341 − | ENST00000595545;ENST00000221801;ENST00000597224;ENST00000601274;ENST0 0000597634 |
| 2% | chr19 | 40328483 | 40328341 − | ENST00000595545;ENST00000221801;ENST00000597224;ENST00000601274;ENST0 0000597634 |
| 2% | chr8 | 120220779 | 120220844 + | ENST00000276681 |
| 2% | chr19 | 45317409 | 45317445 + | ENST00000589651;ENST00000270233;ENST00000591520 |
| 2% | chr19 | 45317409 | 45317445 + | ENST00000589651;ENST00000270233;ENST00000591520 |
| 2% | chr9 | 80932592 | 80932720 + | ENST00000347159;ENST00000376588 |
| 2% | chr11 | 64087206 | 64087232 + | ENST00000265462;ENST00000352435 |
| 2% | chr10 | 116020945 | 116021054 + | ENST00000603594;ENST00000392982 |
| 2% | chr5 | 175723254 | 175723323 + | ENST00000341199;ENST00000430704;ENST00000443967;ENST00000429602 |
| 2% | chr5 | 175723254 | 175723323 + | ENST00000341199;ENST00000430704;ENST00000443967;ENST00000429602 |
| 2% | chr5 | 175723254 | 175723323 + | ENST00000341199;ENST00000430704;ENST00000443967;ENST00000429602 |
| 2% | chr19 | 45322603 | 45322630 + | ENST00000589651;ENST00000270233 |
| 2% | chr15 | 81436003 | 81436161 + | ENST00000286732 |
| 2% | chr11 | 73075497 | 73075645 + | ENST00000263674 |
| 2% | chr19 | 16381600 | 19381719 + | ENST00000399336;ENST00000263012;ENST00000538468 |
| 2% | chr16 | 16381600 | 16381719 + | ENST00000399336;ENST00000263012;ENST00000538468 |
| 2% | chr12 | 113403549; 113403702 | 113403834 + | ENST00000228928;ENST00000546973 |
| 2% | chr12 | 113403549; 113403702 | 113403834 + | ENST00000228928;ENST00000546973 |
| 2% | chr12 | 53691634 | 53691705 + | ENST00000551018;ENST00000351500;ENST00000334478;ENST00000549759 |
| 2% | chr12 | 53691634 | 53691705 + | ENST00000551018;ENST00000351500;ENST00000334478;ENST00000549759 |
| 2% | chr12 | 53691634 | 53691705 + | ENST00000551018;ENST00000351500;ENST00000334478;ENST00000549759 |
| 2% | chr14 | 75904624; 75904601 | 75904716 + | ENST00000419727;ENST00000559060;ENST00000437176;ENST00000435893;ENST0 0000267569 |
| 2% | chr14 | 75904624; 75904601 | 75904716 + | ENST00000419727;ENST00000559060;ENST00000437176;ENST00000435893;ENST0 0000267569 |
| 2% | chr9 | 5689959 | 5690038 + | ENST00000251879;ENST00000414202;ENST00000381532;ENST00000418622;ENST0 0000449720;ENST00000545641 |
| 2% | chr9 | 5689959 | 5690038 + | ENST00000251879;ENST00000414202;ENST00000381532;ENST00000418622;ENST0 0000449720;ENST00000545641 |
| 2% | chr9 | 5689959 | 5690038 + | ENST00000251879;ENST00000414202;ENST00000381532;ENST00000418622;ENST0 0000449720;ENST00000545641 |
| 2% | chr9 | 100774703 | 100774754 + | ENST00000339399 |
| 2% | chr4 | 56230241 | 56230438 + | ENST00000264228 |
| 2% | chr11 | 16769644 | 16769704 + | ENST00000228136;ENST00000524439;ENST00000422258;ENST00000528634 |
| 2% | chr11 | 16769644 | 16769704 + | ENST00000228136;ENST00000524439;ENST00000422258;ENST00000528634 |
| 2% | chr11 | 16769644 | 16769704 + | ENST00000228136;ENST00000524439;ENST00000422258;ENST00000528634 |

TABLE 43-continued

| | | | | |
|---|---|---|---|---|
| 2% | chr16 | 1735440; 1735444; 1735501 | 1735588 + | ENST00000248098;ENST00000562684;ENST00000561516;ENST00000382711;ENST00000566742;ENST00000569765;ENST00000566691;ENST00000382710;ENST00000565851;ENST00000562569 |
| 2% | chr16 | 1735440; 1735444; 1735501 | 1735588 + | ENST00000248098;ENST00000562684;ENST00000561516;ENST00000382711;ENST00000566742;ENST00000569765;ENST00000566691;ENST00000382710;ENST00000565851;ENST00000562569 |
| 2% | chr16 | 1735440; 1735444; 1735501 | 1735588 + | ENST00000248098;ENST00000562684;ENST00000561516;ENST00000382711;ENST00000566742;ENST00000569765;ENST00000566691;ENST00000382710;ENST00000565851;ENST00000562569 |
| 2% | chr16 | 1735440; 1735444; 1735501 | 1735588 + | ENST00000248098;ENST00000562684;ENST00000561516;ENST00000382711;ENST00000566742;ENST00000569765;ENST00000566691;ENST00000382710;ENST00000565851;ENST00000562569 |
| 2% | chr16 | 1735440; 1735444; 1735501 | 1735588 + | ENST00000248098;ENST00000562684;ENST00000561516;ENST00000382711;ENST00000566742;ENST00000569765;ENST00000566691;ENST00000382710;ENST00000565851;ENST00000562569 |
| 2% | chr2 | 160176929 | 160176785 − | ENST00000343439;ENST00000355831;ENST00000392782;ENST00000392783 |
| 2% | chr2 | 160176929 | 160176785 − | ENST00000343439;ENST00000355831;ENST00000392782;ENST00000392783 |
| 2% | chr2 | 160176929 | 160176785 − | ENST00000343439;ENST00000355831;ENST00000392782;ENST00000392783 |
| 2% | chr2 | 160176929 | 160176785 − | ENST00000343439;ENST00000355831;ENST00000392782;ENST00000392783 |
| 2% | chr22 | 39711560 | 39711495 − | ENST00000401609;ENST00000216146;ENST00000402527;ENST00000453303;ENST00000427905 |
| 2% | chr22 | 39711560 | 39711495 − | ENST00000401609;ENST00000216146;ENST00000402527;ENST00000453303;ENST00000427905 |
| 2% | chr22 | 39711560 | 39711495 − | ENST00000401609;ENST00000216146;ENST00000402527;ENST00000453303;ENST00000427905 |
| 2% | chr22 | 39711560 | 39711495 − | ENST00000401609;ENST00000216146;ENST00000402527;ENST00000453303;ENST00000427905 |
| 2% | chr12 | 21427520 | 21427403 − | ENST00000307378;ENST00000452078;ENST00000458504;ENST00000537524 |
| 2% | chr12 | 21427520 | 21427403 − | ENST00000307378;ENST00000452078;ENST00000458504;ENST00000537524 |
| 2% | chr1 | 55352792 | 55352562 − | ENST00000371269 |
| 2% | chr16 | 2835172 | 2835003 − | ENST00000293851;ENST00000570702;ENST00000571674 |
| 2% | chr16 | 2835172 | 2835003 − | ENST00000293851;ENST00000570702;ENST00000571674 |
| 2% | chr11 | 77784187; 77784118 | 77784044 − | ENST00000530054;ENST00000281031;ENST00000525085;ENST00000528164 |
| 2% | chr11 | 77784187; 77784118 | 77784044 − | ENST00000530054;ENST00000281031;ENST00000525085;ENST00000528164 |
| 2% | chr14 | 106235896 | 106235574 − | ENST00000390551 |
| 2% | chr6 | 75953546; 75953450; 75953503 | 75953433 − | ENST00000370081;ENST00000230459;ENST00000370089;ENST00000459637;ENST00000509698;ENST00000460985;ENST00000472311;ENST00000377978 |
| 2% | chr6 | 75953546; 75953450; 75953503 | 75953433 − | ENST00000370081;ENST00000230459;ENST00000370089;ENST00000459637;ENST00000509698;ENST00000460985;ENST00000472311;ENST00000377978 |
| 2% | chr6 | 75953546; 75953450; 75953503 | 75953433 − | ENST00000370081;ENST00000230459;ENST00000370089;ENST00000459637;ENST00000509698;ENST00000460985;ENST00000472311;ENST00000377978 |
| 2% | chr5 | 79410474 | 79410337 − | ENST00000509193 |
| 2% | chr1 | 20979464 | 20979344 − | ENST00000602624;ENST00000375048;ENST00000415136 |
| 2% | chr1 | 20979464 | 20979344 − | ENST00000602624;ENST00000375048;ENST00000415136 |
| 2% | chr1 | 20979464 | 20979344 − | ENST00000602624;ENST00000375048;ENST00000415136 |
| 2% | chr1 | 47101642 | 47101569 − | ENST00000576409;ENST00000371937;ENST00000574428;ENST00000492233;ENST00000526821;ENST00000542495;ENST00000329231;ENST00000534216;ENST00000532925 |
| 2% | chr1 | 47101642 | 47101569 − | ENST00000576409;ENST00000371937;ENST00000574428;ENST00000492233;ENST00000526821;ENST00000542495;ENST00000329231;ENST00000534216;ENST00000532925 |
| 2% | chr1 | 47101642 | 47101569 − | ENST00000576409;ENST00000371937;ENST00000574428;ENST00000492233;ENST00000526821;ENST00000542495;ENST00000329231;ENST00000534216;ENST00000532925 |
| 2% | chr1 | 47101642 | 47101569 − | ENST00000576409;ENST00000371937;ENST00000574428;ENST00000492233;ENST00000526821;ENST00000542495;ENST00000329231;ENST00000534216;ENST00000532925 |
| 2% | chr1 | 47101642 | 47101569 − | ENST00000576409;ENST00000371937;ENST00000574428;ENST00000492233;ENST00000526821;ENST00000542495;ENST00000329231;ENST00000534216;ENST00000532925 |
| 2% | chr1 | 47101642 | 47101569 − | ENST00000576409;ENST00000371937;ENST00000574428;ENST00000492233;ENST00000526821;ENST00000542495;ENST00000329231;ENST00000534216;ENST00000532925 |
| 2% | chr1 | 47101642 | 47101569 − | ENST00000576409;ENST00000371937;ENST00000574428;ENST00000492233;ENST00000526821;ENST00000542495;ENST00000329231;ENST00000534216;ENST00000532925 |
| 2% | chr1 | 47101642 | 47101569 − | ENST00000576409;ENST00000371937;ENST00000574428;ENST00000492233;ENST00000526821;ENST00000542495;ENST00000329231;ENST00000534216;ENST00000532925 |
| 2% | chr1 | 47101642 | 47101569 − | ENST00000576409;ENST00000371937;ENST00000574428;ENST00000492233;ENST00000526821;ENST00000542495;ENST00000329231;ENST00000534216;ENST00000532925 |
| 2% | chr20 | 30060816 | 30060759 − | ENST00000317676 |
| 2% | chr3 | 156262228 | 156262097 − | ENST00000265044;ENST00000467789;ENST00000476217;ENST00000463503;ENST00000496050 |

TABLE 43-continued

| | | | | |
|---|---|---|---|---|
| 2% | chr3 | 156262228 | 156262097 − | ENST00000265044;ENST00000467789;ENST00000476217;ENST00000463503;ENST00000496050 |
| 2% | chr3 | 156262228 | 156262097 − | ENST00000265044;ENST00000467789;ENST00000476217;ENST00000463503;ENST00000496050 |
| 2% | chr19 | 8962031 | 8961952 − | ENST00000397910;ENST00000599436;ENST00000380951 |
| 2% | chr19 | 8962031 | 8961952 − | ENST00000397910;ENST00000599436;ENST00000380951 |
| 2% | chr19 | 8962031 | 8961952 − | ENST00000397910;ENST00000599436;ENST00000380951 |
| 2% | chr10 | 127483547 | 127483449 − | ENST00000368797;ENST00000368786 |
| 1% | chr19 | 40478053 | 40478151 + | ENST00000157812;ENST00000455878 |
| 1% | chr18 | 12720509 | 12720682 + | ENST00000585331;ENST00000586445;ENST00000317615;ENST00000590217 |
| 1% | chr18 | 12720509 | 12720682 + | ENST00000585331;ENST00000586445;ENST00000317615;ENST00000590217 |
| 1% | chr18 | 12720509 | 12720682 + | ENST00000585331;ENST00000586445;ENST00000317615;ENST00000590217 |
| 1% | chr19 | 45323962 | 45324079 + | ENST00000270233 |
| 1% | chr3 | 50153339 | 50153413 + | ENST00000347869 |
| 1% | chrX | 49358721 | 49358846 + | ENST00000362097 |
| 1% | chr3 | 50153339 | 50153413 + | ENST00000347869 |
| 1% | chr22 | 35819207 | 35819334 + | ENST00000216122;ENST00000382011 |
| 1% | chr22 | 35819207 | 35819334 + | ENST00000216122;ENST00000382011 |
| 1% | chr1 | 82372702 | 82372915 + | ENST00000370721;ENST00000370723;ENST00000370725;ENST00000370727;ENST00000370728;ENST00000370730;ENST00000359929;ENST00000319517;ENST00000370713;ENST00000370715;ENST00000271029;ENST00000335786;ENST00000370717;ENST00000394879 |
| 1% | chr2 | 130940200 | 130940348 + | ENST00000425361;ENST00000457492;ENST00000281871;ENST00000409255 |
| 1% | chr2 | 130940200 | 130940348 + | ENST00000425361;ENST00000457492;ENST00000281871;ENST00000409255 |
| 1% | chr2 | 130940200 | 130940348 + | ENST00000425361;ENST00000457492;ENST00000281871;ENST00000409255 |
| 1% | chr22 | 24200187 | 24200216 + | ENST00000436643;ENST00000316185 |
| 1% | chr19 | 45316507 | 45316603 + | ENST00000589651;ENST00000270233;ENST00000591520 |
| 1% | chr19 | 45316507 | 45316603 + | ENST00000589651;ENST00000270233;ENST00000591520 |
| 1% | chr3 | 23960687; 23960694 | 23960737 + | ENST00000307839;ENST00000422218;ENST00000434031;ENST00000413699;ENST00000456530;ENST00000412097;ENST00000415719;ENST00000435882;ENST00000354811 |
| 1% | chr3 | 23960687; 23960694 | 23960737 + | ENST00000307839;ENST00000422218;ENST00000434031;ENST00000413699;ENST00000456530;ENST00000412097;ENST00000415719;ENST00000435882;ENST00000354811 |
| 1% | chr22 | 24236959 | 24237131 + | ENST00000433835;ENST00000215754 |
| 1% | chr22 | 24236959 | 24237131 + | ENST00000433835;ENST00000215754 |
| 1% | chr1 | 25883644 | 25883758 + | ENST00000374338 |
| 1% | chr10 | 81111243 | 81111329 + | ENST00000472580;ENST00000394579;ENST00000225174;ENST00000448165 |
| 1% | chr10 | 81111243 | 81111329 + | ENST00000472580;ENST00000394579;ENST00000225174;ENST00000448165 |
| 1% | chr11 | 64088479 | 64088540 + | ENST00000265462;ENST00000352435;ENST00000347941 |
| 1% | chr11 | 64088479 | 64088540 + | ENST00000265462;ENST00000352435;ENST00000347941 |
| 1% | chr11 | 64088479 | 64088540 + | ENST00000265462;ENST00000352435;ENST00000347941 |
| 1% | chr11 | 60701014 | 60701216 + | ENST00000453848;ENST00000005286;ENST00000536409 |
| 1% | chr11 | 60701014 | 60701216 + | ENST00000453848;ENST00000005286;ENST00000536409 |
| 1% | chr11 | 60701014 | 60701216 + | ENST00000453848;ENST00000005286;ENST00000536409 |
| 1% | chr6 | 21594766 | 21595236 + | ENST00000543472 |
| 1% | chr16 | 30783410 | 30783511 + | ENST00000324685;ENST00000402121;ENST00000563683;ENST00000357890 |
| 1% | chr16 | 30783410 | 30783511 + | ENST00000324685;ENST00000402121;ENST00000563683;ENST00000357890 |
| 1% | chr16 | 30783410 | 30783511 + | ENST00000324685;ENST00000402121;ENST00000563683;ENST00000357890 |
| 1% | chr16 | 30783410 | 30783511 + | ENST00000324685;ENST00000402121;ENST00000563683;ENST00000357890 |
| 1% | chr19 | 45316507 | 45316581 + | ENST00000589651;ENST00000270233;ENST00000591520 |
| 1% | chr19 | 45316507 | 45316581 + | ENST00000589651;ENST00000270233;ENST00000591520 |
| 1% | chr8 | 146279404 | 146279527 + | ENST00000331434 |
| 1% | chrX | 134852702 | 134852722 + | ENST00000370741;ENST00000497301;ENST00000482795 |
| 1% | chr6 | 30458017 | 30458292 + | ENST00000376630 |
| 1% | chr19 | 17628519 | 17628659 + | ENST00000252603 |
| 1% | chr7 | 71142196 | 71142291 + | ENST00000333538 |
| 1% | chr20 | 52831839 | 52831979 + | ENST00000371419;ENST00000441080 |
| 1% | chrX | 49368271 | 49368396 + | ENST00000381709;ENST00000381700 |
| 1% | chr22 | 36661197; 36661246 | 36661833 + | ENST00000397278;ENST00000422706;ENST00000426053;ENST00000319136;ENST00000347595;ENST00000397279 |
| 1% | chr22 | 36661197; 36661246 | 36661833 + | ENST00000397278;ENST00000422706;ENST00000426053;ENST00000319136;ENST00000347595;ENST00000397279 |
| 1% | chr22 | 36661197; 36661246 | 36661833 + | ENST00000397278;ENST00000422706;ENST00000426053;ENST00000319136;ENST00000347595;ENST00000397279 |
| 1% | chr22 | 36661197; 36661246 | 36661833 + | ENST00000397278;ENST00000422706;ENST00000426053;ENST00000319136;ENST00000347595;ENST00000397279 |
| 1% | chr14 | 24615449 | 24615417 − | ENST00000216802;ENST00000558273;ENST00000560370 |
| 1% | chr12 | 71509738 | 71509630 − | ENST00000549357 |
| 1% | chrX | 134950246 | 134950226 − | ENST00000420087;ENST00000463085;ENST00000370724;ENST00000491480 |
| 1% | chr2 | 71216946 | 71216879 − | ENST00000606025;ENST00000272438 |
| 1% | chrX | 153277368 | 153277177 − | ENST00000455690 |
| 1% | chr19 | 54666021 | 54665838 − | ENST00000301187;ENST00000416963;ENST00000376591 |
| 1% | chr19 | 54666021 | 54665838 − | ENST00000301187;ENST00000416963;ENST00000376591 |
| 1% | chr19 | 54666021 | 54665838 − | ENST00000301187;ENST00000416963;ENST00000376591 |
| 1% | chr6 | 65098733 | 65098583 − | ENST00000503581;ENST00000370621;ENST00000370616 |
| 1% | chr7 | 150939064 | 150939023 − | ENST00000262188;ENST00000392811;ENST00000356800 |
| 1% | chr7 | 150939064 | 150939023 − | ENST00000262188;ENST00000392811;ENST00000356800 |
| 1% | chr1 | 152006276 | 152006124 − | ENST00000271638 |
| 1% | chrX | 118923974 | 118923871 − | ENST00000361575 |

TABLE 43-continued

| | | | | | |
|---|---|---|---|---|---|
| 1% | chr19 | 54687563; 54687517 | 54687404 | − | ENST00000431666;ENST00000338624;ENST00000245615;ENST00000449249;ENST00000391754;ENST00000495279;ENST00000414665;ENST00000453320 |
| 1% | chr19 | 54687563; 54687517 | 54687404 | − | ENST00000431666;ENST00000338624;ENST00000245615;ENST00000449249;ENST00000391754;ENST00000495279;ENST00000414665;ENST00000453320 |
| 1% | chr19 | 54687563; 54687517 | 54687404 | − | ENST00000431666;ENST00000338624;ENST00000245615;ENST00000449249;ENST00000391754;ENST00000495279;ENST00000414665;ENST00000453320 |
| 1% | chr19 | 54687563; 54687517 | 54687404 | − | ENST00000431666;ENST00000338624;ENST00000245615;ENST00000449249;ENST00000391754;ENST00000495279;ENST00000414665;ENST00000453320 |
| 1% | chr12 | 8808043 | 8808011 | − | ENST00000535411;ENST00000359478;ENST00000433590;ENST00000396549;ENST00000543369;ENST00000544211;ENST00000535336;ENST00000540087;ENST00000537009;ENST00000544889 |
| 1% | chr12 | 8808043 | 8808011 | − | ENST00000535411;ENST00000359478;ENST00000433590;ENST00000396549;ENST00000543369;ENST00000544211;ENST00000535336;ENST00000540087;ENST00000537009;ENST00000544889 |
| 1% | chr12 | 8808043 | 8808011 | − | ENST00000535411;ENST00000359478;ENST00000433590;ENST00000396549;ENST00000543369;ENST00000544211;ENST00000535336;ENST00000540087;ENST00000537009;ENST00000544889 |
| 1% | chr9 | 130678698 | 130678687 | − | ENST00000335791 |
| 1% | chr11 | 75917451 | 75917369 | − | ENST00000322563 |
| 1% | chr12 | 56744974 | 56744882 | − | ENST00000314128;ENST00000557235;ENST00000418572 |
| 1% | chr12 | 56744974 | 56744882 | − | ENST00000314128;ENST00000557235;ENST00000418572 |
| 1% | chrX | 134967496 | 134967476 | − | ENST00000491002;ENST00000448053;ENST00000472834 |
| 1% | chr19 | 49335016 | 49334925 | − | ENST00000263278;ENST00000595764 |
| 1% | chr19 | 49335016 | 49334925 | − | ENST00000263278;ENST00000595764 |
| 1% | chr1 | 85279854 | 85279558 | − | ENST00000440886;ENST00000370611 |
| 1% | chr20 | 55803477 | 55803285 | − | ENST00000395863;ENST00000395864;ENST00000450594;ENST00000433911 |
| 1% | chr20 | 55803477 | 55803285 | − | ENST00000395863;ENST00000395864;ENST00000450594;ENST00000433911 |
| 1% | chr19 | 6422447 | 6422351 | − | ENST00000398148;ENST00000599395 |
| 1% | chr19 | 6422447 | 6422351 | − | ENST00000398148;ENST00000599395 |
| 1% | chr4 | 980639 | 980594 | − | ENST00000510286 |
| 1% | chr8 | 144919471 | 144919421 | − | ENST00000442628;ENST00000327830 |
| 1% | chr8 | 144919471 | 144919421 | − | ENST00000442628;ENST00000327830 |
| 1% | chr15 | 40849571; 40849518 | 40849415 | − | ENST00000560305;ENST00000559153;ENST00000561011;ENST00000559291;ENST00000559911;ENST00000558113;ENST00000358005;ENST00000416810;ENST00000558750;ENST00000558918;ENST00000559103;ENST00000558871 |
| 1% | chr15 | 40849571; 40849518 | 40849415 | − | ENST00000560305;ENST00000559153;ENST00000561011;ENST00000559291;ENST00000559911;ENST00000558113;ENST00000358005;ENST00000416810;ENST00000558750;ENST00000558918;ENST00000559103;ENST00000558871 |
| 1% | chr15 | 40849571; 40849518 | 40849415 | − | ENST00000560305;ENST00000559153;ENST00000561011;ENST00000559291;ENST00000559911;ENST00000558113;ENST00000358005;ENST00000416810;ENST00000558750;ENST00000558918;ENST00000559103;ENST00000558871 |
| 1% | chrX | 134967496 | 134967476 | − | ENST00000491002;ENST00000448053;ENST00000472834 |
| 7 | 8 | | 9 | 10 | 11 |
| | chr20 | 53111339 | 53111426 | + | TAF |
| | chr19 | 45324388 | 45324391 | + | TSF |
| | chr1 | 32696861 | 32697110 | + | TAF |
| | chr6 | 74195910 | 74195882 | − | TSF |
| | chr20 | 47761186 | 47760181 | − | TAF |
| | chr20 | 47761186 | 47760181 | − | TAF |
| | chr20 | 47761186 | 47760181 | − | TAF |
| | chr6 | 10829240 | 10829256 | + | TAF |
| | chr6 | 10829240 | 10829256 | + | TAF |
| | chr12 | 113623998 | 113624117 | + | TSF |
| | chr12 | 124767376 | 124767267 | − | TAF |
| | chr12 | 124767376 | 124767267 | − | TAF |
| | chr12 | 124767376 | 124767267 | − | TAF |
| | chr12 | 124767376 | 124767267 | − | TAF |
| | chr12 | 124767376 | 124767267 | − | TAF |
| | chr12 | 124767376 | 124767267 | − | TAF |
| | chr12 | 124767376 | 124767267 | − | TAF |
| | chr1 | 224551811 | 224551931 | + | TAF |
| | chr14 | 31907346 | 31905965 | − | TSF |
| | chr8 | 144113283 | 144113885 | + | TAF |
| | chr12 | 6364053 | 5462746 | − | TAF |
| | chr12 | 6364053 | 5462746 | − | TAF |
| | chr12 | 6364053 | 5462746 | − | TAF |
| | chr12 | 6364053 | 5462746 | − | TAF |
| | chr19 | 45324388 | 45324391 | + | TSF |
| | chr20 | 43880953 | 43880903 | − | TAF |
| | chr11 | 118861152 | 118861045 | − | TSF |
| | chr2 | 26630464 | 26631004 | + | TAF |
| | chr9 | 91198914 | 91198934 | + | TAF |
| | chr19 | 45316049 | 45316236 | + | TAF |
| | chr19 | 45316049 | 45316236 | + | TAF |
| | chr19 | 35995923 | 35995655 | − | TAF |
| | chr19 | 35995923 | 35995655 | − | TAF |
| | chr19 | 35995923 | 35995655 | − | TAF |
| | chr19 | 35995923 | 35995655 | − | TAF |

TABLE 43-continued

| | | | |
|---|---|---|---|
| chr19 | 35995923 | 35995655 − | TAF |
| chr19 | 35995923 | 35995655 − | TAF |
| chr19 | 35995923 | 35995655 − | TAF |
| chr19 | 35995923 | 35995655 − | TAF |
| chr19 | 35995923 | 35995655 − | TAF |
| chr19 | 35995923 | 35995655 − | TAF |
| chr19 | 35995923 | 35995655 − | TAF |
| chr19 | 35995923 | 35995655 − | TAF |
| chr19 | 35995923 | 35995655 − | TAF |
| chr19 | 35995923 | 35995655 − | TAF |
| chr11 | 18534149 | 18533862 − | TAF |
| chr15 | 67000837 | 67001281 + | TAF |
| chr10 | 120901885 | 120901741 − | TAF |
| chr10 | 120901885 | 120901741 − | TAF |
| chr7 | 91767155 | 91766808 − | TSF |
| chr19 | 13872305 | 13872412 + | TAF |
| chr19 | 13872305 | 13872412 + | TAF |
| chr19 | 13872305 | 13872412 + | TAF |
| chr19 | 13872305 | 13872412 + | TAF |
| chr15 | 82808796 | 82808882 + | TAF |
| chr15 | 83193141 | 83193227 + | TSF |
| chr8 | 27555709 | 27555926 + | TAF |
| chr19 | 51445160 | 51445047 − | TAF |
| chr9 | 133421349 | 133421406 + | TSF |
| chr19 | 16213047 | 16213167 + | TSF |
| chr19 | 16213047 | 16213167 + | TSF |
| chr19 | 16213047 | 16213167 + | TSF |
| chr19 | 16213047 | 16213167 + | TSF |
| chr1 | 33270534 | 33269340 − | TAF |
| chr19 | 46499503 | 46499685 + | TSF |
| chr6 | 34385704 | 34385695 − | TSF |
| chr4 | 17629629 | 17629638 + | TAF |
| chr4 | 17629629 | 17629638 + | TAF |
| chr12 | 71504233 | 71503634 − | TAF |
| chr7 | 27581374 | 27579272 − | TAF |
| chr7 | 27581374 | 27579272 − | TAF |
| chr9 | 91198917 | 91198934 + | TAF |
| chr11 | 66010931 | 66010981 + | TSF |
| chr11 | 66010931 | 66010981 + | TSF |
| chr11 | 66010931 | 66010981 + | TSF |
| chr11 | 66010931 | 66010981 + | TSF |
| chr2 | 132245283 | 132245193 − | TAF |
| chr2 | 132245283 | 132245193 − | TAF |
| chr6 | 42973204 | 42973029 − | TSF |
| chr19 | 35514601 | 35514631 + | TAF |
| chr19 | 35514601 | 35514631 + | TAF |
| chr19 | 35514601 | 35514631 + | TAF |
| chr19 | 35514601 | 35514631 + | TAF |
| chr6 | 35351354 | 35351915 + | TAF |
| chr18 | 33773430 | 33773774 + | TAF |
| chr6 | 34212756 | 34212817 + | TSF |
| chr6 | 34212756 | 34212817 + | TSF |
| chr8 | 42925245 | 42925476 + | TSF |
| chr8 | 42925245 | 42925476 + | TSF |
| chr8 | 42925245 | 42925476 + | TSF |
| chr8 | 42925245 | 42925476 + | TSF |
| chr8 | 42925245 | 42925476 + | TSF |
| chr1 | 153663274 | 153663445 + | TSF |
| chr1 | 55317584 | 55317525 − | TSF |
| chr1 | 55317584 | 55317525 − | TSF |
| chr1 | 55317584 | 55317525 − | TSF |
| chr2 | 242276200 | 242276228 + | TAF |
| chr2 | 242276200 | 242276228 + | TAF |
| chr2 | 242276200 | 242276228 + | TAF |
| chr2 | 242276200 | 242276228 + | TAF |
| chr9 | 15492223 | 15492056 − | TAF |
| chr12 | 57059571 | 57059432 − | TAF |
| chr12 | 57059571 | 57059432 − | TAF |
| chr12 | 57059571 | 57059432 − | TAF |
| chr12 | 57059571 | 57059432 − | TAF |
| chr19 | 14060442 | 14060422 − | TAF |
| chr19 | 45324388 | 45324391 + | TSF |
| chr19 | 45324388 | 45324391 + | TSF |
| chr1 | 225157336 | 225158402 + | TSF |
| chr1 | 225157336 | 225158402 + | TSF |

TABLE 43-continued

| | | | |
|---|---|---|---|
| chr1 | 11805987 | 11806151 + | TSF |
| chr1 | 11805987 | 11806151 + | TSF |
| chr19 | 3855694 | 3855445 − | TSF |
| chr19 | 3855694 | 3855445 − | TSF |
| chr1 | 992542 | 992691 + | TSF |
| chr1 | 992542 | 992691 + | TSF |
| chr19 | 494980 | 494981 + | TSF |
| chr5 | 54993040 | 54992544 − | TSF |
| chr6 | 10829243 | 10829256 + | TAF |
| chr6 | 10829243 | 10829256 + | TAF |
| chr6 | 10829243 | 10829256 + | TAF |
| chr6 | 42948581 | 42948550 − | TAF |
| chr1 | 151245243 | 151245553 + | TAF |
| chr1 | 151245243 | 151245553 + | TAF |
| chr1 | 151245243 | 151245553 + | TAF |
| chr1 | 151245243 | 151245553 + | TAF |
| chr17 | 7215641 | 7215651 + | TSF |
| chr17 | 7215641 | 7215651 + | TSF |
| chr2 | 133381838 | 133381614 − | TSF |
| chr2 | 133381838 | 133381614 − | TSF |
| chr12 | 71938771 | 71938901 + | TSF |
| chr14 | 66099743 | 66101298 + | TSF |
| chr14 | 66099743 | 66101298 + | TSF |
| chr14 | 66099743 | 66101298 + | TSF |
| chr1 | 155036918 | 155037085 + | TSF |
| chr | 72187682 | 72187899 + | TSF |
| chr | 72187682 | 72187899 + | TSF |
| chr12 | 102548605 | 102548938 + | TSF |
| chr12 | 102548605 | 102548938 + | TSF |
| chr12 | 102548605 | 102548938 + | TSF |
| chr12 | 102548605 | 102548938 + | TSF |
| chr12 | 102548605 | 102548938 + | TSF |
| chr19 | 15289244 | 15289201 − | TSF |
| chr19 | 15289244 | 15289201 − | TSF |
| chr2 | 110672249 | 110672374 + | TSF |
| chr22 | 36662881 | 36662970 + | TSF |
| chr22 | 36662881 | 36662970 + | TSF |
| chr22 | 36662881 | 36662970 + | TSF |
| chr22 | 36662881 | 36662970 + | TSF |
| chr19 | 45324358 | 45324391 + | TSF |
| chr2 | 111214412 | 111214287 − | TSF |
| chr16 | 2875971 | 2876154 + | TSF |
| chr16 | 2875971 | 2876154 + | TSF |
| chr16 | 2875971 | 2876154 + | TSF |
| chr19 | 45323867 | 453239109 + | TSF |
| chr19 | 45324372 | 45324391 + | TSF |
| chr16 | 2823822 | 2823809 − | TSF |
| chr16 | 2823822 | 2823809 − | TSF |
| chr16 | 2823822 | 2823809 − | TSF |
| chr3 | 48702393 | 48702198 − | TSF |
| chr3 | 48702393 | 48702198 − | TSF |
| chr3 | 48702393 | 48702198 − | TSF |
| chr19 | 45324388 | 45324391 + | TSF |
| chr7 | 76648226 | 76648393 + | TSF |
| chr7 | 76648226 | 76648393 + | TSF |
| chr7 | 76648226 | 76648393 + | TSF |
| chr2 | 217393993 | 217394327 + | TSF |
| chr2 | 217393993 | 217394327 + | TSF |
| chr17 | 7215648 | 7215651 + | TSF |
| chr17 | 7215648 | 7215651 + | TSF |
| chr7 | 76676146 | 76676313 + | TSF |
| chr7 | 76676146 | 76676313 + | TSF |
| chr7 | 76676146 | 76676313 + | TSF |
| chr7 | 76676146 | 76676313 + | TSF |
| chr7 | 76676146 | 76676313 + | TSF |
| chr20 | 29652086 | 29652324 + | TSF |
| chr7 | 76648226 | 76648393 + | TSF |
| chr7 | 76648226 | 76648393 + | TSF |
| chr7 | 76648226 | 76648393 + | TSF |
| chr1 | 183470266 | 183470283 + | TSF |
| chr11 | 101937956 | 101938097 + | TSF |
| chr11 | 101937956 | 101938097 + | TSF |
| chr6 | 10829240 | 10829256 + | TSF |
| chr6 | 10829240 | 10829256 + | TSF |
| chr6 | 10829240 | 10829256 + | TSF |
| chr6 | 10829240 | 10829256 + | TSF |
| chr7 | 74168612 | 74168748 + | TSF |
| chr7 | 74168612 | 74168748 + | TSF |
| chr7 | 74168612 | 74168748 + | TSF |

TABLE 43-continued

| | | | |
|---|---|---|---|
| chr7 | 74168612 | 74168748 + | TSF |
| chr12 | 56736879 | 56736779 − | TSF |
| chr12 | 56736879 | 56736779 − | TSF |
| chr19 | 45365316 | 45365390 + | TSF |
| chr3 | 185411016 | 185410789 − | TSF |
| chr3 | 185411016 | 185410789 − | TSF |
| chr22 | 36663327 | 36663652 + | TSF |
| chr22 | 36663327 | 36663652 + | TSF |
| chr22 | 36663327 | 36663652 + | TSF |
| chr22 | 36663327 | 36663652 + | TSF |
| chr9 | 3855631 | 3855480 − | TSF |
| chr9 | 3855631 | 3855480 − | TSF |
| chr1 | 1255223 | 1254988 − | TSF |
| chr1 | 1255223 | 1254988 − | TSF |
| chr1 | 1255223 | 1254988 − | TSF |
| chr1 | 1255223 | 1254988 − | TSF |
| chr1 | 1255223 | 1254988 − | TSF |
| chr4 | 1101132 | 1100845 − | TSF |
| chr9 | 19269457 | 19269457 − | TSF |
| chr9 | 19269457 | 19269457 − | TSF |
| chr6 | 30349606 | 30349643 + | TSF |
| chr1 | 40313419 | 40313374 − | TSF |
| chr1 | 40313419 | 40313374 − | TSF |
| chr1 | 40313419 | 40313374 − | TSF |
| chr1 | 40313419 | 40313374 − | TSF |
| chr1 | 44801643 | 44801548 − | TSF |
| chr1 | 44801643 | 44801548 − | TSF |
| chr1 | 20978611 | 20978295 − | TSF |
| chr1 | 20978611 | 20978295 − | TSF |
| chr1 | 20978611 | 20978295 − | TSF |
| chr20 | 3854441 | 3854475 + | TSF |
| chr20 | 3854441 | 3854475 + | TSF |
| chr8 | 71625661 | 71625673 + | TSF |
| chr17 | 7215628 | 7215651 + | TSF |
| chr17 | 7215628 | 7215651 + | TSF |
| chr19 | 45324388 | 45324381 + | TSF |
| chr16 | 2875971 | 2876154 + | TSF |
| chr16 | 2875971 | 2876154 + | TSF |
| chr16 | 2875971 | 2876154 + | TSF |
| chr16 | 2875971 | 2876154 + | TSF |
| chr18 | 72187799 | 72187899 + | TSF |
| chr18 | 72187799 | 72187899 + | TSF |
| chr10 | 75556079 | 75556138 + | TSF |
| chr10 | 75556079 | 75556138 + | TSF |
| chr10 | 75556079 | 75556138 + | TSF |
| chr10 | 75556079 | 75556138 + | TSF |
| chr10 | 75556079 | 75556138 + | TSF |
| chr10 | 75556079 | 75556138 + | TSF |
| chr10 | 75556079 | 75556138 + | TSF |
| chr1 | 33145073 | 33145159 + | TSF |
| chr1 | 33145073 | 33145159 + | TSF |
| chr1 | 33145073 | 33145159 + | TSF |
| chr1 | 33145073 | 33145159 + | TSF |
| chr1 | 33145073 | 33145159 + | TSF |
| chr1 | 33145073 | 33145159 + | TSF |
| chr1 | 33145073 | 33145159 + | TSF |
| chr19 | 53339322 | 53339166 − | TSF |
| chr19 | 53339322 | 53339166 − | TSF |
| chr4 | 227073 | 226784 − | TSF |
| chr14 | 93864129 | 93864243 + | TSF |
| chr3 | 50155909 | 50155909 + | TSF |
| chr3 | 137907243 | 137907252 + | TSF |
| chr3 | 137907243 | 137907252 + | TSF |
| chr19 | 17388878 | 17389009 + | TSF |
| chr19 | 17388878 | 17389009 + | TSF |
| chr19 | 17388878 | 17389009 + | TSF |
| chr19 | 17388878 | 17389009 + | TSF |
| chr19 | 17388878 | 17389009 + | TSF |
| chr19 | 45324363 | 45324391 + | TSF |
| chr15 | 89453897 | 89453853 − | TSF |
| chr9 | 4992433 | 4991945 − | TSF |
| chr11 | 64089177 | 64089204 + | TSF |
| chr19 | 18717523 | 18717557 + | TSF |
| chr19 | 18717523 | 18717557 + | TSF |
| chr19 | 18717523 | 18717557 + | TSF |
| chr12 | 21387233 | 21386864 − | TSF |
| chr12 | 21387233 | 21386864 − | TSF |

TABLE 43-continued

| | | | |
|---|---|---|---|
| chr12 | 21387233 | 21386864 − | TSF |
| chr7 | 116738667 | 116738692 + | TSF |
| chr2 | 217393976 | 217394327 + | TSF |
| chr2 | 217393976 | 217394327 + | TSF |
| chr15 | 83193141 | 83193227 + | TSF |
| chr19 | 39890782 | 39891028 + | TSF |
| chr19 | 39890782 | 39891028 + | TSF |
| chr19 | 39890782 | 39891028 + | TSF |
| chr19 | 39890782 | 39891028 + | TSF |
| chr1 | 54362523 | 54362446 − | TSF |
| chr1 | 156716225 | 156716218 − | TSF |
| chr19 | 58361929 | 58361580 − | TSF |
| chr1 | 153703418 | 153703434 + | TSF |
| chr19 | 45324388 | 45324391 + | TSF |
| chr19 | 45324388 | 45324391 + | TSF |
| chr5 | 24177946 | 24178380 + | TSF |
| chr1 | 32696865 | 32697110 + | TSF |
| chr12 | 52659397 | 52659518 + | TSF |
| chr7 | 81929467 | 81929190 − | TSF |
| chr7 | 75603302 | 75603295 − | TSF |
| chr9 | 130213398 | 130213359 − | TSF |
| chr1 | 32561261 | 32561358 + | TSF |
| chr1 | 32561261 | 32561358 + | TSF |
| chr1 | 32561261 | 32561358 + | TSF |
| chr20 | 45656785 | 45656967 + | TSF |
| chr20 | 45656785 | 45656967 + | TSF |
| chr20 | 45656785 | 45656967 + | TSF |
| chr1 | 25916660 | 25916675 + | TSF |
| chr4 | 17629629 | 17629638 + | TSF |
| chr4 | 17629629 | 17629638 + | TSF |
| chr19 | 17551332 | 17551032 − | TSF |
| chr19 | 17551332 | 17551032 − | TSF |
| chrX | 151994427 | 151994098 − | TSF |
| chr19 | 11561222 | 11561319 + | TSF |
| chr8 | 144113354 | 144113885 + | TSF |
| chr12 | 15086263 | 15086233 − | TSF |
| chr20 | 36757686 | 36757563 − | TSF |
| chr20 | 36757686 | 36757563 − | TSF |
| chr20 | 36757686 | 36757563 | |
| | | | TSF |
| chr1 | 6531300 | 6531188 − | TSF |
| chr1 | 6531300 | 6531188 − | TSF |
| chr1 | 6531300 | 6531188 − | TSF |
| chr1 | 6531300 | 6531188 − | TSF |
| chr1 | 6531300 | 6531188 − | TSF |
| chr1 | 6531300 | 6531188 − | TSF |
| chr8 | 27458611 | 27458570 − | TSF |
| chr8 | 27458611 | 27458570 − | TSF |
| chr8 | 27458611 | 27458570 − | TSF |
| chr8 | 27458611 | 27458570 − | TSF |
| chr7 | 91767179 | 91766808 − | TSF |
| chr3 | 420259 | 420361 + | TSF |
| chr3 | 420259 | 420361 + | TSF |
| chr10 | 128608404 | 128608409 + | TSF |
| chr20 | 45728490 | 45728598 + | TSF |
| chr20 | 45728490 | 45728598 + | TSF |
| chr19 | 45324372 | 45324391 + | ITSF |
| chr19 | 45324388 | 45324391 + | TSF |
| chrX | 1481917 | 1481663 − | TSF |
| chr7 | 135585557 | 135585512 − | TSF |
| chr19 | 58361929 | 58361580 − | TSF |
| chr7 | 74856485 | 74856184 − | TSF |
| chr5 | 149709118 | 149709023 − | TSF |
| chr5 | 149709118 | 149709023 − | TSF |
| chr10 | 114208140 | 114208243 + | TSF |
| chr11 | 76834999 | 76835082 + | TSF |
| chr11 | 76834999 | 76835082 + | TSF |
| chr14 | 75936196 | 75936249 + | TSF |
| chr14 | 75936196 | 75936249 + | TSF |
| chr7 | 150067849 | 150067901 + | TSF |
| chr9 | 5712361 | 5712559 + | TSF |
| chr9 | 5712361 | 5712559 + | TSF |
| chr9 | 5712361 | 5712559 + | TSF |
| chr19 | 45324388 | 45324391 + | TSF |
| chr17 | 7215638 | 7215651 + | TSF |
| chr17 | 7215638 | 7215651 + | TSF |
| chr7 | 91430582 | 91429696 − | TSF |
| chr | 80401028 | 80400962 − | TSF |
| chr | 80401028 | 80400962 − | TSF |
| chr | 80401028 | 80400962 − | TSF |

TABLE 43-continued

| | | | |
|---|---|---|---|
| chr4 | 25723603 | 25723555 − | TSF |
| chr4 | 25723603 | 25723555 − | TSF |
| chr4 | 25723603 | 25723555 − | TSF |
| chr4 | 25723603 | 25723555 − | TSF |
| chr6 | 30461007 | 30461101 + | TSF |
| chr4 | 107242023 | 107243452 + | TSF |
| chr1 | 230227336 | 230227441 + | TSF |
| chr8 | 117960753 | 117961020 + | TSF |
| chr1 | 70831829 | 70831848 + | TSF |
| chr5 | 70868141 | 70868205 + | TSF |
| chr5 | 70868141 | 70868205 + | TSF |
| chr19 | 2141056 | 2140753 − | TSF |
| chr1 | 63952444 | 63951983 − | TSF |
| chr1 | 63952444 | 63951983 − | TSF |
| chr5 | 10732796 | 10732287 − | TSF |
| chr6 | 11056581 | 110565664 − | TSF |
| chr1 | 1255085 | 1254988 − | TSF |
| chr1 | 1255085 | 1254988 − | TSF |
| chr1 | 1255085 | 1254988 − | TSF |
| chr1 | 1255085 | 1254988 − | TSF |
| chr1 | 1255085 | 1254988 − | TSF |
| chr1 | 1255085 | 1254988 − | TSF |
| chr6 | 51608386 | 51607435 − | TSF |
| chr11 | 118739656 | 118739455 − | TSF |
| chr8 | 109233832 | 109233552 − | TSF |
| chr8 | 109233832 | 109233552 − | TSF |
| chr8 | 109233832 | 109233552 − | TSF |
| chr8 | 109233832 | 109233552 − | TSF |
| chr17 | 27242466 | 27242238 − | TSF |
| chr20 | 48177475 | 48177085 − | TSF |
| chr8 | 11700371 | 11700139 − | TSF |
| chr10 | 71982750 | 71982433 − | TSF |
| chr9 | 7798658 | 7798645 − | TSF |
| chr19 | 35505459 | 35505647 + | TSF |
| chr19 | 35505459 | 35505647 + | TSF |
| chr19 | 35505459 | 35505647 + | TSF |
| chr19 | 35505459 | 35505647 + | TSF |
| chr6 | 10760279 | 10760632 + | TSF |
| chr6 | 10760249 | 10790632 + | TSF |
| chr19 | 45324388 | 45324391 + | ITSF |
| chr2 | 219211310 | 219211505 + | TSF |
| chr2 | 219211310 | 219211505 + | TSF |
| chr2 | 219211310 | 219211505 + | TSF |
| chr12 | 56503862 | 56504158 + | TSF |
| chr22 | 47078308 | 47078350 + | TSF |
| chr22 | 47078308 | 47078350 + | TSF |
| chr3 | 32324083 | 32324625 + | TSF |
| chr15 | 74234853 | 74234966 + | TSF |
| chr6 | 30461539 | 30461850 + | TSF |
| chr6 | 30461539 | 30461850 + | TSF |
| chr16 | 2818542 | 2818580 + | TSF |
| chr16 | 2818542 | 2818580 + | TSF |
| chr11 | 113858309 | 11358477 + | TSF |
| chr11 | 113858309 | 11358477 + | TSF |
| chr11 | 113858309 | 11358477 + | TSF |
| chr11 | 113858309 | 11358477 + | TSF |
| chr11 | 113858309 | 11358477 + | TSF |
| chr11 | 113858309 | 11358477 + | TSF |
| chrX | 153276645 | 153276543 − | TSF |
| chrX | 153276645 | 153276543 − | TSF |
| chrX | 153276645 | 153276543 − | TSF |
| chr1 | 117702007 | 117701826 − | TSF |
| chr1 | 117702007 | 117701826 − | TSF |
| chr1 | 55317750 | 55317525 − | TSF |
| chr1 | 55317750 | 55317525 − | TSF |
| chr17 | 74615240 | 74615040 − | TSF |
| chr1 | 55317750 | 55317525 − | TSF |
| chr1 | 55317750 | 55317525 − | TSF |
| chr19 | 58361929 | 58361580 − | TSF |
| chr19 | 58361929 | 58361580 − | TSF |
| chr19 | 58361929 | 58361580 − | TSF |
| chr19 | 58361929 | 58361580 − | TSF |
| chr19 | 40327613 | 10327527 − | TSF |
| chr19 | 40327613 | 10327527 − | TSF |
| chr19 | 40327613 | 10327527 − | TSF |
| chr19 | 40327613 | 10327527 − | TSF |
| chr19 | 40327613 | 10327527 − | TSF |
| chr8 | 120233190 | 120233225 + | TSF |
| chr19 | 45324388 | 45324391 + | TSF |
| chr19 | 45324388 | 45324391 + | TSF |

TABLE 43-continued

| | | | |
|---|---|---|---|
| chr9 | 81037010 | 81037166 + | TSF |
| chr11 | 64089165 | 64089204 + | TSF |
| chr10 | 116030863 | 116030985 + | TSF |
| chr5 | 175731557 | 175732243 + | TSF |
| chr5 | 175731557 | 175732243 + | TSF |
| chr5 | 175731557 | 175732243 + | TSF |
| chr19 | 45324372 | 45324391 + | TSF |
| chr15 | 81439636 | 81439809 + | TSF |
| chr11 | 73076139 | 73076217 + | TSF |
| chr16 | 16382422 | 16382605 + | TSF |
| chr16 | 16382422 | 16382605 + | TSF |
| chr12 | 11340402 | 113404051 + | TSF |
| chr12 | 11340402 | 113404051 + | TSF |
| chr12 | 53716024 | 53716124 + | TSF |
| chr12 | 53716024 | 53716124 + | TSF |
| chr12 | 53716024 | 53716124 + | TSF |
| chr14 | 75936196 | 75936249 + | TSF |
| chr14 | 75936196 | 75936249 + | TSF |
| chr9 | 5710416 | 5711239 + | TSF |
| chr9 | 5710416 | 5711239 + | TSF |
| chr9 | 5710416 | 5711239 + | TSF |
| chr9 | 100777715 | 100777715 + | TSF |
| chr4 | 56252510 | 56252750 + | TSF |
| chr11 | 16771716 | 16772764 + | TSF |
| chr11 | 16771716 | 16772764 + | TSF |
| chr11 | 16771716 | 16772764 + | TSF |
| chr16 | 1740010 | 1740018 + | TSF |
| chr16 | 1740010 | 1740018 + | TSF |
| chr16 | 1740010 | 1740018 + | TSF |
| chr16 | 1740010 | 1740018 + | TSF |
| chr16 | 1740010 | 1740018 + | TSF |
| chr2 | 160172085 | 160171780 − | TSF |
| chr2 | 160172085 | 160171780 − | TSF |
| chr2 | 160172085 | 160171780 − | TSF |
| chr2 | 160172085 | 160171780 − | TSF |
| chr22 | 39689975 | 39689898 − | TSF |
| chr22 | 39689975 | 39689898 − | TSF |
| chr22 | 39689975 | 39689898 − | TSF |
| chr22 | 39689975 | 39689898 − | TSF |
| chr12 | 21387233 | 21386864 − | TSF |
| chr12 | 21387233 | 21386864 − | TSF |
| chr1 | 55317546 | 55317525 − | TSF |
| chr16 | 2834278 | 2833911 − | TSF |
| chr16 | 2834278 | 2833911 − | TSF |
| chr11 | 77763913 | 77763811 − | TSF |
| chr11 | 77763913 | 77763811 − | TSF |
| chr14 | 106216701 | 106216511 − | TSF |
| chr6 | 75951015 | 75951009 − | TSF |
| chr6 | 75951015 | 75951009 − | TSF |
| chr6 | 75951015 | 75951009 − | TSF |
| chr5 | 79409445 | 79409319 − | TSF |
| chr1 | 20978562 | 20978295 − | TSF |
| chr1 | 20978562 | 20978295 − | TSF |
| chr1 | 20978562 | 20978295 − | TSF |
| chr1 | 47098528 | 47098433 − | TSF |
| chr1 | 47098528 | 47098433 − | TSF |
| chr1 | 47098528 | 47098433 − | TSF |
| chr1 | 47098528 | 47098433 − | TSF |
| chr1 | 47098528 | 47098433 − | TSF |
| chr1 | 47098528 | 47098433 − | TSF |
| chr1 | 47098528 | 47098433 − | TSF |
| chr1 | 47098528 | 47098433 − | TSF |
| chr20 | 30059856 | 30059283 − | TSF |
| chr3 | 156246256 | 156246164 − | TSF |
| chr3 | 156246256 | 156246164 − | TSF |
| chr3 | 156246256 | 156246164 − | TSF |
| chr19 | 8958092 | 8957538 − | TSF |
| chr19 | 8958092 | 8957538 − | TSF |
| chr19 | 8958092 | 8957538 − | TSF |
| chr10 | 127473829 | 127473633 − | TSF |
| chr19 19 | 40491610 | 49491685 + | TSF |
| chr18 | 12728047 | 12728839 + | TSF |
| chr18 | 12728047 | 12728839 + | TSF |
| chr18 | 12728047 | 12728839 + | TSF |
| chr19 | 45324388 | 45324391 + | TSF |
| chr3 | 50155897 | 50155909 + | TSF |
| chrX | 49452063 | 49452091 + | TSF |
| chr3 | 50155901 | 50155909 + | TSF |

TABLE 43-continued

| | | | |
|---|---|---|---|
| chr22 | 35846150 | 35846200 + | TSF |
| chr22 | 35846150 | 35846200 + | TSF |
| chr1 | 82386280 | 82386482 + | TSF |
| chr2 | 130944553 | 130944643 + | TSF |
| chr2 | 130944553 | 130944643 + | TSF |
| chr2 | 130944553 | 130944643 + | TSF |
| chr22 | 24200767 | 24200784 + | TSF |
| chr19 | 45323220 | 45323361 + | TSF |
| chr19 | 45323220 | 45323361 + | TSF |
| chr3 | 23965495 | 23965511 + | TSF |
| chr3 | 23965495 | 23965511 + | TSF |
| chr22 | 24237181 | 24237187 + | TSF |
| chr22 | 24237181 | 24237187 + | TSF |
| chr1 | 25916660 | 25916675 + | TSF |
| chr10 | 81114803 | 81115129 + | TSF |
| chr10 | 81114803 | 81115129 + | TSF |
| chr11 | 64089177 | 64089204 + | TSF |
| chr11 | 64089177 | 64089204 + | TSF |
| chr11 | 64089177 | 64089204 + | TSF |
| chr11 | 60701443 | 60701575 + | TSF |
| chr11 | 60701443 | 60701575 + | TSF |
| chr11 | 60701443 | 60701575 + | TSF |
| chr6 | 21596236 | 21596314 + | TSF |
| chr16 | 30785136 | 30785155 + | TSF |
| chr16 | 30785136 | 30785155 + | TSF |
| chr16 | 30785136 | 30785155 + | TSF |
| chr16 | 30785136 | 30785155 + | TSF |
| chr19 | 45324388 | 45324391 + | TSF |
| chr19 | 45324388 | 45324391 + | TSF |
| chr8 | 146280809 | 146281504 + | TSF |
| chrX | 134866428 | 134866512 + | TSF |
| chr6 | 30461503 | 30461850 + | TSF |
| chr19 | 17631427 | 17631563 + | TSF |
| chr7 | 71169493 | 71170639 + | TSF |
| chr20 | 52835531 | 52835553 + | TSF |
| chrX | 49452063 | 49452091 + | TSF |
| chr22 | 36663327 | 36663652 + | TSF |
| chr22 | 36663327 | 36663652 + | TSF |
| chr22 | 36663327 | 36663652 + | TSF |
| chr22 | 36663327 | 36663652 + | TSF |
| chr14 | 24615120 | 24615007 − | TSF |
| chr12 | 71507025 | 71506982 − | TSF |
| chrX | 134936521 | 134936437 − | TSF |
| chr2 | 71213835 | 71213417 − | TSF |
| chrX | 153276642 | 153276543 − | TSF |
| chr19 | 54665366 | 54665264 − | TSF |
| chr19 | 54665366 | 54665264 − | TSF |
| chr19 | 54665366 | 54665264 − | TSF |
| chr6 | 65097495 | 65097442 − | TSF |
| chr7 | 150938275 | 150938099 − | TSF |
| chr7 | 15093827 | 150938099 − | TSF |
| chr1 | 152005339 | 152005310 − | TSF |
| chrX | 118884131 | 118883802 − | TSF |
| chr19 | 54687313 | 54687206 − | TSF |
| chr19 | 54687313 | 54687206 − | TSF |
| chr19 | 54687313 | 54687206 − | TSF |
| chr19 | 54687313 | 54687206 − | TSF |
| chr12 | 8793960 | 8793803 − | TSF |
| chr12 | 8793960 | 8793803 − | TSF |
| chr12 | 8793960 | 8793803 − | TSF |
| chr9 | 130678527 | 130678449 − | TSF |
| chr11 | 75917186 | 75917166 − | TSF |
| chr12 | 56736937 | 56736779 − | TSF |
| chr12 | 56736937 | 56736779 − | TSF |
| chrX | 134953780 | 134953696 − | TSF |
| chr19 | 49322122 | 49322095 − | TSF |
| chr19 | 49322122 | 49322095 − | TSF |
| chr1 | 85278179 | 85278107 − | TSF |
| chr20 | 55781390 | 55781345 − | TSF |
| chr20 | 55781390 | 55781345 − | TSF |
| chr19 | 6414524 | 6414481 − | TSF |
| chr19 | 6414524 | 6414481 − | TSF |
| chr4 | 973292 | 973258 − | TSF |
| chr8 | 144916987 | 144916867 − | TSF |
| chr8 | 144916987 | 144916867 − | TSF |
| chr15 | 40813374 | 40812967 − | TSF |
| chr15 | 40813374 | 40812967 − | TSF |
| chr15 | 40813374 | 40812967 − | TSF |
| chrX | 134936521 | 134936437 − | TSF |

TABLE 44

Transcript fusion for ovarian cancer (OV) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 81% | chr17 | 74261446 | 74261484 | + | chr17 | 74261988 | 74262050 | + | ENST00000327490 | TAF |
| 70% | chr12 | 66102868 | 6602840 | − | chr12 | 6602138 | 6602028 | − | ENST00000229238 | TAF |
| 69% | chr4 | 39699858 | 39699922 | + | chr4 | 39739040 | 39739133 | + | ENST00000261427; ENST00000510934; ENST00000295963; ENST00000445950 | TAF |
| 69% | chr4 | 39699858 | 39699922 | + | chr4 | 39739040 | 39739133 | + | ENST00000261427; ENST00000510934; ENST00000295963; ENST00000445950 | TAF |
| 69% | chr4 | 39699858 | 39699922 | + | chr4 | 39739040 | 39739133 | + | ENST00000261427; ENST00000510934; ENST00000295963; ENST00000445950 | TAF |
| 69% | chr4 | 39699858 | 39699922 | + | chr4 | 39739040 | 39739133 | + | ENST00000261427; ENST00000510934; ENST00000295963; ENST00000445950 | TAF |
| 59% | chr21 | 19289273 | 19289717 | + | chr21 | 19628826 | 19629135 | + | ENST00000299295; ENST00000543733 | TAF |
| 58% | chr12 | 64687157 | 64687061 | − | chr12 | 64679840 | 64679734 | − | ENST00000543942; ENST00000333722 | TAF |
| 54% | chr11 | 78075071 | 78075062 | − | chr11 | 77991947 | 77991647 | − | ENST00000361507 | TAF |
| 53% | chr7 | 150938296 | 150938250 | − | chr7 | 150937608 | 150937511 | − | ENST00000262188; ENST00000392811; ENST00000356800 | TAF |
| 49% | chr17 | 75318693 | 75318752 | + | chr17 | 75398141 | 75398484; 75398785; 75398497; 75398565 | + | ENST00000589070; ENST00000427177; ENST00000591198; ENST00000329047; ESNT00000590294; ENST00000591934; ENST00000423034; ENST00000589140 | TAF |
| 49% | chr17 | 75318693 | 75318752 | + | chr17 | 75398141 | 75398484; 75398785; 75398497; 75398565 | + | ENST00000589070; ENST00000427177; ENST00000591198; ENST00000329047; ESNT00000590294; ENST00000591934; ENST00000423034; ENST00000589140 | TAF |
| 49% | chr17 | 75318693 | 75318752 | + | chr17 | 75398141 | 75398484; 75398785; 75398497; 75398565 | + | ENST00000589070; ENST00000427177; ENST00000591198; ENST00000329047; ESNT00000590294; ENST00000591934; ENST00000423034; ENST00000589140 | TAF |
| 49% | chr17 | 75318693 | 75318752 | + | chr17 | 75398141 | 75398484; 75398785; 75398497; 75398565 | + | ENST00000589070; ENST00000427177; ENST00000591198; ENST00000329047; ESNT00000590294; ENST00000591934; ENST00000423034; ENST00000589140 | TAF |
| 48% | chr1 | 46797740 | 46797497 | − | chr1 | 46764042 | 46763956 | − | ENST00000343304 | TAF |
| 44% | chr3 | 128359904 | 128359849 | − | chr3 | 128356948 | 128356642 | − | ENST00000296255 | TAF |
| 43% | chr12 | 6602868 | 6602754 | − | chr12 | 6602138 | 6602028 | − | ENST00000229238 | TSF |
| 42% | chr11 | 93468219 | 93468129 | − | chr11 | 93467826 | 93467791; 93467814 | − | ENST00000393259; ENST00000527169 | TAF |
| 42% | chr11 | 93468219 | 93468129 | − | chr11 | 93467826 | 93467791; 93467814 | − | ENST00000393259; ENST00000527169 | TAF |
| 41% | chr2 | 133363747 | 133363763 | + | chr2 | 133402674 | 133403179 | + | ENST00000329321 | TAF |
| 39% | chr19 | 56187371 | 56187420 | + | chr19 | 56189893 | 56190221 | + | ENST00000411543 | TAF |
| 39% | chr21 | 46238665 | 46238584 | − | chr21 | 46234019 | 46233891; 46233777 | − | ENST00000397898; ENST00000332859; ENST00000411651; ENST00000397893 | TAF |
| 39% | chr21 | 46238665 | 46238584 | − | chr21 | 46234019 | 46233891; 46233777 | − | ENST00000397898; ENST00000332859; ENST00000411651; ENST00000397893 | TAF |
| 39% | chr21 | 46238665 | 46238584 | − | chr21 | 46234019 | 46233891; 46233777 | − | ENST00000397898; ENST00000332859; ENST00000411651; ENST00000397893 | TAF |
| 39% | chr21 | 46238665 | 46238584 | − | chr21 | 46234019 | 46233891; 46233777 | − | ENST00000397898; ENST00000332859; ENST00000411651; ENST00000397893 | TAF |
| 39% | chr4 | 39585352 | 39585284 | − | chr4 | 39459881 | 39459814 | − | ENST00000295955; ENST00000449470; ENST00000508595; ENST00000503040; ENST00000504470 | TSF |
| 39% | chr4 | 39585352 | 39585284 | − | chr4 | 39459881 | 39459814 | − | ENST00000295955; ENST00000449470; ENST00000508595; ENST00000503040; ENST00000504470 | TSF |
| 39% | chr4 | 39585352 | 39585284 | − | chr4 | 39459881 | 39459814 | − | ENST00000295955; ENST00000449470; ENST00000508595; ENST00000503040; ENST00000504470 | TSF |
| 35% | chr21 | 19399995 | 19400289 | + | chr21 | 19628826 | 19629135 | + | ENST00000299295; ENST00000543733 | TSF |
| 33% | chr19 | 49121994 | 49121817 | − | chr19 | 49121134 | 49121048 | − | ENST00000549920; ENST00000547897; ENST00000084795; ENST00000550645; ENST00000549370; ENST00000549273 | TAF |
| 33% | chr19 | 49121994 | 49121817 | − | chr19 | 49121134 | 49121048 | − | ENST00000549920; ENST00000547897; ENST00000084795; ENST00000550645; ENST00000549370; ENST00000549273 | TAF |
| 33% | chr19 | 49121994 | 49121817 | − | chr19 | 49121134 | 49121048 | − | ENST00000549920; ENST00000547897; ENST00000084795; ENST00000550645; ENST00000549370; ENST00000549273 | TAF |
| 33% | chr19 | 49121994 | 49121817 | − | chr19 | 49121134 | 49121048 | − | ENST00000549920; ENST00000547897; ENST00000084795; ENST00000550645; ENST00000549370; ENST00000549273 | TAF |
| 33% | chr19 | 49121994 | 49121817 | − | chr19 | 49121134 | 49121048 | − | ENST00000549920; ENST00000547897; ENST00000084795; ENST00000550645; ENST00000549370; ENST00000549273 | TAF |
| 32% | chr14 | 105944002 | 105944214 | + | chr14 | 10594603 | 105944697 | + | ENST00000483017; ENST00000329146 | TAF |
| 32% | chr9 | 130924283 | 130924301 | + | chr9 | 130925722 | 130925894 | + | ENST00000372994 | TAF |
| 30% | chr2 | 28190037 | 28190310 | + | chr2 | 28210860 | 28210954 | + | ENST00000436924; ENST00000344773; | TAF |

TABLE 44-continued

Transcript fusion for ovarian cancer (OV) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 30% | chr2 | 28190037 | 28190310 | + | chr2 | 28210860 | 28210954 | + | ENST00000379624; ENST00000342045; ENST00000361704; ENST00000379632; ENST00000379629; ENST00000604932 ENST00000436924; ENST00000344773; | TAF |
| 30% | chr2 | 28190037 | 28190310 | + | chr2 | 28210860 | 28210954 | + | ENST00000379624; ENST00000342045; ENST00000361704; ENST00000379632; ENST00000379629; ENST00000604932 ENST00000436924; ENST00000344773; | TAF |
| 30% | chr2 | 28190037 | 28190310 | + | chr2 | 28210860 | 28210954 | + | ENST00000379624; ENST00000342045; ENST00000361704; ENST00000379632; ENST00000379629; ENST00000604932 ENST00000436924; ENST00000344773; | TAF |
| 30% | chr2 | 28190037 | 28190310 | + | chr2 | 28210860 | 28210954 | + | ENST00000379624; ENST00000342045; ENST00000361704; ENST00000379632; ENST00000379629; ENST00000604932 ENST00000436924; ENST00000344773; | TAF |
| 30% | chr2 | 28190037 | 28190310 | + | chr2 | 28210860 | 28210954 | + | ENST00000379624; ENST00000342045; ENST00000361704; ENST00000379632; ENST00000379629; ENST00000604932 ENST00000436924; ENST00000344773; | TAF |
| 30% | chr19 | 17971608 | 17971652 | + | chr19 | 17972102 | 17972281; 17972116 | + | ENST00000222247; ENST00000600147; ENST00000599898 | TAF |
| 30% | chr19 | 17971608 | 17971652 | + | chr19 | 17972102 | 17972281; 17972116 | + | ENST00000222247; ENST00000600147; ENST00000599898 | TAF |
| 30% | chr19 | 17971608 | 17971652 | + | chr19 | 17972102 | 17972281; 17972116 | + | ENST00000222247; ENST00000600147; ENST00000599898 | TAF |
| 30% | chr12 | 53342573 | 53342523 | − | chr12 | 53298811 | 53298442; 53298460 | − | ENST00000552150; ENST00000546542; | TAF |
| 30% | chr12 | 53342573 | 53342523 | − | chr12 | 53298811 | 53298442; 53298460 | − | ENST00000552150; ENST00000546542; | TAF |
| 30% | chr12 | 53342573 | 53342523 | − | chr12 | 53298811 | 53298442; 53298460 | − | ENST00000552150; ENST00000546542; | TAF |
| 30% | chr19 | 50391349 | 50391391 | + | chr19 | 50391488 | 50391574 | + | ENST00000221543; ENST00000535102 | TAF |
| 28% | chr9 | 130569975 | 130570054 | + | chr9 | 130570513 | 130570590; 130570580 | + | ENST00000373247; ENST00000373245; ENST00000393706; ENST00000373228; ENST00000373225; ENST00000431857; ENST00000423577 | TAF |
| 28% | chr9 | 130569975 | 130570054 | + | chr9 | 130570513 | 130570590; 130570580 | + | ENST00000373247; ENST00000373245; ENST00000393706; ENST00000373228; ENST00000373225; ENST00000431857; ENST00000423577 | TAF |
| 28% | chr9 | 130569975 | 130570054 | + | chr9 | 130570513 | 130570590; 130570580 | + | ENST00000373247; ENST00000373245; ENST00000393706; ENST00000373228; ENST00000373225; ENST00000431857; ENST00000423577 | TAF |
| 28% | chr9 | 130569975 | 130570054 | + | chr9 | 130570513 | 130570590; 130570580 | + | ENST00000373247; ENST00000373245; ENST00000393706; ENST00000373228; ENST00000373225; ENST00000431857; ENST00000423577 | TAF |
| 28% | chr3 | 124842655 | 124842374 | − | chr3 | 124839530 | 124839443 | − | ENST00000430155; ENST00000393469; ENST00000423114; ENST00000469902; ENST00000479826 | TAF |
| 28% | chr3 | 124842655 | 124842374 | − | chr3 | 124839530 | 124839443 | − | ENST00000430155; ENST00000393469; ENST00000423114; ENST00000469902; ENST00000479826 | TAF |
| 27% | chr7 | 73098299 | 73098330 | + | chr7 | 73100966 | 73101061 | + | ENST00000265758; ENST00000432522; ENST00000421744; ENST00000428163; ENST00000423166; ENST00000423497 | TAF |
| 27% | chr7 | 73098299 | 73098330 | + | chr7 | 73100966 | 73101061 | + | ENST00000265758; ENST00000432522; ENST00000421744; ENST00000428163; ENST00000423166; ENST00000423497 | TAF |
| 27% | chr7 | 73098299 | 73098330 | + | chr7 | 73100966 | 73101061 | + | ENST00000265758; ENST00000432522; ENST00000421744; ENST00000428163; ENST00000423166; ENST00000423497 | TAF |
| 27% | chr7 | 73098299 | 73098330 | + | chr7 | 73100966 | 73101061 | + | ENST00000265758; ENST00000432522; ENST00000421744; ENST00000428163; ENST00000423166; ENST00000423497 | TAF |
| 27% | chr7 | 73098299 | 73098330 | + | chr7 | 73100966 | 73101061 | + | ENST00000265758; ENST00000432522; ENST00000421744; ENST00000428163; ENST00000423166; ENST00000423497 | TAF |
| 27% | chr19 | 35995931 | 35995843 | − | chr19 | 35994349 | 35994323; 35994334 | − | ENST00000474928; ENST00000488892; ENST00000461300; ENST00000447113; ENST00000392206; ENST00000440396; | TAF |

TABLE 44-continued

Transcript fusion for ovarian cancer (OV) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 27% | chr19 | 35995931 | 35995843 | − | chr19 | 35994349 | 35994323; 35994334 | − | ENST00000458071; ENST00000418261; ENST00000424570; ENST00000451297; ENST00000450261 ENST00000474928; ENST00000488892; ENST00000461300; ENST00000447113; ENST00000392206; ENST00000440396; ENST00000458071; ENST00000418261; ENST00000424570; ENST00000451297; ENST00000450261 | TAF |
| 27% | chr21 | 42597177 | 42597622 | + | chr21 | 42598193 | 42598281 | + | ENST00000328735; ENST00000330333; ENST00000347667 | TAF |
| 27% | chr21 | 42597177 | 42597622 | + | chr21 | 42598193 | 42598281 | + | ENST00000328735; ENST00000330333; ENST00000347667 | TAF |
| 27% | chr21 | 42597177 | 42597622 | + | chr21 | 42598193 | 42598281 | + | ENST00000328735; ENST00000330333; ENST00000347667 | TAF |
| 27% | chr14 | 69863275 | 69863209 | − | chr14 | 69861629 | 69861542 | − | ENST00000557016; ENST00000555373 | TAF |
| 27% | chr14 | 69863275 | 69863209 | − | chr14 | 69861629 | 69861542 | − | ENST00000557016; ENST00000555373 | TAF |
| 26% | chr11 | 321638 | 321504 | − | chr11 | 320772 | 320565 | − | ENST00000399808 | TAF |
| 26% | chr11 | 321488 | 321465 | − | chr11 | 320772 | 320565 | − | ENST00000399808 | TAF |
| 26% | chr11 | 321410 | 321387 | − | chr11 | 320772 | 320565 | − | ENST00000399808 | TAF |
| 26% | chr11 | 321450 | 321426 | − | chr11 | 320772 | 320565 | − | ENST00000399808 | TAF |
| 26% | chr11 | 321638 | 321543 | − | chr11 | 320772 | 320565 | − | ENST00000399808 | TAF |
| 26% | chr3 | 47700203 | 47700048 | − | chr3 | 47680270 | 47680215 | − | ENST00000254480 | TAF |
| 25% | chr11 | 322580 | 322557 | − | chr11 | 320772 | 320565 | − | ENST00000399808 | TAF |
| 25% | chr11 | 321638 | 321582 | − | chr11 | 320772 | 320565 | − | ENST00000399808 | TAF |
| 25% | chr11 | 321716 | 321660 | − | chr11 | 320772 | 320565 | − | ENST00000399808 | TAF |
| 25% | chr11 | 322067 | 322011 | − | chr11 | 320772 | 320565 | − | ENST00000399808 | TAF |
| 25% | chr11 | 322262 | 322206 | − | chr11 | 320772 | 320565 | − | ENST00000399808 | TAF |
| 25% | chr11 | 321911 | 321855 | − | chr11 | 320772 | 320565 | − | ENST00000399808 | TAF |
| 25% | chr14 | 105944002 | 105944268 | + | chr14 | 105944603 | 105944697 | + | ENST00000483017; ENST00000329146 | TAF |
| 25% | chr6 | 31154067 | 31153803 | − | chr6 | 31133824 | 31133704 | − | ENST00000259915 | TAF |
| 24% | chr14 | 105944002 | 105944250 | + | chr14 | 105944603 | 105944697 | + | ENST00000483017; ENST00000329146 | TAF |
| 24% | chr14 | 105944002 | 105944232 | + | chr14 | 105944603 | 105944697 | + | ENST00000483017; ENST00000329146 | TAF |
| 24% | chr10 | 126455800 | 126455793 | − | chr10 | 126454177 | 126453961 | − | ENST00000494792; ENST00000368836 | TAF |
| 24% | chr10 | 126455800 | 126455793 | − | chr10 | 126454177 | 126453961 | − | ENST00000494792; ENST00000368836 | TAF |
| 24% | chr22 | 22899971 | 22899965 | − | chr22 | 22893511 | 22893189; 22893185; 22893481; 22893274 | − | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |
| 24% | chr22 | 22899971 | 22899965 | − | chr22 | 22893511 | 22893189; 22893185; 22893481; 22893274 | − | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |
| 24% | chr22 | 22899971 | 22899965 | − | chr22 | 22893511 | 22893189; 22893185; 22893481; 22893274 | − | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |
| 24% | chr22 | 22899971 | 22899965 | − | chr22 | 22893511 | 22893189; 22893185; 22893481; 22893274 | − | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |
| 24% | chr22 | 22899971 | 22899965 | − | chr22 | 22893511 | 22893189; 22893185; 22893481; 22893274 | − | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |
| 24% | chr22 | 22899971 | 22899965 | − | chr22 | 22893511 | 22893189; 22893185; 22893481; 22893274 | − | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |
| 24% | chr22 | 22899971 | 22899965 | − | chr22 | 22893511 | 22893189; 22893185; 22893481; 22893274 | − | ENST00000398743; ENST00000398741; ENST00000543184; ENST00000405655; ENST00000402697; ENST00000439106; ENST00000438888; ENST00000420709; ENST00000406503; ENST00000442481; | TSF |

TABLE 44-continued

Transcript fusion for ovarian cancer (OV) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 23% | chr10 | 120902016 | 120901765 | − | chr10 | 120900831 | 120900754 | − | ENST00000403441 ENST00000355697; ENST00000330036 | TAF |
| 23% | chr3 | 185411133 | 185410965 | − | chr3 | 18541087 | 185410487 | − | ENST00000382199; ENST00000421047; ENST00000457616; ENST00000346192 | TAF |
| 23% | chr3 | 185411133 | 185410965 | − | chr3 | 18541087 | 185410487 | − | ENST00000382199; ENST00000421047; ENST00000457616; ENST00000346192 | TAF |
| 23% | chr20 | 110606 | 110697 | + | chr20 | 126056 | 126333 | + | ENST00000382398 | TSF |
| 23% | chr2 | 150044073 | 150044093 | + | chr2 | 150061767 | 150061918 | + | ENST00000409642; ENST00000409876; ENST00000409029; ENST00000442722; ENST00000280115 | TSF |
| 23% | chr2 | 150044073 | 150044093 | + | chr2 | 150061767 | 150061918 | + | ENST00000409642; ENST00000409876; ENST00000409029; ENST00000442722; ENST00000280115 | TSF |
| 22% | chr17 | 80440912 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |
| 22% | chr17 | 80440912 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |
| 22% | chr17 | 80440912 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |
| 22% | chr17 | 80440912 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |
| 22% | chr10 | 89682344 | 89682384 | + | chr10 | 89685270 | 89685314 | + | ENST00000371953 | TAF |
| 21% | chr1 | 33142637 | 33142971 | + | chr1 | 33145241 | 33145306; 33145415; 33145299 | + | ENST00000414241; ENST00000373493; ENST00000544435; ENST00000458695; ENST00000463378; ENST00000460669; ENST00000482190 | TAF |
| 21% | chr1 | 33142637 | 33142971 | + | chr1 | 33145241 | 33145306; 33145415; 33145299 | + | ENST00000414241; ENST00000373493; ENST00000544435; ENST00000458695; ENST00000463378; ENST00000460669; ENST00000482190 | TAF |
| 21% | chr1 | 33142637 | 33142971 | + | chr1 | 33145241 | 33145306; 33145415; 33145299 | + | ENST00000414241; ENST00000373493; ENST00000544435; ENST00000458695; ENST00000463378; ENST00000460669; ENST00000482190 | TAF |
| 21% | chr19 | 39110121 | 39110170 | + | chr19 | 39110977 | 39111075 | + | ENST00000248342; ENST00000588934; ENST00000545173; ENST00000586513; ENST00000592558 | TAF |
| 21% | chr19 | 39110121 | 39110170 | + | chr19 | 39110977 | 39111075 | + | ENST00000248342; ENST00000588934; ENST00000545173; ENST00000586513; ENST00000592558 | TAF |
| 21% | chr19 | 39110121 | 39110170 | + | chr19 | 39110977 | 39111075 | + | ENST00000248342; ENST00000588934; ENST00000545173; ENST00000586513; ENST00000592558 | TAF |
| 21% | chr19 | 39110121 | 39110170 | + | chr19 | 39110977 | 39111075 | + | ENST00000248342; ENST00000588934; ENST00000545173; ENST00000586513; ENST00000592558 | TAF |
| 21% | chr19 | 39110121 | 39110170 | + | chr19 | 39110977 | 39111075 | + | ENST00000248342; ENST00000588934; ENST00000545173; ENST00000586513; ENST00000592558 | TAF |
| 21% | chr10 | 5826921 | 5825287 | − | chr10 | 5815904 | 5815805 | − | ENST00000380191; ENST00000447751; ENST00000380132; ENST00000380181; ENST00000456041 | TAF |
| 21% | chr10 | 5826921 | 5825287 | − | chr10 | 5815904 | 5815805 | − | ENST00000380191; ENST00000447751; ENST00000380132; ENST00000380181; ENST00000456041 | TAF |
| 21% | chr10 | 5826921 | 5825287 | − | chr10 | 5815904 | 5815805 | − | ENST00000380191; ENST00000447751; ENST00000380132; ENST00000380181; ENST00000456041 | TAF |
| 21% | chr20 | 110606 | 110697 | + | chr20 | 126220 | 126333 | + | ENST00000382398 | TSF |
| 20% | chr19 | 50188651 | 50188743 | + | chr19 | 50189350 | 50189500 | + | ENST00000532489; ENST00000391851; ENST00000454376 | TAF |
| 20% | chr19 | 1600051 | 1599987 | − | chr19 | 1599559 | 1599439 | − | ENST00000585937; ENST0000591899; ENST00000589880; ENST00000585671 | TAF |
| 20% | chr1 | 55368856 | 55366719 | − | chr1 | 55349446 | 55349291 | − | ENST00000371269; ENST00000535035 | TSF |
| 20% | chr11 | 32453241 | 32453220 | − | chr11 | 32450165 | 32450043 | − | ENST00000379079; ENST00000379077; ENST00000332351; ENST00000530998; ENST00000452863; ENST00000448076 | TSF |
| 20% | chr11 | 32453241 | 32324520 | − | chr11 | 32450165 | 32450043 | − | ENST00000379079; ENST00000379077; | TSF |

TABLE 44-continued

Transcript fusion for ovarian cancer (OV) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 20% | chr11 | 32453241 | 32324520 | − | chr11 | 32450165 | 32450043 | − | ENST00000332351; ENST00000530998; ENST00000452863; ENST00000448076 ENST00000379079; ENST00000379077 | TSF |
| 20% | chr11 | 32453241 | 32324520 | − | chr11 | 32450165 | 32450043 | − | ENST00000332351; ENST00000530998; ENST00000452863; ENST00000448076 ENST00000379079; ENST00000379077 | TSF |
| 20% | chr11 | 32453241 | 32324520 | − | chr11 | 32450165 | 32450043 | − | ENST00000332351; ENST00000530998; ENST00000452863; ENST00000448076 ENST00000379079; ENST00000379077 | TSF |
| 20% | chr6 | 71556614 | 71556625 | + | chr6 | 71562243 | 71562367 | + | ENST00000316999; ENST00000370452; ENST00000370455 | TSF |
| 20% | chr6 | 71556614 | 71556625 | + | chr6 | 71562243 | 71562367 | + | ENST00000316999; ENST00000370452; ENST00000370455 | TSF |
| 18% | chr1 | 40781678 | 40781517 | − | chr1 | 40781336 | 40781262 | − | ENST00000372748; ENST00000417105; ENST00000372736 | TAF |
| 18% | chr1 | 40781678 | 40781517 | − | chr1 | 40781336 | 40781262 | − | ENST00000372748; ENST00000417105; ENST00000372736 | TAF |
| 18% | chr1 | 40781678 | 40781517 | − | chr1 | 40781336 | 40781262 | − | ENST00000372748; ENST00000417105; ENST00000372736 | TAF |
| 18% | chr5 | 10732874 | 10732658 | − | chr5 | 10683683 | 10683641 | − | ENST00000230895 | TAF |
| 17% | chr1 | 21901654 | 21901670 | + | chr1 | 21902226 | 21902417 | + | ENST00000539907; ENST00000540617; ENST00000374840; ENST00000374832; ENST00000425315 | TAF |
| 17% | chr1 | 155036912 | 155037036 | + | chr1 | 155039206 | 155039492 | + | ENST00000368409; ENST00000359751; ENST00000427683 | TAF |
| 17% | chr1 | 155036912 | 155037036 | + | chr1 | 155039206 | 155039492 | + | ENST00000368409; ENST00000359751; ENST00000427683 | TAF |
| 17% | chr1 | 155036912 | 155037036 | + | chr1 | 155039206 | 155039492 | + | ENST00000368409; ENST00000359751; ENST00000427683 | TAF |
| 17% | chr19 | 55649945 | 55649877 | − | chr19 | 55649442 | 55649329; 55649344; 55649386 | − | ENST00000587758; ENST00000291901; ENST00000356783; ENST00000588426; ENST00000536926; ENST00000588981; ENST00000593194; ENST00000589745; ENST00000587465; ENST00000585321; ENST00000593046; ENST00000589226; ENST00000588147 | TAF |
| 17% | chr19 | 55649945 | 55649877 | − | chr19 | 55649442 | 55649329; 55649344; 55649386 | − | ENST00000587758; ENST00000291901; ENST00000356783; ENST00000588426; ENST00000536926; ENST00000588981; ENST00000593194; ENST00000589745; ENST00000587465; ENST00000585321; ENST00000593046; ENST00000589226; ENST00000588147 | TAF |
| 17% | chr19 | 55649945 | 55649877 | − | chr19 | 55649442 | 55649329; 55649344; 55649386 | − | ENST00000587758; ENST00000291901; ENST00000356783; ENST00000588426; ENST00000536926; ENST00000588981; ENST00000593194; ENST00000589745; ENST00000587465; ENST00000585321; ENST00000593046; ENST00000589226; ENST00000588147 | TAF |
| 17% | chr19 | 55649945 | 55649877 | − | chr19 | 55649442 | 55649329; 55649344; 55649386 | − | ENST00000587758; ENST00000291901; ENST00000356783; ENST00000588426; ENST00000536926; ENST00000588981; ENST00000593194; ENST00000589745; ENST00000587465; ENST00000585321; ENST00000593046; ENST00000589226; ENST00000588147 | TAF |
| 17% | chr19 | 55649945 | 55649877 | − | chr19 | 55649442 | 55649329; 55649344; 55649386 | − | ENST00000587758; ENST00000291901; ENST00000356783; ENST00000588426; ENST00000536926; ENST00000588981; ENST00000593194; ENST00000589745; ENST00000587465; ENST00000585321; ENST00000593046; ENST00000589226; ENST00000588147 | TAF |
| 17% | chr12 | 123873690 | 123873729 | + | chr12 | 123873980 | 123874101 | + | ENST00000330479; ENST00000402868 | TSF |
| 17% | chr1 | 44446234 | 44446286 | + | chr1 | 44446781 | 44447145 | + | ENST00000309519 | TSF |
| 16% | chr2 | 28200909 | 28201241 | + | chr2 | 28210860 | 28210954 | + | ENST00000436924; ENST00000344773; ENST00000379624; ENST00000342045; ENST00000361704; ENST00000379632; ENST00000379629; ENST00000604932 | TAF |
| 16% | chr2 | 28200909 | 28201241 | + | chr2 | 28210860 | 28210954 | + | ENST00000436924; ENST00000344773; ENST00000379624; ENST00000342045; ENST00000361704; ENST00000379632; ENST00000379629; ENST00000604932 | TAF |

TABLE 44-continued

Transcript fusion for ovarian cancer (OV) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 16% | chr2 | 28200909 | 28201241 | + | chr2 | 28210860 | 28210954 | + | ENST00000436924; ENST00000344773; ENST00000379624; ENST00000342045; ENST00000361704; ENST00000379632; ENST00000379629; ENST00000604932 | TAF |
| 16% | chr2 | 28200909 | 28201241 | + | chr2 | 28210860 | 28210954 | + | ENST00000436924; ENST00000344773; ENST00000379624; ENST00000342045; ENST00000361704; ENST00000379632; ENST00000379629; ENST00000604932 | TAF |
| 16% | chr2 | 28200909 | 28201241 | + | chr2 | 28210860 | 28210954 | + | ENST00000436924; ENST00000344773; ENST00000379624; ENST00000342045; ENST00000361704; ENST00000379632; ENST00000379629; ENST00000604932 | TAF |
| 16% | chr2 | 28200909 | 28201241 | + | chr2 | 28210860 | 28210954 | + | ENST00000436924; ENST00000344773; ENST00000379624; ENST00000342045; ENST00000361704; ENST00000379632; ENST00000379629; ENST00000604932 | TAF |
| 16% | chr8 | 104389530 | 104389551 | + | chr8 | 104390255 | 104390471 | + | ENST00000330295; ENST00000520337 | TAF |
| 16% | chr5 | 179238653 | 179238682 | + | chr5 | 179249989 | 179250053 | + | ENST00000389805; ENST00000504627; ENST00000510187 | TAF |
| 16% | chr5 | 179238653 | 179238682 | + | chr5 | 179249989 | 179250053 | + | ENST00000389805; ENST00000504627; ENST00000510187 | TAF |
| 16% | chr5 | 179238653 | 179238682 | + | chr5 | 179249989 | 179250053 | + | ENST00000389805; ENST00000504627; ENST00000510187 | TAF |
| 16% | chr7 | 99747312 | 99747315 | + | chr7 | 99751023 | 99751140; 99751352 | + | ENST00000341942; ENST00000441173 | TAF |
| 16% | chr7 | 99747312 | 99747315 | + | chr7 | 99751023 | 99751140; 99751352 | + | ENST00000341942; ENST00000441173 | TAF |
| 16% | chr1 | 27228495 | 27228857 | + | chr1 | 27250580 | 27250657 | + | ENST00000435827; ENST00000321265 | TAF |
| 16% | chr1 | 27228495 | 27228857 | + | chr1 | 27250580 | 27250657 | + | ENST00000435827; ENST00000321265 | TAF |
| 16% | chr2 | 62197111 | 62197160 | + | chr2 | 62227836 | 62228117 | + | ENST00000311832; ENST00000538736 | TAF |
| 16% | chr2 | 62197111 | 62197160 | + | chr2 | 62227836 | 62228117 | + | ENST00000311832; ENST00000538736 | TAF |
| 16% | chr15 | 66170740 | 66170790 | + | chr15 | 66172009 | 66172089; 66172017 | + | ENST00000564910; ENST00000261890; ENST00000569896; ENST00000567671 | TSF |
| 16% | chr15 | 66170740 | 66170790 | + | chr15 | 66172009 | 66172089; 66172017 | + | ENST00000564910; ENST00000261890; ENST00000569896; ENST00000567671 | TSF |
| 16% | chr15 | 66170740 | 66170790 | + | chr15 | 66172009 | 66172089; 66172017 | + | ENST00000564910; ENST00000261890; ENST00000569896; ENST00000567671 | TSF |
| 16% | chr7 | 56018506 | 56018522 | + | chr7 | 56020872 | 56021011 | + | ENST00000426595 | TSF |
| 15% | chr7 | 130127044 | 130127065 | + | chr7 | 130135209 | 130135363 | + | ENST00000223215; ENST00000437945 | TAF |
| 15% | chr7 | 130127044 | 130127065 | + | chr7 | 130135209 | 130135363 | + | ENST00000223215; ENST00000437945 | TAF |
| 15% | chr13 | 43628887 | 43629679 | + | chr13 | 43639822 | 43639873 | + | ENST00000379221 | TAF |
| 15% | chr19 | 5902574 | 5902426 | − | chr19 | 5897008 | 5896916 | − | ENST00000592091; ENST00000585661; ENST00000586349; ENST00000418389; ENST00000592634; ENST00000308961 | TAF |
| 15% | chr19 | 5902574 | 5902426 | − | chr19 | 5897008 | 5896916 | − | ENST00000592091; ENST00000585661; ENST00000586349; ENST00000418389; ENST00000592634; ENST00000308961 | TAF |
| 15% | chr19 | 5902574 | 5902426 | − | chr19 | 5897008 | 5896916 | − | ENST00000592091; ENST00000585661; ENST00000586349; ENST00000418389; ENST00000592634; ENST00000308961 | TAF |
| 15% | chr19 | 5902574 | 5902426 | − | chr19 | 5897008 | 5896916 | − | ENST00000592091; ENST00000585661; ENST00000586349; ENST00000418389; ENST00000592634; ENST00000308961 | TAF |
| 15% | chr19 | 5902574 | 5902426 | − | chr19 | 5897008 | 5896916 | − | ENST00000592091; ENST00000585661; ENST00000586349; ENST00000418389; ENST00000592634; ENST00000308961 | TAF |
| 15% | chr19 | 5902574 | 5902426 | − | chr19 | 5897008 | 5896916 | − | ENST00000592091; ENST00000585661; ENST00000586349; ENST00000418389; ENST00000592634; ENST00000308961 | TAF |
| 15% | chr2 | 9737072 | 9736908 | − | chr2 | 9731644 | 9731521 | − | ENST00000381844; ENST00000238081; ENST00000446619 | TAF |
| 15% | chr2 | 9737072 | 9736908 | − | chr2 | 9731644 | 9731521 | − | ENST00000381844; ENST00000238081; ENST00000446619 | TAF |
| 14% | chr19 | 41816860 | 41816920 | + | chr19 | 41822289 | 41822744 | + | ENST00000269967 | |
| 14% | chr3 | 195444683 | 195445067 | + | chr3 | 195451551 | 195453443; 195452030 | + | ENST00000447234; ENST00000320736; ENST00000436408 | TAF |
| 14% | chr3 | 195444683 | 195445067 | + | chr3 | 195451551 | 195453443; 195452030 | + | ENST00000447234; ENST00000320736; ENST00000436408 | TAF |
| 14% | chr3 | 195444683 | 195445067 | + | chr3 | 195451551 | 195453443; 195452030 | + | ENST00000447234; ENST00000320736; ENST00000436408 | TAF |
| 14% | chr20 | 55970013 | 55970039 | + | chr20 | 55982599 | 55982902; 55982603 | + | ENST00000356208; ENST00000440234; ENST00000371219 | TAF |
| 14% | chr20 | 55970013 | 55970039 | + | chr20 | 55982599 | 55982902; 55982603 | + | ENST00000356208; ENST00000440234; ENST00000371219 | TAF |
| 14% | chr5 | 823586 | 823504 | − | chr5 | 822010 | 821976 | − | ENST00000424784; ENST00000283441 | |
| 14% | chr19 | 17384225 | 17384260 | + | chr19 | 17384713 | 17384833; | + | ENST00000598188; ENST00000594247; | TSF |

TABLE 44-continued

Transcript fusion for ovarian cancer (OV) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| | | | | | | | 17384754; 17384789 | | ENST00000359435; ENST00000596542; ENST00000599474; ENST00000599057; ENST00000447614; ENST00000601043; ENST00000596335; ENST00000601436; ENST00000601938; ENST00000602066; ENST00000598567 | |
| 14% | chr19 | 17384225 | 17384260 | + | chr19 | 17384713 | 17384833; 17384754; 17384789 | + | ENST00000598188; ENST00000594247; ENST00000359435; ENST00000596542; ENST00000599474; ENST00000599057; ENST00000447614; ENST00000601043; ENST00000596335; ENST00000601436; ENST00000601938; ENST00000602066; ENST00000598567 | TSF |
| 14% | chr19 | 17384225 | 17384260 | + | chr19 | 17384713 | 17384833; 17384754; 17384789 | + | ENST00000598188; ENST00000594247; ENST00000359435; ENST00000596542; ENST00000599474; ENST00000599057; ENST00000447614; ENST00000601043; ENST00000596335; ENST00000601436; ENST00000601938; ENST00000602066; ENST00000598567 | TSF |
| 14% | chr19 | 17384225 | 17384260 | + | chr19 | 17384713 | 17384833; 17384754; 17384789 | + | ENST00000598188; ENST00000594247; ENST00000359435; ENST00000596542; ENST00000599474; ENST00000599057; ENST00000447614; ENST00000601043; ENST00000596335; ENST00000601436; ENST00000601938; ENST00000602066; ENST00000598567 | TSF |
| 14% | chr19 | 17384225 | 17384260 | + | chr19 | 17384713 | 17384833; 17384754; 17384789 | + | ENST00000598188; ENST00000594247; ENST00000359435; ENST00000596542; ENST00000599474; ENST00000599057; ENST00000447614; ENST00000601043; ENST00000596335; ENST00000601436; ENST00000601938; ENST00000602066; ENST00000598567 | TSF |
| 14% | chr19 | 17384225 | 17384260 | + | chr19 | 17384713 | 17384833; 17384754; 17384789 | + | ENST00000598188; ENST00000594247; ENST00000359435; ENST00000596542; ENST00000599474; ENST00000599057; ENST00000447614; ENST00000601043; ENST00000596335; ENST00000601436; ENST00000601938; ENST00000602066; ENST00000598567 | TSF |
| 14% | chr19 | 17384225 | 17384260 | + | chr19 | 17384713 | 17384833; 17384754; 17384789 | + | ENST00000598188; ENST00000594247; ENST00000359435; ENST00000596542; ENST00000599474; ENST00000599057; ENST00000447614; ENST00000601043; ENST00000596335; ENST00000601436; ENST00000601938; ENST00000602066; ENST00000598567 | TSF |
| 14% | chr19 | 17384225 | 17384260 | + | chr19 | 17384713 | 17384833; 17384754; 17384789 | + | ENST00000598188; ENST00000594247; ENST00000359435; ENST00000596542; ENST00000599474; ENST00000599057; ENST00000447614; ENST00000601043; ENST00000596335; ENST00000601436; ENST00000601938; ENST00000602066; ENST00000598567 | TSF |
| 14% | chr19 | 17384225 | 17384260 | + | chr19 | 17384713 | 17384833; 17384754; 17384789 | + | ENST00000598188; ENST00000594247; ENST00000359435; ENST00000596542; ENST00000599474; ENST00000599057; ENST00000447614; ENST00000601043; ENST00000596335; ENST00000601436; ENST00000601938; ENST00000602066; ENST00000598567 | TSF |
| 14% | chr19 | 17384225 | 17384260 | + | chr19 | 17384713 | 17384833; 17384754; 17384789 | + | ENST00000598188; ENST00000594247; ENST00000359435; ENST00000596542; ENST00000599474; ENST00000599057; ENST00000447614; ENST00000601043; ENST00000596335; ENST00000601436; ENST00000601938; ENST00000602066; ENST00000598567 | TSF |

TABLE 44-continued

Transcript fusion for ovarian cancer (OV) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 14% | chr1 | 53070435 | 53070501 | + | chr1 | 53072356 | 53072617 | + | ENST00000361314 | TSF |
| 14% | chr19 | 39347374 | 39346206 | − | chr19 | 39338074 | 39337956 | − | ENST00000221419; ENST00000601449; ENST00000600233; ENST00000601813 | TSF |
| 14% | chr19 | 39347374 | 39346206 | − | chr19 | 39338074 | 39337956 | − | ENST00000221419; ENST00000601449; ENST00000600233; ENST00000601813 | TSF |
| 14% | chr19 | 39347374 | 39346206 | − | chr19 | 39338074 | 39337956 | − | ENST00000221419; ENST00000601449; ENST00000600233; ENST00000601813 | TSF |
| 14% | chrX | 47057962 | 47058027 | + | chrX | 47058202 | 47058318 | + | ENST00000377351; ENST00000412206; ENST00000427561; ENST00000442035; ENST00000457753; ENST00000335972; ENST00000451702 | TSF |
| 14% | chrX | 47057962 | 47058027 | + | chrX | 47058202 | 47058318 | + | ENST00000377351; ENST00000412206; ENST00000427561; ENST00000442035; ENST00000457753; ENST00000335972; ENST00000451702 | TSF |
| 14% | chrX | 47057962 | 47058027 | + | chrX | 47058202 | 47058318 | + | ENST00000377351; ENST00000412206; ENST00000427561; ENST00000442035; ENST00000457753; ENST00000335972; ENST00000451702 | TSF |
| 14% | chrX | 47057962 | 47058027 | + | chrX | 47058202 | 47058318 | + | ENST00000377351; ENST00000412206; ENST00000427561; ENST00000442035; ENST00000457753; ENST00000335972; ENST00000451702 | TSF |
| 14% | chrX | 47057962 | 47058027 | + | chrX | 47058202 | 47058318 | + | ENST00000377351; ENST00000412206; ENST00000427561; ENST00000442035; ENST00000457753; ENST00000335972; ENST00000451702 | TSF |
| 14% | chrX | 47057962 | 47058027 | + | chrX | 47058202 | 47058318 | + | ENST00000377351; ENST00000412206; ENST00000427561; ENST00000442035; ENST00000457753; ENST00000335972; ENST00000451702 | TSF |
| 14% | chr1 | 206288369 | 206288105 | − | chr1 | 206243250 | 206243150 | − | ENST00000331555 | TSF |
| 13% | chr19 | 16267516 | 16267566 | + | chr19 | 16268020 | 16268208; 16268205; 16268448; 16268139 | + | ENST00000253680; ENST00000397372; ENST00000593154; ENST00000588246; ENST00000593031 | TAF |
| 13% | chr19 | 16267516 | 16267566 | + | chr19 | 16268020 | 16268208; 16268205; 16268448; 16268139 | + | ENST00000253680; ENST00000397372; ENST00000593154; ENST00000588246; ENST00000593031 | TAF |
| 13% | chr19 | 16267516 | 16267566 | + | chr19 | 16268020 | 16268208; 16268205; 16268448; 16268139 | + | ENST00000253680; ENST00000397372; ENST00000593154; ENST00000588246; ENST00000593031 | TAF |
| 13% | chr19 | 16267516 | 16267566 | + | chr19 | 16268020 | 16268208; 16268205; 16268448; 16268139 | + | ENST00000253680; ENST00000397372; ENST00000593154; ENST00000588246; ENST00000593031 | TAF |
| 13% | chr8 | 126162241 | 126168340 | + | chr8 | 126194345 | 126194498 | + | ENST00000523741; ENST00000517532; ENST00000287437; ENST00000522563; ENST00000517315 | TAF |
| 13% | chr8 | 126162241 | 126168340 | + | chr8 | 126194345 | 126194498 | + | ENST00000523741; ENST00000517532; ENST00000287437; ENST00000522563; ENST00000517315 | TAF |
| 13% | chr8 | 126162241 | 126168340 | + | chr8 | 126194345 | 126194498 | + | ENST00000523741; ENST00000517532; ENST00000287437; ENST00000522563; ENST00000517315 | TAF |
| 13% | chr11 | 424193 | 423942 | − | chr11 | 421198 | 421141 | − | ENST00000332826 | TAF |
| 13% | chr1 | 2124338 | 2124284 | − | chr1 | 2121196 | 2121152; 2121148 | − | ENST00000414253; ENST00000378546; ENST00000378545 | TAF |
| 13% | chr1 | 2124338 | 2124284 | − | chr1 | 2121196 | 2121152; 2121148 | − | ENST00000414253; ENST00000378546; ENST00000378545 | TAF |
| 13% | chr12 | 56110428 | 56110523 | + | chr12 | 56110717 | 56110789 | + | ENST00000257899; ENST00000550412; ENST00000548925; ENST00000549147 | TAF |
| 13% | chr12 | 56110428 | 56110523 | + | chr12 | 56110717 | 56110789 | + | ENST00000257899; ENST00000550412; ENST00000548925; ENST00000549147 | TAF |
| 13% | chr12 | 56110428 | 56110523 | + | chr12 | 56110717 | 56110789 | + | ENST00000257899; ENST00000550412; ENST00000548925; ENST00000549147 | TAF |
| 13% | chr3 | 197680391 | 197680531 | + | chr | 197680874 | 197681018; 197680991 | + | ENST00000464167; ENST00000448864; ENST00000442341 | TAF |
| 13% | chr3 | 197680391 | 197680531 | + | chr3 | 197680874 | 197681018; 197680991 | + | ENST00000464167; ENST00000448864; ENST00000442341 | TAF |
| 13% | chr12 | 120900591 | 12098393 | − | chr12 | 120899965 | 120899822 | − | ENST00000229390 | TAF |
| 13% | chr11 | 61196480 | 61196370 | − | chr11 | 61189080 | 61188862 | − | ENST00000340437; ENST00000394888; ENST00000439958; ENST00000448745; ENST00000477890; ENST00000539952; | TSF |

TABLE 44-continued

Transcript fusion for ovarian cancer (OV) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 13% | chr11 | 61196480 | 61196370 | – | chr11 | 61189080 | 61188862 | – | ENST00000535222; ENST00000544990; ENST00000544585; ENST00000413232; ENST00000537162; ENST00000543545; ENST00000541963; ENST00000536548; ENST00000450000; ENST00000449811; ENST00000413184; ENST00000536145 ENST00000340437; ENST00000394888; ENST00000439958; ENST00000448745; ENST00000477890; ENST00000539952; ENST00000535222; ENST00000544990; ENST00000544585; ENST00000413232; ENST00000537162; ENST00000543545; ENST00000541963; ENST00000536548; ENST00000450000; ENST00000449811; ENST00000413184; ENST00000536145 | TSF |
| 13% | chr11 | 61196480 | 61196370 | – | chr11 | 61189080 | 61188862 | – | ENST00000340437; ENST00000394888; ENST00000439958; ENST00000448745; ENST00000477890; ENST00000539952; ENST00000535222; ENST00000544990; ENST00000544585; ENST00000413232; ENST00000537162; ENST00000543545; ENST00000541963; ENST00000536548; ENST00000450000; ENST00000449811; ENST00000413184; ENST00000536145 | TSF |
| 13% | chr11 | 61196480 | 61196370 | – | chr11 | 61189080 | 61188862 | – | ENST00000340437; ENST00000394888; ENST00000439958; ENST00000448745; ENST00000477890; ENST00000539952; ENST00000535222; ENST00000544990; ENST00000544585; ENST00000413232; ENST00000537162; ENST00000543545; ENST00000541963; ENST00000536548; ENST00000450000; ENST00000449811; ENST00000413184; ENST00000536145 | TSF |
| 13% | chr11 | 61196480 | 61196370 | – | chr11 | 61189080 | 61188862 | – | ENST00000340437; ENST00000394888; ENST00000439958; ENST00000448745; ENST00000477890; ENST00000539952; ENST00000535222; ENST00000544990; ENST00000544585; ENST00000413232; ENST00000537162; ENST00000543545; ENST00000541963; ENST00000536548; ENST00000450000; ENST00000449811; ENST00000413184; ENST00000536145 | TSF |
| 13% | chr11 | 61196480 | 61196370 | – | chr11 | 61189080 | 61188862 | – | ENST00000340437; ENST00000394888; ENST00000439958; ENST00000448745; ENST00000477890; ENST00000539952; ENST00000535222; ENST00000544990; ENST00000544585; ENST00000413232; ENST00000537162; ENST00000543545; ENST00000541963; ENST00000536548; ENST00000450000; ENST00000449811; ENST00000413184; ENST00000536145 | TSF |
| 13% | chr11 | 61196480 | 61196370 | – | chr11 | 61189080 | 61188862 | – | ENST00000340437; ENST00000394888; ENST00000439958; ENST00000448745; ENST00000477890; ENST00000539952; ENST00000535222; ENST00000544990; ENST00000544585; ENST00000413232; ENST00000537162; ENST00000543545; ENST00000541963; ENST00000536548; ENST00000450000; ENST00000449811; ENST00000413184; ENST00000536145 | TSF |
| 13% | chr11 | 61196480 | 61196370 | – | chr11 | 61189080 | 61188862 | – | ENST00000340437; ENST00000394888; ENST00000439958; ENST00000448745; ENST00000477890; ENST00000539952; ENST00000535222; ENST00000544990; ENST00000544585; ENST00000413232; ENST00000537162; ENST00000543545; ENST00000541963; ENST00000536548; ENST00000450000; ENST00000449811; ENST00000413184; ENST00000536145 | TSF |
| 13% | chr11 | 61196480 | 61196370 | – | chr11 | 61189080 | 61188862 | – | ENST00000340437; ENST00000394888; ENST00000439958; ENST00000448745; ENST00000477890; ENST00000539952; ENST00000535222; ENST00000544990; ENST00000544585; ENST00000413232; ENST00000537162; ENST00000543545; ENST00000541963; ENST00000536548; | TSF |

TABLE 44-continued

Transcript fusion for ovarian cancer (OV) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 13% | chr11 | 61196480 | 61196370 | – | chr11 | 61189080 | 61188862 | – | ENST00000450000; ENST00000449811; ENST00000413184; ENST00000536145 ENST00000340437; ENST00000394888; ENST00000439958; ENST00000448745; ENST00000477890; ENST00000539952; ENST00000535222; ENST00000544990; ENST00000544585; ENST00000413232; ENST00000537162; ENST00000543545; ENST00000541963; ENST00000536548; | TSF |
| 13% | chr11 | 61196480 | 61196370 | – | chr11 | 61189080 | 61188862 | – | ENST00000450000; ENST00000449811; ENST00000413184; ENST00000536145 ENST00000340437; ENST00000394888; ENST00000439958; ENST00000448745; ENST00000477890; ENST00000539952; ENST00000535222; ENST00000544990; ENST00000544585; ENST00000413232; ENST00000537162; ENST00000543545; ENST00000541963; ENST00000536548; | TSF |
| 13% | chr11 | 61196480 | 61196370 | – | chr11 | 61189080 | 61188862 | – | ENST00000450000; ENST00000449811; ENST00000413184; ENST00000536145 ENST00000340437; ENST00000394888; ENST00000439958; ENST00000448745; ENST00000477890; ENST00000539952; ENST00000535222; ENST00000544990; ENST00000544585; ENST00000413232; ENST00000537162; ENST00000543545; ENST00000541963; ENST00000536548; | TSF |
| 13% | chr11 | 61196480 | 61196370 | – | chr11 | 61189080 | 61188862 | – | ENST00000450000; ENST00000449811; ENST00000413184; ENST00000536145 ENST00000340437; ENST00000394888; ENST00000439958; ENST00000448745; ENST00000477890; ENST00000539952; ENST00000535222; ENST00000544990; ENST00000544585; ENST00000413232; ENST00000537162; ENST00000543545; ENST00000541963; ENST00000536548; | TSF |
| 13% | chr11 | 61196480 | 61196370 | – | chr11 | 61189080 | 61188862 | – | ENST00000450000; ENST00000449811; ENST00000413184; ENST00000536145 ENST00000340437; ENST00000394888; ENST00000439958; ENST00000448745; ENST00000477890; ENST00000539952; ENST00000535222; ENST00000544990; ENST00000544585; ENST00000413232; ENST00000537162; ENST00000543545; ENST00000541963; ENST00000536548; | TSF |
| 13% | chr11 | 61196480 | 61196370 | – | chr11 | 61189080 | 61188862 | – | ENST00000450000; ENST00000449811; ENST00000413184; ENST00000536145 ENST00000340437; ENST00000394888; ENST00000439958; ENST00000448745; ENST00000477890; ENST00000539952; ENST00000535222; ENST00000544990; ENST00000544585; ENST00000413232; ENST00000537162; ENST00000543545; ENST00000541963; ENST00000536548; | TSF |
| 12% | chr3 | 146238022 | 146237953 | – | chr3 | 146234951 | 146234793; 146234876; 146234936; 146234945 | – | ENST00000342435; ENST00000487389; ENST00000448787; ENST00000483300; ENST00000462666; ENST00000486631; ENST00000472349 | TAF |
| 12% | chr3 | 146238022 | 146237953 | – | chr3 | 146234951 | 146234793; 146234876; 146234936; 146234945 | – | ENST00000342435; ENST00000487389; ENST00000448787; ENST00000483300; ENST00000462666; ENST00000486631; ENST00000472349 | TAF |
| 12% | chr3 | 146238022 | 146237953 | – | chr3 | 146234951 | 146234793; 146234876; 146234936; 146234945 | – | ENST00000342435; ENST00000487389; ENST00000448787; ENST00000483300; ENST00000462666; ENST00000486631; ENST00000472349 | TAF |
| 12% | chr3 | 146238022 | 146237953 | – | chr3 | 146234951 | 146234793; 146234876; 146234936; 146234945 | – | ENST00000342435; ENST00000487389; ENST00000448787; ENST00000483300; ENST00000462666; ENST00000486631; ENST00000472349 | TAF |
| 12% | chr3 | 146238022 | 146237953 | – | chr3 | 146234951 | 146234793; 146234876; 146234936; 146234945 | – | ENST00000342435; ENST00000487389; ENST00000448787; ENST00000483300; ENST00000462666; ENST00000486631; ENST00000472349 | TAF |

TABLE 44-continued

Transcript fusion for ovarian cancer (OV) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 12% | chr22 | 45064651 | 45064685 | + | chr22 | 45098488 | 45098488 | + | ENST00000403581; ENST00000336985; ENST00000403696; ENST00000431834; ENST00000361473; ENST00000352766; ENST00000517296 | TAF |
| 12% | chr22 | 45064651 | 45064685 | + | chr22 | 45098488 | 45098488 | + | ENST00000403581; ENST00000336985; ENST00000403696; ENST00000431834; ENST00000361473; ENST00000352766; ENST00000517296 | TAF |
| 12% | chr22 | 45064651 | 45064685 | + | chr22 | 45098488 | 45098488 | + | ENST00000403581; ENST00000336985; ENST00000403696; ENST00000431834; ENST00000361473; ENST00000352766; ENST00000517296 | TAF |
| 12% | chr22 | 45064651 | 45064685 | + | chr22 | 45098488 | 45098488 | + | ENST00000403581; ENST00000336985; ENST00000403696; ENST00000431834; ENST00000361473; ENST00000352766; ENST00000517296 | TAF |
| 12% | chr22 | 45064651 | 45064685 | + | chr22 | 45098488 | 45098488 | + | ENST00000403581; ENST00000336985; ENST00000403696; ENST00000431834; ENST00000361473; ENST00000352766; ENST00000517296 | TAF |
| 12% | chr17 | 79214190 | 79214239 | + | chr17 | 79214787 | 79214816; 79214953 | + | ENST00000431388; ENST00000576002 | TAF |
| 12% | chr17 | 79214190 | 79214239 | + | chr17 | 79214787 | 79214816; 79214953 | + | ENST00000431388; ENST00000576002 | TAF |
| 12% | chr10 | 3122429 | 3122494 | + | chr10 | 3124580 | 3124653 | + | ENST00000381125; ENST00000381075 | TAF |
| 12% | chr10 | 3122429 | 3122494 | + | chr10 | 3124580 | 3124653 | + | ENST00000381125; ENST00000381075 | TAF |
| 12% | chr2 | 242174499 | 242174121 | − | chr2 | 242173378 | 242173235; 242173268 | − | ENST00000391975; ENST00000391976; ENST00000310931; ENST00000427183; ENST00000373292 | TAF |
| 12% | chr2 | 242174499 | 242174121 | − | chr2 | 242173378 | 242173235; 242173268 | − | ENST00000391975; ENST00000391976; ENST00000310931; ENST00000427183; ENST00000373292 | TAF |
| 12% | chr2 | 161411930 | 161411748 | − | chr2 | 161223902 | 161223727 | − | ENST00000348849; ENST00000392753 | TAF |
| 12% | chr2 | 161411930 | 161411748 | − | chr2 | 161223902 | 161223727 | − | ENST00000348849; ENST00000392753 | TAF |
| 12% | chr3 | 69286305 | 69286248 | − | chr3 | 69273841 | 69273758; 69273834 | − | ENST00000398540; ENST00000542259; ENST00000493880; ENST00000473029; ENST00000460709 | TAF |
| 12% | chr3 | 69286305 | 69286248 | − | chr3 | 69273841 | 69273758; 69273834 | − | ENST00000398540; ENST00000542259; ENST00000493880; ENST00000473029; ENST00000460709 | TAF |
| 12% | chr3 | 69286305 | 69286248 | − | chr3 | 69273841 | 69273758; 69273834 | − | ENST00000398540; ENST00000542259; ENST00000493880; ENST00000473029; ENST00000460709 | TAF |
| 12% | chr3 | 69286305 | 69286248 | − | chr3 | 69273841 | 69273758; 69273834 | − | ENST00000398540; ENST00000542259; ENST00000493880; ENST00000473029; ENST00000460709 | TAF |
| 12% | chr19 | 39347374 | 39346430 | − | chr19 | 39338074 | 39337956 | − | ENST00000221419; ENST00000601449; ENST00000600233; ENST00000601813 | TSF |
| 12% | chr19 | 39347374 | 39346430 | − | chr19 | 39338074 | 39337956 | − | ENST00000221419; ENST00000601449; ENST00000600233; ENST00000601813 | TSF |
| 12% | chr19 | 39347374 | 39346430 | − | chr19 | 39338074 | 39337956 | − | ENST00000221419; ENST00000601449; ENST00000600233; ENST00000601813 | TSF |
| 12% | chrX | 151410500 | 151410406 | − | chrX | 151393317 | 151393235 | − | ENST00000370314; ENST00000535043 | TSF |
| 11% | chrX | 71397824 | 71398498 | + | chrX | 71406311 | 71406384 | + | ENST00000218432; ENST00000423432; ENST00000373669; ENST00000496835; ENST00000439980; ENST00000446576 | TAF |
| 11% | chrX | 71397824 | 71398498 | + | chrX | 71406311 | 71406384 | + | ENST00000218432; ENST00000423432; ENST00000373669; ENST00000496835; ENST00000439980; ENST00000446576 | TAF |
| 11% | chrX | 71397824 | 71398498 | + | chrX | 71406311 | 71406384 | + | ENST00000218432; ENST00000423432; ENST00000373669; ENST00000496835; ENST00000439980; ENST00000446576 | TAF |
| 11% | chrX | 71397824 | 71398498 | + | chrX | 71406311 | 71406384 | + | ENST00000218432; ENST00000423432; ENST00000373669; ENST00000496835; ENST00000439980; ENST00000446576 | TAF |
| 11% | chr22 | 37419605 | 37419606 | + | chr22 | 37420233 | 37420851 | + | ENST00000397129 | TAF |
| 11% | chr1 | 154190418 | 154190416 | − | chr1 | 154187050 | 154186933 | − | ENST00000368521; ENST00000362076; ENST00000350592; ENST00000368519; ENST00000368518; ENST00000368516 | TAF |
| 11% | chr1 | 154190418 | 154190416 | − | chr1 | 154187050 | 154186933 | − | ENST00000368521; ENST00000362076; ENST00000350592; ENST00000368519; ENST00000368518; ENST00000368516 | TAF |
| 11% | chr1 | 154190418 | 154190416 | − | chr1 | 154187050 | 154186933 | − | ENST00000368521; ENST00000362076; ENST00000350592; ENST00000368519; ENST00000368518; ENST00000368516 | TAF |
| 11% | chr15 | 41968651 | 41968463 | − | chr15 | 41815513 | 41815443 | − | ENST00000561603; ENST00000304330; | TAF |

TABLE 44-continued

Transcript fusion for ovarian cancer (OV) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 11% | chr15 | 41968651 | 41968463 | − | chr15 | 41815513 | 41815443 | − | ENST00000561603; ENST00000304330; ENST00000562303 | TAF |
| 11% | chr15 | 41968651 | 41968463 | − | chr15 | 41815513 | 41815443 | − | ENST00000561603; ENST00000304330; ENST00000562303 | TAF |
| 11% | chr17 | 28178819 | 2879069 | + | chr17 | 2883581 | 2883659 | + | ENST00000540393; ENST00000254695; ENST00000366401; ENST00000542807 | TAF |
| 11% | chr2 | 99797199 | 90797170 | − | chr2 | 99790479 | 99790378 | − | ENST00000422537; ENST00000289359; ENST00000409107 | TAF |
| 11% | chr2 | 99797199 | 90797170 | − | chr2 | 99790479 | 99790378 | − | ENST00000422537; ENST00000289359; ENST00000409107 | TAF |
| 11% | chr8 | 74871473 | 74871320 | − | chr8 | 74868289 | 74868146 | − | ENST00000602840; ENST00000518127; ENST00000520242; ENST00000519487; ENST00000284811; ENST00000522337; ENST00000523815; ENST00000519082 | TAF |
| 11% | chr8 | 74871473 | 74871320 | − | chr8 | 74868289 | 74868146 | − | ENST00000602840; ENST00000518127; ENST00000520242; ENST00000519487; ENST00000284811; ENST00000522337; ENST00000523815; ENST00000519082 | TAF |
| 11% | chr8 | 74871473 | 74871320 | − | chr8 | 74868289 | 74868146 | − | ENST00000602840; ENST00000518127; ENST00000520242; ENST00000519487; ENST00000284811; ENST00000522337; ENST00000523815; ENST00000519082 | TAF |
| 11% | chr9 | 130213440 | 130213384 | − | chr9 | 130213083 | 130213010 | − | ENST00000361436; ENST00000536368 | TAF |
| 11% | chr9 | 130213440 | 130213384 | − | chr9 | 130213083 | 130213010 | − | ENST00000361436; ENST00000536368 | TAF |
| 11% | chr6 | 24710791 | 24710723 | − | chr6 | 24709139 | 24709005 | − | ENST00000378119; ENST00000540769; ENST00000378102 | TAF |
| 11% | chr9 | 131002678 | 131002811 | + | chr9 | 131004511 | 131004624 | + | ENST00000475805; ENST00000341179; ENST00000372923; ENST00000393594; ENST00000486160 | TAF |
| 11% | chr9 | 131002678 | 131002811 | + | chr9 | 131004511 | 131004624 | + | ENST00000475805; ENST00000341179; ENST00000372923; ENST00000393594; ENST00000486160 | TAF |
| 10% | chr16 | 603045 | 603077 | + | chr16 | 603343 | 603516 | + | ENST00000219611 | TAF |
| 10% | chr16 | 603045 | 603077 | + | chr16 | 603343 | 603516 | + | ENST00000219611 | TAF |
| 10% | chr16 | 29915789 | 29915910 | + | chr16 | 29916173 | 29916286 | + | ENST00000563177; ENST00000483405; ENST00000308748; ENST00000414952; ENST00000566693 | TAF |
| 10% | chr16 | 29915789 | 29915910 | + | chr16 | 29916173 | 29916286 | + | ENST00000563177; ENST00000483405; ENST00000308748; ENST00000414952; ENST00000566693 | TAF |
| 9% | chr9 | 130921922 | 130922014 | + | chr9 | 130925722 | 130925894 | + | ENST00000372994 | TSF |
| 9% | chr9 | 140122334 | 140122359 | + | chr9 | 140123074 | 140123538 | + | ENST00000445101 | TSF |
| 9% | chr10 | 74437735 | 35744391 | + | chr10 | 35772332 | 35772406 | + | ENST00000374704 | TSF |
| 8% | chr11 | 60978221 | 60978370 | + | chr11 | 60978562 | 60978706 | + | ENST00000325558; ENST00000543505; ENST00000543125 | TSF |
| 8% | chr11 | 60978221 | 60978370 | + | chr11 | 60978562 | 60978706 | + | ENST00000325558; ENST00000543505; ENST00000543125 | TSF |
| 8% | chr11 | 99705060 | 60997199 | + | chr11 | 60997391 | 60997535 | + | ENST00000378149; ENST00000537932 | TSF |
| 8% | chr2 | 19182928 | 28192099 | + | chr2 | 28210860 | 28210954 | + | ENST00000436924; ENST00000344773; ENST00000379624; ENST00000342045; ENST00000361704; ENST00000379632; ENST00000379629; ENST00000604932 | TSF |
| 8% | chr2 | 19182928 | 28192099 | + | chr2 | 28210860 | 28210954 | + | ENST00000436924; ENST00000344773; ENST00000379624; ENST00000342045; ENST00000361704; ENST00000379632; ENST00000379629; ENST00000604932 | TSF |
| 8% | chr2 | 19182928 | 28192099 | + | chr2 | 28210860 | 28210954 | + | ENST00000436924; ENST00000344773; ENST00000379624; ENST00000342045; ENST00000361704; ENST00000379632; ENST00000379629; ENST00000604932 | TSF |
| 8% | chr2 | 19182928 | 28192099 | + | chr2 | 28210860 | 28210954 | + | ENST00000436924; ENST00000344773; ENST00000379624; ENST00000342045; ENST00000361704; ENST00000379632; ENST00000379629; ENST00000604932 | TSF |
| 8% | chr2 | 19182928 | 28192099 | + | chr2 | 28210860 | 28210954 | + | ENST00000436924; ENST00000344773; ENST00000379624; ENST00000342045; ENST00000361704; ENST00000379632; ENST00000379629; ENST00000604932 | TSF |
| 8% | chr2 | 19182928 | 28192099 | + | chr2 | 28210860 | 28210954 | + | ENST00000436924; ENST00000344773; ENST00000379624; ENST00000342045; ENST00000361704; ENST00000379632; ENST00000379629; ENST00000604932 | TSF |
| 8% | chrX | 495405313 | 134953756 | − | chrX | 134950187 | 134950078 | − | ENST00000420087; ENST00000463085; ENST00000370724; ENST00000491480 | TSF |
| 8% | chrX | 495405313 | 134953756 | − | chrX | 134950187 | 134950078 | − | ENST00000420087; ENST00000463085; | TSF |

TABLE 44-continued

Transcript fusion for ovarian cancer (OV) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 7% | chr12 | 53835137 | 53835233 | + | chr12 | 53836479 | 53836517 | + | ENST00000370724; ENST00000491480 ENST00000547368 | TSF |
| 7% | chr15 | 74004214 | 74004264 | + | chr15 | 74005275 | 74005297 | + | ENST00000318443; ENST00000537340; ENST00000318424; ENST00000564751; ENST00000561176; ENST00000559073 | TSF |
| 7% | chr2 | 135414144 | 135414047 | − | chr2 | 135308232 | 135308141 | − | ENST00000281924 | TSF |
| 7% | chr19 | 17551333 | 1755123517 | − | chr19 | 171547736 | 17547267; | − | ENST00000341130; ENST00000594663 | TSF |
| 7% | chr19 | 17551333 | 1755123517 | − | chr19 | 171547736 | 17547267; | − | ENST00000341130; ENST00000594663 | TSF |
| 7% | chr7 | 66386440 | 66386448 | + | chr7 | 66409963 | 66410248; 66410147; 66410019; 66410221; 66410085 | + | ENST00000341567; ENST00000607045; ENST00000433271; ENST00000413593; ENST00000424964; ENST00000418375 | TSF |
| 7% | chr7 | 66386440 | 66386448 | + | chr7 | 66409963 | 66410248; 66410147; 66410019; 66410221; 66410085 | + | ENST00000341567; ENST00000607045; ENST00000433271; ENST00000413593; ENST00000424964; ENST00000418375 | TSF |
| 7% | chr7 | 66386440 | 66386448 | + | chr7 | 66409963 | 66410248; 66410147; 66410019; 66410221; 66410085 | + | ENST00000341567; ENST00000607045; ENST00000433271; ENST00000413593; ENST00000424964; ENST00000418375 | TSF |
| 7% | chr7 | 66386440 | 66386448 | + | chr7 | 66409963 | 66410248; 66410147; 66410019; 66410221; 66410085 | + | ENST00000341567; ENST00000607045; ENST00000433271; ENST00000413593; ENST00000424964; ENST00000418375 | TSF |
| 7% | chr7 | 66386440 | 66386448 | + | chr7 | 66409963 | 66410248; 66410147; 66410019; 66410221; 66410085 | + | ENST00000341567; ENST00000607045; ENST00000433271; ENST00000413593; ENST00000424964; ENST00000418375 | TSF |
| 7% | chr7 | 66386440 | 66386448 | + | chr7 | 66409963 | 66410248; 66410147; 66410019; 66410221; 66410085 | + | ENST00000341567; ENST00000607045; ENST00000433271; ENST00000413593; ENST00000424964; ENST00000418375 | TSF |
| 7% | chr10 | 116126443 | 116126388 | − | chr10 | 116100490 | 116100362 | − | ENST00000304129; ENST00000369271; ENST00000545353; ENST00000419268 | TSF |
| 7% | chr10 | 116126443 | 116126388 | − | chr10 | 116100490 | 116100362 | − | ENST00000304129; ENST00000369271; ENST00000545353; ENST00000419268 | TSF |
| 7% | chr10 | 116126443 | 116126388 | − | chr10 | 116100490 | 116100362 | − | ENST00000304129; ENST00000369271; ENST00000545353; ENST00000419268 | TSF |
| 7% | chr10 | 116126443 | 116126388 | − | chr10 | 116100490 | 116100362 | − | ENST00000304129; ENST00000369271; ENST00000545353; ENST00000419268 | TSF |
| 7% | chr1 | 19672366 | 19672295 | − | chr1 | 19671746 | 19671681 | − | ENST00000401084; ENST00000264203; ENST00000375144; ENST00000375142; ENST00000433834; ENST00000264202; ENST00000413711 | TSF |
| 7% | chr1 | 19672366 | 19672295 | − | chr1 | 19671746 | 19671681 | − | ENST00000401084; ENST00000264203; ENST00000375144; ENST00000375142; ENST00000433834; ENST00000264202; ENST00000413711 | TSF |
| 7% | chr1 | 19672366 | 19672295 | − | chr1 | 19671746 | 19671681 | − | ENST00000401084; ENST00000264203; ENST00000375144; ENST00000375142; ENST00000433834; ENST00000264202; ENST00000413711 | TSF |
| 7% | chr1 | 19672366 | 19672295 | − | chr1 | 19671746 | 19671681 | − | ENST00000401084; ENST00000264203; ENST00000375144; ENST00000375142; ENST00000433834; ENST00000264202; ENST00000413711 | TSF |
| 7% | chrX | 134971303 | 134971306 | − | chrX | 134950187 | 134950078 | − | ENST00000420087; ENST00000463085; ENST00000370724; ENST00000491480 | TSF |
| 7% | chrX | 134971303 | 134971306 | − | chrX | 134950187 | 134950078 | − | ENST00000420087; ENST00000463085; ENST00000370724; ENST00000491480 | TSF |
| 7% | chrX | 134971303 | 134971306 | − | chrX | 134950187 | 134950078 | − | ENST00000420087; ENST00000463085; ENST00000370724; ENST00000491480 | TSF |
| 7% | chrX | 134971303 | 134971006 | − | chrX | 134967437 | 134967328 | − | ENST00000491002; ENST00000448053; ENST00000472834 | TSF |
| 7% | chr11 | 47013185 | 47013198 | + | chr11 | 47073939 | 47074069 | + | ENST00000528488; ENST00000278460; ENST00000378618; ENST00000395460; ENST00000378615; ENST00000525895 | TSF |
| 7% | chr11 | 47013185 | 47013198 | + | chr11 | 47073939 | 47074069 | + | ENST00000528488; ENST00000278460; ENST00000378618; ENST00000395460; ENST00000378615; ENST00000525895 | TSF |

TABLE 44-continued

Transcript fusion for ovarian cancer (OV) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 7% | chr11 | 47013185 | 47013198 | + | chr11 | 47073939 | 47074069 | + | ENST00000528488; ENST00000278460; ENST00000378618; ENST00000395460; ENST00000378615; ENST00000525895 | TSF |
| 7% | chr11 | 47013185 | 47013198 | + | chr11 | 47073939 | 47074069 | + | ENST00000528488; ENST00000278460; ENST00000378618; ENST00000395460; ENST00000378615; ENST00000525895 | TSF |
| 7% | chr11 | 47013185 | 47013198 | + | chr11 | 47073939 | 47074069 | + | ENST00000528488; ENST00000278460; ENST00000378618; ENST00000395460; ENST00000378615; ENST00000525895 | TSF |
| 7% | chr11 | 47013185 | 47013198 | + | chr11 | 47073939 | 47074069 | + | ENST00000528488; ENST00000278460; ENST00000378618; ENST00000395460; ENST00000378615; ENST00000525895 | TSF |
| 6% | chr7 | 33006587 | 33006627 | + | chr7 | 33014229 | 33014374 | + | ENST00000242209; ENST00000538336 | TSF |
| 6% | chr1 | 111960622 | 111960373 | − | chr1 | 111959080 | 111958945; 111959068 | − | ENST00000369732; ENST00000540696 | TSF |
| 6% | chr1 | 111960622 | 111960373 | − | chr1 | 111959080 | 111958945; 111959068 | − | ENST00000369732; ENST00000540696 | TSF |
| 6% | chrX | 134883429 | 134883726 | + | chrX | 134887292 | 134887401 | + | ENST00000370734; ENST00000485366; ENST00000443882 | TSF |
| 6% | chr14 | 105172936 | 105173038 | + | chr14 | 105173247 | 105173388 | + | ENST00000330634; ENST00000392634 | TSF |
| 6% | chr14 | 105172936 | 105173038 | + | chr14 | 105173247 | 105173388 | + | ENST00000330634; ENST00000392634 | TSF |
| 6% | chr3 | 100461913 | 100462018 | + | chr3 | 100463677 | 100463775 | + | ENST00000418917; ENST00000490574; ENST00000240851; ENST00000476228 | TSF |
| 6% | chr20 | 60878087 | 60878105 | + | chr20 | 60882884 | 60882884 | + | ENST00000253003 | TSF |
| 6% | chr16 | 21060024 | 21059927 | − | chr16 | 21053525 | 21053349 | − | ENST00000261383; ENST00000415178 | TSF |
| 6% | chr16 | 21060024 | 21059927 | − | chr16 | 21053525 | 21053349 | − | ENST00000261383; ENST00000415178 | TSF |
| 6% | chr1 | 33270876 | 33270146 | − | chr1 | 33263444 | 33263364 | − | ENST00000373477 | TSF |
| 6% | chrX | 134954053 | 134953756 | − | chrX | 134932924 | 134932815 | − | ENST00000487941; ENST00000434966; ENST00000494421 | TSF |
| 6% | chr14 | 24686795 | 24686695 | − | chr14 | 24686429 | 24686392; 24686333 | − | ENST00000605847; ENST00000250495 | TSF |
| 6% | chr14 | 24686795 | 24686695 | − | chr14 | 24686429 | 24686392; 24686333 | − | ENST00000605847; ENST00000250495 | TSF |
| 6% | chr17 | 42400590 | 42400540 | − | chr17 | 42400220 | 42400176 | − | ENST00000225308; ENST00000377095; ENST00000590194; ENST00000588049; ENST00000586633; ENST00000592857; ENST00000585523 | TSF |
| 6% | chr17 | 42400590 | 42400540 | − | chr17 | 42400220 | 42400176 | − | ENST00000225308; ENST00000377095; ENST00000590194; ENST00000588049; ENST00000586633; ENST00000592857; ENST00000585523 | TSF |
| 6% | chr17 | 42400590 | 42400540 | − | chr17 | 42400220 | 42400176 | − | ENST00000225308; ENST00000377095; ENST00000590194; ENST00000588049; ENST00000586633; ENST00000592857; ENST00000585523 | TSF |
| 6% | chr17 | 42400590 | 42400540 | − | chr17 | 42400220 | 42400176 | − | ENST00000225308; ENST00000377095; ENST00000590194; ENST00000588049; ENST00000586633; ENST00000592857; ENST00000585523 | TSF |
| 6% | chr17 | 42400590 | 42400540 | − | chr17 | 42400220 | 42400176 | − | ENST00000225308; ENST00000377095; ENST00000590194; ENST00000588049; ENST00000586633; ENST00000592857; ENST00000585523 | TSF |
| 6% | chr17 | 42400590 | 42400540 | − | chr17 | 42400220 | 42400176 | − | ENST00000225308; ENST00000377095; ENST00000590194; ENST00000588049; ENST00000586633; ENST00000592857; ENST00000585523 | TSF |
| 6% | chrX | 134936794 | 134936497 | − | chrX | 134932924 | 134932815 | − | ENST00000487941; ENST00000434966; ENST00000494421 | TSF |
| 6% | chr17 | 39976225 | 39976301 | + | chr17 | 39976521 | 39976713 | + | ENST00000321562; ENST00000455106; ENST00000544340 | TSF |
| 5% | chr5 | 31298457 | 31298554 | + | chr5 | 31299571 | 31299738 | + | ENST00000514738; ENST00000265071 | TSF |
| 5% | chr5 | 31298457 | 31298554 | + | chr5 | 31299571 | 31299738 | + | ENST00000514738; ENST00000265071 | TSF |
| 5% | chr11 | 77945120 | 77945089 | − | chr11 | 77938097 | 77937511 | − | ENST00000340149; ENST00000361507 | TSF |
| 5% | chrX | 134866155 | 134866452 | + | chrX | 134870023 | 134870132 | + | ENST00000370736; ENST00000471213; ENST00000495729 | TSF |
| 5% | chr13 | 114996946 | 114997117 | + | chr13 | 115002120 | 115002174 | + | ENST00000360383; ENST00000356221; ENST00000252457 | TSF |
| 5% | chr13 | 114996946 | 114997117 | + | chr13 | 115002120 | 115002174 | + | ENST00000360383; ENST00000356221; ENST00000252457 | TSF |
| 5% | chr17 | 78344149 | 78344187 | + | chr17 | 78345674 | 78345785 | + | ENST00000508628; ENST00000582970; ENST00000336301 | TSF |
| 5% | chr8 | 125535738 | 125535448 | − | chr8 | 125535243 | 125535178 | − | ENST00000276692; ENST00000523214; ENST00000522810; ENST00000519776; ENST00000605953; ENST00000522310; | TSF |

TABLE 44-continued

Transcript fusion for ovarian cancer (OV) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 5% | chr8 | 125535738 | 125535448 | – | chr8 | 125535243 | 125535178 | – | ENST00000519232 ENST00000276692; ENST00000523214; ENST00000522810; ENST00000519776; ENST00000605953; ENST00000522310; ENST00000519232 | TSF |
| 5% | chr8 | 125535738 | 125535448 | – | chr8 | 125535243 | 125535178 | – | ENST00000276692; ENST00000523214; ENST00000522810; ENST00000519776; ENST00000605953; ENST00000522310; ENST00000519232 | TSF |
| 5% | chr8 | 125535738 | 125535448 | – | chr8 | 125535243 | 125535178 | – | ENST00000276692; ENST00000523214; ENST00000522810; ENST00000519776; ENST00000605953; ENST00000522310; ENST00000519232 | TSF |
| 5% | chr8 | 125535738 | 125535448 | – | chr8 | 125535243 | 125535178 | – | ENST00000276692; ENST00000523214; ENST00000522810; ENST00000519776; ENST00000605953; ENST00000522310; ENST00000519232 | TSF |
| 5% | chr8 | 125535738 | 125535448 | – | chr8 | 125535243 | 125535178 | – | ENST00000276692; ENST00000523214; ENST00000522810; ENST00000519776; ENST00000605953; ENST00000522310; ENST00000519232 | TSF |
| 5% | chr8 | 125535738 | 125535448 | – | chr8 | 125535243 | 125535178 | – | ENST00000276692; ENST00000523214; ENST00000522810; ENST00000519776; ENST00000605953; ENST00000522310; ENST00000519232 | TSF |
| 5% | chr21 | 34902064 | 34901873 | – | chr21 | 34901243 | 34901156 | – | ENST00000381815; ENST00000381831; ENST00000381839; ENST00000424203; ENST00000361093 | TSF |
| 5% | chr21 | 34902064 | 34901873 | – | chr21 | 34901243 | 34901156 | – | ENST00000381815; ENST00000381831; ENST00000381839; ENST00000424203; ENST00000361093 | TSF |
| 5% | chr21 | 34902064 | 34901873 | – | chr21 | 34901243 | 34901156 | – | ENST00000381815; ENST00000381831; ENST00000381839; ENST00000424203; ENST00000361093 | TSF |
| 5% | chr3 | 150463581 | 150463483 | – | chr3 | 150460485 | 150459928; 150460275 | – | ENST00000312960; ENST00000482706 | TSF |
| 5% | chr3 | 150463581 | 150463483 | – | chr3 | 150460485 | 150459928; 150460275 | – | ENST00000312960; ENST00000482706 | TSF |
| 5% | chr17 | 66244121 | 66244199 | + | chr17 | 66244785 | 66244846 | + | ENST00000584837 | TSF |
| 5% | chrX | 134866155 | 134866452 | + | chrX | 134887292 | 134887401 | + | ENST00000370734; ENST00000485366; ENST00000443882 | TSF |
| 5% | chr17 | 42149044 | 42149179 | + | chr17 | 42151528 | 42151634; 42151597 | + | ENST00000269097; ENST00000591696 | TSF |
| 5% | chr17 | 42149044 | 42149179 | + | chr17 | 42151528 | 42151634; 42151597 | + | ENST00000269097; ENST00000591696 | TSF |
| 5% | chr22 | 21972574 | 21972670 | + | chr22 | 21975804 | 21975958 | + | ENST00000458578; ENST00000342192; ENST00000545681 | TSF |
| 5% | chr10 | 12277215 | 12277329 | + | chr10 | 12279143 | 12279265; 12279223 | + | ENST00000281141; ENST00000442050; ENST00000440613 | TSF |
| 5% | chr10 | 12277215 | 12277329 | + | chr10 | 12279143 | 12279265; 12279223 | + | ENST00000281141; ENST00000442050; ENST00000440613 | TSF |
| 5% | chr10 | 12277215 | 12277329 | + | chr10 | 12279143 | 12279265; 12279223 | + | ENST00000281141; ENST00000442050; ENST00000440613 | TSF |
| 5% | chr4 | 56493122 | 29564923 | – | chr4 | 56482552 | 56482505 | – | ENST00000264218; ENST00000505262; ENST00000507338 | TSF |
| 5% | chr4 | 56493122 | 29564923 | – | chr4 | 56482552 | 56482505 | – | ENST00000264218; ENST00000505262; ENST00000507338 | TSF |
| 5% | chr4 | 56493122 | 29564923 | – | chr4 | 56482552 | 56482505 | – | ENST00000264218; ENST00000505262; ENST00000507338 | TSF |
| 5% | chr19 | 11528445 | 11528379 | – | chr19 | 11527733 | 11527510 | – | ENST00000562663; ENST00000563726; ENST00000380456; ENST00000393423; ENST00000567431; ENST00000567080 | TSF |
| 5% | chr19 | 11528445 | 11528379 | – | chr19 | 11527733 | 11527510 | – | ENST00000562663; ENST00000563726; ENST00000380456; ENST00000393423; ENST00000567431; ENST00000567080 | TSF |
| 5% | chr19 | 11528445 | 11528379 | – | chr19 | 11527733 | 11527510 | – | ENST00000562663; ENST00000563726; ENST00000380456; ENST00000393423; ENST00000567431; ENST00000567080 | TSF |
| 5% | chr19 | 11528445 | 11528379 | – | chr19 | 11527733 | 11527510 | – | ENST00000562663; ENST00000563726; ENST00000380456; ENST00000393423; ENST00000567431; ENST00000567080 | TSF |
| 5% | chr19 | 11528445 | 11528379 | – | chr19 | 11527733 | 11527510 | – | ENST00000562663; ENST00000563726; ENST00000380456; ENST00000393423; ENST00000567431; ENST00000567080 | TSF |
| 5% | chr19 | 11528445 | 11528379 | – | chr19 | 11527733 | 11527510 | – | ENST00000562663; ENST00000563726; ENST00000380456; ENST00000393423; | TSF |

TABLE 44-continued

Transcript fusion for ovarian cancer (OV) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 5% | chr11 | 60934781 | 60933962 | − | chr11 | 60901679 | 60901508 | − | ENST00000567431; ENST00000567080 ENST00000301765; ENST00000538036 | TSF |
| 5% | chr11 | 60934781 | 60933962 | − | chr11 | 60901679 | 60901508 | − | ENST00000301765; ENST00000538036 | TSF |
| 5% | chr1 | 156716197 | 156716133 | − | chr1 | 156715165 | 156715089 | − | ENST00000357325; ENST00000537739; ENST00000368209; ENST00000368206 | TSF |
| 5% | chr2 | 27667813 | 27667765 | − | chr2 | 27667388 | 27667299 | − | ENST00000260570 | TSF |
| 5% | chr1 | 33593993 | 33594050 | + | chr1 | 33741701 | 33741764 | + | ENST00000539719; ENST00000373428 | TSF |
| 5% | chr20 | 62631560 | 62631735 | + | chr20 | 62632430 | 62632592 | + | ENST00000535781; ENST00000266079 | TSF |
| 5% | chr20 | 62631560 | 62631735 | + | chr20 | 62632430 | 62632592 | + | ENST00000535781; ENST00000266079 | TSF |
| 5% | chr5 | 64050585 | 64050405 | − | chr5 | 64050189 | 64050142 | − | ENST00000513458 | TSF |
| 4% | chr19 | 45365391 | 45365456 | + | chr19 | 45368528 | 45368917 | + | ENST00000252485; ENST00000252483 | TSF |
| 4% | chr19 | 45365391 | 45365456 | + | chr19 | 45368528 | 45368917 | + | ENST00000252485; ENST00000252483 | TSF |
| 4% | chr6 | 31941780 | 31941829 | + | chr6 | 31946680 | 31946775; 31946787; 31946759 | + | ENST00000375331; ENST00000375333; ENST00000483801; ENST00000519179 | TSF |
| 4% | chr6 | 31941780 | 31941829 | + | chr6 | 31946680 | 31946775; 31946787; 31946759 | + | ENST00000375331; ENST00000375333; ENST00000483801; ENST00000519179 | TSF |
| 4% | chr6 | 31941780 | 31941829 | + | chr6 | 31946680 | 31946775; 31946787; 31946759 | + | ENST00000375331; ENST00000375333; ENST00000483801; ENST00000519179 | TSF |
| 4% | chr19 | 13880454 | 13880520 | + | chr19 | 13882935 | 13883095 | + | ENST00000319545; ENST00000040663 | TSF |
| 4% | chr1 | 165854440 | 165854616 | + | chr1 | 165859441 | 165859600 | + | ENST00000367879; ENST00000372212 | TSF |
| 4% | chr1 | 165854440 | 165854616 | + | chr1 | 165859441 | 165859600 | + | ENST00000367879; ENST00000372212 | TSF |
| 4% | chr9 | 35790327 | 35790337 | + | chr9 | 35799615 | 35799728 | + | ENST00000342694 | TSF |
| 4% | chr9 | 140499260 | 140499389 | + | chr9 | 140507348 | 140507458; 140507601 | + | ENST00000371421; ENST00000431925; ENST00000461627; ENST00000419386 | TSF |
| 4% | chr9 | 140499260 | 140499389 | + | chr9 | 140507348 | 140507458; 140507601 | + | ENST00000371421; ENST00000431925; ENST00000461627; ENST00000419386 | TSF |
| 4% | chr9 | 140499260 | 140499389 | + | chr9 | 140507348 | 140507458; 140507601 | + | ENST00000371421; ENST00000431925; ENST00000461627; ENST00000419386 | TSF |
| 4% | chr9 | 140499260 | 140499389 | + | chr9 | 140507348 | 140507458; 140507601 | + | ENST00000371421; ENST00000431925; ENST00000461627; ENST00000419386 | TSF |
| 4% | chr19 | 51464315 | 51464269 | − | chr19 | 51462572 | 51462420; 51462407 | − | ENST00000376851; ENST00000310157; ENST00000391808; ENST00000456750; ENST00000376853; ENST00000594641 | TSF |
| 4% | chr19 | 51464315 | 51464269 | − | chr19 | 51462572 | 51462420; 51462407 | − | ENST00000376851; ENST00000310157; ENST00000391808; ENST00000456750; ENST00000376853; ENST00000594641 | TSF |
| 4% | chr2 | 135414144 | 135414047 | − | chr2 | 135309662 | 135309619 | − | ENST00000281924 | TSF |
| 4% | chr14 | 105944002 | 105944196 | + | chr14 | 105944603 | 105944697 | + | ENST00000483017; ENST00000329146 | TSF |
| 4% | chr1 | 15562769 | 15563257 | + | chr1 | 15578267 | 15578373 | + | ENST00000433640 | TSF |
| 4% | chr11 | 66219706 | 66219444 | − | chr11 | 66205730 | 66205635 | − | ENST00000310999; ENST00000430466; ENST00000534488; ENST00000329819 | TSF |
| 4% | chr11 | 66219706 | 66219444 | − | chr11 | 66205730 | 66205635 | − | ENST00000310999; ENST00000430466; ENST00000534488; ENST00000329819 | TSF |
| 4% | chr11 | 66219706 | 66219444 | − | chr11 | 66205730 | 66205635 | − | ENST00000310999; ENST00000430466; ENST00000534488; ENST00000329819 | TSF |
| 4% | chr11 | 15114123 | 15112973 | − | chr6 | 32497961 | 32497902 | − | ENST00000374975 | TSF |
| 4% | chr20 | 32693720 | 32693709 | − | chr20 | 32693351 | 32693174 | − | ENST00000374980 | TSF |
| 4% | chr18 | 51273 | 49727 | − | chr18 | 49237 | 49129 | − | ENST00000308911 | TSF |
| 4% | chr19 | 50167252 | 50167184 | − | chr19 | 50166771 | 50166600; 50166728; 50166630 | − | ENST00000309877; ENST00000600911; ENST00000601291; ENST00000377139; ENST00000597198; ENST00000597636; ENST00000599223; ENST00000377135; ENST00000596756; ENST00000598108; ENST00000593337; ENST00000601809; ENST00000596788; ENST00000600453 | TSF |
| 4% | chr19 | 50167252 | 50167184 | − | chr19 | 50166771 | 50166600; 50166728; 50166630 | − | ENST00000309877; ENST00000600911; ENST00000601291; ENST00000377139; ENST00000597198; ENST00000597636; ENST00000599223; ENST00000377135; ENST00000596756; ENST00000598108; ENST00000593337; ENST00000601809; ENST00000596788; ENST00000600453 | TSF |
| 4% | chr19 | 50167252 | 50167184 | − | chr19 | 50166771 | 50166600; 50166728; 50166630 | − | ENST00000309877; ENST00000600911; ENST00000601291; ENST00000377139; ENST00000597198; ENST00000597636; ENST00000599223; ENST00000377135; ENST00000596756; ENST00000598108; ENST00000593337; ENST00000601809; ENST00000596788; ENST00000600453 | TSF |
| 4% | chr19 | 50167252 | 50167184 | − | chr19 | 50166771 | 50166600; 50166728; 50166630 | − | ENST00000309877; ENST00000600911; ENST00000601291; ENST00000377139; ENST00000597198; ENST00000597636; ENST00000599223; ENST00000377135; | |

TABLE 44-continued

Transcript fusion for ovarian cancer (OV) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 4% | chr19 | 50167252 | 50167184 | − | chr19 | 50166771 | 50166600; 50166728; 50166630 | − | ENST00000596756; ENST00000598108; ENST00000593337; ENST00000601809; ENST00000596788; ENST00000600453 ENST00000309877; ENST00000600911; ENST00000601291; ENST00000377139; ENST00000597198; ENST00000597636; ENST00000599223; ENST00000377135; | TSF |
| 4% | chr19 | 50167252 | 50167184 | − | chr19 | 50166771 | 50166600; 50166728; 50166630 | − | ENST00000596756; ENST00000598108; ENST00000593337; ENST00000601809; ENST00000596788; ENST00000600453 ENST00000309877; ENST00000600911; ENST00000601291; ENST00000377139; ENST00000597198; ENST00000597636; ENST00000599223; ENST00000377135; | TSF |
| 4% | chr19 | 50167252 | 50167184 | − | chr19 | 50166771 | 50166600; 50166728; 50166630 | − | ENST00000596756; ENST00000598108; ENST00000593337; ENST00000601809; ENST00000596788; ENST00000600453 ENST00000309877; ENST00000600911; ENST00000601291; ENST00000377139; ENST00000597198; ENST00000597636; ENST00000599223; ENST00000377135; | TSF |
| 4% | chr19 | 50167252 | 50167184 | − | chr19 | 50166771 | 50166600; 50166728; 50166630 | − | ENST00000596756; ENST00000598108; ENST00000593337; ENST00000601809; ENST00000596788; ENST00000600453 ENST00000309877; ENST00000600911; ENST00000601291; ENST00000377139; ENST00000597198; ENST00000597636; ENST00000599223; ENST00000377135; | TSF |
| 4% | chr19 | 50167252 | 50167184 | − | chr19 | 50166771 | 50166600; 50166728; 50166630 | − | ENST00000596756; ENST00000598108; ENST00000593337; ENST00000601809; ENST00000596788; ENST00000600453 ENST00000309877; ENST00000600911; ENST00000601291; ENST00000377139; ENST00000597198; ENST00000597636; ENST00000599223; ENST00000377135; | TSF |
| 4% | chr19 | 50167252 | 50167184 | − | chr19 | 50166771 | 50166600; 50166728; 50166630 | − | ENST00000596756; ENST00000598108; ENST00000593337; ENST00000601809; ENST00000596788; ENST00000600453 ENST00000309877; ENST00000600911; ENST00000601291; ENST00000377139; ENST00000597198; ENST00000597636; ENST00000599223; ENST00000377135; | TSF |
| 4% | chr19 | 50167252 | 50167184 | − | chr19 | 50166771 | 50166600; 50166728; 50166630 | − | ENST00000596756; ENST00000598108; ENST00000593337; ENST00000601809; ENST00000596788; ENST00000600453 ENST00000309877; ENST00000600911; ENST00000601291; ENST00000377139; ENST00000597198; ENST00000597636; ENST00000599223; ENST00000377135; | TSF |
| 4% | chr2 | 25015386 | 25015253 | − | chr2 | 25013450 | 25013280 | − | ENST00000328379 | TSF |
| 4% | chr1 | 156305455 | 156305264 | − | chr1 | 156304709 | 156304659 | − | ENST00000295688; ENST00000368258; ENST00000413555; ENST00000496684; ENST00000478640; ENST00000415548 | TSF |
| 4% | chr1 | 156305455 | 156305264 | − | chr1 | 156304709 | 156304659 | − | ENST00000295688; ENST00000368258; ENST00000413555; ENST00000496684; ENST00000478640; ENST00000415548 | TSF |
| 4% | chr1 | 156305455 | 156305264 | − | chr1 | 156304709 | 156304659 | − | ENST00000295688; ENST00000368258; ENST00000413555; ENST00000496684; ENST00000478640; ENST00000415548 | TSF |
| 4% | chr1 | 156305455 | 156305264 | − | chr1 | 156304709 | 156304659 | − | ENST00000295688; ENST00000368258; ENST00000413555; ENST00000496684; ENST00000478640; ENST00000415548 | TSF |
| 4% | chr1 | 156305455 | 156305264 | − | chr1 | 156304709 | 156304659 | − | ENST00000295688; ENST00000368258; ENST00000413555; ENST00000496684; ENST00000478640; ENST00000415548 | TSF |
| 4% | chr1 | 156305455 | 156305264 | − | chr1 | 156304709 | 156304659 | − | ENST00000295688; ENST00000368258; ENST00000413555; ENST00000496684; ENST00000478640; ENST00000415548 | TSF |
| 4% | chr12 | 120877048 | 120877098 | + | chr12 | 120878257 | 120878340 | + | ENST00000229379 | TSF |
| 4% | chr20 | 57466589 | 57466605 | + | chr20 | 57480438 | 57480535 | + | ENST00000371100; ENST00000371102; ENST00000450130; ENST00000349036; ENST00000604005; ENST00000371095; ENST00000354359; ENST00000371085; | TSF |

TABLE 44-continued

Transcript fusion for ovarian cancer (OV) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 4% | chr20 | 57466589 | 57466605 | + | chr20 | 57480438 | 57480535 | + | ENST00000265620; ENST00000306090; ENST00000603546 ENST00000371100; ENST00000371102; ENST00000450130; ENST00000349036; ENST00000604005; ENST00000371095; ENST00000354359; ENST00000371085; | TSF |
| 4% | chr20 | 57466589 | 57466605 | + | chr20 | 57480438 | 57480535 | + | ENST00000265620; ENST00000306090; ENST00000603546 ENST00000371100; ENST00000371102; ENST00000450130; ENST00000349036; ENST00000604005; ENST00000371095; ENST00000354359; ENST00000371085; | TSF |
| 4% | chr20 | 57466589 | 57466605 | + | chr20 | 57480438 | 57480535 | + | ENST00000265620; ENST00000306090; ENST00000603546 ENST00000371100; ENST00000371102; ENST00000450130; ENST00000349036; ENST00000604005; ENST00000371095; ENST00000354359; ENST00000371085; | TSF |
| 4% | chr20 | 57466589 | 57466605 | + | chr20 | 57480438 | 57480535 | + | ENST00000265620; ENST00000306090; ENST00000603546 ENST00000371100; ENST00000371102; ENST00000450130; ENST00000349036; ENST00000604005; ENST00000371095; ENST00000354359; ENST00000371085; | TSF |
| 4% | chr19 | 35760074 | 35760261 | + | chr19 | 35760349 | 35760395; 35760602 | + | ENST00000343550; ENST00000222305; ENST00000595068; ENST00000379134; ENST00000602164; ENST00000594064; ENST00000598058 | TSF |
| 4% | chr19 | 35760074 | 35760261 | + | chr19 | 35760349 | 35760395; 35760602 | + | ENST00000343550; ENST00000222305; ENST00000595068; ENST00000379134; ENST00000602164; ENST00000594064; ENST00000598058 | TSF |
| 4% | chr19 | 35760074 | 35760261 | + | chr19 | 35760349 | 35760395; 35760602 | + | ENST00000343550; ENST00000222305; ENST00000595068; ENST00000379134; ENST00000602164; ENST00000594064; ENST00000598058 | TSF |
| 4% | chr19 | 35760074 | 35760261 | + | chr19 | 35760349 | 35760395; 35760602 | + | ENST00000343550; ENST00000222305; ENST00000595068; ENST00000379134; ENST00000602164; ENST00000594064; ENST00000598058 | TSF |
| 4% | chr19 | 35760074 | 35760261 | + | chr19 | 35760349 | 35760395; 35760602 | + | ENST00000343550; ENST00000222305; ENST00000595068; ENST00000379134; ENST00000602164; ENST00000594064; ENST00000598058 | TSF |
| 4% | chr19 | 35760074 | 35760261 | + | chr19 | 35760349 | 35760395; 35760602 | + | ENST00000343550; ENST00000222305; ENST00000595068; ENST00000379134; ENST00000602164; ENST00000594064; ENST00000598058 | TSF |
| 4% | chr11 | 32453241 | 32453188 | − | chr11 | 32450165 | 32450043 | − | ENST00000379079; ENST00000379077; ENST00000332351; ENST00000530998; ENST00000452863; ENST00000448076 | TSF |
| 4% | chr11 | 32453241 | 32453188 | − | chr11 | 32450165 | 32450043 | − | ENST00000379079; ENST00000379077; ENST00000332351; ENST00000530998; ENST00000452863; ENST00000448076 | TSF |
| 4% | chr11 | 32453241 | 32453188 | − | chr11 | 32450165 | 32450043 | − | ENST00000379079; ENST00000379077; ENST00000332351; ENST00000530998; ENST00000452863; ENST00000448076 | TSF |
| 4% | chr11 | 32453241 | 32453188 | − | chr11 | 32450165 | 32450043 | − | ENST00000379079; ENST00000379077; ENST00000332351; ENST00000530998; ENST00000452863; ENST00000448076 | TSF |
| 4% | chr11 | 32453241 | 32453188 | − | chr11 | 32450165 | 32450043 | − | ENST00000379079; ENST00000379077; ENST00000332351; ENST00000530998; ENST00000452863; ENST00000448076 | TSF |
| 4% | chrX | 134971303 | 134971006 | − | chrX | 134932924 | 134932815 | − | ENST00000487941; ENST00000434966; ENST00000494421 | TSF |
| 4% | chr22 | 29194595 | 29194546 | − | chr22 | 29193193 | 29193065 | − | ENST00000216037; ENST00000403532; ENST00000405219; ENST00000344347 | TSF |
| 4% | chr22 | 29194595 | 29194546 | − | chr22 | 29193193 | 29193065 | − | ENST00000216037; ENST00000403532; ENST00000405219; ENST00000344347 | TSF |
| 4% | chr1 | 206278006 | 206277067 | − | chr1 | 206243250 | 206243150 | − | ENST00000331555 | TSF |

TABLE 44-continued

Transcript fusion for ovarian cancer (OV) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 4% | chr13 | 43628887 | 43629679 | + | chr13 | 43681314 | 43681384 | + | ENST00000379221 | TSF |
| 4% | chr5 | 175697409 | 175697523 | + | chr5 | 175716657 | 175717958 | + | ENST00000443967; ENST00000429602 | TSF |
| 4% | chr5 | 175697409 | 175697523 | + | chr5 | 175716657 | 175717958 | + | ENST00000443967; ENST00000429602 | TSF |
| 4% | chr14 | 105944002 | 105944027 | + | chr14 | 105944603 | 105944697 | + | ENST00000483017; ENST00000329146 | TSF |
| 4% | chr2 | 242276229 | 242276279 | + | chr2 | 242276797 | 242276931; 242276900; 242276863; 242276848 | + | ENST00000391973; ENST00000428282; ENST00000360051; ENST00000391971; ENST00000401990; ENST00000407971; ENST00000436795; ENST00000411484; ENST00000402092; ENST00000443492; ENST00000437066; ENST00000449239; ENST00000457874 | TSF |
| 4% | chr2 | 242276229 | 242276279 | + | chr2 | 242276797 | 242276931; 242276900; 242276863; 242276848 | + | ENST00000391973; ENST00000428282; ENST00000360051; ENST00000391971; ENST00000401990; ENST00000407971; ENST00000436795; ENST00000411484; ENST00000402092; ENST00000443492; ENST00000437066; ENST00000449239; ENST00000457874 | TSF |
| 4% | chr2 | 242276229 | 242276279 | + | chr2 | 242276797 | 242276931; 242276900; 242276863; 242276848 | + | ENST00000391973; ENST00000428282; ENST00000360051; ENST00000391971; ENST00000401990; ENST00000407971; ENST00000436795; ENST00000411484; ENST00000402092; ENST00000443492; ENST00000437066; ENST00000449239; ENST00000457874 | TSF |
| 4% | chr2 | 242276229 | 242276279 | + | chr2 | 242276797 | 242276931; 242276900; 242276863; 242276848 | + | ENST00000391973; ENST00000428282; ENST00000360051; ENST00000391971; ENST00000401990; ENST00000407971; ENST00000436795; ENST00000411484; ENST00000402092; ENST00000443492; ENST00000437066; ENST00000449239; ENST00000457874 | TSF |
| 4% | chr2 | 242276229 | 242276279 | + | chr2 | 242276797 | 242276931; 242276900; 242276863; 242276848 | + | ENST00000391973; ENST00000428282; ENST00000360051; ENST00000391971; ENST00000401990; ENST00000407971; ENST00000436795; ENST00000411484; ENST00000402092; ENST00000443492; ENST00000437066; ENST00000449239; ENST00000457874 | TSF |
| 4% | chr2 | 242276229 | 242276279 | + | chr2 | 242276797 | 242276931; 242276900; 242276863; 242276848 | + | ENST00000391973; ENST00000428282; ENST00000360051; ENST00000391971; ENST00000401990; ENST00000407971; ENST00000436795; ENST00000411484; ENST00000402092; ENST00000443492; ENST00000437066; ENST00000449239; ENST00000457874 | TSF |
| 4% | chr2 | 242276229 | 242276279 | + | chr2 | 242276797 | 242276931; 242276900; 242276863; 242276848 | + | ENST00000391973; ENST00000428282; ENST00000360051; ENST00000391971; ENST00000401990; ENST00000407971; ENST00000436795; ENST00000411484; ENST00000402092; ENST00000443492; ENST00000437066; ENST00000449239; ENST00000457874 | TSF |
| 4% | chr16 | 28836248 | 28836298 | + | chr16 | 28836687 | 28836723 | + | ENST00000340394; ENST00000325215; ENST00000336783; ENST00000382686; ENST00000395547; ENST00000564304; ENST00000570200; ENST00000568266 | TSF |
| 4% | chr16 | 28836248 | 28836298 | + | chr16 | 28836687 | 28836723 | + | ENST00000340394; ENST00000325215; ENST00000336783; ENST00000382686; ENST00000395547; ENST00000564304; ENST00000570200; ENST00000568266 | TSF |
| 4% | chr16 | 28836248 | 28836298 | + | chr16 | 28836687 | 28836723 | + | ENST00000340394; ENST00000325215; ENST00000336783; ENST00000382686; ENST00000395547; ENST00000564304; ENST00000570200; ENST00000568266 | TSF |
| 4% | chr16 | 28836248 | 28836298 | + | chr16 | 28836687 | 28836723 | + | ENST00000340394; ENST00000325215; ENST00000336783; ENST00000382686; ENST00000395547; ENST00000564304; ENST00000570200; ENST00000568266 | TSF |

TABLE 44-continued

Transcript fusion for ovarian cancer (OV) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 4% | chr16 | 28836248 | 28836298 | + | chr16 | 28836687 | 28836723 | + | ENST00000340394; ENST00000325215; ENST00000336783; ENST00000382686; ENST00000395547; ENST00000564304; ENST00000570200; ENST00000568266 | TSF |
| 4% | chr16 | 28836248 | 28836298 | + | chr16 | 28836687 | 28836723 | + | ENST00000340394; ENST00000325215; ENST00000336783; ENST00000382686; ENST00000395547; ENST00000564304; ENST00000570200; ENST00000568266 | TSF |
| 4% | chr16 | 28836248 | 28836298 | + | chr16 | 28836687 | 28836723 | + | ENST00000340394; ENST00000325215; ENST00000336783; ENST00000382686; ENST00000395547; ENST00000564304; ENST00000570200; ENST00000568266 | TSF |
| 4% | chr16 | 28836248 | 28836298 | + | chr16 | 28836687 | 28836723 | + | ENST00000340394; ENST00000325215; ENST00000336783; ENST00000382686; ENST00000395547; ENST00000564304; ENST00000570200; ENST00000568266 | TSF |
| 4% | chr16 | 56972194 | 56972244 | + | chr16 | 56973149 | 56973271 | + | ENST00000439977; ENST00000300302; ENST00000379792; ENST00000569429; ENST00000563343; ENST00000568358 | TSF |
| 4% | chr16 | 56972194 | 56972244 | + | chr16 | 56973149 | 56973271 | + | ENST00000439977; ENST00000300302; ENST00000379792; ENST00000569429; ENST00000563343; ENST00000568358 | TSF |
| 4% | chr16 | 56972194 | 56972244 | + | chr16 | 56973149 | 56973271 | + | ENST00000439977; ENST00000300302; ENST00000379792; ENST00000569429; ENST00000563343; ENST00000568358 | TSF |
| 4% | chr16 | 56972194 | 56972244 | + | chr16 | 56973149 | 56973271 | + | ENST00000439977; ENST00000300302; ENST00000379792; ENST00000569429; ENST00000563343; ENST00000568358 | TSF |
| 4% | chr20 | 34133027 | 34133127 | + | chr20 | 34135163 | 34135256 | + | ENST00000348547; ENST00000357394; ENST00000279052; ENST00000447986; ENST00000416206; ENST00000413587 | TSF |
| 4% | chr20 | 34133027 | 34133127 | + | chr20 | 34135163 | 34135256 | + | ENST00000348547; ENST00000357394; ENST00000279052; ENST00000447986; ENST00000416206; ENST00000413587 | TSF |
| 4% | chr20 | 34133027 | 34133127 | + | chr20 | 34135163 | 34135256 | + | ENST00000348547; ENST00000357394; ENST00000279052; ENST00000447986; ENST00000416206; ENST00000413587 | TSF |
| 4% | chr20 | 34133027 | 34133127 | + | chr20 | 34135163 | 34135256 | + | ENST00000348547; ENST00000357394; ENST00000279052; ENST00000447986; ENST00000416206; ENST00000413587 | TSF |
| 4% | chr20 | 34133027 | 34133127 | + | chr20 | 34135163 | 34135256 | + | ENST00000348547; ENST00000357394; ENST00000279052; ENST00000447986; ENST00000416206; ENST00000413587 | TSF |
| 4% | chr10 | 133791239 | 133791188 | − | chr10 | 133787447 | 133787297 | − | ENST00000368636; ENST00000540159 | TSF |
| 4% | chr10 | 133791239 | 133791188 | − | chr10 | 133787447 | 133787297 | − | ENST00000368636; ENST00000540159 | TSF |
| 4% | chr17 | 72951257 | 72951178 | − | chr17 | 72950460 | 72950233 | − | ENST00000425042 | TSF |
| 4% | chr7 | 102212392 | 102212170 | − | chr7 | 102210371 | 102210282 | − | ENST00000489144; ENST00000379340; ENST00000486319; ENST00000508848; ENST00000513506; ENST00000514917; ENST00000507355; ENST00000608621; ENST00000511313; ENST00000513438 | TSF |
| 4% | chr7 | 102212392 | 102212170 | − | chr7 | 102210371 | 102210282 | − | ENST00000489144; ENST00000379340; ENST00000486319; ENST00000508848; ENST00000513506; ENST00000514917; ENST00000507355; ENST00000608621; ENST00000511313; ENST00000513438 | TSF |
| 4% | chr7 | 102212392 | 102212170 | − | chr7 | 102210371 | 102210282 | − | ENST00000489144; ENST00000379340; ENST00000486319; ENST00000508848; ENST00000513506; ENST00000514917; ENST00000507355; ENST00000608621; ENST00000511313; ENST00000513438 | TSF |
| 4% | chr7 | 102212392 | 102212170 | − | chr7 | 102210371 | 102210282 | − | ENST00000489144; ENST00000379340; ENST00000486319; ENST00000508848; ENST00000513506; ENST00000514917; ENST00000507355; ENST00000608621; ENST00000511313; ENST00000513438 | TSF |
| 4% | chr7 | 102212392 | 102212170 | − | chr7 | 102210371 | 102210282 | − | ENST00000489144; ENST00000379340; ENST00000486319; ENST00000508848; ENST00000513506; ENST00000514917; ENST00000507355; ENST00000608621; ENST00000511313; ENST00000513438 | TSF |
| 4% | chr7 | 102212392 | 102212170 | − | chr7 | 102210371 | 102210282 | − | ENST00000489144; ENST00000379340; ENST00000486319; ENST00000508848; ENST00000513506; ENST00000514917; ENST00000507355; ENST00000608621; ENST00000511313; ENST00000513438 | TSF |

TABLE 44-continued

Transcript fusion for ovarian cancer (OV) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 4% | chr7 | 102212392 | 102212170 | − | chr7 | 102210371 | 102210282 | − | ENST00000489144; ENST00000379340; ENST00000486319; ENST00000508848; ENST00000513506; ENST00000514917; ENST00000507355; ENST00000608621; ENST00000511313; ENST00000513438 | TSF |
| 4% | chr7 | 102212392 | 102212170 | − | chr7 | 102210371 | 102210282 | − | ENST00000489144; ENST00000379340; ENST00000486319; ENST00000508848; ENST00000513506; ENST00000514917; ENST00000507355; ENST00000608621; ENST00000511313; ENST00000513438 | TSF |
| 3% | chr21 | 46927878 | 46927878 | + | chr21 | 46929270 | 46929515 | + | ENST00000400337; ENST00000355480; ENST00000359759; ENST00000342220; ENST00000423214 | TSF |
| 3% | chr21 | 46927878 | 46927878 | + | chr21 | 46929270 | 46929515 | + | ENST00000400337; ENST00000355480; ENST00000359759; ENST00000342220; ENST00000423214 | TSF |
| 3% | chr7 | 148982749 | 148982787 | + | chr7 | 148984656 | 148984699; 148984867 | + | ENST00000378052; ENST00000476295; ENST00000418158 | TSF |
| 3% | chr7 | 148982749 | 148982787 | + | chr7 | 148984656 | 148984699; 148984867 | + | ENST00000378052; ENST00000476295; ENST00000418158 | TSF |
| 3% | chr14 | 105944002 | 105944067 | + | chr14 | 105944603 | 105944697 | + | ENST00000483017; ENST00000329146 | TSF |
| 3% | chr17 | 39974832 | 39974893 | + | chr17 | 39975462 | 39975651 | + | ENST00000321562 | TSF |
| 3% | chr9 | 21974190 | 21974089 | − | chr9 | 21971207 | 21971002; 21970901; 21970975 | − | ENST00000361570; ENST00000304494; ENST00000579755; ENST00000579122; ENST00000530628; ENST00000498124; ENST00000446177 | TSF |
| 3% | chr9 | 21974190 | 21974089 | − | chr9 | 21971207 | 21971002; 21970901; 21970975 | − | ENST00000361570; ENST00000304494; ENST00000579755; ENST00000579122; ENST00000530628; ENST00000498124; ENST00000446177 | TSF |
| 3% | chr9 | 21974190 | 21974089 | − | chr9 | 21971207 | 21971002; 21970901; 21970975 | − | ENST00000361570; ENST00000304494; ENST00000579755; ENST00000579122; ENST00000530628; ENST00000498124; ENST00000446177 | TSF |
| 3% | chr9 | 21974190 | 21974089 | − | chr9 | 21971207 | 21971002; 21970901; 21970975 | − | ENST00000361570; ENST00000304494; ENST00000579755; ENST00000579122; ENST00000530628; ENST00000498124; ENST00000446177 | TSF |
| 3% | chr6 | 80092917 | 80022085 | − | chr6 | 79924739 | 79924689 | − | ENST00000275036; ENST00000344726 | TSF |
| 3% | chr6 | 80092917 | 80022085 | − | chr6 | 79924739 | 79924689 | − | ENST00000275036; ENST00000344726 | TSF |
| 3% | chr22 | 38620420 | 38620354 | − | chr22 | 38617717 | 38617476 | − | ENST00000361906; ENST00000361684 | TSF |
| 3% | chr20 | 44246144 | 44442685 | + | chr20 | 44443023 | 44443109 | + | ENST00000356455; ENST00000405520; ENST00000335046; ENST00000372568 | TSF |
| 3% | chr20 | 44246144 | 44442685 | + | chr20 | 44443023 | 44443109 | + | ENST00000356455; ENST00000405520; ENST00000335046; ENST00000372568 | TSF |
| 3% | chr1 | 33228913 | 33229103 | + | chr | 33233388 | 33233558 | + | ENST00000401073; ENST00000373481; ENST00000294521; ENST00000373480 | TSF |
| 3% | chr1 | 33228913 | 33229103 | + | chr | 33233388 | 33233558 | + | ENST00000401073; ENST00000373481; ENST00000294521; ENST00000373480 | TSF |
| 3% | chr6 | 125440425 | 125440534 | + | chr6 | 125541224 | 125541339 | + | ENST00000304877; ENST00000534000; ENST00000368402; ENST00000368388; ENST00000527711; ENST00000528193 | TSF |
| 3% | chr6 | 125440425 | 125440534 | + | chr6 | 125541224 | 125541339 | + | ENST00000304877; ENST00000534000; ENST00000368402; ENST00000368388; ENST00000527711; ENST00000528193 | TSF |
| 3% | chr6 | 125440425 | 125440534 | + | chr6 | 125541224 | 125541339 | + | ENST00000304877; ENST00000534000; ENST00000368402; ENST00000368388; ENST00000527711; ENST00000528193 | TSF |
| 3% | chr6 | 125440425 | 125440534 | + | chr6 | 125541224 | 125541339 | + | ENST00000304877; ENST00000534000; ENST00000368402; ENST00000368388; ENST00000527711; ENST00000528193 | TSF |
| 3% | chr6 | 125440425 | 125440534 | + | chr6 | 125541224 | 125541339 | + | ENST00000304877; ENST00000534000; ENST00000368402; ENST00000368388; ENST00000527711; ENST00000528193 | TSF |
| 3% | chr6 | 125440425 | 125440534 | + | chr6 | 125541224 | 125541339 | + | ENST00000304877; ENST00000534000; ENST00000368402; ENST00000368388; ENST00000527711; ENST00000528193 | TSF |
| 3% | chr2 | 47596424 | 47596600 | + | chr2 | 47596660 | 47596720; | + | ENST00000263735; ENST00000419334 | TSF |
| 3% | chr2 | 47596424 | 47596600 | + | chr2 | 47596660 | 47596720; | + | ENST00000263735; ENST00000419334 | TSF |
| 3% | chr17 | 37898260 | 37898291 | + | chr17 | 37898505 | 37898709 | + | ENST00000445327 | TSF |
| 3% | chr3 | 39374892 | 39374955 | + | chr3 | 39453486 | 39453552; 39453550 | + | ENST00000301821; ENST00000458478; ENST00000443003 | TSF |
| 3% | chr3 | 39374892 | 39374955 | + | chr3 | 39453486 | 39453552; 39453550 | + | ENST00000301821; ENST00000458478; ENST00000443003 | TSF |
| 3% | chr17 | 37897992 | 37898081 | + | chr17 | 37898505 | 37898709 | + | ENST00000445327 | TSF |
| 3% | chr21 | 42822313 | 42822398 | + | chr21 | 42823094 | 42823170 | + | ENST00000398600; ENST00000398598; | TSF |

TABLE 44-continued

Transcript fusion for ovarian cancer (OV) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 3% | chr10 | 135208151 | 135208232 | + | chr10 | 135209217 | 135209281 | + | ENST00000455164; ENST00000288383 ENST00000468317; ENST00000317502; ENST00000432508 | TSF |
| 3% | chr10 | 135208151 | 135208232 | + | chr10 | 135209217 | 135209281 | + | ENST00000455164; ENST00000288383 ENST00000468317; ENST00000317502; ENST00000432508 | TSF |
| 3% | chr1 | 153636090 | 153635838 | − | chr1 | 153635752 | 153635691 | − | ENST00000361891 | TSF |
| 3% | chr8 | 74036014 | 74035742 | − | chr8 | 73993448 | 73993254 | − | ENST00000297354 | TSF |
| 3% | chr2 | 40465767 | 40465674 | − | chr2 | 40404995 | 40404892; 40404907 | − | ENST00000406785; ENST00000407929; ENST00000402441; ENST00000405269; ENST00000406391; ENST00000408028; ENST00000542024 | TSF |
| 3% | chr2 | 40465767 | 40465674 | − | chr2 | 40404995 | 40404892; 40404907 | − | ENST00000406785; ENST00000407929; ENST00000402441; ENST00000405269; ENST00000406391; ENST00000408028; ENST00000542024 | TSF |
| 3% | chr2 | 40465767 | 40465674 | − | chr2 | 40404995 | 40404892; 40404907 | − | ENST00000406785; ENST00000407929; ENST00000402441; ENST00000405269; ENST00000406391; ENST00000408028; ENST00000542024 | TSF |
| 3% | chr2 | 40465767 | 40465674 | − | chr2 | 40404995 | 40404892; 40404907 | − | ENST00000406785; ENST00000407929; ENST00000402441; ENST00000405269; ENST00000406391; ENST00000408028; ENST00000542024 | TSF |
| 3% | chr8 | 38320722 | 38320623 | − | chr | 38315052 | 38314874 | − | ENST00000425967 | TSF |
| 3% | chrX | 47013218 | 47013188 | − | chrX | 47002143 | 47002013; 47001983 | − | ENST00000377811; ENST00000276062 | TSF |
| 3% | chrX | 47013218 | 47013188 | − | chrX | 47002143 | 47002013; 47001983 | − | ENST00000377811; ENST00000276062 | TSF |
| 3% | chr7 | 72059372 | 72720556 | − | chr7 | 72719094 | 72718956; 72719042 | − | ENST00000428206; ENST00000252594; ENST00000438747; ENST00000310326; ENST00000455763 | TSF |
| 3% | chr7 | 72059372 | 72720556 | − | chr7 | 72719094 | 72718956; 72719042 | − | ENST00000428206; ENST00000252594; ENST00000438747; ENST00000310326; ENST00000455763 | TSF |
| 3% | chr7 | 72059372 | 72720556 | − | chr7 | 72719094 | 72718956; 72719042 | − | ENST00000428206; ENST00000252594; ENST00000438747; ENST00000310326; ENST00000455763 | TSF |
| 3% | chr7 | 72059372 | 72720556 | − | chr7 | 72719094 | 72718956; 72719042 | − | ENST00000428206; ENST00000252594; ENST00000438747; ENST00000310326; ENST00000455763 | TSF |
| 3% | chr9 | 130213440 | 130213384 | − | chr9 | 130213062 | 130213010 | − | ENST00000361436; ENST00000536368 | TSF |
| 3% | chr9 | 130213440 | 130213384 | − | chr9 | 130213062 | 130213010 | − | ENST00000361436; ENST00000536368 | TSF |
| 3% | chr9 | 131902050 | 131902148 | + | chr9 | 131904724 | 131904831; 131905179 | + | ENST00000358994; ENST00000393370; ENST00000337738; ENST00000348141; ENST00000452489; ENST00000357197; ENST00000347048; ENST00000355007; ENST00000417728; ENST00000411917; ENST00000423100; ENST00000524946; ENST00000436883; ENST00000414510; ENST00000432124; ENST00000435305; ENST00000419582; ENST00000432651; ENST00000435132; ENST00000434095 | TSF |
| 3% | chr9 | 131902050 | 131902148 | + | chr9 | 131904724 | 131904831; 131905179 | + | ENST00000358994; ENST00000393370; ENST00000337738; ENST00000348141; ENST00000452489; ENST00000357197; ENST00000347048; ENST00000355007; ENST00000417728; ENST00000411917; ENST00000423100; ENST00000524946; ENST00000436883; ENST00000414510; ENST00000432124; ENST00000435305; ENST00000419582; ENST00000432651; ENST00000435132; ENST00000434095 | TSF |
| 3% | chr9 | 131902050 | 131902148 | + | chr9 | 131904724 | 131904831; 131905179 | + | ENST00000358994; ENST00000393370; ENST00000337738; ENST00000348141; ENST00000452489; ENST00000357197; ENST00000347048; ENST00000355007; ENST00000417728; ENST00000411917; ENST00000423100; ENST00000524946; ENST00000436883; ENST00000414510; ENST00000432124; ENST00000435305; ENST00000419582; ENST00000432651; ENST00000435132; ENST00000434095 | TSF |
| 3% | chr9 | 131902050 | 131902148 | + | chr9 | 131904724 | 131904831; 131905179 | + | ENST00000358994; ENST00000393370; ENST00000337738; ENST00000348141; ENST00000452489; ENST00000357197; ENST00000347048; ENST00000355007; | TSF |

TABLE 44-continued

Transcript fusion for ovarian cancer (OV) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 3% | chr9 | 131902050 | 131902148 | + | chr9 | 131904724 | 131904831; 131905179 | + | ENST00000417728; ENST00000411917; ENST00000423100; ENST00000524946; ENST00000436883; ENST00000414510; ENST00000432124; ENST00000435305; ENST00000419582; ENST00000432651; ENST00000435132; ENST00000434095 ENST00000358994; ENST00000393370; ENST00000337738; ENST00000348141; ENST00000452489; ENST00000357197; ENST00000347048; ENST00000355007; ENST00000417728; ENST00000411917; ENST00000423100; ENST00000524946; ENST00000436883; ENST00000414510; ENST00000432124; ENST00000435305; ENST00000419582; ENST00000432651; ENST00000435132; ENST00000434095 | TSF |
| 3% | chr1 | 168348640 | 168349020 | + | chr1 | 168549301 | 168549415 | + | ENST00000367818 | TSF |
| 3% | chr9 | 130921922 | 1309221177 | + | chr9 | 130925722 | 130925894 | + | ENST00000372994 | TSF |
| 3% | chr7 | 56020443 | 56020541 | + | chr7 | 56020872 | 56021011 | + | ENST00000426595 | TSF |
| 3% | chr20 | 42231978 | 42232068 | + | chr20 | 42232400 | 42232529 | + | ENST00000373030; ENST00000373039 | TSF |
| 3% | chr20 | 389765 | 390021 | + | chr20 | 390525 | 390669 | + | ENST00000411647; ENST00000382214; ENST00000356286; ENST00000415942; ENST00000475269 | TSF |
| 3% | chr20 | 389765 | 390021 | + | chr20 | 390525 | 390669 | + | ENST00000411647; ENST00000382214; ENST00000356286; ENST00000415942; ENST00000475269 | TSF |
| 3% | chr20 | 389765 | 390021 | + | chr20 | 390525 | 390669 | + | ENST00000411647; ENST00000382214; ENST00000356286; ENST00000415942; ENST00000475269 | TSF |
| 3% | chr20 | 389765 | 390021 | + | chr20 | 390525 | 390669 | + | ENST00000411647; ENST00000382214; ENST00000356286; ENST00000415942; ENST00000475269 | TSF |
| 3% | chr20 | 389765 | 390021 | + | chr20 | 390525 | 390669 | + | ENST00000411647; ENST00000382214; ENST00000356286; ENST00000415942; ENST00000475269 | TSF |
| 3% | chr11 | 118917082 | 118917078 | − | chr11 | 118916543 | 118916493 | − | ENST00000404233; ENST00000529972; ENST00000525859 | TSF |
| 3% | chr3 | 124597514 | 124597450 | − | chr3 | 124592378 | 124592293 | − | ENST00000296181 | TSF |
| 3% | chr19 | 51502251 | 51502209 | − | chr19 | 51501140 | 51501007 | − | ENST00000391806; ENST00000291726; ENST00000600767; ENST00000347619 | TSF |
| 3% | chr1 | 36604350 | 36604261 | − | chr1 | 36603579 | 36603397 | − | ENST00000373166; ENST00000373163; ENST00000373162 | TSF |
| 3% | chr11 | 324821 | 324180 | − | chr11 | 320772 | 320565 | − | ENST00000399808 | TSF |
| 3% | chr8 | 144691011 | 144690934 | − | chr8 | 149690296 | 144690232 | − | ENST00000220966; ENST00000433751 | TSF |
| 3% | chr8 | 144691011 | 144690934 | − | chr8 | 149690296 | 144690232 | − | ENST00000220966; ENST00000433751 | TSF |
| 3% | chr4 | 1101138 | 1101040 | − | chr4 | 1090627 | 1090578; 1090553 | − | ENST00000506730; ENST00000382968; ENST00000433731; ENST00000511620; ENST00000508428; ENST00000333673 | TSF |
| 3% | chr4 | 1101138 | 1101040 | − | chr4 | 1090627 | 1090578; 1090553 | − | ENST00000506730; ENST00000382968; ENST00000433731; ENST00000511620; ENST00000508428; ENST00000333673 | TSF |
| 3% | chr4 | 1101138 | 1101040 | − | chr4 | 1090627 | 1090578; 1090553 | − | ENST00000506730; ENST00000382968; ENST00000433731; ENST00000511620; ENST00000508428; ENST00000333673 | TSF |
| 3% | chr4 | 1101138 | 1101040 | − | chr4 | 1090627 | 1090578; 1090553 | − | ENST00000506730; ENST00000382968; ENST00000433731; ENST00000511620; ENST00000508428; ENST00000333673 | TSF |
| 3% | chr4 | 1101138 | 1101040 | − | chr4 | 1090627 | 1090578; 1090553 | − | ENST00000506730; ENST00000382968; ENST00000433731; ENST00000511620; ENST00000508428; ENST00000333673 | TSF |
| 3% | chr3 | 191873117 | 191872988 | − | chr3 | 191861916 | 191861798; 191861849 | − | ENST00000445105; ENST00000264730; ENST00000454309; ENST00000440901; ENST00000450716; ENST00000430714; ENST00000448795 | TSF |
| 3% | chr3 | 191873117 | 191872988 | − | chr3 | 191861916 | 191861798; 191861849 | − | ENST00000445105; ENST00000264730; ENST00000454309; ENST00000440901; ENST00000450716; ENST00000430714; ENST00000448795 | TSF |
| 3% | chr1 | 43634418 | 43634409 | − | chr1 | 43632906 | 43632831 | − | ENST00000431635; ENST00000236051 | TSF |
| 3% | chr2 | 99224680 | 99224660 | − | chr2 | 99220654 | 99220571 | − | ENST00000328709; ENST00000409997 | TSF |
| 3% | chr2 | 99224680 | 99224660 | − | chr2 | 99220654 | 99220571 | − | ENST00000328709; ENST00000409997 | TSF |
| 3% | chr3 | 139086428 | 139086379 | − | chr3 | 139085987 | 139085857; 139085942 | − | ENST00000333188; ENST00000507777; ENST00000512309 | TSF |
| 3% | chr3 | 139086428 | 139086379 | − | chr3 | 139085987 | 139085857; 139085942 | − | ENST00000333188; ENST00000507777; ENST00000512309 | TSF |
| 3% | chr2 | 238921636 | 238921737 | + | chr2 | 238925208 | 238925275 | + | ENST00000272930; ENST00000448502; | TSF |

TABLE 44-continued

Transcript fusion for ovarian cancer (OV) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| | | | | | | | | | ENST00000416292; ENST00000409633; ENST00000455999; ENST00000414443; ENST00000439780; ENST00000449191; ENST00000433241; ENST00000409953; ENST00000409332; ENST00000434655; ENST00000434137 | |
| 3% | chr2 | 238921636 | 238921737 | + | chr2 | 238925208 | 238925275 | + | ENST00000272930; ENST00000448502; ENST00000416292; ENST00000409633; ENST00000455999; ENST00000414443; ENST00000439780; ENST00000449191; ENST00000433241; ENST00000409953; ENST00000409332; ENST00000434655; ENST00000434137 | TSF |
| 3% | chr2 | 238921636 | 238921737 | + | chr2 | 238925208 | 238925275 | + | ENST00000272930; ENST00000448502; ENST00000416292; ENST00000409633; ENST00000455999; ENST00000414443; ENST00000439780; ENST00000449191; ENST00000433241; ENST00000409953; ENST00000409332; ENST00000434655; ENST00000434137 | TSF |
| 3% | chr2 | 238921636 | 238921737 | + | chr2 | 238925208 | 238925275 | + | ENST00000272930; ENST00000448502; ENST00000416292; ENST00000409633; ENST00000455999; ENST00000414443; ENST00000439780; ENST00000449191; ENST00000433241; ENST00000409953; ENST00000409332; ENST00000434655; ENST00000434137 | TSF |
| 3% | chr2 | 238921636 | 238921737 | + | chr2 | 238925208 | 238925275 | + | ENST00000272930; ENST00000448502; ENST00000416292; ENST00000409633; ENST00000455999; ENST00000414443; ENST00000439780; ENST00000449191; ENST00000433241; ENST00000409953; ENST00000409332; ENST00000434655; ENST00000434137 | TSF |
| 3% | chr2 | 238921636 | 238921737 | + | chr2 | 238925208 | 238925275 | + | ENST00000272930; ENST00000448502; ENST00000416292; ENST00000409633; ENST00000455999; ENST00000414443; ENST00000439780; ENST00000449191; ENST00000433241; ENST00000409953; ENST00000409332; ENST00000434655; ENST00000434137 | TSF |
| 3% | chr2 | 238921636 | 238921737 | + | chr2 | 238925208 | 238925275 | + | ENST00000272930; ENST00000448502; ENST00000416292; ENST00000409633; ENST00000455999; ENST00000414443; ENST00000439780; ENST00000449191; ENST00000433241; ENST00000409953; ENST00000409332; ENST00000434655; ENST00000434137 | TSF |
| 3% | chr2 | 238921636 | 238921737 | + | chr2 | 238925208 | 238925275 | + | ENST00000272930; ENST00000448502; ENST00000416292; ENST00000409633; ENST00000455999; ENST00000414443; ENST00000439780; ENST00000449191; ENST00000433241; ENST00000409953; ENST00000409332; ENST00000434655; ENST00000434137 | TSF |
| 3% | chr2 | 238921636 | 238921737 | + | chr2 | 238925208 | 238925275 | + | ENST00000272930; ENST00000448502; ENST00000416292; ENST00000409633; ENST00000455999; ENST00000414443; ENST00000439780; ENST00000449191; ENST00000433241; ENST00000409953; ENST00000409332; ENST00000434655; ENST00000434137 | TSF |
| 3% | chr14 | 95047992 | 95048047 | + | chr14 | 95053957 | 95054215; 95054318; 95053971; 95053957; 95054132; 95054170 | + | ENST00000554220; ENST00000553780; ENST00000554760; ENST00000554866; ENST00000329597; ENST00000556775; ENST00000553511; ENST00000554633; ENST00000555681; ENST00000554276; ENST00000557598 | TSF |
| 3% | chr14 | 95047992 | 95048047 | + | chr14 | 95053957 | 95054215; | + | ENST00000554220; ENST00000553780; | TSF |

TABLE 44-continued

Transcript fusion for ovarian cancer (OV) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
|  |  |  |  |  |  |  | 95054318; 95053971; 95053957; 95054132; 95054170 4170 | | ENST00000554760; ENST00000554866; ENST00000329597; ENST00000556775; ENST00000553511; ENST00000554633; ENST00000555681; ENST00000554276; ENST00000557598 ENST00000554276; ENST00000557598 |  |
| 3% | chr14 | 95047992 | 95048047 | + | chr14 | 95053957 | 95054215; 95054318; 95053971; 95053957; 95054132; 95054170 | + | ENST00000554220; ENST00000553780; ENST00000554760; ENST00000554866; ENST00000329597; ENST00000556775; ENST00000553511; ENST00000554633; ENST00000555681; ENST00000554276; ENST00000557598 | TSF |
| 3% | chr14 | 95047992 | 95048047 | + | chr14 | 95053957 | 95054215; 95054318; 95053971; 95053957; 95054132; 95054170 | + | ENST00000554220; ENST00000553780; ENST00000554760; ENST00000554866; ENST00000329597; ENST00000556775; ENST00000553511; ENST00000554633; ENST00000555681; ENST00000554276; ENST00000557598 | TSF |
| 3% | chr14 | 95047992 | 95048047 | + | chr14 | 95053957 | 95054215; 95054318; 95053971; 95053957; 95054132; 95054170 | + | ENST00000554220; ENST00000553780; ENST00000554760; ENST00000554866; ENST00000329597; ENST00000556775; ENST00000553511; ENST00000554633; ENST00000555681; ENST00000554276; ENST00000557598 | TSF |
| 3% | chr14 | 95047992 | 95048047 | + | chr14 | 95053957 | 95054215; 95054318; 95053971; 95053957; 95054132; 95054170 | + | ENST00000554220; ENST00000553780; ENST00000554760; ENST00000554866; ENST00000329597; ENST00000556775; ENST00000553511; ENST00000554633; ENST00000555681; ENST00000554276; ENST00000557598 | TSF |
| 3% | chr14 | 95047992 | 95048047 | + | chr14 | 95053957 | 95054215; 95054318; 95053971; 95053957; 95054132; 95054170 | + | ENST00000554220; ENST00000553780; ENST00000554760; ENST00000554866; ENST00000329597; ENST00000556775; ENST00000553511; ENST00000554633; ENST00000555681; ENST00000554276; ENST00000557598 | TSF |
| 3% | chr14 | 95047992 | 95048047 | + | chr14 | 95053957 | 95054215; 95054318; 95053971; 95053957; 95054132; 95054170 | + | ENST00000554220; ENST00000553780; ENST00000554760; ENST00000554866; ENST00000329597; ENST00000556775; ENST00000553511; ENST00000554633; ENST00000555681; ENST00000554276; ENST00000557598 | TSF |
| 3% | chr19 | 13148192 | 13148316 | + | chr19 | 13183861 | 13183923 | + | ENST00000397661; ENST00000592199; ENST00000585382; ENST00000587760; ENST00000585575; ENST00000360105; ENST00000588228; ENST00000587260; ENST00000358552 | TSF |
| 3% | chr19 | 13148192 | 13148316 | + | chr19 | 13183861 | 13183923 | + | ENST00000397661; ENST00000592199; ENST00000585382; ENST00000587760; ENST00000585575; ENST00000360105; ENST00000588228; ENST00000587260; ENST00000358552 | TSF |
| 3% | chr19 | 13148192 | 13148316 | + | chr19 | 13183861 | 13183923 | + | ENST00000397661; ENST00000592199; ENST00000585382; ENST00000587760; ENST00000585575; ENST00000360105; ENST00000588228; ENST00000587260; ENST00000358552 | TSF |
| 3% | chr19 | 13148192 | 13148316 | + | chr19 | 13183861 | 13183923 | + | ENST00000397661; ENST00000592199; ENST00000585382; ENST00000587760; ENST00000585575; ENST00000360105; ENST00000588228; ENST00000587260; ENST00000358552 | TSF |
| 3% | chr19 | 13148192 | 13148316 | + | chr19 | 13183861 | 13183923 | + | ENST00000397661; ENST00000592199; ENST00000585382; ENST00000587760; ENST00000585575; ENST00000360105; ENST00000588228; ENST00000587260; ENST00000358552 | TSF |
| 3% | chr5 | 179238653 | 179238682 | + | chr5 | 179250858 | 179251087; 179251057 | + | ENST00000376929; ENST00000514093; ENST00000422245; ENST00000389805; ENST00000504627; ENST00000402874; ENST00000510187; ENST00000360718 | TSF |
| 3% | chr5 | 179238653 | 179238682 | + | chr5 | 179250858 | 179251087; 179251057 | + | ENST00000376929; ENST00000514093; ENST00000422245; ENST00000389805; ENST00000504627; ENST00000402874; ENST00000510187; ENST00000360718 | TSF |
| 3% | chr5 | 179238653 | 179238682 | + | chr5 | 179250858 | 179251087; | + | ENST00000376929; ENST00000514093; | TSF |

TABLE 44-continued

Transcript fusion for ovarian cancer (OV) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 3% | chr5 | 179238653 | 179238682 | + | chr5 | 179250858 | 179251087; 179251057 | + | ENST00000422245; ENST00000389805; ENST00000504627; ENST00000402874; ENST00000510187; ENST00000360718 ENST00000376929; ENST00000514093; | TSF |
| 3% | chr5 | 179238653 | 179238682 | + | chr5 | 179250858 | 179251087; 179251057 | + | ENST00000422245; ENST00000389805; ENST00000504627; ENST00000402874; ENST00000510187; ENST00000360718 ENST00000376929; ENST00000514093; | TSF |
| 3% | chr2 | 26947307 | 26947428 | + | chr2 | 26950532 | 26951436 | + | ENST00000302909 | TSF |
| 3% | chr12 | 12966683 | 12966871 | + | chr12 | 12967065 | 12967158 | + | ENST00000352940; ENST00000358007; ENST00000544400 | TSF |
| 3% | chr12 | 12966683 | 12966871 | + | chr12 | 12967065 | 12967158 | + | ENST00000352940; ENST00000358007; ENST00000544400 | TSF |
| 3% | chr12 | 12966683 | 12966871 | + | chr12 | 12967065 | 12967158 | + | ENST00000352940; ENST00000358007; ENST00000544400 | TSF |
| 3% | chr20 | 62631560 | 62631628 | + | chr20 | 62632430 | 62632592 | + | ENST00000535781; ENST00000266079 | TSF |
| 3% | chr20 | 62631560 | 62631628 | + | chr20 | 62632430 | 62632592 | + | ENST00000535781; ENST00000266079 | TSF |
| 3% | chr4 | 56227367 | 56227417 | + | chr4 | 56235999 | 56236258 | + | ENST00000264228; ENST00000505210 | TSF |
| 3% | chr2 | 232340741 | 232340940 | + | chr2 | 232576646 | 232576693 | + | ENST00000409321; ENST00000409115; ENST00000341369; ENST00000409683; ENST00000410064; ENST00000412128 | TSF |
| 3% | chr2 | 232340741 | 232340940 | + | chr2 | 232576646 | 232576693 | + | ENST00000409321; ENST00000409115; ENST00000341369; ENST00000409683; ENST00000410064; ENST00000412128 | TSF |
| 3% | chr4 | 6592494 | 6592648 | + | chr4 | 6594900 | 6595077; 6595011 | + | ENST00000285599; ENST00000504248; ENST00000505907 | TSF |
| 3% | chr4 | 6592494 | 6592648 | + | chr4 | 6594900 | 6595077; 6595011 | + | ENST00000285599; ENST00000504248; ENST00000505907 | TSF |
| 3% | chr4 | 6592494 | 6592648 | + | chr4 | 6594900 | 6595077; 6595011 | + | ENST00000285599; ENST00000504248; ENST00000505907 | TSF |
| 3% | chr11 | 67803205 | 67803255 | + | chr11 | 67803929 | 67804060; 67803981 | + | ENST00000313468; ENST00000528492; ENST00000526339 | TSF |
| 3% | chr11 | 67803205 | 67803255 | + | chr11 | 67803929 | 67804060; 67803981 | + | ENST00000313468; ENST00000528492; ENST00000526339 | TSF |
| 3% | chr12 | 48166180 | 48166365 | + | chr12 | 48172811 | 48172978; 48172837 | + | ENST00000442218; ENST00000551301 | TSF |
| 3% | chr12 | 48166180 | 48166365 | + | chr12 | 48172811 | 48172978; 48172837 | + | ENST00000442218; ENST00000551301 | TSF |
| 3% | chr14 | 20787221 | 20787171 | − | chr14 | 20784719 | 20784573 | − | ENST00000556563 | TSF |
| 3% | chr19 | 55449720 | 55449717 | − | chr19 | 55449609 | 55449412 | − | ENST00000340844; ENST00000590030; ENST00000446217; ENST00000588756; ENST00000586379; ENST00000592784 | TSF |
| 3% | chr19 | 55449720 | 55449717 | − | chr19 | 55449609 | 55449412 | − | ENST00000340844; ENST00000590030; ENST00000446217; ENST00000588756; ENST00000586379; ENST00000592784 | TSF |
| 3% | chr19 | 55449720 | 55449717 | − | chr19 | 55449609 | 55449412 | − | ENST00000340844; ENST00000590030; ENST00000446217; ENST00000588756; ENST00000586379; ENST00000592784 | TSF |
| 3% | chr7 | 102118425 | 102118421 | − | chr7 | 102116717 | 102116628 | − | ENST00000292614; ENST00000393794 | TSF |
| 3% | chr7 | 102118425 | 102118421 | − | chr7 | 102116717 | 102116628 | − | ENST00000292614; ENST00000393794 | TSF |
| 3% | chr12 | 54862718 | 54862609 | − | chr12 | 54858951 | 54858851 | − | ENST00000546931; ENST00000552397; ENST00000305879 | TSF |
| 3% | chr12 | 54862718 | 54862609 | − | chr12 | 54858951 | 54858851 | − | ENST00000546931; ENST00000552397; ENST00000305879 | TSF |
| 3% | chr1 | 8924664 | 8924519 | − | chr1 | 8924151 | 8923950 | − | ENST00000234590 | TSF |
| 3% | chr11 | 60720029 | 60719973 | − | chr11 | 60718838 | 60718466 | − | ENST00000541505; ENST00000227880 | TSF |
| 3% | chr11 | 60720029 | 60719973 | − | chr11 | 60718838 | 60718466 | − | ENST00000541505; ENST00000227880 | TSF |
| 3% | chr15 | 67546688 | 67546562 | − | chr15 | 67529158 | 67528968 | − | ENST00000261880 | TSF |
| 2% | chr19 | 16267516 | 16267584 | + | chr19 | 16268020 | 16268208; 16268205; 16268448; 16268139 | + | ENST00000253680; ENST00000397372; ENST00000593154; ENST00000588246; ENST00000593031 | TSF |
| 2% | chr19 | 16267516 | 16267584 | + | chr19 | 16268020 | 16268208; 16268205; 16268448; 16268139 | + | ENST00000253680; ENST00000397372; ENST00000593154; ENST00000588246; ENST00000593031 | TSF |
| 2% | chr19 | 16267516 | 16267584 | + | chr19 | 16268020 | 16268208; 16268205; 16268448; 16268139 | + | ENST00000253680; ENST00000397372; ENST00000593154; ENST00000588246; ENST00000593031 | TSF |
| 2% | chr19 | 16267516 | 16267584 | + | chr19 | 16268020 | 16268208; 16268205; 16268448; | + | ENST00000253680; ENST00000397372; ENST00000593154; ENST00000588246; ENST00000593031 | |

TABLE 44-continued

Transcript fusion for ovarian cancer (OV) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 2% | chr22 | 38253087 | 38253185 | + | chr22 | 38254686 | 16268139 38254747 | + | ENST00000412331; ENST00000381683; ENST00000414316; ENST00000406934; ENST00000451427 | TSF |
| 2% | chr22 | 38253087 | 38253185 | + | chr22 | 38254686 | 38254747 | + | ENST00000412331; ENST00000381683; ENST00000414316; ENST00000406934; ENST00000451427 | TSF |
| 2% | chr22 | 38253087 | 38253185 | + | chr22 | 38254686 | 38254747 | + | ENST00000412331; ENST00000381683; ENST00000414316; ENST00000406934; ENST00000451427 | TSF |
| 2% | chr22 | 38253087 | 38253185 | + | chr22 | 38254686 | 38254747 | + | ENST00000412331; ENST00000381683; ENST00000414316; ENST00000406934; ENST00000451427 | TSF |
| 2% | chr2 | 3624355 | 3624441 | + | chr2 | 3625300 | 3625364 | + | ENST00000304921; ENST00000407445; ENST00000403564; ENST00000406376 | TSF |
| 2% | chr2 | 3624355 | 3624441 | + | chr2 | 3625300 | 3625364 | + | ENST00000304921; ENST00000407445; ENST00000403564; ENST00000406376 | TSF |
| 2% | chr16 | 89884404 | 89884946 | + | chr16 | 89911730 | 89911773 | + | ENST00000393062; ENST00000378247; ENST00000563972 | TSF |
| 2% | chr16 | 89884404 | 89884946 | + | chr16 | 89911730 | 89911773 | + | ENST00000393062; ENST00000378247; ENST00000563972 | TSF |
| 2% | chr16 | 89884404 | 89884946 | + | chr16 | 89911730 | 89911773 | + | ENST00000393062; ENST00000378247; ENST00000563972 | TSF |
| 2% | chr4 | 56227367 | 56227417 | + | chr4 | 56230241 | 56230438 | + | ENST00000264228 | TSF |
| 2% | chr9 | 97766976 | 97767010 | + | chr9 | 97767440 | 97767502 | + | ENST00000297979; ENST00000375315; ENST00000424143; ENST00000428313; ENST00000451893; ENST00000425634; ENST00000445181; ENST00000478473 | TSF |
| 2% | chr9 | 97766976 | 97767010 | + | chr9 | 97767440 | 97767502 | + | ENST00000297979; ENST00000375315; ENST00000424143; ENST00000428313; ENST00000451893; ENST00000425634; ENST00000445181; ENST00000478473 | TSF |
| 2% | chr9 | 97766976 | 97767010 | + | chr9 | 97767440 | 97767502 | + | ENST00000297979; ENST00000375315; ENST00000424143; ENST00000428313; ENST00000451893; ENST00000425634; ENST00000445181; ENST00000478473 | TSF |
| 2% | chr2 | 26309164 | 26309272 | + | chr2 | 26321531 | 26321591 | + | ENST00000264710 | TSF |
| 2% | chr2 | 150015354 | 150015745 | + | chr2 | 150017278 | 150017349 | + | ENST00000409642; ENST00000450639; ENST00000280115 | TSF |
| 2% | chr2 | 150015354 | 150015745 | + | chr2 | 150017278 | 150017349 | + | ENST00000409642; ENST00000450639; ENST00000280115 | TSF |
| 2% | chr16 | 30011417 | 30011504 | + | chr16 | 30012079 | 30012157 | + | ENST00000563197; ENST00000304516; ENST00000567254; ENST00000567065; ENST00000562441; ENST00000567705; ENST00000567987 | TSF |
| 2% | chr16 | 30011417 | 30011504 | + | chr16 | 30012079 | 30012157 | + | ENST00000563197; ENST00000304516; ENST00000567254; ENST00000567065; ENST00000562441; ENST00000567705; ENST00000567987 | TSF |
| 2% | chr16 | 30011417 | 30011504 | + | chr16 | 30012079 | 30012157 | + | ENST00000563197; ENST00000304516; ENST00000567254; ENST00000567065; ENST00000562441; ENST00000567705; ENST00000567987 | TSF |
| 2% | chr16 | 30011417 | 30011504 | + | chr16 | 30012079 | 30012157 | + | ENST00000563197; ENST00000304516; ENST00000567254; ENST00000567065; ENST00000562441; ENST00000567705; ENST00000567987 | TSF |
| 2% | chr16 | 30011417 | 30011504 | + | chr16 | 30012079 | 30012157 | + | ENST00000563197; ENST00000304516; ENST00000567254; ENST00000567065; ENST00000562441; ENST00000567705; ENST00000567987 | TSF |
| 2% | chr16 | 30011417 | 30011504 | + | chr16 | 30012079 | 30012157 | + | ENST00000563197; ENST00000304516; ENST00000567254; ENST00000567065; ENST00000562441; ENST00000567705; ENST00000567987 | TSF |
| 2% | chr6 | 35258663 | 35258760 | + | chr6 | 35259055 | 35259180 | + | ENST00000469195; ENST00000373953; ENST00000440666; ENST00000339411 | TSF |
| 2% | chr6 | 35258663 | 35258760 | + | chr6 | 35259055 | 35259180 | + | ENST00000469195; ENST00000373953; ENST00000440666; ENST00000339411 | TSF |
| 2% | chr6 | 35258663 | 35258760 | + | chr6 | 35259055 | 35259180 | + | ENST00000469195; ENST00000373953; ENST00000440666; ENST00000339411 | TSF |
| 2% | chr11 | 102045048 | 102045146 | + | chr11 | 102056749 | 102056862 | + | ENST00000282441; ENST00000537274; ENST00000531439; ENST00000524575 | TSF |
| 2% | chr11 | 102045048 | 102045146 | + | chr11 | 102056749 | 102056862 | + | ENST00000282441; ENST00000537274; ENST00000531439; ENST00000524575 | TSF |
| 2% | chr11 | 102045048 | 102045146 | + | chr11 | 102056749 | 102056862 | + | ENST00000282441; ENST00000537274; | TSF |

TABLE 44-continued

Transcript fusion for ovarian cancer (OV) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 2% | chr4 | 111332609 | 111332609 | + | chr4 | 111409697 | 111409838 | + | ENST00000531439; ENST00000524575 ENST00000265162 | TSF |
| 2% | chr9 | 35846065 | 35846070 | + | chr9 | 35846255 | 35846378 | + | ENST00000377996; ENST00000439587; ENST00000377991; ENST00000377988 | TSF |
| 2% | chr9 | 35846065 | 35846070 | + | chr9 | 35846255 | 35846378 | + | ENST00000377996; ENST00000439587; ENST00000377991; ENST00000377988 | TSF |
| 2% | chr3 | 139251153 | 139250891 | − | chr3 | 139237364 | 139237263 | − | ENST00000232219 | TSF |
| 2% | chr1 | 49723490 | 49723396 | − | chr1 | 49711536 | 49711442 | − | ENST00000371839; ENST00000371838; ENST00000371836 | TSF |
| 2% | chr1 | 49723490 | 49723396 | − | chr1 | 49711536 | 49711442 | − | ENST00000371839; ENST00000371838; ENST00000371836 | TSF |
| 2% | chr1 | 49723490 | 49723396 | − | chr1 | 49711536 | 49711442 | − | ENST00000371839; ENST00000371838; ENST00000371836 | TSF |
| 2% | chr1 | 43409712 | 43409704 | − | chr1 | 43408992 | 43408897 | − | ENST00000426263; ENST00000415851; ENST00000372500 | TSF |
| 2% | chr1 | 43409712 | 43409704 | − | chr1 | 43408992 | 43408897 | − | ENST00000426263; ENST00000415851; ENST00000372500 | TSF |
| 2% | chr1 | 43409712 | 43409704 | − | chr1 | 43408992 | 43408897 | − | ENST00000426263; ENST00000415851; ENST00000372500 | TSF |
| 2% | chr7 | 102212088 | 102212084 | − | chr7 | 102210371 | 102210282 | − | ENST00000489144; ENST00000379340; ENST00000486319; ENST00000508848; ENST00000513506; ENST00000514917; ENST00000507355; ENST00000608621; ENST00000511313; ENST00000513438 | TSF |
| 2% | chr7 | 102212088 | 102212084 | − | chr7 | 102210371 | 102210282 | − | ENST00000489144; ENST00000379340; ENST00000486319; ENST00000508848; ENST00000513506; ENST00000514917; ENST00000507355; ENST00000608621; ENST00000511313; ENST00000513438 | TSF |
| 2% | chr7 | 102212088 | 102212084 | − | chr7 | 102210371 | 102210282 | − | ENST00000489144; ENST00000379340; ENST00000486319; ENST00000508848; ENST00000513506; ENST00000514917; ENST00000507355; ENST00000608621; ENST00000511313; ENST00000513438 | TSF |
| 2% | chr7 | 102212088 | 102212084 | − | chr7 | 102210371 | 102210282 | − | ENST00000489144; ENST00000379340; ENST00000486319; ENST00000508848; ENST00000513506; ENST00000514917; ENST00000507355; ENST00000608621; ENST00000511313; ENST00000513438 | TSF |
| 2% | chr7 | 102212088 | 102212084 | − | chr7 | 102210371 | 102210282 | − | ENST00000489144; ENST00000379340; ENST00000486319; ENST00000508848; ENST00000513506; ENST00000514917; ENST00000507355; ENST00000608621; ENST00000511313; ENST00000513438 | TSF |
| 2% | chr7 | 102212088 | 102212084 | − | chr7 | 102210371 | 102210282 | − | ENST00000489144; ENST00000379340; ENST00000486319; ENST00000508848; ENST00000513506; ENST00000514917; ENST00000507355; ENST00000608621; ENST00000511313; ENST00000513438 | TSF |
| 2% | chr7 | 102212088 | 102212084 | − | chr7 | 102210371 | 102210282 | − | ENST00000489144; ENST00000379340; ENST00000486319; ENST00000508848; ENST00000513506; ENST00000514917; ENST00000507355; ENST00000608621; ENST00000511313; ENST00000513438 | TSF |
| 2% | chr7 | 102212088 | 102212084 | − | chr7 | 102210371 | 102210282 | − | ENST00000489144; ENST00000379340; ENST00000486319; ENST00000508848; ENST00000513506; ENST00000514917; ENST00000507355; ENST00000608621; ENST00000511313; ENST00000513438 | TSF |
| 2% | chr19 | 47347459 | 47347409 | − | chr19 | 47342835 | 47342722 | − | ENST00000352203; ENST00000601498; ENST00000599990; ENST00000593442; ENST00000263270; ENST00000597020 | TSF |
| 2% | chr11 | 323767 | 323324 | − | chr11 | 320772 | 320565 | − | ENST00000399808 | TSF |
| 2% | chr19 | 46194689 | 46194670 | − | chr19 | 46191824 | 46191645 | − | ENST00000342669; ENST00000588301; ENST00000590212 | TSF |
| 2% | chr19 | 46194689 | 46194670 | − | chr19 | 46191824 | 46191645 | − | ENST00000342669; ENST00000588301; ENST00000590212 | TSF |
| 2% | chr17 | 30185561 | 30185499 | − | chr17 | 30183884 | 30183818 | − | ENST00000302362; ENST00000378634; ENST00000496655 | TSF |
| 2% | chr17 | 30185567 | 30185499 | − | chr17 | 30183884 | 30183818 | − | ENST00000302362; ENST00000378634; ENST00000496655 | TSF |
| 2% | chr19 | 2141057 | 2140989 | − | chr19 | 2138713 | 2138618 | − | ENST00000355272; ENST00000356926; ENST00000350812; ENST00000345016 | TSF |
| 2% | chr19 | 2141057 | 2140989 | − | chr19 | 2138713 | 2138618 | − | ENST00000355272; ENST00000356926; ENST00000350812; ENST00000345016 | TSF |
| 2% | chr19 | 2141057 | 2140989 | − | chr19 | 2138713 | 2138618 | − | ENST00000355272; ENST00000356926; | TSF |

TABLE 44-continued

Transcript fusion for ovarian cancer (OV) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 2% | chr19 | 2141057 | 2140989 | – | chr19 | 2138713 | 2138618 | – | ENST00000350812; ENST00000345016 ENST00000355272; ENST00000356926; | TSF |
| 2% | chr2 | 38983894 | 38983253 | – | chr2 | 38977336 | 38977156 | – | ENST00000350812; ENST00000345016 ENST00000313117; ENST00000425778; ENST00000425941; ENST00000446327; ENST00000409276; ENST00000431066; ENST00000443213 | TSF |
| 2% | chr2 | 38983894 | 38983253 | – | chr2 | 38977336 | 38977156 | – | ENST00000313117; ENST00000425778; ENST00000425941; ENST00000446327; ENST00000409276; ENST00000431066; ENST00000443213 | TSF |
| 2% | chr2 | 38983894 | 38983253 | – | chr2 | 38977336 | 38977156 | – | ENST00000313117; ENST00000425778; ENST00000425941; ENST00000446327; ENST00000409276; ENST00000431066; ENST00000443213 | TSF |
| 2% | chr2 | 38983894 | 38983253 | – | chr2 | 38977336 | 38977156 | – | ENST00000313117; ENST00000425778; ENST00000425941; ENST00000446327; ENST00000409276; ENST00000431066; ENST00000443213 | TSF |
| 2% | chr2 | 38983894 | 38983253 | – | chr2 | 38977336 | 38977156 | – | ENST00000313117; ENST00000425778; ENST00000425941; ENST00000446327; ENST00000409276; ENST00000431066; ENST00000443213 | TSF |
| 2% | chr2 | 38983894 | 38983253 | – | chr2 | 38977336 | 38977156 | – | ENST00000313117; ENST00000425778; ENST00000425941; ENST00000446327; ENST00000409276; ENST00000431066; ENST00000443213 | TSF |
| 2% | chr4 | 83774285 | 83774211 | – | chr4 | 83772757 | 83772584; 83772667 | – | ENST00000348405; ENST00000513858; ENST00000395310; ENST00000443462; ENST00000509142; ENST00000311785; ENST00000326950; ENST00000432794; ENST00000448323; ENST00000505472; ENST00000500777; ENST00000508502; ENST00000355196; ENST00000264405; ENST00000505984; ENST00000508479; ENST00000507828; ENST00000512664 | TSF |
| 2% | chr4 | 83774285 | 83774211 | – | chr4 | 83772757 | 83772584; 83772667 | – | ENST00000348405; ENST00000513858; ENST00000395310; ENST00000443462; ENST00000509142; ENST00000311785; ENST00000326950; ENST00000432794; ENST00000448323; ENST00000505472; ENST00000500777; ENST00000508502; ENST00000355196; ENST00000264405; ENST00000505984; ENST00000508479; ENST00000507828; ENST00000512664 | TSF |
| 2% | chr4 | 83774285 | 83774211 | – | chr4 | 83772757 | 83772584; 83772667 | – | ENST00000348405; ENST00000513858; ENST00000395310; ENST00000443462; ENST00000509142; ENST00000311785; ENST00000326950; ENST00000432794; ENST00000448323; ENST00000505472; ENST00000500777; ENST00000508502; ENST00000355196; ENST00000264405; ENST00000505984; ENST00000508479; ENST00000507828; ENST00000512664 | TSF |
| 2% | chr4 | 83774285 | 83774211 | – | chr4 | 83772757 | 83772584; 83772667 | – | ENST00000348405; ENST00000513858; ENST00000395310; ENST00000443462; ENST00000509142; ENST00000311785; ENST00000326950; ENST00000432794; ENST00000448323; ENST00000505472; ENST00000500777; ENST00000508502; ENST00000355196; ENST00000264405; ENST00000505984; ENST00000508479; ENST00000507828; ENST00000512664 | TSF |
| 2% | chr4 | 83774285 | 83774211 | – | chr4 | 83772757 | 83772584; 83772667 | – | ENST00000348405; ENST00000513858; ENST00000395310; ENST00000443462; ENST00000509142; ENST00000311785; ENST00000326950; ENST00000432794; ENST00000448323; ENST00000505472; ENST00000500777; ENST00000508502; ENST00000355196; ENST00000264405; ENST00000505984; ENST00000508479; ENST00000507828; ENST00000512664 | TSF |
| 2% | chr4 | 83774285 | 83774211 | – | chr4 | 83772757 | 83772584; 83772667 | – | ENST00000348405; ENST00000513858; ENST00000395310; ENST00000443462; ENST00000509142; ENST00000311785; ENST00000326950; ENST00000432794; | TSF |

TABLE 44-continued

Transcript fusion for ovarian cancer (OV) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 2% | chr4 | 83774285 | 83774211 | − | chr4 | 83772757 | 83772584; 83772667 | − | ENST00000448323; ENST00000505472; ENST00000500777; ENST00000508502; ENST00000355196; ENST00000264405; ENST00000505984; ENST00000508479; ENST00000507828; ENST00000512664 ENST00000348405; ENST00000513858; ENST00000395310; ENST00000443462; ENST00000509142; ENST00000311785; ENST00000326950; ENST00000432794; | TSF |
| 2% | chr4 | 83774285 | 83774211 | − | chr4 | 83772757 | 83772584; 83772667 | − | ENST00000448323; ENST00000505472; ENST00000500777; ENST00000508502; ENST00000355196; ENST00000264405; ENST00000505984; ENST00000508479; ENST00000507828; ENST00000512664 ENST00000348405; ENST00000513858; ENST00000395310; ENST00000443462; ENST00000509142; ENST00000311785; ENST00000326950; ENST00000432794; | TSF |
| 2% | chr4 | 83774285 | 83774211 | − | chr4 | 83772757 | 83772584; 83772667 | − | ENST00000448323; ENST00000505472; ENST00000500777; ENST00000508502; ENST00000355196; ENST00000264405; ENST00000505984; ENST00000508479; ENST00000507828; ENST00000512664 ENST00000348405; ENST00000513858; ENST00000395310; ENST00000443462; ENST00000509142; ENST00000311785; ENST00000326950; ENST00000432794; ENST00000448323; ENST00000505472; ENST00000500777; ENST00000508502; ENST00000355196; ENST00000264405; ENST00000505984; ENST00000508479; ENST00000507828; ENST00000512664 | TSF |
| 2% | chr14 | 92112577 | 92112481 | − | chr14 | 92105594 | 92105508; 92105440 | − | ENST00000557036; ENST00000256343 | TSF |
| 2% | chr14 | 92112577 | 92112481 | − | chr14 | 92105594 | 92105508; 92105440 | − | ENST00000557036; ENST00000256343 | TSF |
| 2% | chr7 | 22858195 | 22858099 | − | chr7 | 22857667 | 22857619 | − | ENST00000358435; ENST00000405021; ENST00000372879 | TSF |
| 2% | chr7 | 22858195 | 22858099 | − | chr7 | 22857667 | 22857619 | − | ENST00000358435; ENST00000405021; ENST00000372879 | TSF |
| 2% | chr11 | 100156479 | 100156572 | + | chr11 | 100168357 | 100168427 | + | ENST00000527185; ENST00000528682; ENST00000524871; ENST00000418526; ENST00000279463 | TSF |
| 2% | chr11 | 100156479 | 100156572 | + | chr11 | 100168357 | 100168427 | + | ENST00000527185; ENST00000528682; ENST00000524871; ENST00000418526; ENST00000279463 | TSF |
| 2% | chr20 | 60878087 | 60878105 | + | chr20 | 60878778 | 60878837 | + | ENST00000253003 | TSF |
| 2% | chr2 | 171572610 | 171572614 | + | chr2 | 171572769 | 171573914 | + | ENST00000375281 | TSF |
| 2% | chr11 | 40331346 | 46403329 | + | chr11 | 46403844 | 46404011; 46403914 | + | ENST00000405308; ENST00000441869; ENST00000359803; ENST00000533952; ENST00000395566; ENST00000489525; ENST00000407067; ENST00000395565 | TSF |
| 2% | chr11 | 40331346 | 46403329 | + | chr11 | 46403844 | 46404011; 46403914 | + | ENST00000405308; ENST00000441869; ENST00000359803; ENST00000533952; ENST00000395566; ENST00000489525; ENST00000407067; ENST00000395565 | TSF |
| 2% | chr11 | 40331346 | 46403329 | + | chr11 | 46403844 | 46404011; 46403914 | + | ENST00000405308; ENST00000441869; ENST00000359803; ENST00000533952; ENST00000395566; ENST00000489525; ENST00000407067; ENST00000395565 | TSF |
| 2% | chr11 | 40331346 | 46403329 | + | chr11 | 46403844 | 46404011; 46403914 | + | ENST00000405308; ENST00000441869; ENST00000359803; ENST00000533952; ENST00000395566; ENST00000489525; ENST00000407067; ENST00000395565 | TSF |
| 2% | chr21 | 42597177 | 42597622 | + | chr21 | 42598199 | 42598281 | + | ENST00000328735; ENST00000330333; ENST00000347667 | TSF |
| 2% | chr21 | 42597177 | 42597622 | + | chr21 | 42598199 | 42598281 | + | ENST00000328735; ENST00000330333; ENST00000347667 | TSF |
| 2% | chr21 | 42597177 | 42597622 | + | chr21 | 42598199 | 42598281 | + | ENST00000328735; ENST00000330333; ENST00000347667 | TSF |
| 2% | chr3 | 183973543 | 183973607 | + | chr3 | 183975261 | 183975544 | + | ENST00000324557; ENST00000402825 | TSF |
| 2% | chr3 | 183973543 | 183973607 | + | chr3 | 183975261 | 183975544 | + | ENST00000324557; ENST00000402825 | TSF |
| 2% | chr3 | 184083167 | 184083362 | + | chr3 | 184084505 | 184084588 | + | ENST00000456318; ENST00000438240; ENST00000455712; ENST00000452961; ENST00000296223; ENST00000429568 | TSF |
| 2% | chr3 | 184083167 | 184083362 | + | chr3 | 184084505 | 184084588 | + | ENST00000456318; ENST00000438240; | TSF |

TABLE 44-continued

Transcript fusion for ovarian cancer (OV) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 2% | chr3 | 184083167 | 184083362 | + | chr3 | 184084505 | 184084588 | + | ENST00000455712; ENST00000452961; ENST00000296223; ENST00000429568 ENST00000456318; ENST00000438240; ENST00000455712; ENST00000452961; ENST00000296223; ENST00000429568 | TSF |
| 2% | chr2 | 133324902 | 133325151 | + | chr2 | 133402674 | 133403179 | + | ENST00000329321 | TSF |
| 2% | chr7 | 56020443 | 56020509 | + | chr7 | 56020872 | 56021011 | + | ENST00000426595 | TSF |
| 2% | chr19 | 17524027 | 17524114 | + | chr19 | 17531122 | 17531220 | + | ENST00000317040; ENST00000528659; ENST00000392702; ENST00000529939; ENST00000528515; ENST00000543795 | TSF |
| 2% | chr19 | 17524027 | 17524114 | + | chr19 | 17531122 | 17531220 | + | ENST00000317040; ENST00000528659; ENST00000392702; ENST00000529939; ENST00000528515; ENST00000543795 | TSF |
| 2% | chr19 | 17524027 | 17524114 | + | chr19 | 17531122 | 17531220 | + | ENST00000317040; ENST00000528659; ENST00000392702; ENST00000529939; ENST00000528515; ENST00000543795 | TSF |
| 2% | chr19 | 17524027 | 17524114 | + | chr19 | 17531122 | 17531220 | + | ENST00000317040; ENST00000528659; ENST00000392702; ENST00000529939; ENST00000528515; ENST00000543795 | TSF |
| 2% | chr19 | 17524027 | 17524114 | + | chr19 | 17531122 | 17531220 | + | ENST00000317040; ENST00000528659; ENST00000392702; ENST00000529939; ENST00000528515; ENST00000543795 | TSF |
| 2% | chr4 | 125071 | 125178 | + | chr4 | 337571 | 337697 | + | ENST00000512994; ENST00000505939; ENST00000240499 | TSF |
| 2% | chr4 | 125071 | 125178 | + | chr4 | 337571 | 337697 | + | ENST00000512994; ENST00000505939; ENST00000240499 | TSF |
| 2% | chr4 | 125071 | 125178 | + | chr4 | 337571 | 337697 | + | ENST00000512994; ENST00000505939; ENST00000240499 | TSF |
| 2% | chr6 | 71556614 | 71556620 | + | chr6 | 71562243 | 71562367 | + | ENST00000316999; ENST00000370452; ENST00000370455 | TSF |
| 2% | chr6 | 71556614 | 71556620 | + | chr6 | 71562243 | 71562367 | + | ENST00000316999; ENST00000370452; ENST00000370455 | TSF |
| 2% | chr6 | 13616316 | 13616338 | + | chr6 | 13616695 | 13616753 | + | ENST00000451315; ENST00000420088 | TSF |
| 2% | chr6 | 13616316 | 13616338 | + | chr6 | 13616695 | 13616753 | + | ENST00000451315; ENST00000420088 | TSF |
| 2% | chr11 | 121357068 | 121357166 | + | chr11 | 121358741 | 121358902 | + | ENST00000260197 | TSF |
| 2% | chr1 | 23397020 | 23397118 | + | chr1 | 23397718 | 23397852 | + | ENST00000356634; ENST00000400181; ENST00000542151 | TSF |
| 2% | chr16 | 2556075 | 2556125 | + | chr16 | 2569219 | 2569384; 2569402 | + | ENST00000564543; ENST00000330398; ENST00000568562 | TSF |
| 2% | chr16 | 2556075 | 2556125 | + | chr16 | 2569219 | 2569384; 2569402 | + | ENST00000564543; ENST00000330398; ENST00000568562 | TSF |
| 2% | chr2 | 232340741 | 232340940 | + | chr2 | 2325777 | 232577226 | + | ENST00000409321; ENST00000409115; ENST00000341369; ENST00000409683; ENST00000410064; ENST00000412128 | TSF |
| 2% | chr2 | 132286104 | 132286168 | + | chr2 | 132287220 | 132287264 | + | ENST00000295171; ENST00000409856; ENST00000434330 | TSF |
| 2% | chr2 | 132286104 | 132286168 | + | chr2 | 132287220 | 132287264 | + | ENST00000295171; ENST00000409856; ENST00000434330 | TSF |
| 2% | chr2 | 132286104 | 132286168 | + | chr2 | 132287220 | 132287264 | + | ENST00000295171; ENST00000409856; ENST00000434330 | TSF |
| 2% | chr8 | 145516361 | 145516371 | + | chr8 | 145532592 | 145532700 | + | ENST00000528838 | TSF |
| 2% | chr22 | 38166164 | 38166230 | + | chr22 | 38167657 | 38167743 | + | ENST00000406386; ENST00000403663 | TSF |
| 2% | chr12 | 25062633 | 25062524 | − | chr12 | 25054819 | 25054748 | − | ENST00000261192; ENST00000538118; ENST00000539282; ENST00000539780 | TSF |
| 2% | chr12 | 25062633 | 25062524 | − | chr12 | 25054819 | 25054748 | − | ENST00000261192; ENST00000538118; ENST00000539282; ENST00000539780 | TSF |
| 2% | chr14 | 24682072 | 24681871 | − | chr14 | 24681035 | 24680886 | − | ENST00000530611; ENST00000556387; ENST00000347519; ENST00000533523; ENST00000609024; ENST00000533011; ENST00000534106 | TSF |
| 2% | chr14 | 24682072 | 24681871 | − | chr14 | 24681035 | 24680886 | − | ENST00000530611; ENST00000556387; ENST00000347519; ENST00000533523; ENST00000609024; ENST00000533011; ENST00000534106 | TSF |
| 2% | chr14 | 24682072 | 24681871 | − | chr14 | 24681035 | 24680886 | − | ENST00000530611; ENST00000556387; ENST00000347519; ENST00000533523; ENST00000609024; ENST00000533011; ENST00000534106 | TSF |
| 2% | chr14 | 24682072 | 24681871 | − | chr14 | 24681035 | 24680886 | − | ENST00000530611; ENST00000556387; ENST00000347519; ENST00000533523; ENST00000609024; ENST00000533011; ENST00000534106 | TSF |
| 2% | chr14 | 24682072 | 24681871 | − | chr14 | 24681035 | 24680886 | − | ENST00000530611; ENST00000556387; ENST00000347519; ENST00000533523; ENST00000609024; ENST00000533011; ENST00000534106 | TSF |

TABLE 44-continued

Transcript fusion for ovarian cancer (OV) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 2% | chr8 | 3040579 | 3040513 | − | chr8 | 3038736 | 3038632 | − | ENST00000335551; ENST00000400186; ENST00000602723; ENST00000520002; ENST00000602557; ENST00000537824; ENST00000542608; ENST00000539096 | TSF |
| 2% | chr8 | 3040579 | 3040513 | − | chr8 | 3038736 | 3038632 | − | ENST00000335551; ENST00000400186; ENST00000602723; ENST00000520002; ENST00000602557; ENST00000537824; ENST00000542608; ENST00000539096 | TSF |
| 2% | chr8 | 3040579 | 3040513 | − | chr8 | 3038736 | 3038632 | − | ENST00000335551; ENST00000400186; ENST00000602723; ENST00000520002; ENST00000602557; ENST00000537824; ENST00000542608; ENST00000539096 | TSF |
| 2% | chr8 | 3040579 | 3040513 | − | chr8 | 3038736 | 3038632 | − | ENST00000335551; ENST00000400186; ENST00000602723; ENST00000520002; ENST00000602557; ENST00000537824; ENST00000542608; ENST00000539096 | TSF |
| 2% | chrX | 134954053 | 134953756 | − | chrX | 134950133 | 134950078 | − | ENST00000420087; ENST00000463085; ENST00000370724; ENST00000491480 | TSF |
| 2% | chrX | 134954053 | 134953756 | − | chrX | 134950133 | 134950078 | − | ENST00000420087; ENST00000463085; ENST00000370724; ENST00000491480 | TSF |
| 2% | chr7 | 130130176 | 130130254 | + | chr7 | 130135209 | 130135363 | + | ENST00000223215; ENST00000437945 | TSF |
| 2% | chr7 | 130130176 | 130130254 | + | chr7 | 130135209 | 130135363 | + | ENST00000223215; ENST00000437945 | TSF |
| 2% | chr9 | 42254026 | 42254270 | + | chr9 | 42671887 | 42671946 | + | ENST00000456520; ENST00000377391 | TSF |
| 2% | chr9 | 42254026 | 42254270 | + | chr9 | 42671887 | 42671946 | + | ENST00000456520; ENST00000377391 | TSF |
| 2% | chr6 | 151188691 | 151188718 | + | chr6 | 151197226 | 151197310 | + | ENST00000367321; ENST00000367307; ENST00000367308 | TSF |
| 2% | chr6 | 151188691 | 151188718 | + | chr6 | 151197226 | 151197310 | + | ENST00000367321; ENST00000367307; ENST00000367308 | TSF |
| 2% | chr6 | 151188691 | 151188718 | + | chr6 | 151197226 | 151197310 | + | ENST00000367321; ENST00000367307; ENST00000367308 | TSF |
| 2% | chr22 | 45098289 | 45098289 | + | chr22 | 45098372 | 45098488 | + | ENST00000403581; ENST00000336985; ENST00000403696; ENST00000431834; ENST00000361473; ENST00000352766; ENST00000517296 | TSF |
| 2% | chr22 | 45098289 | 45098289 | + | chr22 | 45098372 | 45098488 | + | ENST00000403581; ENST00000336985; ENST00000403696; ENST00000431834; ENST00000361473; ENST00000352766; ENST00000517296 | TSF |
| 2% | chr22 | 45098289 | 45098289 | + | chr22 | 45098372 | 45098488 | + | ENST00000403581; ENST00000336985; ENST00000403696; ENST00000431834; ENST00000361473; ENST00000352766; ENST00000517296 | TSF |
| 2% | chr22 | 45098289 | 45098289 | + | chr22 | 45098372 | 45098488 | + | ENST00000403581; ENST00000336985; ENST00000403696; ENST00000431834; ENST00000361473; ENST00000352766; ENST00000517296 | TSF |
| 2% | chr22 | 45098289 | 45098289 | + | chr22 | 45098372 | 45098488 | + | ENST00000403581; ENST00000336985; ENST00000403696; ENST00000431834; ENST00000361473; ENST00000352766; ENST00000517296 | TSF |
| 2% | chr11 | 61544394 | 61544423 | + | chr11 | 61544736 | 61544936 | + | ENST00000278836; ENST00000265460; ENST00000327797 | TSF |
| 2% | chr11 | 61544394 | 61544423 | + | chr11 | 61544736 | 61544936 | + | ENST00000278836; ENST00000265460; ENST00000327797 | TSF |
| 2% | chr11 | 61544394 | 61544423 | + | chr11 | 61544736 | 61544936 | + | ENST00000278836; ENST00000265460; ENST00000327797 | TSF |
| 2% | chr11 | 65037941 | 65038313 | + | chr11 | 65043363 | 65043469 | + | ENST00000265465; ENST00000532391 | TSF |
| 2% | chr11 | 65037941 | 65038313 | + | chr11 | 65043363 | 65043469 | + | ENST00000265465; ENST00000532391 | TSF |
| 2% | chr2 | 177035648 | 177035647 | + | chr2 | 177036245 | 177037002 | + | ENST00000468418; ENST00000410016; ENST00000249440 | TSF |
| 2% | chr6 | 124669760 | 124669850 | + | chr6 | 124676413 | 124676493 | + | ENST00000368416; ENST00000368417; ENST00000546092; ENST00000545433 | TSF |
| 2% | chr6 | 124669760 | 124669850 | + | chr6 | 124676413 | 124676493 | + | ENST00000368416; ENST00000368417; ENST00000546092; ENST00000545433 | TSF |
| 2% | chr6 | 124669760 | 124669850 | + | chr6 | 124676413 | 124676493 | + | ENST00000368416; ENST00000368417; ENST00000546092; ENST00000545433 | TSF |
| 2% | chr6 | 124669760 | 124669850 | + | chr6 | 124676413 | 124676493 | + | ENST00000368416; ENST00000368417; ENST00000546092; ENST00000545433 | TSF |
| 2% | chr8 | 128749913 | 128749923 | + | chr8 | 128750494 | 128751265 | + | ENST00000377970 | TSF |
| 2% | chr19 | 39973016 | 39973114 | + | chr19 | 39973525 | 39973556; 39973603 | + | ENST00000314349; ENST00000601358; ENST00000607714; ENST00000597666; ENST00000602028; ENST00000597782; ENST00000599733; ENST00000602265; ENST00000594583 | TSF |
| 2% | chr19 | 39973016 | 39973114 | + | chr19 | 39973525 | 39973556; 39973603 | + | ENST00000314349; ENST00000601358; ENST00000607714; ENST00000597666; | TSF |

TABLE 44-continued

Transcript fusion for ovarian cancer (OV) Coordinates of the fusion sequences for which the donor is the TE.

| 1 | 2' | 3' | 4' | 5' | 6' | 7' | 8' | 9' | 10' | 11' |
|---|----|----|----|----|----|----|----|----|-----|-----|
| 2% | chr19 | 39973016 | 39973114 | + | chr19 | 39973525 | 39973556; 39973603 | + | ENST00000602028; ENST00000597782; ENST00000599733; ENST00000602265; ENST00000594583 ENST00000314349; ENST00000601358; ENST00000607714; ENST00000597666; ENST00000602028; ENST00000597782; ENST00000599733; ENST00000602265; ENST00000594583 | TSF |
| 2% | chr19 | 39973016 | 39973114 | + | chr19 | 39973525 | 39973556; 39973603 | + | ENST00000314349; ENST00000601358; ENST00000607714; ENST00000597666; ENST00000602028; ENST00000597782; ENST00000599733; ENST00000602265; ENST00000594583 | TSF |
| 2% | chr19 | 39973016 | 39973114 | + | chr19 | 39973525 | 39973556; 39973603 | + | ENST00000314349; ENST00000601358; ENST00000607714; ENST00000597666; ENST00000602028; ENST00000597782; ENST00000599733; ENST00000602265; ENST00000594583 | TSF |
| 2% | chr19 | 39973016 | 39973114 | + | chr19 | 39973525 | 39973556; 39973603 | + | ENST00000314349; ENST00000601358; ENST00000607714; ENST00000597666; ENST00000602028; ENST00000597782; ENST00000599733; ENST00000602265; ENST00000594583 | TSF |
| 2% | chr19 | 39973016 | 39973114 | + | chr19 | 39973525 | 39973556; 39973603 | + | ENST00000314349; ENST00000601358; ENST00000607714; ENST00000597666; ENST00000602028; ENST00000597782; ENST00000599733; ENST00000602265; ENST00000594583 | TSF |
| 2% | chr7 | 73098580 | 73098709 | + | chr7 | 73100966 | 73101061 | + | ENST00000265758; ENST00000432522; ENST00000421744; ENST00000428163; ENST00000423166; ENST00000423497 | TSF |
| 2% | chr7 | 73098580 | 73098709 | + | chr7 | 73100966 | 73101061 | + | ENST00000265758; ENST00000432522; ENST00000421744; ENST00000428163; ENST00000423166; ENST00000423497 | TSF |
| 2% | chr7 | 73098580 | 73098709 | + | chr7 | 73100966 | 73101061 | + | ENST00000265758; ENST00000432522; ENST00000421744; ENST00000428163; ENST00000423166; ENST00000423497 | TSF |
| 2% | chr7 | 73098580 | 73098709 | + | chr7 | 73100966 | 73101061 | + | ENST00000265758; ENST00000432522; ENST00000421744; ENST00000428163; ENST00000423166; ENST00000423497 | TSF |
| 2% | chr7 | 73098580 | 73098709 | + | chr7 | 73100966 | 73101061 | + | ENST00000265758; ENST00000432522; ENST00000421744; ENST00000428163; ENST00000423166; ENST00000423497 | TSF |
| 2% | chr2 | 232340741 | 232340940 | + | chr2 | 232576105 | 232576119; 232576129 | + | ENST00000448874; ENST00000409321; ENST00000409115; ENST00000341369; ENST00000409683; ENST00000410064; ENST00000412128 | TSF |
| 2% | chr2 | 232340741 | 232340940 | + | chr2 | 232576105 | 232576119; 232576129 | + | ENST00000448874; ENST00000409321; ENST00000409115; ENST00000341369; ENST00000409683; ENST00000410064; ENST00000412128 | TSF |
| 2% | chr2 | 232340741 | 232340940 | + | chr2 | 232576105 | 232576119; 232576129 | + | ENST00000448874; ENST00000409321; ENST00000409115; ENST00000341369; ENST00000409683; ENST00000410064; ENST00000412128 | TSF |
| 2% | chr2 | 232340741 | 232340940 | + | chr2 | 232576105 | 232576119; 232576129 | + | ENST00000448874; ENST00000409321; ENST00000409115; ENST00000341369; ENST00000409683; ENST00000410064; ENST00000412128 | TSF |
| 2% | chr8 | 145134058 | 145134124 | + | chr8 | 145134846 | 145135052; 145134924 | + | ENST00000316052; ENST00000525936; ENST00000527954 | TSF |
| 2% | chr8 | 145134058 | 145134124 | + | chr8 | 145134846 | 145135052; 145134924 | + | ENST00000316052; ENST00000525936; ENST00000527954 | TSF |
| 2% | chr8 | 145134058 | 145134124 | + | chr8 | 145134846 | 145135052; 145134924 | + | ENST00000316052; ENST00000525936; ENST00000527954 | TSF |
| 2% | chr12 | 49659927 | 4966025 | + | chr12 | 49663248 | 49663470; 49663252 | + | ENST00000541364; ENST00000552125; ENST00000301072; ENST00000549183 | TSF |
| 2% | chr12 | 49659927 | 4966025 | + | chr12 | 49663248 | 49663470; 49663252 | + | ENST00000541364; ENST00000552125; ENST00000301072; ENST00000549183 | TSF |
| 2% | chr12 | 49659927 | 4966025 | + | chr12 | 49663248 | 49663470; 49663252 | + | ENST00000541364; ENST00000552125; ENST00000301072; ENST00000549183 | TSF |
| 2% | chr15 | 72464154 | 72463983 | − | chr15 | 72462280 | 72462188 | − | ENST00000309731; ENST00000564129; ENST00000568594; ENST00000570275; ENST00000562288 | TSF |
| 2% | chr15 | 72464154 | 72463983 | − | chr15 | 72462280 | 72462188 | − | ENST00000309731; ENST00000564129; ENST00000568594; ENST00000570275; | TSF |

TABLE 44-continued

Transcript fusion for ovarian cancer (OV) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 2% | chr15 | 72464154 | 72463983 | − | chr15 | 72462280 | 72462188 | − | ENST00000562288 ENST00000309731; ENST00000564129; ENST00000568594; ENST00000570275; ENST00000562288 | TSF |
| 2% | chr15 | 72464154 | 72463983 | − | chr15 | 72462280 | 72462188 | − | ENST00000309731; ENST00000564129; ENST00000568594; ENST00000570275; ENST00000562288 | TSF |
| 2% | chr15 | 72464154 | 72463983 | − | chr15 | 72462280 | 72462188 | − | ENST00000309731; ENST00000564129; ENST00000568594; ENST00000570275; ENST00000562288 | TSF |
| 2% | chrX | 134971303 | 134971006 | − | chrX | 134950133 | 134950078 | − | ENST00000420087; ENST00000463085; ENST00000370724; ENST00000491480 | TSF |
| 2% | chrX | 134971303 | 134971006 | − | chrX | 134950133 | 134950078 | − | ENST00000420087; ENST00000463085; ENST00000370724; ENST00000491480 | TSF |
| 2% | chr3 | 128352356 | 1283523306 | − | chr3 | 128351000 | 128350791 | − | ENST00000296255; ENST00000497289 | TSF |
| 2% | chr20 | 48264330 | 48264298 | − | chr20 | 48263615 | 48263502 | − | ENST00000371711 | TSF |
| 2% | chr6 | 33544821 | 33544801 | − | chr6 | 33543643 | 33543570 | − | ENST00000374467; ENST00000442998; ENST00000360661 | TSF |
| 2% | chr6 | 33544821 | 33544801 | − | chr6 | 33543643 | 33543570 | − | ENST00000374467; ENST00000442998; ENST00000360661 | TSF |
| 2% | chr19 | 45681322 | 45681186 | − | chr19 | 45668452 | 45668385 | − | ENST00000006275; ENST00000585934 | TSF |
| 2% | chr19 | 48654965 | 48654725 | − | chr19 | 48654596 | 48654489 | − | ENST00000263274; ENST00000601091; ENST00000542460 | TSF |
| 2% | chr19 | 48654965 | 48654725 | − | chr19 | 48654596 | 48654489 | − | ENST00000263274; ENST00000601091; ENST00000542460 | TSF |
| 2% | chr19 | 48654965 | 48654725 | − | chr19 | 48654596 | 48654489 | − | ENST00000263274; ENST00000601091; ENST00000542460 | TSF |
| 2% | chr3 | 191873117 | 191873032 | − | chr3 | 191861916 | 191861798; 191861849 | − | ENST00000445105; ENST00000264730; ENST00000454309; ENST00000440901; ENST00000450716; ENST00000430714; ENST00000448795 | TSF |
| 2% | chr3 | 191873117 | 191873032 | − | chr3 | 191861916 | 191861798; 191861849 | − | ENST00000445105; ENST00000264730; ENST00000454309; ENST00000440901; ENST00000450716; ENST00000430714; ENST00000448795 | TSF |
| 2% | chr4 | 1079284 | 1079281 | − | chr4 | 1075407 | 1075355 | − | ENST00000382968; ENST00000433731 | TSF |
| 2% | chr4 | 1079284 | 1079281 | − | chr4 | 1075407 | 1075355 | − | ENST00000382968; ENST00000433731 | TSF |
| 2% | chr4 | 1101138 | 1101040 | − | chr4 | 1093715 | 1093539 | − | ENST00000510715 | TSF |
| 2% | chr5 | 59983652 | 59983552 | − | chr5 | 59983054 | 59982789 | − | ENST00000265036; ENST00000453022 | TSF |
| 2% | chr5 | 59983652 | 59983552 | − | chr5 | 59983054 | 59982789 | − | ENST00000265036; ENST00000453022 | TSF |
| 2% | chrX | 103287465 | 103287369 | − | chrX | 103267320 | 103267284 | − | ENST00000217926 | TSF |
| 2% | chr13 | 95233957 | 95233815 | − | chr13 | 95233443 | 95233345 | − | ENST00000261296 | TSF |
| 2% | chr22 | 38253087 | 38253153 | + | chr22 | 38254686 | 38254747 | + | ENST00000412331; ENST00000381683; ENST00000414316; ENST00000406934; ENST00000451427 | TSF |
| 2% | chr22 | 38253087 | 38253153 | + | chr22 | 38254686 | 38254747 | + | ENST00000412331; ENST00000381683; ENST00000414316; ENST00000406934; ENST00000451427 | TSF |
| 2% | chr22 | 38253087 | 38253153 | + | chr22 | 38254686 | 38254747 | + | ENST00000412331; ENST00000381683; ENST00000414316; ENST00000406934; ENST00000451427 | TSF |
| 2% | chr22 | 38253087 | 38253153 | + | chr22 | 38254686 | 38254747 | + | ENST00000412331; ENST00000381683; ENST00000414316; ENST00000406934; ENST00000451427 | TSF |
| 2% | chr11 | 32617857 | 32617922 | + | chr11 | 32622235 | 32622378 | + | ENST00000531120; ENST00000524896; ENST00000526267 | TSF |
| 2% | chr11 | 32617857 | 32617922 | + | chr11 | 32622235 | 32622378 | + | ENST00000531120; ENST00000524896; ENST00000526267 | TSF |
| 2% | chr11 | 122699762 | 122700370 | + | chr11 | 122720776 | 122720922 | + | ENST00000227348 | TSF |
| 2% | chr21 | 42801857 | 42802535 | + | chr21 | 42811621 | 42811775 | + | ENST00000398600; ENST00000398598; ENST00000455164; ENST00000424365; ENST00000417963; ENST00000288383 | TSF |
| 2% | chr21 | 42801857 | 42802535 | + | chr21 | 42811621 | 42811775 | + | ENST00000398600; ENST00000398598; ENST00000455164; ENST00000424365; ENST00000417963; ENST00000288383 | TSF |
| 2% | chr21 | 42801857 | 42802535 | + | chr21 | 42811621 | 42811775 | + | ENST00000398600; ENST00000398598; ENST00000455164; ENST00000424365; ENST00000417963; ENST00000288383 | TSF |
| 2% | chr16 | 66587343 | 66587382 | + | chr16 | 66597025 | 66597120 | + | ENST00000264001; ENST00000351137; ENST00000417030; ENST00000532838 | TSF |
| 2% | chr16 | 66587343 | 66587382 | + | chr16 | 66597025 | 66597120 | + | ENST00000264001; ENST00000351137; ENST00000417030; ENST00000532838 | TSF |
| 2% | chr16 | 2819422 | 2820027 | + | chr16 | 2820353 | 2820466 | + | ENST00000301740 | TSF |
| 2% | chr20 | 33107223 | 33107303 | + | chr20 | 33122432 | 33122599; 33122718 | + | ENST00000357156; ENST00000417166; ENST00000374846 | TSF |
| 2% | chr20 | 33107223 | 33107303 | + | chr20 | 33122432 | 33122599; | + | ENST00000357156; ENST00000417166; | TSF |

TABLE 44-continued

Transcript fusion for ovarian cancer (OV) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 2% | chr19 | 17667441 | 17667488 | + | chr19 | 17670120 | 33122718 17670230 | + | ENST00000374846 ENST00000252599 | TSF |
| 2% | chr8 | 125551665 | 125551665 | + | chr8 | 125555328 | 125555520 | + | ENST00000276689; ENST00000518008; ENST00000522532 | TSF |
| 2% | chr8 | 125551665 | 125551665 | + | chr8 | 125555328 | 125555520 | + | ENST00000276689; ENST00000518008; ENST00000522532 | TSF |
| 2% | chr8 | 125551665 | 125551665 | + | chr8 | 125555328 | 125555520 | + | ENST00000276689; ENST00000518008; ENST00000522532 | TSF |
| 2% | chr11 | 64853798 | 64852846 | + | chr11 | 64853887 | 64854027; 64853914; 64854080 | + | ENST00000531761; ENST00000453524; ENST00000294258; ENST00000526334; ENST00000526945; ENST00000532200 | TSF |
| 2% | chr11 | 64853798 | 64852846 | + | chr11 | 64853887 | 64854027; 64853914; 64854080 | + | ENST00000531761; ENST00000453524; ENST00000294258; ENST00000526334; ENST00000526945; ENST00000532200 | TSF |
| 2% | chr11 | 64853798 | 64852846 | + | chr11 | 64853887 | 64854027; 64853914; 64854080 | + | ENST00000531761; ENST00000453524; ENST00000294258; ENST00000526334; ENST00000526945; ENST00000532200 | TSF |
| 2% | chr11 | 64853798 | 64852846 | + | chr11 | 64853887 | 64854027; 64853914; 64854080 | + | ENST00000531761; ENST00000453524; ENST00000294258; ENST00000526334; ENST00000526945; ENST00000532200 | TSF |
| 2% | chr11 | 64853798 | 64852846 | + | chr11 | 64853887 | 64854027; 64853914; 64854080 | + | ENST00000531761; ENST00000453524; ENST00000294258; ENST00000526334; ENST00000526945; ENST00000532200 | TSF |
| 2% | chr11 | 64853798 | 64852846 | + | chr11 | 64853887 | 64854027; 64853914; 64854080 | + | ENST00000531761; ENST00000453524; ENST00000294258; ENST00000526334; ENST00000526945; ENST00000532200 | TSF |
| 2% | chr12 | 56110428 | 56110523 | + | chr12 | 56112875 | 56113007; 56112894; 56113085 | + | ENST00000257899; ENST00000551946; ENST00000550412; ENST00000548925; ENST00000549147; ENST00000553100 | TSF |
| 2% | chr12 | 56110428 | 56110523 | + | chr12 | 56112875 | 56113007; 56112894; 56113085 | + | ENST00000257899; ENST00000551946; ENST00000550412; ENST00000548925; ENST00000549147; ENST00000553100 | TSF |
| 2% | chr12 | 56110428 | 56110523 | + | chr12 | 56112875 | 56113007; 56112894; 56113085 | + | ENST00000257899; ENST00000551946; ENST00000550412; ENST00000548925; ENST00000549147; ENST00000553100 | TSF |
| 2% | chr12 | 56110428 | 56110523 | + | chr12 | 56112875 | 56113007; 56112894; 56113085 | + | ENST00000257899; ENST00000551946; ENST00000550412; ENST00000548925; ENST00000549147; ENST00000553100 | TSF |
| 2% | chrX | 118371254 | 118371371 | + | chrX | 118374272 | 118374427 | + | ENST00000217971 | TSF |
| 2% | chr5 | 142190974 | 142191055 | + | chr5 | 142252965 | 142253060 | + | ENST00000274498; ENST00000378004; ENST00000378013 | TSF |
| 2% | chr5 | 142190974 | 142191055 | + | chr5 | 142252965 | 142253060 | + | ENST00000274498; ENST00000378004; ENST00000378013 | TSF |
| 2% | chr5 | 142190974 | 142191055 | + | chr5 | 142252965 | 142253060 | + | ENST00000274498; ENST00000378004; ENST00000378013 | TSF |
| 2% | chr2 | 3431377 | 3431530 | + | chr2 | 3624220 | 3624220 | + | ENST00000304921; ENST00000407445; ENST00000403564; ENST00000406376 | TSF |
| 2% | chr2 | 3431377 | 3431530 | + | chr2 | 3624220 | 3624220 | + | ENST00000304921; ENST00000407445; ENST00000403564; ENST00000406376 | TSF |
| 2% | chr13 | 43670805 | 43671144 | + | chr13 | 43381314 | 43681384 | + | ENST00000379221 | TSF |
| 2% | chr20 | 45337040 | 45337192 | + | chr20 | 45353680 | 45354963 | + | ENST00000359271 | TSF |
| 2% | chr1 | 28199269 | 28199387 | + | chr1 | 28203099 | 28203239 | + | ENST00000328928; ENST00000373925; ENST00000373927; ENST00000442118; ENST00000373921 | TSF |
| 2% | chr1 | 28199269 | 28199387 | + | chr1 | 28203099 | 28203239 | + | ENST00000328928; ENST00000373925; ENST00000373927; ENST00000442118; ENST00000373921 | TSF |
| 2% | chr1 | 28199269 | 28199387 | + | chr1 | 28203099 | 28203239 | + | ENST00000328928; ENST00000373925; ENST00000373927; ENST00000442118; ENST00000373921 | TSF |
| 2% | chr1 | 28199269 | 28199387 | + | chr1 | 28203099 | 28203239 | + | ENST00000328928; ENST00000373925; ENST00000373927; ENST00000442118; ENST00000373921 | TSF |
| 2% | chr1 | 28199269 | 28199387 | + | chr1 | 28203099 | 28203239 | + | ENST00000328928; ENST00000373925; ENST00000373927; ENST00000442118; ENST00000373921 | TSF |
| 2% | chr20 | 33111081 | 33111436 | + | chr20 | 33114073 | 33114148 | + | ENST00000357156; ENST00000417166; ENST00000300469; ENST00000374846 | TSF |
| 2% | chr20 | 33111081 | 33111436 | + | chr20 | 33114073 | 33114148 | + | ENST00000357156; ENST00000417166; ENST00000300469; ENST00000374846 | TSF |
| 2% | chr20 | 33111081 | 33111436 | + | chr20 | 33114073 | 33114148 | + | ENST00000357156; ENST00000417166; ENST00000300469; ENST00000374846 | TSF |
| 2% | chr5 | 108341955 | 1083421993 | + | chr5 | 108373123 | 108373179 | + | ENST00000281092; ENST00000438717 | TSF |
| 2% | chrX | 69366031 | 69366077 | + | chrX | 69366595 | 69366678 | + | ENST00000342206; ENST00000356413 | TSF |
| 2% | chr7 | 74128471 | 74128505 | + | chr7 | 74165693 | 74165748 | + | ENST00000324896; ENST00000346152; ENST00000353920; ENST00000416070 | TSF |

TABLE 44-continued

Transcript fusion for ovarian cancer (OV) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 2% | chr8 | 100905650 | 100954057 | − | chr8 | 100899846 | 100899733 | − | ENST00000522934; ENST00000520517; ENST00000520468; ENST00000297564; ENST00000520271; ENST00000517682; ENST00000524245; ENST00000522940; ENST00000518171; ENST00000523016 | TSF |
| 2% | chr19 | 1114930 | 1114676 | − | chr19 | 1114421 | 1114230 | − | ENST00000361757; ENST00000587024; ENST00000438103 | TSF |
| 2% | chr9 | 132580720 | 132580632 | − | chr9 | 132576501 | 132576251 | − | ENST00000351698 | TSF |
| 2% | chr10 | 71990523 | 71990251 | − | chr10 | 71990155 | 71990097 | − | ENST00000373232; ENST00000373230; ENST00000608321 | TSF |
| 2% | chr10 | 71990523 | 71990251 | − | chr10 | 71990155 | 71990097 | − | ENST00000373232; ENST00000373230; ENST00000608321 | TSF |
| 2% | chrX | 134971303 | 13497186 | − | chrX | 134932870 | 134932815 | − | ENST00000487941; ENST00000434966; ENST00000494421 | TSF |
| 2% | chr12 | 27144384 | 27144286 | − | chr12 | 27143560 | 27143383 | − | ENST00000343028; ENST00000545303; ENST00000535260; ENST00000543882; ENST00000543655; ENST00000535819 | TSF |
| 2% | chr12 | 27144384 | 27144286 | − | chr12 | 27143560 | 27143383 | − | ENST00000343028; ENST00000545303; ENST00000535260; ENST00000543882; ENST00000543655; ENST00000535819 | TSF |
| 2% | chr12 | 27144384 | 27144286 | − | chr12 | 27143560 | 27143383 | − | ENST00000343028; ENST00000545303; ENST00000535260; ENST00000543882; ENST00000543655; ENST00000535819 | TSF |
| 2% | chr12 | 27144384 | 27144286 | − | chr12 | 27143560 | 27143383 | − | ENST00000343028; ENST00000545303; ENST00000535260; ENST00000543882; ENST00000543655; ENST00000535819 | TSF |
| 2% | chr12 | 27144384 | 27144286 | − | chr12 | 27143560 | 27143383 | − | ENST00000343028; ENST00000545303; ENST00000535260; ENST00000543882; ENST00000543655; ENST00000535819 | TSF |
| 2% | chrX | 134971303 | 134971006 | − | chrX | 134967383 | 134967328 | − | ENST00000491002; ENST00000448053; ENST00000472834 | TSF |
| 2% | chr8 | 143834800 | 143834786 | − | chr8 | 143832588 | 143832469 | − | ENST00000359228 | TSF |
| 2% | chr7 | 48039730 | 48039725 | − | chr7 | 48035743 | 48035628 | − | ENST00000453071; ENST00000297325; ENST00000412371; ENST00000453192; ENST00000395572; ENST00000438771 | TSF |
| 2% | chr7 | 48039730 | 48039725 | − | chr7 | 48035743 | 48035628 | − | ENST00000453071; ENST00000297325; ENST00000412371; ENST00000453192; ENST00000395572; ENST00000438771 | TSF |
| 2% | chr7 | 48039730 | 48039725 | − | chr7 | 48035743 | 48035628 | − | ENST00000453071; ENST00000297325; ENST00000412371; ENST00000453192; ENST00000395572; ENST00000438771 | TSF |
| 2% | chr1 | 206278006 | 206276891 | − | chr1 | 206243250 | 206243150 | − | ENST00000331555 | TSF |
| 2% | chr3 | 197640178 | 197640160 | − | chr3 | 197639671 | 197639546 | − | ENST00000265239; ENST00000455191 | TSF |
| 2% | chr14 | 35063866 | 35063813 | − | chr14 | 35062356 | 35062251 | − | ENST00000396526; ENST00000396534; ENST00000362031; ENST00000355110; ENST00000557265 | TSF |
| 2% | chr14 | 35063866 | 35063813 | − | chr14 | 35062356 | 35062251 | − | ENST00000396526; ENST00000396534; ENST00000362031; ENST00000355110; ENST00000557265 | TSF |
| 2% | chr1 | 33251116 | 33251115 | − | chr1 | 33248140 | 33248005 | − | ENST00000373477 | TSF |
| 2% | chr4 | 162586244 | 162585968 | − | chr4 | 162577646 | 162577480 | − | ENST00000306100; ENST00000379164; ENST00000536695; ENST00000427802 | TSF |
| 2% | chr4 | 162586244 | 162585968 | − | chr4 | 162577646 | 162577480 | − | ENST00000306100; ENST00000379164; ENST00000536695; ENST00000427802 | TSF |
| 2% | chr6 | 31660537 | 31660355 | − | chr6 | 31659695 | 31659581 | − | ENST00000395952; ENST00000440843 | TSF |
| 2% | chr9 | 130213440 | 130213384 | − | chr9 | 130211635 | 130211560 | − | ENST00000361436; ENST00000536368 | TSF |
| 2% | chr6 | 41744299 | 41744159 | − | chr6 | 41743343 | 41743157; 41743301 | − | ENST00000259748; ENST00000373018; ENST00000426290; ENST00000422888 | TSF |
| 2% | chr6 | 41744299 | 41744159 | − | chr6 | 41743343 | 41743157; 41743301 | − | ENST00000259748; ENST00000373018; ENST00000426290; ENST00000422888 | TSF |
| 2% | chr6 | 41744299 | 41744159 | − | chr6 | 41743343 | 41743157; 41743301 | − | ENST00000259748; ENST00000373018; ENST00000426290; ENST00000422888 | TSF |
| 2% | chr22 | 21355965 | 21355835 | − | chr22 | 21355700 | 21355545 | − | ENST00000215742; ENST00000399133 | |
| 2% | chr12 | 15490399 | 15490311 | − | chr12 | 15274053 | 15273997; 15273999 | − | ENST00000256953; ENST00000538313; ENST00000536465; ENST00000545567; ENST00000537647; ENST00000393736 | TSF |
| 2% | chr12 | 15490399 | 15490311 | − | chr12 | 15274053 | 15273997; 15273999 | − | ENST00000256953; ENST00000538313; ENST00000536465; ENST00000545567; ENST00000537647; ENST00000393736 | TSF |
| 2% | chr12 | 15490399 | 15490311 | − | chr12 | 15274053 | 15273997; 15273999 | − | ENST00000256953; ENST00000538313; ENST00000536465; ENST00000545567; ENST00000537647; ENST00000393736 | TSF |
| 2% | chr12 | 15490399 | 15490311 | − | chr12 | 15274053 | 15273997; | − | ENST00000256953; ENST00000538313; | TSF |

TABLE 44-continued

Transcript fusion for ovarian cancer (OV) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| | | | | | | | 15273999 | | ENST00000536465; ENST00000545567; ENST00000537647; ENST00000393736 | |
| 2% | chr12 | 15490399 | 15490311 | – | chr12 | 15274053 | 15273997; 15273999 | – | ENST00000256953; ENST00000538313; ENST00000536465; ENST00000545567; ENST00000537647; ENST00000393736 | TSF |
| 2% | chr12 | 15490399 | 15490311 | – | chr12 | 15274053 | 15273997; 15273999 | – | ENST00000256953; ENST00000538313; ENST00000536465; ENST00000545567; ENST00000537647; ENST00000393736 | TSF |
| 2% | chrX | 134954053 | 134953756 | – | chrX | 134932870 | 134932815 | – | ENST00000487941; ENST00000434966; ENST00000494421 | TSF |
| 2% | chr3 | 18283330 | 182833262 | – | chr3 | 182812393 | 182812347 | – | ENST00000265594; ENST00000497830; ENST00000495767; ENST00000476176; ENST00000487634; ENST00000466650; ENST00000486226 | TSF |
| 2% | chr3 | 18283330 | 182833262 | – | chr3 | 182812393 | 182812347 | – | ENST00000265594; ENST00000497830; ENST00000495767; ENST00000476176; ENST00000487634; ENST00000466650; ENST00000486226 | TSF |
| 2% | chr3 | 18283330 | 182833262 | – | chr3 | 182812393 | 182812347 | – | ENST00000265594; ENST00000497830; ENST00000495767; ENST00000476176; ENST00000487634; ENST00000466650; ENST00000486226 | TSF |
| 2% | chr3 | 18283330 | 182833262 | – | chr3 | 182812393 | 182812347 | – | ENST00000265594; ENST00000497830; ENST00000495767; ENST00000476176; ENST00000487634; ENST00000466650; ENST00000486226 | TSF |
| 2% | chr3 | 18283330 | 182833262 | – | chr3 | 182812393 | 182812347 | – | ENST00000265594; ENST00000497830; ENST00000495767; ENST00000476176; ENST00000487634; ENST00000466650; ENST00000486226 | TSF |
| 2% | chrX | 134936794 | 134936497 | – | chrX | 134932870 | 134932815 | – | ENST00000487941; ENST00000434966; ENST00000494421 | TSF |
| 1% | chr10 | 27470588 | 27470654 | + | chr10 | 27476308 | 27475465 | + | ENST00000375946; ENST00000375940; ENST00000342386 | TSF |
| 1% | chr2 | 101518034 | 101518064 | + | chr2 | 101521195 | 101521248 | + | ENST00000427413; ENST00000542504 | TSF |
| 1% | chr2 | 101518034 | 101518064 | + | chr2 | 101521195 | 101521248 | + | ENST00000427413; ENST00000542504 | TSF |
| 1% | chr17 | 37902588 | 37902638 | + | chr17 | 37903004 | 37903150 | + | ENST00000309156; ENST00000394211; ENST00000445327; ENST00000394209 | TSF |
| 1% | chr9 | 130921922 | 130921962 | + | chr9 | 13092572 | 130925894 | + | ENST00000372994 | TSF |
| 1% | chr19 | 16198411 | 16198509 | + | chr19 | 16198837 | 16198907; 16198903; 16198876 | + | ENST00000344824; ENST00000538887; ENST00000586499; ENST00000586833; ENST00000588507; ENST00000300933; ENST00000588410; ENST00000592138 | TSF |
| 1% | chr19 | 16198411 | 16198509 | + | chr19 | 16198837 | 16198907; 16198903; 16198876 | + | ENST00000344824; ENST00000538887; ENST00000586499; ENST00000586833; ENST00000588507; ENST00000300933; ENST00000588410; ENST00000592138 | TSF |
| 1% | chr19 | 16198411 | 16198509 | + | chr19 | 16198837 | 16198907; 16198903; 16198876 | + | ENST00000344824; ENST00000538887; ENST00000586499; ENST00000586833; ENST00000588507; ENST00000300933; ENST00000588410; ENST00000592138 | TSF |
| 1% | chr19 | 16198411 | 16198509 | + | chr19 | 16198837 | 16198907; 16198903; 16198876 | + | ENST00000344824; ENST00000538887; ENST00000586499; ENST00000586833; ENST00000588507; ENST00000300933; ENST00000588410; ENST00000592138 | TSF |
| 1% | chr19 | 16198411 | 16198509 | + | chr19 | 16198837 | 16198907; 16198903; 16198876 | + | ENST00000344824; ENST00000538887; ENST00000586499; ENST00000586833; ENST00000588507; ENST00000300933; ENST00000588410; ENST00000592138 | TSF |
| 1% | chr19 | 16198411 | 16198509 | + | chr19 | 16198837 | 16198907; 16198903; 16198876 | + | ENST00000344824; ENST00000538887; ENST00000586499; ENST00000586833; ENST00000588507; ENST00000300933; ENST00000588410; ENST00000592138 | TSF |
| 1% | chr19 | 16201364 | 16201431 | + | chr19 | 16204346 | 16204408; 16204354; 16204374; 16204391 | + | ENST00000344824; ENST00000538887; ENST00000586833; ENST00000588507; ENST00000300933; ENST00000592138; ENST00000588032 | TSF |
| 1% | chr19 | 16201364 | 16201431 | + | chr19 | 16204346 | 16204408; 16204354; 16204374; 16204391 | + | ENST00000344824; ENST00000538887; ENST00000586833; ENST00000588507; ENST00000300933; ENST00000592138; ENST00000588032 | TSF |
| 1% | chr19 | 16201364 | 16201431 | + | chr19 | 16204346 | 16204408; 16204354; 16204374; 16204391 | + | ENST00000344824; ENST00000538887; ENST00000586833; ENST00000588507; ENST00000300933; ENST00000592138; ENST00000588032 | TSF |
| 1% | chr19 | 16201364 | 16201431 | + | chr19 | 16204346 | 16204408; | + | ENST00000344824; ENST00000538887; | TSF |

TABLE 44-continued

Transcript fusion for ovarian cancer (OV) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| | | | | | | | 16204354; 16204374; 16204391 | | ENST00000586833; ENST00000588507; ENST00000300933; ENST00000592138; ENST00000588032 | |
| 1% | chr17 | 65894489 | 65894534 | + | chr17 | 65899905 | 65900034 | + | ENST00000544778; ENST00000321892; ENST00000335221; ENST00000306378; ENST00000424123 | TSF |
| 1% | chr17 | 65894489 | 65894534 | + | chr17 | 65899905 | 65900034 | + | ENST00000544778; ENST00000321892; ENST00000335221; ENST00000306378; ENST00000424123 | TSF |
| 1% | chr17 | 65894489 | 65894534 | + | chr17 | 65899905 | 65900034 | + | ENST00000544778; ENST00000321892; ENST00000335221; ENST00000306378; ENST00000424123 | TSF |
| 1% | chr2 | 232340741 | 232340940 | + | chr2 | 232576649 | 232576693 | + | ENST00000409321; ENST00000409115; ENST00000341369; ENST00000409683; ENST00000410064; ENST00000412128 | TSF |
| 1% | chr2 | 232340741 | 232340940 | + | chr2 | 232576649 | 232576693 | + | ENST00000409321; ENST00000409115; ENST00000341369; ENST00000409683; ENST00000410064; ENST00000412128 | TSF |
| 1% | chr1 | 43234653 | 43234703 | + | chr1 | 43239234 | 43239320 | + | ENST00000372525 | TSF |
| 1% | chr21 | 42801857 | 42802535 | + | chr21 | 42807910 | 42807956 | + | ENST00000398600; ENST00000398598; ENST00000455164; ENST00000424365; ENST00000417963 | TSF |
| 1% | chr21 | 42801857 | 42802535 | + | chr21 | 42807910 | 42807956 | + | ENST00000398600; ENST00000398598; ENST00000455164; ENST00000424365; ENST00000417963 | TSF |
| 1% | chr21 | 42801857 | 42802535 | + | chr21 | 42807910 | 42807956 | + | ENST00000398600; ENST00000398598; ENST00000455164; ENST00000424365; ENST00000417963 | TSF |
| 1% | chr1 | 155179310 | 155179341 | + | chr1 | 155180137 | 155180206; 155180226 | + | ENST00000368376; ENST00000316721; ENST00000424959; ENST00000609421 | TSF |
| 1% | chr1 | 155179310 | 155179341 | + | chr1 | 155180137 | 155180206; 155180226 | + | ENST00000368376; ENST00000316721; ENST00000424959; ENST00000609421 | TSF |
| 1% | chr1 | 155179310 | 155179341 | + | chr1 | 155180137 | 155180206; 155180226 | + | ENST00000368376; ENST00000316721; ENST00000424959; ENST00000609421 | TSF |
| 1% | chr12 | 49105350 | 50491120 | + | chr12 | 50492497 | 50492598 | + | ENST00000394963; ENST00000381513; ENST00000548573; ENST00000549274 | TSF |
| 1% | chr3 | 54946412 | 54946415 | + | chr3 | 55002477 | 55002538 | + | ENST00000415676; ENST00000288197; ENST00000474759; ENST00000490478 | TSF |
| 1% | chr12 | 133288092 | 133288275 | + | chr12 | 133291444 | 133291498; 133291622 | + | ENST00000537262; ENST00000545677; ENST00000317555; ENST00000498926 | TSF |
| 1% | chr12 | 133288092 | 133288275 | + | chr12 | 133291444 | 133291498; 133291622 | + | ENST00000537262; ENST00000545677; ENST00000317555; ENST00000498926 | TSF |
| 1% | chr12 | 133288092 | 133288275 | + | chr12 | 133291444 | 133291498; 133291622 | + | ENST00000537262; ENST00000545677; ENST00000317555; ENST00000498926 | TSF |
| 1% | chr12 | 133288092 | 133288275 | + | chr12 | 133291444 | 133291498; 133291622 | + | ENST00000537262; ENST00000545677; ENST00000317555; ENST00000498926 | TSF |
| 1% | chr17 | 64988088 | 64988129 | + | chr17 | 65014305 | 65014388 | + | ENST00000262138 | TSF |
| 1% | chr15 | 73976790 | 73976801 | + | chr15 | 73994596 | 73994914; 73994934; 73994926; 73994838; 73994671 | + | ENST00000567189; ENST00000318443; ENST00000318424; ENST00000558689; ENST00000560786; ENST00000561213; ENST00000563584; ENST00000561416; ENST00000560995; ENST00000561260; ENST00000564751 | TSF |
| 1% | chr15 | 73976790 | 73976801 | + | chr15 | 73994596 | 73994914; 73994934; 73994926; 73994838; 73994671 | + | ENST00000567189; ENST00000318443; ENST00000318424; ENST00000558689; ENST00000560786; ENST00000561213; ENST00000563584; ENST00000561416; ENST00000560995; ENST00000561260; ENST00000564751 | TSF |
| 1% | chr15 | 73976790 | 73976801 | + | chr15 | 73994596 | 73994914; 73994934; 73994926; 73994838; 73994671 | + | ENST00000567189; ENST00000318443; ENST00000318424; ENST00000558689; ENST00000560786; ENST00000561213; ENST00000563584; ENST00000561416; ENST00000560995; ENST00000561260; ENST00000564751 | TSF |
| 1% | chr15 | 73976790 | 73976801 | + | chr15 | 73994596 | 73994914; 73994934; 73994926; 73994838; 73994671 | + | ENST00000567189; ENST00000318443; ENST00000318424; ENST00000558689; ENST00000560786; ENST00000561213; ENST00000563584; ENST00000561416; ENST00000560995; ENST00000561260; ENST00000564751 | TSF |
| 1% | chr15 | 73976790 | 73976801 | + | chr15 | 73994596 | 73994914; 73994934; 73994926; 73994838; 73994671 | + | ENST00000567189; ENST00000318443; ENST00000318424; ENST00000558689; ENST00000560786; ENST00000561213; ENST00000563584; ENST00000561416; ENST00000560995; ENST00000561260; | TSF |

TABLE 44-continued

Transcript fusion for ovarian cancer (OV) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 1% | chr15 | 73976790 | 73976801 | + | chr15 | 73994596 | 73994914; 73994934; 73994926; 73994838; 73994671 | + | ENST00000567189; ENST00000318443; ENST00000318424; ENST00000558689; ENST00000560786; ENST00000561213; ENST00000563584; ENST00000561416; ENST00000560995; ENST00000561260; ENST00000564751 | TSF |
| 1% | chr15 | 73976790 | 73976801 | + | chr15 | 73994596 | 73994914; 73994934; 73994926; 73994838; 73994671 | + | ENST00000567189; ENST00000318443; ENST00000318424; ENST00000558689; ENST00000560786; ENST00000561213; ENST00000563584; ENST00000561416; ENST00000560995; ENST00000561260; ENST00000564751 | TSF |
| 1% | chr15 | 73976790 | 73976801 | + | chr15 | 73994596 | 73994914; 73994934; 73994926; 73994838; 73994671 | + | ENST00000567189; ENST00000318443; ENST00000318424; ENST00000558689; ENST00000560786; ENST00000561213; ENST00000563584; ENST00000561416; ENST00000560995; ENST00000561260; ENST00000564751 | TSF |
| 1% | chr15 | 73976790 | 73976801 | + | chr15 | 73994596 | 73994914; 73994934; 73994926; 73994838; 73994671 | + | ENST00000567189; ENST00000318443; ENST00000318424; ENST00000558689; ENST00000560786; ENST00000561213; ENST00000563584; ENST00000561416; ENST00000560995; ENST00000561260; ENST00000564751 | TSF |
| 1% | chr17 | 79936116 | 79936215 | + | chr17 | 79937060 | 79937115 | + | ENST00000581484; ENST00000306729; ENST00000306739; ENST00000344865; ENST00000581647; ENST00000583503; ENST00000579684 | TSF |
| 1% | chr17 | 79936116 | 79936215 | + | chr17 | 79937060 | 79937115 | + | ENST00000581484; ENST00000306729; ENST00000306739; ENST00000344865; ENST00000581647; ENST00000583503; ENST00000579684 | TSF |
| 1% | chr17 | 79936116 | 79936215 | + | chr17 | 79937060 | 79937115 | + | ENST00000581484; ENST00000306729; ENST00000306739; ENST00000344865; ENST00000581647; ENST00000583503; ENST00000579684 | TSF |
| 1% | chr17 | 79936116 | 79936215 | + | chr17 | 79937060 | 79937115 | + | ENST00000581484; ENST00000306729; ENST00000306739; ENST00000344865; ENST00000581647; ENST00000583503; ENST00000579684 | TSF |
| 1% | chr17 | 79936116 | 79936215 | + | chr17 | 79937060 | 79937115 | + | ENST00000581484; ENST00000306729; ENST00000306739; ENST00000344865; ENST00000581647; ENST00000583503; ENST00000579684 | TSF |
| 1% | chr17 | 79936116 | 79936215 | + | chr17 | 79937060 | 79937115 | + | ENST00000581484; ENST00000306729; ENST00000306739; ENST00000344865; ENST00000581647; ENST00000583503; ENST00000579684 | TSF |
| 1% | chrX | 71397824 | 71398498 | + | chrX | 71416635 | 71416778; 71416754 | + | ENST00000218432; ENST00000423432; ENST00000373669; ENST00000496835; ENST00000439980; ENST00000446576 | TSF |
| 1% | chrX | 71397824 | 71398498 | + | chrX | 71416635 | 71416778; 71416754 | + | ENST00000218432; ENST00000423432; ENST00000373669; ENST00000496835; ENST00000439980; ENST00000446576 | TSF |
| 1% | chrX | 71397824 | 71398498 | + | chrX | 71416635 | 71416778; 71416754 | + | ENST00000218432; ENST00000423432; ENST00000373669; ENST00000496835; ENST00000439980; ENST00000446576 | TSF |
| 1% | chrX | 71397824 | 71398498 | + | chrX | 71416635 | 71416778; 71416754 | + | ENST00000218432; ENST00000423432; ENST00000373669; ENST00000496835; ENST00000439980; ENST00000446576 | TSF |
| 1% | chr8 | 143592075 | 143592168 | + | chr8 | 143592293 | 143592434 | + | ENST00000517894; ENST00000521208; ENST00000323289 | TSF |
| 1% | chr8 | 143592075 | 143592168 | + | chr8 | 143592293 | 143592434 | + | ENST00000517894; ENST00000521208; ENST00000323289 | TSF |
| 1% | chr2 | 101567739 | 101568117 | + | chr2 | 101580520 | 101580638 | + | ENST00000335681; ENST00000542504 | TSF |
| 1% | chr7 | 76921651 | 76921749 | + | chr7 | 76922269 | 76922517 | + | ENST00000285871; ENST00000431197 | TSF |
| 1% | chr16 | 28838911 | 28839140 | + | chr16 | 288407 | 28840813 | + | ENST00000340394; ENST00000325215; ENST00000336783; ENST00000382686; ENST00000395547; ENST00000564304; ENST00000570200; ENST00000568266 | TSF |
| 1% | chr16 | 28838911 | 28839140 | + | chr16 | 288407 | 28840813 | + | ENST00000340394; ENST00000325215; | TSF |

TABLE 44-continued

Transcript fusion for ovarian cancer (OV) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 1% | chr16 | 28838911 | 28839140 | + | chr16 | 288407 | 28840813 | + | ENST00000336783; ENST00000382686; ENST00000395547; ENST00000564304; ENST00000570200; ENST00000568266 ENST00000340394; ENST00000325215; | TSF |
| 1% | chr16 | 28838911 | 28839140 | + | chr16 | 288407 | 28840813 | + | ENST00000336783; ENST00000382686; ENST00000395547; ENST00000564304; ENST00000570200; ENST00000568266 ENST00000340394; ENST00000325215; | TSF |
| 1% | chr16 | 28838911 | 28839140 | + | chr16 | 288407 | 28840813 | + | ENST00000336783; ENST00000382686; ENST00000395547; ENST00000564304; ENST00000570200; ENST00000568266 ENST00000340394; ENST00000325215; | TSF |
| 1% | chr16 | 28838911 | 28839140 | + | chr16 | 288407 | 28840813 | + | ENST00000336783; ENST00000382686; ENST00000395547; ENST00000564304; ENST00000570200; ENST00000568266 ENST00000340394; ENST00000325215; | TSF |
| 1% | chr16 | 28838911 | 28839140 | + | chr16 | 288407 | 28840813 | + | ENST00000336783; ENST00000382686; ENST00000395547; ENST00000564304; ENST00000570200; ENST00000568266 ENST00000340394; ENST00000325215; | TSF |
| 1% | chr16 | 28838911 | 28839140 | + | chr16 | 288407 | 28840813 | + | ENST00000336783; ENST00000382686; ENST00000395547; ENST00000564304; ENST00000570200; ENST00000568266 ENST00000340394; ENST00000325215; | TSF |
| 1% | chr8 | 95716710 | 95716810 | + | chr8 | 95718153 | 95718173; 95718159 | + | ENST00000423620; ENST00000454170; ENST00000517610 | TSF |
| 1% | chr8 | 95716710 | 95716810 | + | chr8 | 95718153 | 95718173; 95718159 | + | ENST00000423620; ENST00000454170; ENST00000517610 | TSF |
| 1% | chr5 | 79293955 | 79294198 | + | chr5 | 79335900 | 79336103 | + | ENST00000350881 | TSF |
| 1% | chr7 | 150777427 | 150777296 | − | chr7 | 150775179 | 150775103; 150774966 | − | ENST00000540185; ENST00000353841; ENST00000297532; ENST00000482571 | TSF |
| 1% | chr7 | 150777427 | 150777296 | − | chr7 | 150775179 | 150775103; 150774966 | − | ENST00000540185; ENST00000353841; ENST00000297532; ENST00000482571 | TSF |
| 1% | chr5 | 151074528 | 151074519 | − | chr5 | 151046027 | 151045922; 151045934 | − | ENST00000231061; ENST00000538026 | TSF |
| 1% | chr5 | 151074528 | 151074519 | − | chr5 | 151046027 | 151045922; 151045934 | − | ENST00000231061; ENST00000538026 | TSF |
| 1% | chr8 | 140818443 | 140818376 | − | chr8 | 140744445 | 140744222 | − | ENST00000389327; ENST00000389328; ENST00000520857; ENST00000438773 | TSF |
| 1% | chr12 | 54064392 | 54064161 | − | chr12 | 54063732 | 54063655 | − | ENST00000602871; ENST00000394349; ENST00000549164; ENST00000338662 | TSF |
| 1% | chr20 | 49556441 | 49556310 | − | chr20 | 49552799 | 49552685 | − | ENST00000371588; ENST00000371582; ENST00000371584; ENST00000371583; ENST00000413082 | TSF |
| 1% | chr20 | 49556441 | 49556310 | − | chr20 | 49552799 | 49552685 | − | ENST00000371588; ENST00000371582; ENST00000371584; ENST00000371583; ENST00000413082 | TSF |
| 1% | chr19 | 36405278 | 36405224 | − | chr19 | 36398166 | 36398120 | − | ENST00000585901; ENST00000544690; ENST00000262629 | TSF |
| 1% | chr19 | 8382856 | 8382806 | − | chr19 | 8381529 | 8381380; 8381494 | − | ENST00000598884; ENST00000593729; ENST00000595856; ENST00000301457 | TSF |
| 1% | chr19 | 8382856 | 8382806 | − | chr19 | 8381529 | 8381380; 8381494 | − | ENST00000598884; ENST00000593729; ENST00000595856; ENST00000301457 | TSF |
| 1% | chr20 | 45138455 | 45138244 | − | chr20 | 4513379 | 45133253 | − | ENST00000593880; ENST00000347606 | TSF |
| 1% | chr20 | 45138455 | 45138244 | − | chr20 | 4513379 | 45133253 | − | ENST00000593880; ENST00000347606 | TSF |
| 1% | chr12 | 34257353 | 53342475 | − | chr12 | 53298811 | 53298442; 53298460 | − | ENST00000552150; ENST00000548998; ENST00000546542 | TSF |
| 1% | chr12 | 34257353 | 53342475 | − | chr12 | 53298811 | 53298442; 53298460 | − | ENST00000552150; ENST00000548998; ENST00000546542 | TSF |
| 1% | chr12 | 34257353 | 53342475 | − | chr12 | 53298811 | 53298442; 53298460 | − | ENST00000552150; ENST00000548998; ENST00000546542 | TSF |
| 1% | chr1 | 154581117 | 154581067 | − | chr1 | 154575102 | 154573517 | − | ENST00000292205; ENST00000368474; ENST00000529168 | TSF |
| 1% | chr1 | 154581117 | 154581067 | − | chr1 | 154575102 | 154573517 | − | ENST00000292205; ENST00000368474; ENST00000529168 | TSF |
| 1% | chr3 | 122652679 | 122652013 | − | chr3 | 122647905 | 122647843 | − | ENST00000357599; ENST00000475244; ENST00000195173; ENST00000451055; ENST00000393583 | TSF |
| 1% | chr3 | 122652679 | 122652013 | − | chr3 | 122647905 | 122647843 | − | ENST00000357599; ENST00000475244; ENST00000195173; ENST00000451055; ENST00000393583 | TSF |
| 1% | chr3 | 122652679 | 122652013 | − | chr3 | 122647905 | 122647843 | − | ENST00000357599; ENST00000475244; ENST00000195173; ENST00000451055; | TSF |

TABLE 44-continued

Transcript fusion for ovarian cancer (OV) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 1% | chr3 | 122652679 | 122652013 | – | chr3 | 122647905 | 122647843 | – | ENST00000393583 ENST00000357599; ENST00000475244; ENST00000195173; ENST00000451055; ENST00000393583 | TSF |
| 1% | chr1 | 153533056 | 153532824 | – | chr1 | 153517203 | 153517130 | – | ENST00000368715; ENST00000354332; ENST00000368716; ENST00000368714 | TSF |
| 1% | chr3 | 52007496 | 52007451 | – | chr3 | 52004200 | 52003959; | – | ENST00000483233; ENST00000395008; ENST00000361143; ENST00000461108; ENST00000525795 | TSF |
| 1% | chr3 | 52007496 | 52007451 | – | chr3 | 52004200 | 52003959; | – | ENST00000483233; ENST00000395008; ENST00000361143; ENST00000461108; ENST00000525795 | TSF |
| 1% | chr8 | 11706946 | 11706904 | – | chr8 | 11706673 | 11706555; 11706570; 11706571; 11706593 | – | ENST00000434271; ENST00000353047; ENST00000530640; ENST00000531089; ENST00000453527; ENST00000345125; ENST00000533455; ENST00000534510; ENST00000534636; ENST00000533572; ENST00000530296; ENST00000526195; ENST00000527243; ENST00000534149; ENST00000526645 | TSF |
| 1% | chr8 | 11706946 | 11706904 | – | chr8 | 11706673 | 11706555; 11706570; 11706571; 11706593 | – | ENST00000434271; ENST00000353047; ENST00000530640; ENST00000531089; ENST00000453527; ENST00000345125; ENST00000533455; ENST00000534510; ENST00000534636; ENST00000533572; ENST00000530296; ENST00000526195; ENST00000527243; ENST00000534149; ENST00000526645 | TSF |
| 1% | chr8 | 11706946 | 11706904 | – | chr8 | 11706673 | 11706555; 11706570; 11706571; 11706593 | – | ENST00000434271; ENST00000353047; ENST00000530640; ENST00000531089; ENST00000453527; ENST00000345125; ENST00000533455; ENST00000534510; ENST00000534636; ENST00000533572; ENST00000530296; ENST00000526195; ENST00000527243; ENST00000534149; ENST00000526645 | TSF |
| 1% | chr8 | 11706946 | 11706904 | – | chr8 | 11706673 | 11706555; 11706570; 11706571; 11706593 | – | ENST00000434271; ENST00000353047; ENST00000530640; ENST00000531089; ENST00000453527; ENST00000345125; ENST00000533455; ENST00000534510; ENST00000534636; ENST00000533572; ENST00000530296; ENST00000526195; ENST00000527243; ENST00000534149; ENST00000526645 | TSF |
| 1% | chr8 | 11706946 | 11706904 | – | chr8 | 11706673 | 11706555; 11706570; 11706571; 11706593 | – | ENST00000434271; ENST00000353047; ENST00000530640; ENST00000531089; ENST00000453527; ENST00000345125; ENST00000533455; ENST00000534510; ENST00000534636; ENST00000533572; ENST00000530296; ENST00000526195; ENST00000527243; ENST00000534149; ENST00000526645 | TSF |
| 1% | chr8 | 11706946 | 11706904 | – | chr8 | 11706673 | 11706555; 11706570; 11706571; 11706593 | – | ENST00000434271; ENST00000353047; ENST00000530640; ENST00000531089; ENST00000453527; ENST00000345125; ENST00000533455; ENST00000534510; ENST00000534636; ENST00000533572; ENST00000530296; ENST00000526195; ENST00000527243; ENST00000534149; ENST00000526645 | TSF |
| 1% | chr8 | 11706946 | 11706904 | – | chr8 | 11706673 | 11706555; 11706570; 11706571; 11706593 | – | ENST00000434271; ENST00000353047; ENST00000530640; ENST00000531089; ENST00000453527; ENST00000345125; ENST00000533455; ENST00000534510; ENST00000534636; ENST00000533572; ENST00000530296; ENST00000526195; ENST00000527243; ENST00000534149; ENST00000526645 | TSF |
| 1% | chr8 | 11706946 | 11706904 | – | chr8 | 11706673 | 11706555; 11706570; 11706571; 11706593 | – | ENST00000434271; ENST00000353047; ENST00000530640; ENST00000531089; ENST00000453527; ENST00000345125; ENST00000533455; ENST00000534510; ENST00000534636; ENST00000533572; ENST00000530296; ENST00000526195; ENST00000527243; ENST00000534149; ENST00000526645 | TSF |

TABLE 44-continued

Transcript fusion for ovarian cancer (OV) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 1% | chr11 | 93468219 | 93468129 | − | chr11 | 93466563 | 93466528 | − | ENST00000393259 | TSF |
| 1% | chr11 | 61558725 | 61558538 | − | chr11 | 61558074 | 61557965; 61557928 | − | ENST00000537328; ENST00000541893; ENST00000545210; ENST00000257262; ENST00000535297 | TSF |
| 1% | chr11 | 61558725 | 61558538 | − | chr11 | 61558074 | 61557965; 61557928 | − | ENST00000537328; ENST00000541893; ENST00000545210; ENST00000257262; ENST00000535297 | TSF |
| 1% | chr11 | 65629362 | 65629337 | − | chr11 | 65623713 | 65623406; 65623445 | − | ENST00000525451; ENST00000308162; ENST00000534769; ENST00000532134; ENST00000526975 | TSF |
| 1% | chr11 | 65629362 | 65629337 | − | chr11 | 65623713 | 65623406; 65623445 | − | ENST00000525451; ENST00000308162; ENST00000534769; ENST00000532134; ENST00000526975 | TSF |
| 1% | chr11 | 65629362 | 65629337 | − | chr11 | 65623713 | 65623406; 65623445 | − | ENST00000525451; ENST00000308162; ENST00000534769; ENST00000532134; ENST00000526975 | TSF |
| 1% | chr19 | 5714928 | 5714878 | − | chr19 | 5714282 | 5714194 | − | ENST00000360614; ENST00000590558; ENST00000585374; ENST00000593119; ENST00000590729 | TSF |
| 1% | chr19 | 5714928 | 5714878 | − | chr19 | 5714282 | 5714194 | − | ENST00000360614; ENST00000590558; ENST00000585374; ENST00000593119; ENST00000590729 | TSF |
| 1% | chr19 | 5714928 | 5714878 | − | chr19 | 5714282 | 5714194 | − | ENST00000360614; ENST00000590558; ENST00000585374; ENST00000593119; ENST00000590729 | TSF |
| 1% | chr1 | 31208485 | 31208427 | − | chr1 | 31208112 | 31208020 | − | ENST00000294507 | TSF |
| 1% | chr19 | 36397290 | 36397240 | − | chr19 | 36395536 | 36395471 | − | ENST00000424586; ENST00000585901; ENST00000544690; ENST00000262629; ENST00000589517 | TSF |
| 1% | chr3 | 32535582 | 32535322 | − | chr3 | 32533378 | 32533202 | − | ENST00000205636 | TSF |
| 1% | chr14 | 105642036 | 105642815 | − | chr14 | 105639598 | 105639358 | − | ENST00000392568 | TSF |
| 1% | chr1 | 206278006 | 206277271 | − | chr1 | 206243250 | 206243150 | − | ENST00000331555 | TSF |
| 1% | chr19 | 46194689 | 46194421 | − | chr19 | 46191824 | 46191645 | − | ENST00000342669; ENST00000588301; ENST00000590212 | TSF |
| 1% | chr19 | 46194689 | 46194421 | − | chr19 | 46191824 | 46191645 | − | ENST00000342669; ENST00000588301; ENST00000590212 | TSF |
| 1% | chr4 | 83762275 | 83761993 | − | chr4 | 83750211 | 83750153 | − | ENST00000503937; ENST00000348405; ENST00000513858; ENST00000395310; ENST00000443462; ENST00000509142; ENST00000311785; ENST00000326950; ENST00000432794; ENST00000448323; ENST00000505472; ENST00000500777; ENST00000508502; ENST00000355196; ENST00000264405; ENST00000505984; ENST00000511338 | TSF |
| 1% | chr4 | 83762275 | 83761993 | − | chr4 | 83750211 | 83750153 | − | ENST00000503937; ENST00000348405; ENST00000513858; ENST00000395310; ENST00000443462; ENST00000509142; ENST00000311785; ENST00000326950; ENST00000432794; ENST00000448323; ENST00000505472; ENST00000500777; ENST00000508502; ENST00000355196; ENST00000264405; ENST00000505984; ENST00000511338 | TSF |
| 1% | chr20 | 5090931 | 5090905 | − | chr20 | 5090091 | 5089978 | − | ENST00000342308 | TSF |
| 1% | chr11 | 57328392 | 57328294 | − | chr11 | 57327905 | 57327810 | − | ENST00000287156; ENST00000526659 | TSF |
| 1% | chr11 | 57328392 | 57328294 | − | chr11 | 57327905 | 57327810 | − | ENST00000287156; ENST00000526659 | TSF |
| 1% | chr8 | 101933557 | 101933272 | − | chr8 | 101932980 | 101932921; 101932944 | − | ENST00000395957; ENST00000395958; ENST00000457309; ENST00000395956; ENST00000353245; ENST00000523848; ENST00000522542; ENST00000521309; ENST00000522819; ENST00000395953; ENST00000395948; ENST00000395951; ENST00000419477; ENST00000521607 | TSF |
| 1% | chr8 | 101933557 | 101933272 | − | chr8 | 101932980 | 101932921; 101932944 | − | ENST00000395957; ENST00000395958; ENST00000457309; ENST00000395956; ENST00000353245; ENST00000523848; ENST00000522542; ENST00000521309; ENST00000522819; ENST00000395953; ENST00000395948; ENST00000395951; ENST00000419477; ENST00000521607 | TSF |
| 1% | chr12 | 6459191 | 6458996 | − | chr12 | 6458387 | 6458330 | − | ENST00000360168; ENST00000358945; ENST00000540037; ENST00000228916; ENST00000543768 | TSF |
| 1% | chr1 | 9850138 | 9850120 | − | chr1 | 9833452 | 9833330 | − | ENST00000377298; ENST00000361311; ENST00000377288 | TSF |

TABLE 44-continued

Transcript fusion for ovarian cancer (OV) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 1% | chr1 | 9850138 | 9850120 | – | chr1 | 9833452 | 9833330 | – | ENST00000377298; ENST00000361311; ENST00000377288 | TSF |
| 1% | chr1 | 9850138 | 9850120 | – | chr1 | 9833452 | 9833330 | – | ENST00000377298; ENST00000361311; ENST00000377288 | TSF |
| 1% | chr19 | 14243138 | 14242881 | – | chr19 | 14237049 | 14236934 | – | ENST00000263382; ENST00000592798; ENST00000590835; ENST00000474890 | TSF |
| 1% | chr19 | 14243138 | 14242881 | – | chr19 | 14237049 | 14236934 | – | ENST00000263382; ENST00000592798; ENST00000590835; ENST00000474890 | TSF |
| 1% | chr19 | 14243138 | 14242881 | – | chr19 | 14237049 | 14236934 | – | ENST00000263382; ENST00000592798; ENST00000590835; ENST00000474890 | TSF |
| 1% | chr19 | 14243138 | 14242881 | – | chr19 | 14237049 | 14236934 | – | ENST00000263382; ENST00000592798; ENST00000590835; ENST00000474890 | TSF |

TABLE 45

Transcript fusion for Pancreatic adenocarcinoma (PAAD) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 43% | chr3 | 49927493 | 49927357 | – | ENST00000296474; ENST00000344206 | chr3 | 49927248 | 49927204 | – | TAF |
| 43% | chr3 | 49927493 | 49927357 | – | ENST00000296474; ENST00000344206 | chr3 | 49927248 | 49927204 | – | TAF |
| 21% | chr5 | 147207691 | 147207585 | – | ENST00000296695; ENST00000510027 | chr5 | 147185494 | 147185375 | – | TAF |
| 20% | chr5 | 82554349 | 82554496 | + | ENST00000282268; ENST00000338635; ENST00000396027; ENST00000511817 | chr5 | 82606608 | 82606935 | + | TAF |
| 19% | chr3 | 118943092 | 118942905 | – | ENST00000483209; ENST00000467604; ENST00000359213; ENST00000393765; ENST00000480814 | chr3 | 118938512 | 118938188 | – | TAF |
| 18% | chr1 | 22313024 | 22313176 | + | ENST00000337107; ENST00000400277 | chr1 | 22321959 | 22322031 | + | TAF |
| 18% | chr1 | 22313024 | 22313176 | + | ENST00000337107; ENST00000400277 | chr1 | 22321959 | 22322031 | + | TAF |
| 17% | chr4 | 169086398 | 169086477 | + | ENST00000359299 | chr4 | 169090666 | 169090754 | + | TSF |
| 13% | chr20 | 53092486 | 53092551 | + | ENST00000262593 | chr20 | 53111339 | 53111426 | + | TAF |
| 12% | chr1 | 15813780 | 15813932 | + | ENST00000375910 | chr1 | 15814741 | 15814890 | + | TSF |
| 11% | chr19 | 50984141 | 50984234 | + | ENST00000334976; ENST00000376918; ENST00000598585 | chr19 | 51009025 | 51009080 | + | TAF |
| 11% | chr3 | 149205406 | 149205542 | + | ENST00000305354 | chr3 | 149210784 | 149210892 | + | TAF |
| 10% | chr15 | 32976758; 32976761 | 32976870 | + | ENST00000300175; ENST00000413748; ENST00000494364; ENST00000497208; ENST00000471027 | chr15 | 32977789 | 32977906 | + | TAF |
| 10% | chr15 | 32976758; 32976761 | 32976870 | + | ENST00000300175; ENST00000413748; ENST00000494364; ENST00000497208; ENST00000471027 | chr15 | 32977789 | 32977906 | + | TAF |
| 10% | chr15 | 32976758; 32976761 | 32976870 | + | ENST00000300175; ENST00000413748; ENST00000494364; ENST00000497208; ENST00000471027 | chr15 | 32977789 | 32977906 | + | TAF |
| 10% | chr10 | 118310610 | 118310744 | + | ENST00000369221 | chr10 | 118311742 | 118312116 | + | TSF |
| 10% | chr1 | 15802952; 15802960 | 15803040 | + | ENST00000375910; ENST00000422901 | chr1 | 15807450 | 15807521 | + | TSF |
| 10% | chr1 | 15802952; 15802960 | 15803040 | + | ENST00000375910; ENST00000422901 | chr1 | 15807450 | 15807521 | + | TSF |
| 10% | chr3 | 49928739 | 49928630 | – | ENST00000296474; ENST00000344206; ENST00000434765; ENST00000440292 | chr3 | 49928452 | 49928163 | – | TSF |
| 10% | chr3 | 49928739 | 49928630 | – | ENST00000296474; ENST00000344206; ENST00000434765; ENST00000440292 | chr3 | 49928452 | 49928163 | – | TSF |
| 10% | chr3 | 49928739 | 49928630 | – | ENST00000296474; ENST00000344206; ENST00000434765; ENST00000440292 | chr3 | 49928452 | 49928163 | – | TSF |
| 10% | chr3 | 49928739 | 49928630 | – | ENST00000296474; ENST00000344206; ENST00000434765; ENST00000440292 | chr3 | 49928452 | 49928163 | – | TSF |
| 9% | chr3 | 148563211 | 148563413 | + | ENST00000491148; ENST00000282957 | chr3 | 148570090 | 148570266 | + | TSF |
| 8% | chr11 | 17429000 | 17428901 | – | ENST00000389817; ENST00000302539 | chr11 | 17428722 | 17428716 | – | TSF |
| 8% | chr11 | 17429000 | 17428901 | – | ENST00000389817; ENST00000302539 | chr11 | 17428722 | 17428716 | – | TSF |
| 8% | chr1 | 15783581 | 15783669 | + | ENST00000359621 | chr1 | 15807450 | 15807521 | + | TSF |
| 8% | chr17 | 43475413 | 43475315 | – | ENST00000532038; ENST00000376922; ENST00000528384; ENST00000455881; ENST00000428638; ENST00000442348; ENST00000532891 | chr17 | 43474814 | 43474703 | – | TSF |
| 8% | chr17 | 43475413 | 43475315 | – | ENST00000532038; ENST00000376922; ENST00000528384; ENST00000455881; ENST00000428638; ENST00000442348; ENST00000532891 | chr17 | 43474814 | 43474703 | – | TSF |
| 8% | chr17 | 43475413 | 43475315 | – | ENST00000532038; ENST00000376922; ENST00000528384; ENST00000455881; ENST00000428638; ENST00000442348; ENST00000532891 | chr17 | 43474814 | 43474703 | – | TSF |
| 8% | chr17 | 43475413 | 43475315 | – | ENST00000532038; ENST00000376922; ENST00000528384; ENST00000455881; ENST00000428638; ENST00000442348; ENST00000532891 | chr17 | 43474814 | 43474703 | – | TSF |
| 8% | chr17 | 43475413 | 43475315 | – | ENST00000532038; ENST00000376922; ENST00000528384; ENST00000455881; ENST00000428638; ENST00000442348; ENST00000532891 | chr17 | 43474814 | 43474703 | – | TSF |
| 8% | chr17 | 43475413 | 43475315 | – | ENST00000532038; ENST00000376922; ENST00000528384; ENST00000455881; ENST00000428638; ENST00000442348; | chr17 | 43474814 | 43474703 | – | TSF |

TABLE 45-continued

Transcript fusion for Pancreatic adenocarcinoma (PAAD) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 7% | chr9 | 33796641 | 33796800 | + | ENST00000532891; ENST00000361005; ENST00000457896; ENST00000342836; ENST00000429677; ENST00000379405 | chr9 | 33797121 | 33797225 | + | TSF |
| 7% | chr9 | 33796641 | 33796800 | + | ENST00000361005; ENST00000457896; ENST00000342836; ENST00000429677; ENST00000379405 | chr9 | 33797121 | 33797225 | + | TSF |
| 7% | chr9 | 33796641 | 33796800 | + | ENST00000361005; ENST00000457896; ENST00000342836; ENST00000429677; ENST00000379405 | chr9 | 33797121 | 33797225 | + | TSF |
| 7% | chr9 | 33796641 | 33796800 | + | ENST00000361005; ENST00000457896; ENST00000342836; ENST00000429677; ENST00000379405 | chr9 | 33797121 | 33797225 | + | TSF |
| 7% | chr9 | 33796641 | 33796800 | + | ENST00000361005; ENST00000457896; ENST00000342836; ENST00000429677; ENST00000379405 | chr9 | 33797121 | 33797225 | + | TSF |
| 6% | chr16 | 75239411 | 75239269 | − | ENST00000303037; ENST00000562106; ENST00000567767; ENST00000562387 | chr16 | 75081811 | 75081640 | − | TSF |
| 6% | chr16 | 75239411 | 75239269 | − | ENST00000303037; ENST00000562106; ENST00000567767; ENST00000562387 | chr16 | 75081811 | 75081640 | − | TSF |
| 6% | chr16 | 75239411 | 75239269 | − | ENST00000303037; ENST00000562106; ENST00000567767; ENST00000562387 | chr16 | 75081811 | 75081640 | − | TSF |
| 6% | chr16 | 75239411 | 75239269 | − | ENST00000303037; ENST00000562106; ENST00000567767; ENST00000562387 | chr16 | 75081811 | 75081640 | − | TSF |
| 6% | chr11 | 17429000 | 17428901 | − | ENST00000389817; ENST00000302539 | chr11 | 17428756 | 17428716 | − | TSF |
| 6% | chr11 | 17429000 | 17428901 | − | ENST00000389817; ENST00000302539 | chr11 | 17428756 | 17428716 | − | TSF |
| 5% | chr16 | 29913136; 29912293 | 29913241 | + | ENST00000563177; ENST00000483405; ENST00000308748; ENST00000414952; ENST00000566693 | chr16 | 29915825 | 29915953 | + | TSF |
| 5% | chr16 | 29913136; 29912293 | 29913241 | + | ENST00000563177; ENST00000483405; ENST00000308748; ENST00000414952; ENST00000566693 | chr16 | 29915825 | 29915953 | + | TSF |
| 4% | chr1 | 15764961 | 15765000 | + | ENST00000375949; ENST00000375943 | chr1 | 15765777 | 15765949 | + | TSF |
| 4% | chr10 | 118386375 | 118386509 | + | ENST00000537242; ENST00000433618 | chr10 | 118386790 | 118386809 | + | TSF |
| 4% | chr10 | 118386375 | 118386509 | + | ENST00000537242; ENST00000433618 | chr10 | 118386790 | 118386809 | + | TSF |
| 4% | chr19 | 54501493 | 54501567 | + | ENST00000252729; ENST00000346968 | chr19 | 54502685 | 54502767 | + | TSF |
| 3% | chr19 | 504745 | 504908 | + | ENST00000587541; ENST00000215637; ENST00000346144; ENST00000382683 | chr19 | 505078 | 505370 | + | TSF |
| 3% | chr19 | 504745 | 504908 | + | ENST00000587541; ENST00000215637; ENST00000346144; ENST00000382683 | chr19 | 505078 | 505370 | + | TSF |
| 3% | chr19 | 504745 | 504908 | + | ENST00000587541; ENST00000215637; ENST00000346144; ENST00000382683 | chr19 | 505078 | 505370 | + | TSF |
| 3% | chr19 | 504745 | 504908 | + | ENST00000587541; ENST00000215637; ENST00000346144; ENST00000382683 | chr19 | 505078 | 505370 | + | TSF |
| 3% | chr9 | 33798484 | 33798593 | + | ENST00000361005; ENST00000342836; ENST00000429677; ENST00000379405 | chr4 | 144494223 | 144494466 | + | TSF |
| 3% | chr9 | 33798484 | 33798593 | + | ENST00000361005; ENST00000342836; ENST00000429677; ENST00000379405 | chr4 | 144494223 | 144494466 | + | TSF |
| 3% | chr9 | 33798484 | 33798593 | + | ENST00000361005; ENST00000342836; ENST00000429677; ENST00000379405 | chr4 | 144494223 | 144494466 | + | TSF |
| 3% | chr9 | 33798484 | 33798593 | + | ENST00000361005; ENST00000342836; ENST00000429677; ENST00000379405 | chr4 | 144494223 | 144494466 | + | TSF |
| 3% | chr1 | 15793881 | 15794033 | + | ENST00000359621 | chr1 | 15795560 | 15795701 | + | TSF |
| 3% | chr8 | 71619168 | 71619388 | + | ENST00000408926; ENST00000520030 | chr8 | 71625661 | 71625673 | + | TSF |
| 3% | chr6 | 84772612 | 84772711 | + | ENST00000257776 | chr6 | 84849189 | 84849246 | + | TSF |
| 3% | chr10 | 96443577 | 96443744 | + | ENST00000339022; ENST00000285979 | chr10 | 96698194 | 96698222 | + | TSF |
| 3% | chr3 | 98600611; 98600498 | 98600384 | − | ENST00000326840; ENST00000326857; ENST00000449482 | chr3 | 98586282 | 98584565 | − | TSF |
| 3% | chr3 | 98600611; 98600498 | 98600384 | − | ENST00000326840; ENST00000326857; ENST00000449482 | chr3 | 98586282 | 98584565 | − | TSF |

TABLE 46

Transcript fusion for Pancreatic adenocarcinoma (PAAD) Coordinates of the fusion sequences for which the donor is the TE.

| 1 | 2' | 3' | 4' | 5' | 6' | 7' | 8' | 9' | 10' | 11 |
|---|---|---|---|---|---|---|---|---|---|---|
| 81% | chr8 | 104389530 | 104389551 | + | chr8 | 104390255 | 104390471 | + | ENST00000330295; ENST00000520337 | TAF |
| 31% | chr17 | 70713894 | 70713885 | − | chr17 | 70645407 | 70645309 | − | ENST00000255559; ENST00000542342; ENST00000582769 | TSF |
| 31% | chr17 | 70713894 | 70713885 | − | chr17 | 70645407 | 70645309 | − | ENST00000255559; ENST00000542342; ENST00000582769 | TSF |
| 29% | chr16 | 29915789 | 29915910 | + | chr16 | 29916173 | 29916286 | + | ENST00000563177; ENST00000483405; ENST00000308748; ENST00000414952; ENST00000566693 | TAF |
| 29% | chr16 | 29915789 | 29915910 | + | chr16 | 29916173 | 29916286 | + | ENST00000563177; ENST00000483405; ENST00000308748; ENST00000414952; ENST00000566693 | TAF |
| 29% | chr9 | 130900342 | 130900452 | + | chr9 | 130913917 | 130913996 | + | ENST00000373017; ENST00000540948; ENST00000277480; ENST00000373013 | TAF |
| 29% | chr9 | 130900342 | 130900452 | + | chr9 | 130913917 | 130913996 | + | ENST00000373017; ENST00000540948; ENST00000277480; ENST00000373013 | TAF |
| 26% | chr5 | 147210961 | 147210946 | − | chr5 | 147209193 | 147209162 | − | ENST0000296695; ENST00000510027 | TAF |
| 26% | chr5 | 147210961 | 147210946 | − | chr5 | 147209193 | 147209162 | − | ENST0000296695; ENST00000510027 | TAF |

TABLE 46-continued

Transcript fusion for Pancreatic adenocarcinoma (PAAD) Coordinates of the fusion sequences for which the donor is the TE.

| 1 | 2' | 3' | 4' | 5' | 6' | 7' | 8' | 9' | 10' | 11 |
|---|---|---|---|---|---|---|---|---|---|---|
| 23% | chr | 22321930 | 22322006 | + | chr1 | 22324644 | 22324682 | + | ENST00000400277 | TAF |
| 21% | chr14 | 102691697 | 102691432 | − | chr14 | 102691131 | 102691116 | − | ENST00000559838 | TAF |
| 20% | chr19 | 55558521 | 55558473 | − | chr19 | 55556677 | 55556442 | − | ENST00000415061; ENST00000396247 | TAF |
| 19% | chr1 | 17568772 | 17568900 | + | chr1 | 17570505 | 17570738 | + | ENST00000375471; ENST00000537499; ENST00000413717; ENST00000536552 | TAF |
| 16% | chr20 | 44420870 | 44421070 | + | chr20 | 44421316 | 44421386 | + | ENST00000372622; ENST00000449078; ENST00000456939 | TAF |
| 16% | chr20 | 44420870 | 44421070 | + | chr20 | 44421316 | 44421386 | + | ENST00000372622; ENST00000449078; ENST00000456939 | TAF |
| 16% | chr20 | 44420870 | 44421070 | + | chr20 | 44421316 | 44421386 | + | ENST00000372622; ENST00000449078; ENST00000456939 | TAF |
| 16% | chr10 | 99548701 | 99548695 | − | chr10 | 99529502 | 99529425 | − | ENST00000266066 | TAF |
| 15% | chr7 | 150938296 | 150938250 | − | chr7 | 150937608 | 150937511 | − | ENST00000262188; ENST00000392811; ENST00000356800 | TAF |
| 15% | chr1 | 22296254 | 22296330 | + | chr1 | 22324644 | 22324682 | + | ENST00000400277 | TSF |
| 13% | chr19 | 16267516 | 16267566 | + | chr19 | 16268020 | 16268208; 16268205; 16268448; 16268139 | + | ENST00000253680; ENST00000397372; ENST00000593154; ENST00000588246; ENST00000593031 | TAF |
| 13% | chr19 | 16267516 | 16267566 | + | chr19 | 16268020 | 16268208; 16268205; 16268448; 16268139 | + | ENST00000253680; ENST00000397372; ENST00000593154; ENST00000588246; ENST00000593031 | TAF |
| 13% | chr19 | 16267516 | 16267566 | + | chr19 | 16268020 | 16268208; 16268205; 16268448; 16268139 | + | ENST00000253680; ENST00000397372; ENST00000593154; ENST00000588246; ENST00000593031 | TAF |
| 13% | chr19 | 16267516 | 16267566 | + | chr19 | 16268020 | 16268208; 16268205; 16268448; 16268139 | + | ENST00000253680; ENST00000397372; ENST00000593154; ENST00000588246; ENST00000593031 | TAF |
| 13% | chr21 | 42597177 | 42597622 | + | chr21 | 42598193 | 42598281 | + | ENST00000328735; ENST00000330333; ENST00000347667 | TAF |
| 13% | chr21 | 42597177 | 42597622 | + | chr21 | 42598193 | 42598281 | + | ENST00000328735; ENST00000330333; ENST00000347667 | TAF |
| 13% | chr21 | 42597177 | 42597622 | + | chr21 | 42598193 | 42598281 | + | ENST00000328735; ENST00000330333; ENST00000347667 | TAF |
| 13% | chr9 | 135665394 | 135665131 | − | chr9 | 135602921 | 135602841 | − | ENST00000298545 | TAF |
| 12% | chr9 | 131189761 | 131190058 | + | chr9 | 131190581 | 131190700; 131190702 | + | ENST00000372842; ENST00000420512; ENST00000372838 | TAF |
| 12% | chr9 | 131189761 | 131190058 | + | chr9 | 131190581 | 131190700; 131190702 | + | ENST00000372842; ENST00000420512; ENST00000372838 | TAF |
| 11% | Ichr8 | 143751981 | 143751986 | + | chr8 | 143762745 | 143762852; 143762884 | + | ENST00000301258; ENST00000513264 | TAF |
| 11% | chr8 | 143751981 | 143751986 | + | chr8 | 143762745 | 143762852; 143762884 | + | ENST00000301258; ENST00000513264 | TAF |
| 11% | chr17 | 79214190 | 79214239 | + | chr17 | 79214787 | 79214816; 79214953 | + | ENST00000431388; ENST00000576002 | TAF |
| 11% | chr17 | 79214190 | 79214239 | + | chr17 | 79214787 | 79214816; 79214953 | + | ENST00000431388; ENST00000576002 | TAF |
| 11% | chr17 | 48749939 | 48750209 | + | chr17 | 48750332 | 48750499 | + | ENST00000285238; ENST00000505699 | TAF |
| 11% | chr17 | 48749939 | 48750209 | + | chr17 | 48750332 | 48750499 | + | ENST00000285238; ENST00000505699 | TAF |
| 11% | chr7 | 116364854 | 116364901 | + | chr7 | 116371722 | 116371913 | + | ENST00000397752; ENST00000318493; ENST00000436117 | TAF |
| 11% | chr7 | 116364854 | 116364901 | + | chr7 | 116371722 | 116371913 | + | ENST00000397752; ENST00000318493; ENST00000436117 | TAF |
| 11% | chr7 | 116364854 | 116364901 | + | chr7 | 116371722 | 116371913 | + | ENST00000397752; ENST00000318493; ENST00000436117 | TAF |
| 11% | chr1 | 15807396 | 15807482 | + | chr1 | 15807593 | 15807690 | + | ENST00000375910; ENST00000422901 | TSF |
| 11% | chr1 | 15807396 | 15807482 | + | chr1 | 15807593 | 15807690 | + | ENST00000375910; ENST00000422901 | TSF |
| 11% | chr10 | 118308042 | 118308051 | + | chr10 | 118310610 | 118310744 | + | ENST00000369221 | TSF |
| 10% | chr17 | 80440912 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |
| 10% | chr17 | 80440912 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |
| 10% | chr17 | 80440912 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |
| 10% | chr17 | 80440912 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |
| 10% | chr9 | 130569975 | 130570054 | + | chr9 | 130570513 | 130570590; 130570580 | + | ENST00000373247; ENST00000373245; ENST00000393706; ENST00000373228; ENST00000373225; ENST00000431857; ENST00000423577 | TAF |
| 10% | chr9 | 130569975 | 130570054 | + | chr9 | 130570513 | 130570590; 130570580 | + | ENST00000373247; ENST00000373245; ENST00000393706; ENST00000373228; ENST00000373225; ENST00000431857; ENST00000423577 | TAF |
| 10% | chr9 | 130569975 | 130570054 | + | chr9 | 130570513 | 130570590; 130570580 | + | ENST00000373247; ENST00000373245; ENST00000393706; ENST00000373228; ENST00000373225; ENST00000431857; ENST00000423577 | TAF |
| 10% | chr9 | 130569975 | 130570054 | + | chr9 | 130570513 | 130570590; 130570580 | + | ENST00000373247; ENST00000373245; ENST00000393706; ENST00000373228; ENST00000373225; ENST00000431857; ENST00000423577 | TAF |
| 10% | chr6 | 31154067 | 31153803 | − | chr6 | 31133824 | 31133704 | − | ENST00000259915 | TAF |

TABLE 46-continued

Transcript fusion for Pancreatic adenocarcinoma (PAAD) Coordinates of the fusion sequences for which the donor is the TE.

| 1 | 2' | 3' | 4' | 5' | 6' | 7' | 8' | 9' | 10' | 11 |
|---|---|---|---|---|---|---|---|---|---|---|
| 8% | chr12 | 117498589 | 117498567 | − | chr12 | 117494691 | 117494611 | − | ENST00000470612; ENST00000335209; ENST00000392545; ENST00000462502 | TSF |
| 8% | chr12 | 117498589 | 117498567 | − | chr12 | 117494691 | 117494611 | − | ENST00000470612; ENST00000335209; ENST00000392545; ENST00000462502 | TSF |
| 8% | chr12 | 117498589 | 117498567 | − | chr12 | 117494691 | 117494611 | − | ENST00000470612; ENST00000335209; ENST00000392545; ENST00000462502 | TSF |
| 7% | chr19 | 1114930 | 1114676 | − | chr19 | 1114421 | 1114230 | − | ENST00000361757; ENST00000587024; ENST00000438103 | TSF |
| 7% | chr9 | 33797054 | 33797162 | + | chr9 | 33797827 | 33798080 | + | ENST00000361005; ENST00000457896; ENST00000342836; ENST00000429677; ENST00000379405 | TSF |
| 7% | chr9 | 33797054 | 33797162 | + | chr9 | 33797827 | 33798080 | + | ENST00000361005; ENST00000457896; ENST00000342836; ENST00000429677; ENST00000379405 | TSF |
| 7% | chr16 | 20336354 | 20336269 | − | chr16 | 20557833 | 20335138; 20335289 | − | ENST00000302555; ENST00000381362; ENST00000575449 | TSF |
| 7% | chr16 | 20336354 | 20336269 | − | chr16 | 20335578 | 20335138; 20335289 | | ENST00000302555; ENST00000381362; ENST00000575449 | TSF |
| 7% | chr16 | 20336354 | 20336269 | − | chr16 | 20335578 | 20335138; 20335289 | − | ENST00000302555; ENST00000381362; ENST00000575449 | TSF |
| 6% | chr10 | 118312917 | 118313077 | + | chr10 | 118313239 | 118313350 | + | ENST00000369221 | TSF |
| 6% | chr1 | 200882539 | 200882562 | + | chr1 | 200882665 | 200882757 | + | ENST00000367342; ENST00000413687 | TSF |
| 6% | chr7 | 100850556 | 100850506 | − | chr7 | 100850185 | 100850060 | − | ENST00000454310; ENST00000223127 | TSF |
| 5% | chr3 | 148570083 | 148570155 | + | chr3 | 148575244 | 148575328 | + | ENST00000491148; ENST00000282957 | TSF |
| 4% | chr1 | 15791260 | 15791412 | + | chr1 | 15792494 | 15792639 | + | ENST00000359621 | TSF |
| 4% | chr20 | 43941352 | 43941632 | + | chr20 | 43942108 | 43942245 | + | ENST00000372741; ENST00000372743; ENST00000343694 | TSF |
| 4% | chr20 | 43941352 | 43941632 | + | chr20 | 43942108 | 43942245 | + | ENST00000372741; ENST00000372743; ENST00000343694 | TSF |
| 4% | chr20 | 43941352 | 43941632 | + | chr20 | 43942108 | 43942245 | + | ENST00000372741; ENST00000372743; ENST00000343694 | TSF |
| 4% | chr | 22296254 | 22296400 | + | chr1 | 22324644 | 22324682 | + | ENST00000400277 | TSF |
| 4% | chr16 | 20328511 | 20328487 | − | chr16 | 20327362 | 20327278 | − | ENST00000302555; ENST00000341642; ENST00000381362; ENST00000381360 | TSF |
| 4% | chr4 | 142977397 | 142977072 | − | chr4 | 142950067 | 142949935 | − | ENST00000513000; ENST00000262992; ENST00000308502; ENST00000508116 | TSF |
| 4% | chr9 | 35678063 | 35678160 | + | chr9 | 35679182 | 35679339 | + | ENST00000378357 | TSF |
| 3% | chr1 | 15795401 | 15795527 | + | chr1 | 15798485 | 15798502 | + | ENST00000359621 | TSF |
| 3% | chr20 | 45337040 | 45337192 | + | chr20 | 45353680 | 45354963 | + | ENST00000359271 | TSF |
| 3% | chr16 | 75251739 | 75251839 | + | chr16 | 75256666 | 75256769 | + | ENST00000361017; ENST00000495583 | TSF |
| 3% | chr16 | 75251739 | 75251839 | + | chr16 | 75256666 | 75256769 | + | ENST00000361017; ENST00000495583 | TSF |
| 3% | chr11 | 59621007 | 59620878 | − | chr11 | 59620794 | 59620676 | − | ENST00000257264 | TSF |
| 3% | chr12 | 120764491 | 120764436 | − | chr12 | 120763823 | 120763664 | − | ENST00000308366; ENST00000423423 | TSF |
| 3% | chr12 | 120764491 | 120764436 | − | chr12 | 120763823 | 120763664 | − | ENST00000308366; ENST00000423423 | TSF |

TABLE 47

Transcript fusion for Pheochromocytoma and Paraganglioma (PCPG) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 84% | chr14 | 101200486 | 101200513 | + | ENST00000341267; ENST00000331224 | chr14 | 101473144 | 101473392 | + | TAF |
| 65% | chr6 | 84772612 | 84772711 | + | ENST00000257776 | chr6 | 84849189 | 84849246 | + | TSF |
| 61% | chr20 | 9453926 | 9454012 | + | ENST00000334005; ENST00000378473; ENST00000278655; ENST00000414679; ENST00000378493; ENST00000378501 | chr20 | 9484605 | 9485169 | + | TAF |
| 61% | chr20 | 9453926 | 9454012 | + | ENST00000334005; ENST00000378473; ENST00000278655; ENST00000414679; ENST00000378493; ENST00000378501 | chr20 | 9484605 | 9485169 | + | TAF |
| 59% | chr3 | 33636460 | 33636443 | − | ENST00000468888; ENST00000399362; ENST00000307312; ENST00000359576; ENST00000480013; ENST00000461133 | chr3 | 33635629 | 33635332 | − | TAF |
| 59% | chr3 | 33636460 | 33636443 | − | ENST00000468888; ENST00000399362; ENST00000307312; ENST00000359576; ENST00000480013; ENST00000461133 | chr3 | 33635629 | 33635332 | − | TAF |
| 59% | chr3 | 33636460 | 33636443 | − | ENST00000468888; ENST00000399362; ENST00000307312; ENST00000359576; ENST00000480013; ENST00000461133 | chr3 | 33635629 | 33635332 | − | TAF |
| 59% | chr3 | 33636460 | 33636443 | − | ENST00000468888; ENST00000399362; ENST00000307312; ENST00000359576; ENST00000480013; ENST00000461133 | chr3 | 33635629 | 33635332 | − | TAF |
| 51% | chr9 | 136518062 | 136518121 | + | ENST00000393056 | chr9 | 136521413 | 136521506 | + | TSF |
| 49% | chr12 | 6943089 | 6943213 | + | ENST00000251761; ENST00000396725; ENST00000606935 | chr12 | 6943989 | 6944119 | + | TAF |
| 49% | chr12 | 6943089 | 6943213 | + | ENST00000251761; ENST00000396725; ENST00000606935 | chr12 | 6943989 | 6944119 | + | TAF |
| 49% | chr12 | 6943089 | 6943213 | + | ENST00000251761; ENST00000396725; ENST00000606935 | chr12 | 6943989 | 6944119 | + | TAF |
| 47% | chrX | 49054298 | 49054174 | − | ENST00000263233; ENST00000479808; ENST00000469389; ENST00000466635 | chrX | 49053735 | 49053463 | − | TSF |
| 41% | chr19 | 44129402 | 44129230 | − | ENST00000222374 | chr19 | 44129055 | 44128921 | − | TAF |
| 41% | chr3 | 54157540 | 54157621 | + | ENST00000415676; ENST00000288197; ENST00000474759 | chr3 | 54326852 | 54327228 | + | TSF |
| 32% | chr9 | 100308467 | 100308623 | + | ENST00000395211; ENST00000259365 | chr9 | 100309531 | 100309647 | + | TAF |
| 31% | chr19 | 1235564 | 1235500 | − | ENST00000590083; ENST00000382477; ENST00000215376; ENST00000589260 | chr19 | 1235389 | 1235290 | − | TAF |
| 31% | chr19 | 1235564 | 1235500 | − | ENST00000590083; ENST00000382477; ENST00000215376; ENST00000589260 | chr19 | 1235389 | 1235290 | − | TAF |
| 31% | chr20 | 5902981 | 5904677 | + | ENST00000378961 | chr20 | 5911058 | 5911312 | + | TSF |

TABLE 47-continued

Transcript fusion for Pheochromocytoma and Paraganglioma (PCPG) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 28% | chr10 | 43601824 | 43602019 | + | ENST00000355710; ENST0000340058 | chr10 | 43602522 | 43602638 | + | TSF |
| 27% | chr15 | 32976758; 32976761 | 32976870 | + | ENST00000300175; ENST00000413748; ENST00000494364; ENST00000497208; ENST00000471027 | chr15 | 32977789 | 32977906 | + | TAF |
| 27% | chr15 | 32976758; 32976761 | 32976870 | + | ENST00000300175; ENST00000413748; ENST00000494364; ENST00000497208; ENST00000471027 | chr15 | 32977789 | 32977906 | + | TAF |
| 27% | chr15 | 32976758; 32976761 | 32976870 | + | ENST00000300175; ENST00000413748; ENST00000494364; ENST00000497208; ENST00000471027 | chr15 | 32977789 | 32977906 | + | TAF |
| 27% | chr2 | 219849027 | 219848953 | − | ENST00000295727 | chr2 | 219847374 | 219847276 | − | TSF |
| 26% | chr17 | 26938813 | 26938786 | − | ENST00000494272; ENST00000301037 | chr17 | 26932233 | 26930495 | − | TSF |
| 26% | chr17 | 26938813 | 26938786 | − | ENST00000494272; ENST00000301037 | chr17 | 26932233 | 26930495 | − | TSF |
| 22% | chr15 | 74476330 | 74476197 | − | ENST00000395105; ENST00000423167; ENST00000323940; ENST00000449139; ENST00000416286; ENST00000535552; ENST00000563965; ENST00000574278; ENST00000569936 | chr15 | 74475723 | 74475630 | − | TSF |
| 22% | chr15 | 74476330 | 74476197 | − | ENST00000395105; ENST00000423167; ENST00000323940; ENST00000449139; ENST00000416286; ENST00000535552; ENST00000563965; ENST00000574278; ENST00000569936 | chr15 | 74475723 | 74475630 | − | TSF |
| 22% | chr15 | 74476330 | 74476197 | − | ENST00000395105; ENST00000423167; ENST00000323940; ENST00000449139; ENST00000416286; ENST00000535552; ENST00000563965; ENST00000574278; ENST00000569936 | chr15 | 74475723 | 74475630 | − | TSF |
| 22% | chr15 | 74476330 | 74476197 | − | ENST00000395105; ENST00000423167; ENST00000323940; ENST00000449139; ENST00000416286; ENST00000535552; ENST00000563965; ENST00000574278; ENST00000569936 | chr15 | 74475723 | 74475630 | − | TSF |
| 22% | chr15 | 74476330 | 74476197 | − | ENST00000395105; ENST00000423167; ENST00000323940; ENST00000449139; ENST00000416286; ENST00000535552; ENST00000563965; ENST00000574278; ENST00000569936 | chr15 | 74475723 | 74475630 | − | TSF |
| 22% | chr15 | 74476330 | 74476197 | − | ENST00000395105; ENST00000423167; ENST00000323940; ENST00000449139; ENST00000416286; ENST00000535552; ENST00000563965; ENST00000574278; ENST00000569936 | chr15 | 74475723 | 74475630 | − | TSF |
| 22% | chr15 | 74476330 | 74476197 | − | ENST00000395105; ENST00000423167; ENST00000323940; ENST00000449139; ENST00000416286; ENST00000535552; ENST00000563965; ENST00000574278; ENST00000569936 | chr15 | 74475723 | 74475630 | − | TSF |
| 20% | chr19 | 50984141 | 50984234 | + | ENST00000334976; ENST00000376918; ENST00000598585 | chr19 | 51009025 | 51009080 | + | TAF |
| 17% | chr10 | 33197462; 33197431 | 33197296 | − | ENST00000423113; ENST00000396033; ENST00000302278; ENST00000374956; ENST00000488427 | chr10 | 33039666 | 33039198 | − | TSF |
| 17% | chr10 | 33197462; 33197431 | 33197296 | − | ENST00000423113; ENST00000396033; ENST00000302278; ENST00000374956; ENST00000488427 | chr10 | 33039666 | 33039198 | − | TSF |
| 16% | chr3 | 54786626 | 54786704 | + | ENST00000415676; ENST00000288197; ENST00000474759; ENST00000471363; ENST00000490478; ENST00000477024 | chr3 | 54787473 | 54787673 | + | TSF |
| 16% | chr3 | 54786626 | 54786704 | + | ENST00000415676; ENST00000288197; ENST00000474759; ENST00000471363; ENST00000490478; ENST00000477024 | chr3 | 54787473 | 54787673 | + | TSF |
| 14% | chr15 | 45464200; 45464276 | 45464081 | − | ENST00000290894; ENST00000318390; ENST00000458022; ENST00000558294; ENST00000559566 | chr15 | 45462680 | 45462661 | − | TSF |
| 14% | chr15 | 45464200; 45464276 | 45464081 | − | ENST00000290894; ENST00000318390; ENST00000458022; ENST00000558294; ENST00000559566 | chr15 | 45462680 | 45462661 | − | TSF |
| 14% | chr15 | 45464200; 45464276 | 45464081 | − | ENST00000290894; ENST00000318390; ENST00000458022; ENST00000558294; ENST00000559566 | chr15 | 45462680 | 45462661 | − | TSF |
| 14% | chr15 | 45464200; 45464276 | 45464081 | − | ENST00000290894; ENST00000318390; ENST00000458022; ENST00000558294; ENST00000559566 | chr15 | 45462680 | 454162661 | − | TSF |
| 14% | chr15 | 45464200; 45464276 | 45464081 | − | ENST00000290894; ENST00000318390; ENST00000458022; ENST00000558294; ENST00000559566 | chr15 | 45462680 | 45462661 | − | TSF |
| 13% | chr6 | 37611719 | 37611585 | − | ENST00000297153; ENST00000434837; ENST00000505425; ENST00000418178 | chr6 | 37611139 | 37611040 | − | TSF |
| 13% | chr6 | 37611719 | 37611585 | − | ENST00000297153; ENST00000434837; ENST00000505425; ENST00000418178 | chr6 | 37611139 | 37611040 | − | TSF |
| 13% | chr6 | 37611719 | 37611585 | − | ENST00000297153; ENST00000434837; ENST00000505425; ENST00000418178 | chr6 | 37611139 | 37611040 | − | TSF |
| 13% | chr19 | 50213980 | 50214114 | + | ENST00000323446; ENST00000392518; ENST00000354199; ENST00000598293; ENST00000405931; ENST00000595031 | chr19 | 50214968 | 50214999 | + | TSF |
| 13% | chr19 | 50213980 | 50214114 | + | ENST00000323446; ENST00000392518; ENST00000354199; ENST00000598293; ENST00000405931; ENST00000595031 | chr19 | 50214968 | 50214999 | + | TSF |
| 13% | chr19 | 50213980 | 50214114 | + | ENST00000323446; ENST00000392518; ENST00000354199; ENST00000598293; ENST00000405931; ENST00000595031 | chr19 | 50214968 | 50214999 | + | TSF |
| 12% | chr6 | 107908284 | 107908379 | + | ENST00000317357 | chr6 | 107948590 | 107948666 | + | TSF |
| 12% | chr7 | 102249269 | 102249208 | − | ENST00000262940; ENST00000461209; ENST00000449970; ENST00000462172; ENST00000522801; ENST00000520042; ENST00000521076 | chr7 | 102248714 | 102248385 | − | TSF |
| 12% | chr7 | 102249269 | 102249208 | − | ENST00000262940; ENST00000461209; ENST00000449970; ENST00000462172; ENST00000522801; ENST00000520042; ENST00000521076 | chr7 | 102248714 | 102248385 | − | TSF |
| 12% | chr7 | 102249269 | 102249208 | − | ENST00000262940; ENST00000461209; ENST00000449970; ENST00000462172; ENST00000522801; ENST00000520042; ENST00000521076 | chr7 | 102248714 | 102248385 | − | TSF |
| 12% | chr8 | 139626163 | 139626110 | − | ENST00000303045; ENST00000435777 | chr8 | 139623600 | 139623460 | − | TSF |
| 12% | chr8 | 139626163 | 139626110 | − | ENST00000303045; ENST00000435777 | chr8 | 139623600 | 139623460 | − | TSF |
| 11% | chr7 | 102141240 | 102141146 | − | ENST00000541662; ENST00000465829; ENST00000306682 | chr7 | 102139087 | 102139007 | − | TAF |
| 11% | chr7 | 102141240 | 102141146 | − | ENST00000541662; ENST00000465829; ENST00000306682 | chr7 | 102139087 | 102139007 | − | TAF |

TABLE 47-continued

Transcript fusion for Pheochromocytoma and Paraganglioma (PCPG) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 11% | chr7 | 102240401 | 102240307 | − | ENST00000262940; ENST00000461209; ENST00000449970; ENST00000462172; ENST00000519539; ENST00000522801 | chr7 | 102238252 | 102238172 | − | TAF |
| 11% | chr7 | 102240401 | 102240307 | − | ENST00000262940; ENST00000461209; ENST00000449970; ENST00000462172; ENST00000519539; ENST00000522801 | chr7 | 102238252 | 102238172 | − | TAF |
| 11% | chr7 | 102240401 | 102240307 | − | ENST00000262940; ENST00000461209; ENST00000449970; ENST00000462172; ENST00000519539; ENST00000522801 | chr7 | 102238252 | 102238172 | − | TAF |
| 11% | chr7 | 102240401 | 102240307 | − | ENST00000262940; ENST00000461209; ENST00000449970; ENST00000462172; ENST00000519539; ENST00000522801 | chr7 | 102238252 | 102238172 | − | TAF |
| 10% | chrX | 64743587; 64743497 | 64743440 | − | ENST00000374807; ENST00000374811; ENST00000374804; ENST00000469091 | chrX | 64742373 | 64741630 | − | TAF |
| 10% | chrX | 64743587; 64743497 | 64743440 | − | ENST00000374807; ENST00000374811; ENST00000374804; ENST00000469091 | chrX | 64742373 | 64741630 | − | TAF |
| 10% | chrX | 64743587; 64743497 | 64743440 | − | ENST00000374807; ENST00000374811; ENST00000374804; ENST00000469091 | chrX | 64742373 | 64741630 | − | TAF |
| 10% | chrX | 64743587; 64743497 | 64743440 | − | ENST00000374807; ENST00000374811; ENST00000374804; ENST00000469091 | chrX | 64742373 | 64741630 | − | TAF |
| 10% | chr16 | 4409386 | 4409297 | − | ENST00000572467; ENST00000251166; ENST00000539968; ENST00000537233; ENST00000574025; ENST00000576637 | chr16 | 4409070 | 4408945 | − | TAF |
| 10% | chr16 | 4409386 | 4409297 | − | ENST00000572467; ENST00000251166; ENST00000539968; ENST00000537233; ENST00000574025; ENST00000576637 | chr16 | 4409070 | 4408945 | − | TAF |
| 10% | chr16 | 4409386 | 4409297 | − | ENST00000572467; ENST00000251166; ENST00000539968; ENST00000537233; ENST00000574025; ENST00000576637 | chr16 | 4409070 | 8944405 | − | TAF |
| 10% | chr16 | 4409386 | 4409297 | − | ENST00000572467; ENST00000251166; ENST00000539968; ENST00000537233; ENST00000574025; ENST00000576637 | chr16 | 4409070 | 4408945 | − | TAF |
| 10% | chr16 | 4409386 | 4409297 | − | ENST00000572467; ENST00000251166; ENST00000539968; ENST00000537233; ENST00000574025; ENST00000576637 | chr16 | 4409070 | 4408945 | − | TAF |
| 10% | chr19 | 3869015; 3869013 | 3868963 | − | ENST00000262961; ENST00000438164; ENST00000587212; ENST00000586578; ENST00000439086 | chr19 | 3855694 | 3855445 | − | TSF |
| 10% | chr19 | 3869015; 3869013 | 3868963 | − | ENST00000262961; ENST00000438164; ENST00000587212; ENST00000586578; ENST00000439086 | chr19 | 3855694 | 3855445 | − | TSF |
| 10% | chr3 | 48716169 | 48715997 | − | ENST00000341520; ENST00000416649; ENST00000294129; ENST00000413374 | chr3 | 48702393 | 48702198 | − | TSF |
| 10% | chr3 | 48716169 | 48715997 | − | ENST00000341520; ENST00000416649; ENST00000294129; ENST00000413374 | chr3 | 48702393 | 48702198 | − | TSF |
| 10% | chr3 | 48716169 | 48715997 | − | ENST00000341520; ENST00000416649; ENST00000294129; ENST00000413374 | chr3 | 48702393 | 02148798 | − | TSF |
| 9% | chr7 | 102150107 | 102150046 | − | ENST00000541662; ENST00000465829; ENST00000306682 | chr7 | 102149552 | 149102223 | − | TSF |
| 9% | chr7 | 102150107 | 102150046 | − | ENST00000541662; ENST00000465829; ENST00000306682 | chr7 | 102149552 | 102149223 | − | TSF |
| 7% | chr7 | 73459552 | 73459623 | + | ENST00000445912; ENST00000252034; ENST00000358929; ENST00000320492; ENST00000438906; ENST00000414324; ENST00000380562; ENST00000380575; ENST00000380584; ENST00000458204; ENST00000357036; ENST00000429192; ENST00000380576; ENST00000320399 | chr7 | 73460337 | 73460377 | + | TSF |
| 7% | chr7 | 73459552 | 73459623 | + | ENST00000445912; ENST00000252034; ENST00000358929; ENST00000320492; ENST00000438906; ENST00000414324; ENST00000380562; ENST00000380575; ENST00000380584; ENST00000458204; ENST00000357036; ENST00000429192; ENST00000380576; ENST00000320399 | chr7 | 73460337 | 73460377 | + | TSF |
| 7% | chr7 | 73459552 | 73459623 | + | ENST00000445912; ENST00000252034; ENST00000358929; ENST00000320492; ENST00000438906; ENST00000414324; ENST00000380562; ENST00000380575; ENST00000380584; ENST00000458204; ENST00000357036; ENST00000429192; ENST00000380576; ENST00000320399 | chr7 | 73460337 | 73460377 | + | TSF |
| 7% | chr7 | 73459552 | 73459623 | + | ENST00000445912; ENST00000252034; ENST00000358929; ENST00000320492; ENST00000438906; ENST00000414324; ENST00000380562; ENST00000380575; ENST00000380584; ENST00000458204; ENST00000357036; ENST00000429192; ENST00000380576; ENST00000320399 | chr7 | 73460337 | 73460377 | + | TSF |
| 7% | chr7 | 73459552 | 73459623 | + | ENST00000445912; ENST00000252034; ENST00000358929; ENST00000320492; ENST00000438906; ENST00000414324; ENST00000380562; ENST00000380575; ENST00000380584; ENST00000458204; ENST00000357036; ENST00000429192; ENST00000380576; ENST00000320399 | chr7 | 73460337 | 734603177 | + | TSF |
| 7% | chr14 | 93397595 | 93397666 | + | ENST00000216492 | chr14 | 93414485 | 93414702 | + | TSF |
| 6% | chr7 | 102240401 | 102240307 | − | ENST00000262940; ENST00000461209; ENST00000449970; ENST00000462172; ENST00000519539; ENST00000522801 | chr7 | 102237809 | 102237686 | − | TSF |
| 6% | chr7 | 102240401 | 102240307 | − | ENST00000262940; ENST00000461209; ENST00000449970; ENST00000462172; ENST00000519539; ENST00000522801 | chr7 | 102237809 | 102237686 | − | TSF |
| 6% | chr7 | 102240401 | 102240307 | − | ENST00000262940; ENST00000461209; ENST00000449970; ENST00000462172; ENST00000519539; ENST00000522801 | chr7 | 102237809 | 102237686 | − | TSF |
| 6% | chr7 | 102240401 | 102240307 | − | ENST00000262940; ENST00000461209; ENST00000449970; ENST00000462172; ENST00000519539; ENST00000522801 | chr7 | 102237809 | 102237686 | − | TSF |
| 6% | chr19 | 42471492 | 42471401 | − | ENST00000441343; ENST00000302102; ENST00000545399; ENST00000543770; ENST00000602133 | chr19 | 42470173 | 70042426 | − | TSF |
| 6% | chr19 | 42471492 | 42471401 | − | ENST00000441343; ENST00000302102; ENST00000545399; ENST00000543770; ENST00000602133 | chr19 | 42470173 | 42470026 | − | TSF |

TABLE 47-continued

Transcript fusion for Pheochromocytoma and Paraganglioma (PCPG) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 6% | chr19 | 42471492 | 42471401 | − | ENST00000441343; ENST00000302102; ENST00000545399; ENST00000543770; ENST00000602133 | chr19 | 42470173 | 70042426 | − | TSF |
| 6% | chr19 | 42471492 | 42471401 | − | ENST00000441343; ENST00000302102; ENST00000545399; ENST00000543770; ENST00000602133 | chr19 | 42470173 | 42470026 | − | TSF |
| 6% | chr7 | 102141240 | 102141146 | − | ENST00000541662; ENST00000465829; ENST00000306682 | chr7 | 102138644 | 102138521 | − | TSF |
| 6% | chr7 | 102141240 | 102141146 | − | ENST00000541662; ENST00000465829; ENST00000306682 | chr7 | 102138644 | 102138521 | − | TSF |
| 6% | chr6 | 110567463 | 110567335 | − | ENST00000338882 | chr6 | 110565813 | 110565664 | − | TSF |
| 6% | chr22 | 25202408 | 25202451 | + | ENST00000400358; ENST00000400359 | chr22 | 25209976 | 25210040 | + | TSF |
| 6% | chr2 | 207146574 | 207146633 | + | ENST00000374423 | chr2 | 207156738 | 207157223 | + | TSF |
| 6% | chrX | 53407651 | 53407541 | − | ENST00000322213; ENST00000470241 | chrX | 53388629 | 53388408 | − | TSF |
| 6% | chrX | 53407651 | 53407541 | − | ENST00000322213; ENST00000470241 | chrX | 53388629 | 53388408 | − | TSF |
| 6% | chr19 | 23556639 | 23556544 | − | ENST00000599743; ENST00000300619 | chr19 | 23491899 | 23491588 | − | TSF |
| 5% | chr8 | 104778455 | 104778765 | + | ENST00000504942; ENST00000406091 | chr8 | 104821508 | 104527821 | + | TSF |
| 5% | chr11 | 117710545 | 117710496 | − | ENST00000532984; ENST00000584394; ENST00000529335 | chr11 | 117703821 | 117703741 | − | TSF |
| 5% | chr11 | 117710545 | 117710496 | − | ENST00000532984; ENST00000584394; ENST00000529335 | chr11 | 117703821 | 117703741 | − | TSF |
| 5% | chr11 | 117710545 | 117710496 | − | ENST00000532984; ENST00000584394; ENST00000529335 | chr11 | 117703821 | 117703741 | − | TSF |
| 4% | chr10 | 73056335 | 73056499 | + | ENST00000335350; ENST00000373192 | chr10 | 73057337 | 730573178 | + | TSF |
| 4% | chr10 | 73056335 | 73056499 | + | ENST00000335350; ENST00000373192 | chr10 | 73057337 | 73057378 | + | TSF |
| 4% | chr15 | 32976758; 32976761 | 3297670 | + | ENST00000300175; ENST00000413748; ENST00000494364; ENST00000497208; ENST00000471027 | chr15 | 32977335 | 132977906 | + | TSF |
| 4% | chr15 | 32976758; 32976761 | 32976870 | + | ENST00000300175; ENST00000413748; ENST00000494364; ENST00000497208; ENST00000471027 | chr15 | 32977335 | 32977906 | + | TSF |
| 4% | chr15 | 32976758; 32976761 | 32976870 | + | ENST00000300175; ENST00000413748; ENST00000494364; ENST00000497208; ENST00000471027 | chr15 | 32977335 | 32977906 | + | TSF |
| 4% | chr19 | 49335016 | 49334925 | − | ENST00000263278; ENST00000595764 | chr19 | 49322122 | 49322095 | − | TSF |
| 4% | chr19 | 49335016 | 49334925 | − | ENST00000263278; ENST00000595764 | chr19 | 49322122 | 49322095 | − | TSF |
| 4% | chr10 | 75555297 | 75555421 | + | ENST00000604729; ENST00000603114; ENST00000604524; ENST00000398706; ENST00000605216; ENST00000433366; ENST00000492395; ENST00000603187; ENST00000412198; ENST00000604754 | chr10 | 75556079 | 75556138 | + | TSF |
| 4% | chr10 | 75555297 | 75555421 | + | ENST00000604729; ENST00000603114; ENST00000604524; ENST00000398706; ENST00000605216; ENST00000433366; ENST00000492395; ENST00000603187; ENST00000412198; ENST00000604754 | chr10 | 75556079 | 75556138 | + | TSF |
| 4% | chr10 | 75555297 | 75555421 | + | ENST00000604729; ENST00000603114; ENST00000604524; ENST00000398706; ENST00000605216; ENST00000433366; ENST00000492395; ENST00000603187; ENST00000412198; ENST00000604754 | chr10 | 75556079 | 56175538 | + | TSF |
| 4% | chr10 | 75555297 | 75555421 | + | ENST00000604729; ENST00000603114; ENST00000604524; ENST00000398706; ENST00000605216; ENST00000433366; ENST00000492395; ENST00000603187; ENST00000412198; ENST00000604754 | chr10 | 75556079 | 75556138 | + | TSF |
| 4% | chr10 | 75555297 | 75555421 | + | ENST00000604729; ENST00000603114; ENST00000604524; ENST00000398706; ENST00000605216; ENST00000433366; ENST00000492395; ENST00000603187; ENST00000412198; ENST00000604754 | chr10 | 75556079 | 75556138 | + | TSF |
| 4% | chr10 | 75555297 | 75555421 | + | ENST00000604729; ENST00000603114; ENST00000604524; ENST00000398706; ENST00000605216; ENST00000433366; ENST00000492395; ENST00000603187; ENST00000412198; ENST00000604754 | chr10 | 75556079 | 75556138 | + | TSF |
| 4% | chr10 | 75555297 | 75555421 | + | ENST00000604729; ENST00000603114; ENST00000604524; ENST00000398706; ENST00000605216; ENST00000433366; ENST00000492395; ENST00000603187; ENST00000412198; ENST00000604754 | chr10 | 75556079 | 75556138 | + | TSF |
| 4% | chr10 | 75555297 | 75555421 | + | ENST00000604729; ENST00000603114; ENST00000604524; ENST00000398706; ENST00000605216; ENST00000433366; ENST00000492395; ENST00000603187; ENST00000412198; ENST00000604754 | chr10 | 175556079 | 75556138 | + | TSF |
| 4% | chr10 | 23399171 | 23399247 | + | ENST00000376510; ENST00000472663 | chr10 | 23428951 | 23429096 | + | TSF |
| 4% | chr10 | 23399171 | 23399247 | + | ENST00000376510; ENST00000472663 | chr10 | 23428951 | 23429096 | + | TSF |
| 4% | chr7 | 81964567 | 81964451 | − | ENST00000356860; ENST00000356253; ENST00000423588 | chr7 | 81929467 | 29181990 | − | TSF |
| 4% | chr19 | 19371984 | 19371622 | − | ENST00000291481 | chr19 | 19371465 | 19371326 | − | TSF |
| 3% | chr10 | 84718705 | 84718831 | + | ENST00000372141; ENST00000404547; ENST00000372142; ENST00000404576; ENST00000556918; ENST00000537893; ENST00000545131 | chr10 | 84720295 | 84720298 | + | TSF |
| 3% | chr10 | 84718705 | 84718831 | + | ENST00000372141; ENST00000404547; ENST00000372142; ENST00000404576; ENST00000556918; ENST00000537893; ENST00000545131 | chr10 | 84720295 | 84720298 | + | TSF |
| 3% | chr10 | 84718705 | 84718831 | + | ENST00000372141; ENST00000404547; ENST00000372142; ENST00000404576; ENST00000556918; ENST00000537893; ENST00000545131 | chr10 | 84720295 | 84720298 | + | TSF |
| 3% | chr10 | 84718705 | 84718831 | + | ENST00000372141; ENST00000404547; ENST00000372142; ENST00000404576; ENST00000556918; ENST00000537893; ENST00000545131 | chr10 | 84720295 | 84720298 | + | TSF |
| 3% | chr10 | 84718705 | 84718831 | + | ENST00000372141; ENST00000404547; ENST00000372142; ENST00000404576; ENST00000556918; ENST00000537893; | chr10 | 84720295 | 84720298 | + | TSF |

TABLE 47-continued

Transcript fusion for Pheochromocytoma and Paraganglioma (PCPG) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 3% | chr9 | 136518062 | 136518121 | + | ENST00000545131; ENST00000393056 | chr9 | 136521502 | 136521506 | + | TSF |
| 3% | chr14 | 24845500; 24845580 | 24846084 | + | ENST00000413692; ENST00000555590; ENST00000424781; ENST00000539237; ENST00000556279; ENST00000250373; ENST00000553708; ENST00000553879; ENST00000554344; ENST00000422617; ENST00000557451; ENST00000555453; ENST00000556759; ENST00000555167; ENST00000555393; ENST00000555802 | chr14 | 24854777 | 24855120 | + | TSF |
| 3% | chr14 | 24845500; 24845580 | 24846084 | + | ENST00000413692; ENST00000555590; ENST00000424781; ENST00000539237; ENST00000556279; ENST00000250373; ENST00000553708; ENST00000553879; ENST00000554344; ENST00000422617; ENST00000557451; ENST00000555453; ENST00000556759; ENST00000555167; ENST00000555393; ENST00000555802 | chr14 | 24854777 | 24855120 | + | TSF |
| 3% | chr14 | 24845500; 24845580 | 24846084 | + | ENST00000413692; ENST00000555590; ENST00000424781; ENST00000539237; ENST00000556279; ENST00000250373; ENST00000553708; ENST00000553879; ENST00000554344; ENST00000422617; ENST00000557451; ENST00000555453; ENST00000556759; ENST00000555167; ENST00000555393; ENST00000555802 | chr14 | 24854777 | 24855120 | + | TSF |
| 3% | chr14 | 24845500; 24845580 | 24846084 | + | ENST00000413692; ENST00000555590; ENST00000424781; ENST00000539237; ENST00000556279; ENST00000250373; ENST00000553708; ENST00000553879; ENST00000554344; ENST00000422617; ENST00000557451; ENST00000555453; ENST00000556759; ENST00000555167; ENST00000555393; ENST00000555802 | chr14 | 24854777 | 24855120 | + | TSF |
| 3% | chr14 | 24845500; 24845580 | 24846084 | + | ENST00000413692; ENST00000555590; ENST00000424781; ENST00000539237; ENST00000556279; ENST00000250373; ENST00000553708; ENST00000553879; ENST00000554344; ENST00000422617; ENST00000557451; ENST00000555453; ENST00000556759; ENST00000555167; ENST00000555393; ENST00000555802 | chr14 | 24854777 | 24855120 | + | TSF |
| 3% | chr14 | 24845500; 24845580 | 24846084 | + | ENST00000413692; ENST00000555590; ENST00000424781; ENST00000539237; ENST00000556279; ENST00000250373; ENST00000553708; ENST00000553879; ENST00000554344; ENST00000422617; ENST00000557451; ENST00000555453; ENST00000556759; ENST00000555167; ENST00000555393; ENST00000555802 | chr14 | 24854777 | 24855120 | + | TSF |
| 3% | chr14 | 24845500; 24845580 | 24846084 | + | ENST00000413692; ENST00000555590; ENST00000424781; ENST00000539237; ENST00000556279; ENST00000250373; ENST00000553708; ENST00000553879; ENST00000554344; ENST00000422617; ENST00000557451; ENST00000555453; ENST00000556759; ENST00000555167; ENST00000555393; ENST00000555802 | chr14 | 24854777 | 24855120 | + | TSF |
| 3% | chr14 | 24845500; 24845580 | 24846084 | + | ENST00000413692; ENST00000555590; ENST00000424781; ENST00000539237; ENST00000556279; ENST00000250373; ENST00000553708; ENST00000553879; ENST00000554344; ENST00000422617; ENST00000557451; ENST00000555453; ENST00000556759; ENST00000555167; ENST00000555393; ENST00000555802 | chr14 | 24854777 | 24855120 | + | TSF |
| 3% | chr17 | 26940164 | 26940096 | − | ENST00000481916; ENST00000531839; ENST00000584196; ENST00000534850; ENST00000301037; ENST00000525510 | chr17 | 26932233 | 26930495 | − | TSF |
| 3% | chr17 | 26940164 | 26940096 | − | ENST00000481916; ENST00000531839; ENST00000584196; ENST00000534850; ENST00000301037; ENST00000525510 | chr17 | 26932233 | 26930495 | − | TSF |
| 3% | chr15 | 43705532; 43705526; 43705484 | 43705317 | − | ENST00000263801; ENST00000382039; ENST00000382044; ENST00000450115; ENST00000434595 | chr15 | 43702724 | 43702621 | − | TSF |
| 3% | chr15 | 43705532; 43705526; 43705484 | 43705317 | − | ENST00000263801; ENST00000382039; ENST00000382044; ENST00000450115; ENST00000434595 | chr15 | 43702724 | 43702621 | − | TSF |
| 3% | chr15 | 43705532; 43705526; 43705484 | 43705317 | − | ENST00000263801; ENST00000382039; ENST00000382044; ENST00000450115; ENST00000434595 | chr15 | 43702724 | 43702621 | − | TSF |
| 3% | chr15 | 43705532; 43705526; 43705484 | 43705317 | − | ENST00000263801; ENST00000382039; ENST00000382044; ENST00000450115; ENST00000434595 | chr15 | 43702724 | 43702621 | − | TSF |
| 3% | chr15 | 43705532; 43705526; 43705484 | 43705317 | − | ENST00000263801; ENST00000382039; ENST00000382044; ENST00000450115; ENST00000434595 | chr15 | 43702724 | 43702621 | − | TSF |
| 3% | chr19 | 11567963 | 11567925 | − | ENST00000359227; ENST00000438662 | chr19 | 11567647 | 11567483 | − | TSF |
| 3% | chr19 | 45991775 | 45991729 | − | ENST00000245923; ENST00000430715; ENST00000344680; ENST00000590526 | chr19 | 45990601 | 45990291 | − | TSF |
| 3% | chr19 | 45991775 | 45991729 | − | ENST00000245923; ENST00000430715; ENST00000344680; ENST00000590526 | chr19 | 45990601 | 45990291 | − | TSF |
| 3% | chr19 | 45991775 | 45991729 | − | ENST00000245923; ENST00000430715; ENST00000344680; ENST00000590526 | chr19 | 45990601 | 45990291 | − | TSF |

TABLE 47-continued

Transcript fusion for Pheochromocytoma and Paraganglioma (PCPG) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 3% | chr19 | 45991775 | 45991729 | − | ENST00000245923; ENST00000430715; ENST00000344680; ENST00000590526 | chr19 | 45990601 | 45990291 | − | TSF |
| 3% | chr1 | 163122506; 163122399 | 163122340 | − | ENST00000313961; ENST00000367903; ENST00000530507; ENST00000527988 | chr1 | 163022553 | 163022549 | − | TSF |
| 3% | chr1 | 163122506; 163122399 | 163122340 | − | ENST00000313961; ENST00000367903; ENST00000530507; ENST00000527988 | chr1 | 163022553 | 163022549 | − | TSF |
| 3% | chr1 | 163122506; 163122399 | 163122340 | − | ENST00000313961; ENST00000367903; ENST00000530507; ENST00000527988 | chr1 | 163022553 | 163022549 | − | TSF |

TABLE 48

Transcript fusion for Pheochromocytoma and Paraganglioma (PCPG) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 88% | chr1 | 151683281 | 151683172 | − | chr1 | 151682267 | 151682219 | − | ENST00000290585; ENST00000290583; ENST00000420342 | TAF |
| 88% | chr1 | 151683281 | 151683172 | − | chr1 | 151682267 | 151682219 | − | ENST00000290585; ENST00000290583; ENST00000420342 | TAF |
| 88% | chr1 | 151683281 | 151683172 | − | chr1 | 151682267 | 151682219 | − | ENST00000290585; ENST00000290583; ENST00000420342 | TAF |
| 76% | chr14 | 93399634 | 93399750 | + | chr14 | 93401146 | 93401229 | + | ENST00000216492; ENST00000334654 | TSF |
| 64% | chr17 | 42395269 | 42395306 | + | chr17 | 42395464 | 42395606 | + | ENST00000426726 | TAF |
| 54% | chr11 | 66048968 | 66049045 | + | chr11 | 66049730 | 66049798; 66049824 | + | ENST00000528852; ENST00000311445; ENST00000528063 | TSF |
| 54% | chr11 | 66048968 | 66049045 | + | chr11 | 66049730 | 66049798; 66049824 | + | ENST00000528852; ENST00000311445; ENST00000528063 | TSF |
| 54% | chr11 | 66048968 | 66049045 | + | chr11 | 66049730 | 66049798; 66049824 | + | ENST00000528852; ENST00000311445; ENST00000528063 | TSF |
| 52% | chr15 | 93221696 | 93221360 | − | chr15 | 93173575 | 93173444 | − | ENST00000327355 | TAF |
| 51% | chr16 | 29915789 | 29915910 | + | chr16 | 29916173 | 29916286 | + | ENST00000563177; ENST00000483405; ENST00000308748; ENST00000414952; ENST00000566693 | TAF |
| 51% | chr16 | 29915789 | 29915910 | − | chr16 | 29916173 | 29916286 | + | ENST00000563177; ENST00000483405; 5ENST00000308748; ENST0000041492; ENST00000566693 | TAF |
| 44% | chr20 | 62066436 | 62065933 | − | chr20 | 62065256 | 62065162; 62065098 | − | ENST00000357249; ENST00000359125; ENST00000354587; ENST00000359689; ENST00000360480; ENST00000370224; ENST00000344462; ENST00000344425 | TSF |
| 44% | chr20 | 62066436 | 62065933 | − | chr20 | 62065256 | 62065162; 62065098 | − | ENST00000357249; ENST00000359125; ENST00000354587; ENST00000359689; ENST00000360480; ENST00000370224; ENST00000344462; ENST00000344425 | TSF |
| 44% | chr20 | 62066436 | 62065933 | − | chr20 | 62065256 | 62065162; 62065098 | − | ENST00000357249; ENST00000359125; ENST00000354587; ENST00000359689; ENST00000360480; ENST00000370224; ENST00000344462; ENST00000344425 | TSF |
| 44% | chr20 | 62066436 | 62065933 | − | chr20 | 62065256 | 62065162; 62065098 | − | ENST00000357249; ENST00000359125; ENST00000354587; ENST00000359689; ENST00000360480; ENST00000370224; ENST00000344462; ENST00000344425 | TSF |
| 44% | chr20 | 62066436 | 62065933 | − | chr20 | 62065256 | 62065162; 62065098 | − | ENST00000357249; ENST00000359125; ENST00000354587; ENST00000359689; ENST00000360480; ENST00000370224; ENST00000344462; ENST00000344425 | TSF |
| 44% | chr20 | 62066436 | 62065933 | − | chr20 | 62065256 | 62065162; 62065098 | − | ENST00000357249; ENST00000359125; ENST00000354587; ENST00000359689; ENST00000360480; ENST00000370224; ENST00000344462; ENST00000344425 | TSF |
| 44% | chr20 | 62066436 | 62065933 | − | chr20 | 62065256 | 62065162; 62065098 | − | ENST00000357249; ENST00000359125; ENST00000354587; ENST00000359689; ENST00000360480; ENST00000370224; ENST00000344462; ENST00000344425 | TSF |
| 44% | chr20 | 62066436 | 62065933 | − | chr20 | 62065256 | 62065162; 62065098 | − | ENST00000357249; ENST00000359125; ENST00000354587; ENST00000359689; ENST00000360480; ENST00000370224; ENST00000344462; ENST00000344425 | TSF |
| 39% | chr15 | 74475607 | 74475594 | − | chr15 | 74474801 | 74474684 | − | ENST00000395105; ENST00000423167; ENST00000323940; ENST00000449139; ENST00000416286; ENST00000535552; ENST00000563965; ENST00000574278; ENST00000572785 | TSF |

TABLE 48-continued

Transcript fusion for Pheochromocytoma and Paraganglioma (PCPG) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 39% | chr15 | 74475607 | 744175594 | − | chr15 | 74474801 | 74474684 | − | ENST00000395105; ENST00000423167; ENST00000323940; ENST00000449139; ENST00000416286; ENST00000535552; ENST00000563965; ENST00000574278; ENST00000572785 | TSF |
| 36% | chr2 | 230409549 | 230409481 | − | chr2 | 230377652 | 230377499 | − | ENST00000341772 | TAF |
| 35% | chr12 | 50264840 | 50264776 | − | chr12 | 50264436 | 50264287; 50264314; 50264356 | − | ENST00000320634; ENST00000550890; ENST00000552669; ENST00000552863 | TAF |
| 35% | chr12 | 50264840 | 50264776 | − | chr12 | 50264436 | 50264287; 50264314; 50264356 | − | ENST00000320634; ENST00000550890; ENST00000552669; ENST00000552863 | TAF |
| 35% | chr12 | 50264840 | 50264776 | − | chr12 | 50264436 | 50264287; 50264314; 50264356 | − | ENST00000320634; ENST00000550890; ENST00000552669; ENST00000552863 | TAF |
| 30% | chr17 | 80440912 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |
| 30% | chr17 | 80440912 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |
| 30% | chr17 | 80440912 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |
| 30% | chr17 | 80440912 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |
| 28% | chr9 | 100309652 | 100309653 | + | chr9 | 100315563 | 100315682 | + | ENST00000395211; ENST00000259365 | TAF |
| 26% | chr10 | 72618870 | 72618877 | + | chr10 | 72619128 | 72619256; 72619307 | + | ENST00000373202; ENST00000299297; ENST00000409118 | TSF |
| 26% | chr10 | 72618870 | 72618877 | + | chr10 | 72619128 | 72619256; 72619307 | + | ENST00000373202; ENST00000299297; ENST00000409118 | TSF |
| 26% | chr10 | 72618870 | 72618877 | + | chr10 | 72619128 | 72619256; 72619307 | + | ENST00000373202; ENST00000299297; ENST00000409118 | TSF |
| 25% | chr14 | 94518197 | 94518094 | − | chr14 | 94517808 | 94517537 | − | ENST00000330836; ENST00000544005; ENST00000555054 | TAF |
| 25% | chr21 | 47278635 | 47278724 | + | chr21 | 47316122 | 47316276 | + | ENST00000400314; ENST00000400310; ENST00000449640; ENST00000400308; ENST00000400309 | TSF |
| 25% | chr21 | 47278635 | 472178724 | + | chr21 | 47316122 | 47316276 | + | ENST00000400314; ENST00000400310; ENST00000449640; ENST00000400308; ENST00000400309 | TSF |
| 25% | chr21 | 47278635 | 47278724 | + | chr21 | 47316122 | 47316276 | + | ENST00000400314; ENST00000400310; ENST00000449640; ENST00000400308; ENST00000400309 | TSF |
| 25% | chr21 | 47278635 | 47278724 | + | chr21 | 47316122 | 47316276 | + | ENST00000400314; ENST00000400310; ENST00000449640; ENST00000400308; ENST00000400309 | TSF |
| 24% | chr12 | 102411559 | 102411498 | − | chr12 | 102406970 | 102406886 | − | ENST00000240079; ENST00000545679; ENST00000542923 | TAF |
| 23% | chr16 | 75685621 | 75685636 | + | chr16 | 75688171 | 75688295; 75688183 | + | ENST00000300086; ENST00000569234 | TAF |
| 23% | chr16 | 75685621 | 75685636 | + | chr16 | 75688171 | 75688295; 75688183 | + | ENST00000300086; ENST00000569234 | TAF |
| 21% | chr17 | 41171108 | 41170991 | − | chr17 | 41170816 | 41170609; 41170766 | − | ENST00000355653; ENST00000587173; ENST00000587062 | TAF |
| 21% | chr17 | 41171108 | 41170991 | − | chr17 | 41170816 | 41170609; 41170766 | − | ENST00000355653; ENST00000587173; ENST00000587062 | TAF |
| 20% | chr10 | 104164273 | 104164216 | − | chr10 | 104163742 | 104163599 | − | ENST00000000673; ENST00000406432 | TAF |
| 20% | chr12 | 7284013 | 7284070 | + | chr12 | 7285620 | 7285742 | + | ENST00000541953; ENST00000266546; ENST00000539982; ENST00000537408 | TAF |
| 20% | chr12 | 7284013 | 7284070 | + | chr12 | 7285620 | 7285742 | + | ENST00000541953; ENST00000266546; ENST00000539982; ENST00000537408 | TAF |
| 20% | chr12 | 7284013 | 7284070 | + | chr12 | 7285620 | 7285742 | + | ENST00000541953; ENST00000266546; ENST00000539982; ENST00000537408 | TAF |
| 17% | chr17 | 42388704 | 42388881 | + | chr17 | 42389948 | 42390063 | + | ENST00000426726; ENST00000590941; ENST00000225441 | TAF |
| 17% | chr17 | 42388704 | 42388881 | + | chr17 | 42389948 | 42390063 | + | ENST00000426726; ENST00000590941; ENST00000225441 | TAF |
| 17% | chr17 | 42388704 | 42388881 | + | chr17 | 42389948 | 42390063 | + | ENST00000426726; ENST00000590941; ENST00000225441 | TAF |
| 17% | chr7 | 54611995 | 54612029 | + | chr7 | 54612315 | 54612481 | + | ENST00000302287; ENST00000407838; | TAF |

TABLE 48-continued

Transcript fusion for Pheochromocytoma and Paraganglioma (PCPG) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 17% | chr7 | 54611995 | 54612029 | + | chr7 | 54612315 | 54612481 | + | ENST00000404951; ENST00000402026; ENST00000402613 ENST00000302287; ENST00000407838; ENST00000404951; ENST00000402026; ENST00000402613 | TAF |
| 17% | chr7 | 54611995 | 54612029 | + | chr7 | 54612315 | 54612481 | + | ENST00000302287; ENST00000407838; ENST00000404951; ENST00000402026; ENST00000402613 | TAF |
| 17% | chr7 | 54611995 | 54612029 | + | chr7 | 54612315 | 54612481 | + | ENST00000302287; ENST00000407838; ENST00000404951; ENST00000402026; ENST00000402613 | TAF |
| 16% | chr2 | 238626962 | 238627008 | + | chr2 | 238628166 | 238628210 | + | ENST00000308482; ENST00000244815; ENST00000420665; ENST00000392000 | TAF |
| 16% | chr2 | 238626962 | 238627008 | + | chr2 | 238628166 | 238628210 | + | ENST00000308482; ENST00000244815; ENST00000420665; ENST00000392000 | TAF |
| 16% | chr2 | 238626962 | 238627008 | + | chr2 | 238628166 | 238628210 | + | ENST00000308482; ENST00000244815; ENST00000420665; ENST00000392000 | TAF |
| 16% | chr2 | 238626962 | 238627008 | + | chr2 | 238628166 | 238628210 | + | ENST00000308482; ENST00000244815; ENST00000420665; ENST00000392000 | TAF |
| 15% | chr16 | 2564319 | 2564396 | + | chr16 | 2569219 | 2569384; 2569402 | + | ENST00000564543; ENST00000330398; ENST00000568562 | TAF |
| 15% | chr16 | 2564319 | 2564396 | + | chr16 | 2569219 | 2569384; 2569402 | + | ENST00000564543; ENST00000330398; ENST00000568562 | TAF |
| 15% | chr12 | 63962410 | 63961380 | − | chr12 | 63954442 | 63954292 | − | ENST00000324472; ENST00000413230 | TAF |
| 15% | chr5 | 54528691 | 54528595 | − | chr5 | 54528374 | 54528189 | − | ENST00000282572 | TAF |
| 14% | chrX | 148577156 | 148576990 | − | chrX | 148571971 | 148571845 | − | ENST00000340855; ENST00000422081; ENST00000541269; ENST00000370441 | TAF |
| 14% | chrX | 148577156 | 148576990 | − | chrX | 148571971 | 148571845 | − | ENST00000340855; ENST00000422081; ENST00000541269; ENST00000370441 | TAF |
| 14% | chr20 | 25053246 | 25053172 | − | chr20 | 25052654 | 25052557; 25052571 | − | ENST00000429762; ENST00000444511 | TSF |
| 14% | chr20 | 25053246 | 25053172 | − | chr20 | 25052654 | 25052557; 25052571 | − | ENST00000429762; ENST00000444511 | TSF |
| 13% | chr12 | 4948345 | 4948527 | + | chr12 | 4959904 | 4960077 | + | ENST00000542998 | TSF |
| 12% | chr11 | 17895953 | 17895767 | − | chr11 | 17809960 | 17809632; 17809702 | − | ENST00000265965; ENST00000529151 | TAF |
| 12% | chr11 | 17895953 | 17895767 | − | chr11 | 17809960 | 17809632; 17809702 | − | ENST00000265965; ENST00000529151 | TAF |
| 12% | chr12 | 94167005 | 94167262 | + | chr12 | 94243746 | 94244047 | + | ENST00000332896; ENST00000542893 | TAF |
| 12% | chr17 | 21476521 | 21476490 | − | chr17 | 21438799 | 21438561; 21438772 | − | ENST00000391411; ENST00000412778 | TAF |
| 12% | chr17 | 21476521 | 21476490 | − | chr17 | 21438799 | 21438561; 21438772 | − | ENST00000391411; ENST00000412778 | TAF |
| 12% | chr7 | 95670520 | 95670949 | + | chr7 | 95705369 | 95705509 | + | ENST00000447467; ENST00000324972; ENST00000537881; ENST00000437599; ENST00000359388; ENST00000457059 | TSF |
| 12% | chr7 | 95670520 | 95670949 | + | chr7 | 95705369 | 95705509 | + | ENST00000447467; ENST00000324972; ENST00000537881; ENST00000437599; ENST00000359388; ENST00000457059 | TSF |
| 12% | chr2 | 74762302 | 74762039 | − | chr2 | 74761901 | 74761658 | − | ENST00000264094; ENST00000393937; ENST00000409549; ENST00000409986 | TSF |
| 12% | chr2 | 74762302 | 74762039 | − | chr2 | 74761901 | 74761658 | − | ENST00000264094; ENST00000393937; ENST00000409549; ENST00000409986 | TSF |
| 11% | chr2 | 207156598 | 207156840 | + | chr2 | 207161970 | 207162097 | + | ENST00000374423 | TAF |
| 11% | chr5 | 38458801 | 38458851 | + | chr5 | 38463010 | 38463113 | + | ENST00000354891; ENST00000322350; ENST00000336740; ENST00000397202; ENST00000397210; ENST00000506135; ENST00000508131; ENST00000514476 | TAF |
| 11% | chr5 | 38458801 | 38458851 | + | chr5 | 38463010 | 38463113 | + | ENST00000354891; ENST00000322350; ENST00000336740; ENST00000397202; ENST00000397210; ENST00000506135; ENST00000508131; ENST00000514476 | TAF |
| 11% | chr5 | 176950016 | 176949956 | − | chr5 | 176949072 | 176948976 | − | ENST00000514747; ENST00000329540; ENST00000443375; ENST00000524677 | TAF |
| 11% | chr8 | 20011376 | 20011370 | − | chr8 | 20008255 | 20008177 | − | ENST00000265808; ENST00000276373; ENST00000437980; ENST00000440926; ENST00000517776; ENST00000519026; ENST00000381608 | TSF |
| 11% | chr8 | 20011376 | 20011370 | − | chr8 | 20008255 | 20008177 | − | ENST00000265808; ENST00000276373; ENST00000437980; ENST00000440926; ENST00000517776; ENST00000519026; ENST00000381608 | TSF |
| 11% | chr8 | 20011376 | 20011370 | − | chr8 | 20008255 | 20008177 | − | ENST00000265808; ENST00000276373; ENST00000437980; ENST00000440926; ENST00000517776; ENST00000519026; ENST00000381608 | TSF |

TABLE 48-continued

Transcript fusion for Pheochromocytoma and Paraganglioma (PCPG) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 11% | chr15 | 74475607 | 74475594 | − | chr15 | 74474784 | 74474684 | − | ENST00000395105; ENST00000423167; ENST00000323940; ENST00000449139; ENST00000416286; ENST00000535552; ENST00000563965; ENST00000574278; ENST00000572785 | TSF |
| 11% | chr15 | 74475607 | 74475594 | − | chr15 | 74474784 | 74474684 | − | ENST00000395105; ENST00000423167; ENST00000323940; ENST00000449139; ENST00000416286; ENST00000535552; ENST00000563965; ENST00000574278; ENST00000572785 | TSF |
| 11% | chr5 | 38304257 | 38305719 | + | chr5 | 38337622 | 38337731 | + | ENST00000354891; ENST00000322350 | TSF |
| 11% | chr5 | 38304257 | 38305719 | + | chr5 | 38337622 | 38337731 | + | ENST00000354891; ENST00000322350 | TSF |
| 11% | chr15 | 72540647 | 72540602 | − | chr15 | 72535040 | 72534961; 72534975; 72535001 | − | ENST00000569795; ENST00000260376; ENST00000287196; ENST00000564610; ENST00000567974; ENST00000565443; ENST00000567263; ENST00000419739 | TSF |
| 11% | chr15 | 72540647 | 72540602 | − | chr15 | 72535040 | 72534961; 72534975; 72535001 | − | ENST00000569795; ENST00000260376; ENST00000287196; ENST00000564610; ENST00000567974; ENST00000565443; ENST00000567263; ENST00000419739 | TSF |
| 11% | chr15 | 72540647 | 72540602 | − | chr15 | 72535040 | 72534961; 72534975; 72535001 | − | ENST00000569795; ENST00000260376; ENST00000287196; ENST00000564610; ENST00000567974; ENST00000565443; ENST00000567263; ENST00000419739 | TSF |
| 11% | chr15 | 72540647 | 72540602 | − | chr15 | 72535040 | 72534961; 72534975; 72535001 | − | ENST00000569795; ENST00000260376; ENST00000287196; ENST00000564610; ENST00000567974; ENST00000565443; ENST00000567263; ENST00000419739 | TSF |
| 11% | chr14 | 91013189 | 91013107 | − | chr14 | 91007933 | 91007712; 91007626 | − | ENST00000328459; ENST00000357056; ENST00000553972; ENST00000555894; ENST00000557292 | TSF |
| 11% | chr14 | 91013189 | 91013107 | − | chr14 | 91007933 | 91007712; 91007626 | − | ENST00000328459; ENST00000357056; ENST00000553972; ENST00000555894; ENST00000557292 | TSF |
| 10% | chr3 | 98482258 | 98482283 | + | chr3 | 98487274 | 98487373 | + | ENST00000492254 | TAF |
| 10% | chr1 | 40041312 | 40041229 | − | chr1 | 40038258 | 40038065 | − | ENST00000372862; ENST00000372858; ENST00000372857; ENST00000372856; ENST00000470443; ENST00000451091 | TAF |
| 10% | chr1 | 40041312 | 40041229 | − | chr1 | 40038258 | 40038065 | − | ENST00000372862; ENST00000372858; ENST00000372857; ENST00000372856; ENST00000470443; ENST00000451091 | TAF |
| 10% | chr1 | 40041312 | 40041229 | − | chr1 | 40038258 | 40038065 | − | ENST00000372862; ENST00000372858; ENST00000372857; ENST00000372856; ENST00000470443; ENST00000451091 | TAF |
| 10% | chr1 | 40041312 | 40041229 | − | chr1 | 40038258 | 40038065 | − | ENST00000372862; ENST00000372858; ENST00000372857; ENST00000372856; ENST00000470443; ENST00000451091 | TAF |
| 10% | chr1 | 40041312 | 40041229 | − | chr1 | 40038258 | 40038065 | − | ENST00000372862; ENST00000372858; ENST00000372857; ENST00000372856; ENST00000470443; ENST00000451091 | TAF |
| 10% | chr1 | 40041312 | 40041229 | − | chr1 | 40038258 | 40038065 | − | ENST00000372862; ENST00000372858; ENST00000372857; ENST00000372856; ENST00000470443; ENST00000451091 | TAF |
| 10% | chr19 | 18653186 | 18653179 | − | chr19 | 18652805 | 18652489 | − | ENST00000453489 | TAF |
| 9% | chrX | 63029112 | 63029083 | − | chrX | 62944591 | 62944412 | − | ENST00000253401; ENST00000374878 | TSF |
| 9% | chrX | 63029112 | 63029083 | − | chrX | 62944591 | 62944412 | − | ENST00000253401; ENST00000374878 | TSF |
| 9% | chr7 | 50595425 | 50595367 | − | chr7 | 50571757 | 50571691 | − | ENST00000357936; ENST00000431062; ENST00000426377; ENST00000444733; ENST00000444124; ENST00000430300; ENST00000380984 | TSF |
| 9% | chr7 | 50595425 | 50595367 | − | chr7 | 50571757 | 50571691 | − | ENST00000357936; ENST00000431062; ENST00000426377; ENST00000444733; ENST00000444124; ENST00000430300; ENST00000380984 | TSF |
| 9% | chr7 | 50595425 | 50595367 | − | chr7 | 50571757 | 50571691 | − | ENST00000357936; ENST00000431062; ENST00000426377; ENST00000444733; ENST00000444124; ENST00000430300; ENST00000380984 | TSF |
| 9% | chr14 | 93396861 | 93396958 | + | chr14 | 93397595 | 93398047 | + | ENST00000216492 | TSF |
| 8% | chr3 | 99883880 | 99884005 | + | chr3 | 99885179 | 99885238 | + | ENST00000421999; ENST00000489081; ENST00000478909; ENST00000497345 | TSF |
| 8% | chr3 | 99883880 | 99884005 | + | chr3 | 99885179 | 99885238 | + | ENST00000421999; ENST00000489081; ENST00000478909; ENST00000497345 | TSF |
| 8% | chr3 | 99883880 | 99884005 | + | chr3 | 99885179 | 99885238 | + | ENST00000421999; ENST00000489081; ENST00000478909; ENST00000497345 | TSF |
| 8% | chr3 | 54853592 | 54853855 | + | chr3 | 54871186 | 54871257 | + | ENST00000415676; ENST00000288197; | TSF |

TABLE 48-continued

Transcript fusion for Pheochromocytoma and Paraganglioma (PCPG) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 8% | chr3 | 54853592 | 54853855 | + | chr3 | 54871186 | 54871257 | + | ENST00000474759; ENST00000471363; ENST00000490478; ENST00000477024 ENST00000415676; ENST00000288197; | TSF |
| 8% | chr4 | 48897704 | 48897441 | – | chr4 | 48896070 | 48896023 | – | ENST00000474759; ENST00000471363; ENST00000490478; ENST00000477024 ENST00000508632; ENST00000273860; ENST00000381464 | TSF |
| 8% | chr4 | 48897704 | 48897441 | – | chr4 | 48896070 | 48896023 | – | ENST00000508632; ENST00000273860; ENST00000381464 | TSF |
| 8% | chr4 | 48897704 | 48897441 | | chr4 | 48896070 | 48896023 | – | ENST00000508632; ENST00000273860; ENST00000381464 | TSF |
| 8% | chr17 | 61518950 | 61518901 | – | chr17 | 61514921 | 61514707; 61514733 | – | ENST00000542042; ENST00000580691; ENST00000582997; ENST00000580592 | TSF |
| 8% | chr17 | 61518950 | 61518901 | – | chr17 | 61514921 | 61514707; 61514733 | – | ENST00000542042; ENST00000580691; ENST00000582997; ENST00000580592 | TSF |
| 8% | chr11 | 71954010 | 71953910 | – | chr11 | 71952333 | 71952146 | – | ENST00000298231 | TSF |
| 7% | chr20 | 9289042 | 9289105 | + | chr20 | 9317773 | 9317853 | + | ENST00000407043; ENST00000441846; ENST00000334005; ENST00000378473; ENST00000437503; ENST00000416836; ENST00000278655; ENST00000414679; ENST00000378493; ENST00000378501 | TSF |
| 7% | chr20 | 9289042 | 9289105 | + | chr20 | 9317773 | 9317853 | + | ENST00000407043; ENST00000441846; ENST00000334005; ENST00000378473; ENST00000437503; ENST00000416836; ENST00000278655; ENST00000414679; ENST00000378493; ENST00000378501 | TSF |
| 7% | chr20 | 9289042 | 9289105 | + | chr20 | 9317773 | 9317853 | + | ENST00000407043; ENST00000441846; ENST00000334005; ENST00000378473; ENST00000437503; ENST00000416836; ENST00000278655; ENST00000414679; ENST00000378493; ENST00000378501 | TSF |
| 7% | chr20 | 9289042 | 9289105 | + | chr20 | 9317773 | 9317853 | + | ENST00000407043; ENST00000441846; ENST00000334005; ENST00000378473; ENST00000437503; ENST00000416836; ENST00000278655; ENST00000414679; ENST00000378493; ENST00000378501 | TSF |
| 7% | chr20 | 9289042 | 9289105 | + | chr20 | 9317773 | 9317853 | + | ENST00000407043; ENST00000441846; ENST00000334005; ENST00000378473; ENST00000437503; ENST00000416836; ENST00000278655; ENST00000414679; ENST00000378493; ENST00000378501 | TSF |
| 7% | chr20 | 9289042 | 9289105 | + | chr20 | 9317773 | 9317853 | + | ENST00000407043; ENST00000441846; ENST00000334005; ENST00000378473; ENST00000437503; ENST00000416836; ENST00000278655; ENST00000414679; ENST00000378493; ENST00000378501 | TSF |
| 7% | chr20 | 9289042 | 9289105 | + | chr20 | 9317773 | 9317853 | + | ENST00000407043; ENST00000441846; ENST00000334005; ENST00000378473; ENST00000437503; ENST00000416836; ENST00000278655; ENST00000414679; ENST00000378493; ENST00000378501 | TSF |
| 7% | chr20 | 5874978 | 5874991 | + | chr20 | 5903286 | 5904746; 5903719 | + | ENST00000378961; ENST00000455042 | TSF |
| 7% | chr20 | 5874978 | 5874991 | + | chr20 | 5903286 | 5904746; 5903719 | + | ENST00000378961; ENST00000455042 | TSF |
| 7% | chr7 | 5340608 | 5340708 | + | chr7 | 5342428 | 5342570 | + | ENST00000396872; ENST00000297195; ENST00000406453 | TSF |
| 7% | chr20 | 57466178 | 57466186 | + | chr20 | 57485409 | 57485456 | + | ENST00000371100; ENST00000371102; ENST00000371095; ENST00000354359; ENST00000371085; ENST00000265620; ENST00000306090 | TSF |
| 7% | chr3 | 183904878 | 183904948 | + | chr3 | 183905185 | 183905231 | + | ENST00000429586; ENST00000292808 | TSF |
| 6% | chr1 | 110168535 | 110168634 | + | chr1 | 110168782 | 110168820; 110168850 | + | ENST00000531734; ENST00000342115; ENST00000528667; ENST00000531203; ENST00000256578; ENST00000358729; ENST00000369840; ENST00000527846; ENST00000528454; ENST00000393688 | TSF |
| 6% | chr1 | 110168535 | 110168634 | + | chr1 | 110168782 | 110168820; 110168850 | + | ENST00000531734; ENST00000342115; ENST00000528667; ENST00000531203; ENST00000256578; ENST00000358729; ENST00000369840; ENST00000527846; ENST00000528454; ENST00000393688 | TSF |
| 6% | chr1 | 110168535 | 110168634 | + | chr1 | 110168782 | 110168820; 110168850 | + | ENST00000531734; ENST00000342115; ENST00000528667; ENST00000531203; ENST00000256578; ENST00000358729; ENST00000369840; ENST00000527846; | TSF |

TABLE 48-continued

Transcript fusion for Pheochromocytoma and Paraganglioma (PCPG) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 6% | chr1 | 110168535 | 110168634 | + | chr1 | 110168782 | 110168820; 110168508 | + | ENST00000528454; ENST00000393688 ENST00000531734; ENST00000342115; ENST00000528667; ENST00000531203; ENST00000256578; ENST00000358729; ENST00000369840; ENST00000527846; ENST00000528454; ENST00000393688 | TSF |
| 6% | chr1 | 110168535 | 110168634 | + | chr1 | 110168782 | 110168820; 110168850 | + | ENST00000531734; ENST00000342115; ENST00000528667; ENST00000531203; ENST00000256578; ENST00000358729; ENST00000369840; ENST00000527846; ENST00000528454; ENST00000393688 | TSF |
| 6% | chr8 | 139623662 | 139623508 | − | chr8 | 139620232 | 139620179 | − | ENST00000303045; ENST00000435777 | TSF |
| 6% | chr4 | 5830600 | 5830583 | − | chr4 | 5830395 | 5830216 | − | ENST00000324989; ENST00000397890; ENST00000512574 | TSF |
| 6% | chr14 | 101195452 | 101195584 | + | chr14 | 101198379 | 101198407; 101198520 | + | ENST00000392848; ENST00000341267; ENST00000331224 | TSF |
| 6% | chr14 | 101195452 | 101195584 | + | chr14 | 101198379 | 101198407; 101198520 | + | ENST00000392848; ENST00000341267; ENST00000331224 | TSF |
| 6% | chr14 | 101195452 | 101195584 | + | chr14 | 101198379 | 101198407; 101198520 | + | ENST00000392848; ENST00000341267; ENST00000331224 | TSF |
| 6% | chr7 | 100818527 | 100818318 | − | chr7 | 100806798 | 100806277 | − | ENST00000249330; ENST00000445482 | TSF |
| 6% | chr7 | 50595425 | 50595367 | − | chr7 | 50563115 | 50563048; 50563093 | − | ENST00000357936; ENST00000431062; ENST00000426377; ENST00000444733; ENST00000444124; ENST00000430300; ENST00000380984 | TSF |
| 6% | chr7 | 50595425 | 50595367 | − | chr7 | 50563115 | 50563048; 50563093 | − | ENST00000357936; ENST00000431062; ENST00000426377; ENST00000444733; ENST00000444124; ENST00000430300; ENST00000380984 | TSF |
| 6% | chr7 | 50595425 | 50595367 | − | chr7 | 50563115 | 50563048; 50563093 | − | ENST00000357936; ENST00000431062; ENST00000426377; ENST00000444733; ENST00000444124; ENST00000430300; ENST00000380984 | TSF |
| 6% | chr2 | 165806067 | 165805999 | − | chr2 | 165802237 | 165802103 | − | ENST00000303735; ENST00000409149; ENST00000409058; ENST00000409662 | TSF |
| 6% | chr2 | 165806067 | 165805999 | − | chr2 | 165802237 | 165802103 | − | ENST00000303735; ENST00000409149; ENST00000409058; ENST00000409662 | TSF |
| 6% | chr17 | 61517244 | 61517092 | − | chr17 | 61514921 | 61514707; 61514733 | − | ENST00000542042; ENST00000580691; ENST00000582997; ENST00000580592 | TSF |
| 6% | chr17 | 61517244 | 61517092 | − | chr17 | 61514921 | 61514707; 61514733 | − | ENST00000542042; ENST00000580691; ENST00000582997; ENST00000580592 | TSF |
| 6% | chr12 | 50285408 | 50285280 | − | chr12 | 50284897 | 50284847; 50284860 | − | ENST00000320634; ENST00000550890; ENST00000550195; ENST00000552669; ENST00000552863; ENST00000550635; ENST00000547871 | TSF |
| 6% | chr12 | 50285408 | 50285280 | − | chr12 | 50284897 | 50284847; 50284860 | − | ENST00000320634; ENST00000550890; ENST00000550195; ENST00000552669; ENST00000552863; ENST00000550635; ENST00000547871 | TSF |
| 6% | chr12 | 50285408 | 50285280 | − | chr12 | 50284897 | 50284847; 50284860 | − | ENST00000320634; ENST00000550890; ENST00000550195; ENST00000552669; ENST00000552863; ENST00000550635; ENST00000547871 | TSF |
| 6% | chr12 | 50285408 | 50285280 | − | chr12 | 50284897 | 50284847; 50284860 | − | ENST00000320634; ENST00000550890; ENST00000550195; ENST00000552669; ENST00000552863; ENST00000550635; ENST00000547871 | TSF |
| 6% | chr12 | 50285408 | 50285280 | − | chr12 | 50284897 | 50284847; 50284860 | − | ENST00000320634; ENST00000550890; ENST00000550195; ENST00000552669; ENST00000552863; ENST00000550635; ENST00000547871 | TSF |
| 6% | chr12 | 50285408 | 50285280 | − | chr12 | 50284897 | 50284847; 50284860 | − | ENST00000320634; ENST00000550890; ENST00000550195; ENST00000552669; ENST00000552863; ENST00000550635; ENST00000547871 | TSF |
| 5% | chr17 | 61517244 | 61517029 | − | chr17 | 61514921 | 61514707; 61514733 | − | ENST00000542042; ENST00000580691; ENST00000582997; ENST00000580592 | TSF |
| 5% | chr17 | 61517244 | 61517029 | − | chr17 | 61514921 | 61514707; 61514733 | − | ENST00000542042; ENST00000580691; ENST00000582997; ENST00000580592 | TSF |
| 5% | chr6 | 32490932 | 32490383 | − | chr6 | 32489951 | 32489682 | − | ENST00000374975 | TSF |
| 4% | chr21 | 39513161 | 39513404 | + | chr21 | 39528398 | 39528496 | + | ENST00000357704; ENST00000400477 | TSF |
| 4% | chr16 | 75683160 | 75683228 | + | chr16 | 75688171 | 75688295; 75688183 | + | ENST00000300086; ENST00000569234 | TSF |
| 4% | chr16 | 75683160 | 75683228 | + | chr16 | 75688171 | 75688295; 75688183 | + | ENST00000300086; ENST00000569234 | TSF |
| 4% | chr3 | 31046348 | 31045927 | − | chr3 | 30903257 | 30903085 | − | ENST00000282538; ENST00000454381 | TSF |

TABLE 48-continued

Transcript fusion for Pheochromocytoma and Paraganglioma (PCPG) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 4% | chr3 | 31046348 | 31045927 | − | chr3 | 30903257 | 30903085 | − | ENST00000282538; ENST00000454381 | TSF |
| 4% | chr7 | 50595425 | 50595367 | − | chr7 | 50547561 | 50547485 | − | ENST00000357936; ENST00000431062; ENST00000426377; ENST00000444124; ENST00000430300 | TSF |
| 4% | chr7 | 102146992 | 102146893 | − | chr7 | 102143691 | 102143610 | − | ENST00000541662; ENST00000465829; ENST00000306682 | TSF |
| 4% | chr7 | 102146992 | 102146893 | − | chr7 | 102143691 | 102143610 | − | ENST00000541662; ENST00000465829; ENST00000306682 | TSF |
| 4% | chr15 | 74490750 | 74490651 | − | chr15 | 74490159 | 74490093; 74490009 | − | ENST00000395105; ENST00000423167; ENST00000323940; ENST00000449139; ENST00000416286; ENST00000535552; ENST00000563965; ENST00000574278; ENST00000569936; ENST00000432245; ENST00000571341; ENST00000573391 | TSF |
| 4% | chr15 | 74490750 | 74490651 | − | chr15 | 74490159 | 74490093; 74490009 | − | ENST00000395105; ENST00000423167; ENST00000323940; ENST00000449139; ENST00000416286; ENST00000535552; ENST00000563965; ENST00000574278; ENST00000569936; ENST00000432245; ENST00000571341; ENST00000573391 | TSF |
| 4% | chr15 | 74490750 | 74490651 | − | chr15 | 74490159 | 74490093; 74490009 | − | ENST00000395105; ENST00000423167; ENST00000323940; ENST00000449139; ENST00000416286; ENST00000535552; ENST00000563965; ENST00000574278; ENST00000569936; ENST00000432245; ENST00000571341; ENST00000573391 | TSF |
| 4% | chr15 | 74490750 | 74490651 | − | chr15 | 74490159 | 74490093; 74490009 | − | ENST00000395105; ENST00000423167; ENST00000323940; ENST00000449139; ENST00000416286; ENST00000535552; ENST00000563965; ENST00000574278; ENST00000569936; ENST00000432245; ENST00000571341; ENST00000573391 | TSF |
| 4% | chr15 | 74490750 | 74490651 | − | chr15 | 74490159 | 74490093; 74490009 | − | ENST00000395105; ENST00000423167; ENST00000323940; ENST00000449139; ENST00000416286; ENST00000535552; ENST00000563965; ENST00000574278; ENST00000569936; ENST00000432245; ENST00000571341; ENST00000573391 | TSF |
| 4% | chr15 | 74490750 | 74490651 | − | chr15 | 74490159 | 74490093; 74490009 | − | ENST00000395105; ENST00000423167; ENST00000323940; ENST00000449139; ENST00000416286; ENST00000535552; ENST00000563965; ENST00000574278; ENST00000569936; ENST00000432245; ENST00000571341; ENST00000573391 | TSF |
| 4% | chr15 | 74490750 | 74490651 | − | chr15 | 74490159 | 74490093; 74490009 | − | ENST00000395105; ENST00000423167; ENST00000323940; ENST00000449139; ENST00000416286; ENST00000535552; ENST00000563965; ENST00000574278; ENST00000569936; ENST00000432245; ENST00000571341; ENST00000573391 | TSF |
| 4% | chr20 | 5741057 | 5741274 | + | chr20 | 5903657 | 5904746; 5903719 | + | ENST00000378961; ENST00000455042 | TSF |
| 4% | chr20 | 5741057 | 5741274 | + | chr20 | 5903657 | 5904746; 5903719 | + | ENST00000378961; ENST00000455042 | TSF |
| 4% | chr10 | 119009835 | 119009901 | + | chr10 | 119012910 | 119012968 | + | ENST00000298472 | TSF |
| 4% | chr9 | 130424996 | 130425055 | + | chr9 | 130425484 | 130425632 | + | ENST00000373302; ENST00000373299 | TSF |
| 4% | chr9 | 130424996 | 130425055 | + | chr9 | 130425484 | 130425632 | + | ENST00000373302; ENST00000373299 | TSF |
| 4% | chr7 | 92778284 | 92778372 | + | chr7 | 92869179 | 92869247; 92869263 | + | ENST00000251739; ENST00000305866; ENST00000438395; ENST00000441602; ENST00000458530; ENST00000436177; ENST00000535481 | TSF |
| 4% | chr7 | 92778284 | 92778372 | + | chr7 | 92869179 | 92869247; 92869263 | + | ENST00000251739; ENST00000305866; ENST00000438395; ENST00000441602; ENST00000458530; ENST00000436177; ENST00000535481 | TSF |
| 4% | chr7 | 92778284 | 92778372 | + | chr7 | 92869179 | 92869247; 92869263 | + | ENST00000251739; ENST00000305866; ENST00000438395; ENST00000441602; ENST00000458530; ENST00000436177; ENST00000535481 | TSF |
| 4% | chr7 | 92778284 | 92778372 | + | chr7 | 92869179 | 92869247; 92869263 | + | ENST00000251739; ENST00000305866; ENST00000438395; ENST00000441602; ENST00000458530; ENST00000436177; ENST00000535481 | TSF |
| 4% | chr7 | 92778284 | 92778372 | + | chr7 | 92869179 | 92869247; 92869263 | + | ENST00000251739; ENST00000305866; ENST00000438395; ENST00000441602; ENST00000458530; ENST00000436177; | TSF |

TABLE 48-continued

Transcript fusion for Pheochromocytoma and Paraganglioma (PCPG) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 4% | chr7 | 92778284 | 92778372 | + | chr7 | 92869179 | 92869247; 92869263 | + | ENST00000535481 ENST00000251739; ENST00000305866; ENST00000438395; ENST00000441602; ENST00000458530; ENST00000436177; ENST00000535481 | TSF |
| 4% | chr7 | 92778284 | 92778372 | + | chr7 | 92869179 | 92869247; 92869263 | + | ENST00000251739; ENST00000305866; ENST00000438395; ENST00000441602; ENST00000458530; ENST00000436177; ENST00000535481 | TSF |
| 4% | chr20 | 5874978 | 5874991 | + | chr20 | 5903856 | 5904746 | + | ENST00000378961 | TSF |
| 4% | chr7 | 98448201 | 98448151 | − | chr7 | 98446318 | 98446206 | − | ENST00000416379; ENST00000339375; ENST00000450876; ENST00000345589; ENST00000546258 | TSF |
| 4% | chr7 | 98448201 | 98448151 | − | chr7 | 198446318 | 98446206 | − | ENST00000416379; ENST00000339375; ENST00000450876; ENST00000345589; ENST00000546258 | TSF |
| 4% | chr7 | 102246155 | 102246056 | − | chr7 | 102242852 | 102242771 | − | ENST00000262940; ENST00000461209; ENST00000449970; ENST00000462172; ENST00000522801; ENST00000520042; ENST00000521076 | TSF |
| 4% | chr7 | 102246155 | 102246056 | − | chr7 | 102242852 | 102242771 | − | ENST00000262940; ENST00000461209; ENST00000449970; ENST00000462172; ENST00000522801; ENST00000520042; ENST00000521076 | TSF |
| 4% | chr7 | 102246155 | 102246056 | − | chr7 | 102242852 | 102242771 | − | ENST00000262940; ENST00000461209; ENST00000449970; ENST00000462172; ENST00000522801; ENST00000520042; ENST00000521076 | TSF |
| 4% | chr7 | 102246155 | 102246056 | − | chr7 | 102242852 | 102242771 | − | ENST00000262940; ENST00000461209; ENST00000449970; ENST00000462172; ENST00000522801; ENST00000520042; ENST00000521076 | TSF |
| 4% | chr10 | 87362982 | 87362906 | − | chr10 | 87362458 | 87362030 | − | ENST00000327946; ENST00000536331 | TSF |
| 4% | chr15 | 78467446 | 78467436 | − | chr15 | 78466866 | 78466727 | − | ENST00000258873; ENST00000541759; ENST00000560817 | TSF |
| 3% | chr9 | 35846065 | 35846070 | + | chr9 | 35846255 | 35846378 | + | ENST00000377996; ENST00000439587; ENST00000377991; ENST00000377988 | TSF |
| 3% | chr9 | 35846065 | 35846070 | + | chr9 | 35846255 | 35846378 | + | ENST00000377996; ENST00000439587; ENST00000377991; ENST00000377988 | TSF |
| 3% | chr20 | 15874978 | 5874991 | + | chr20 | 5903727 | 5904746 | + | ENST00000378961 | TSF |
| 3% | chr12 | 50292609 | 50292556 | − | chr12 | 50291869 | 50291770 | − | ENST00000320634; ENST00000550890; ENST00000550195; ENST00000552669; ENST00000550635; ENST00000547871 | TSF |
| 3% | chr12 | 50292609 | 50292556 | − | chr12 | 50291869 | 50291770 | − | ENST00000320634; ENST00000550890; ENST00000550195; ENST00000552669; ENST00000550635; ENST00000547871 | TSF |
| 3% | chr12 | 50292609 | 50292556 | − | chr12 | 50291869 | 50291770 | − | ENST00000320634; ENST00000550890; ENST00000550195; ENST00000552669; ENST00000550635; ENST00000547871 | TSF |
| 3% | chr12 | 50292609 | 50292556 | − | chr12 | 50291869 | 50291770 | − | ENST00000320634; ENST00000550890; ENST00000550195; ENST00000552669; ENST00000550635; ENST00000547871 | TSF |
| 3% | chr12 | 50292609 | 50292556 | − | chr12 | 50291869 | 50291770 | − | ENST00000320634; ENST00000550890; ENST00000550195; ENST00000552669; ENST00000550635; ENST00000547871 | TSF |

TABLE 49

Transcript fusion for Prostate Adenocarcinoma (PRAD) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 61% | chr11 | 49229961 | 49229844 | − | ENST00000256999; ENST00000356696; ENST00000525826; ENST00000533510; ENST00000529648 | chr11 | 49228426 | 49228367 | − | TAF |
| 60% | chr13 | 95768255 | 95768176 | − | ENST00000412704; ENST00000376887; ENST00000536256; ENST00000431522 | chr13 | 95757357 | 95757136 | − | TAF |
| 50% | chr13 | 95768255 | 95768176 | − | ENST00000412704; ENST00000376887; ENST00000536256; ENST00000431522 | chr13 | 95757357 | 95757136 | − | TAF |
| 60% | chr13 | 95768255 | 95768176 | − | ENST00000412704; ENST00000376887; ENST00000536256; ENST00000431522 | chr13 | 95757357 | 95757136 | − | TAF |
| 49% | chr6 | 34512232 | 34511797 | − | ENST00000374037; ENST00000544425 | chr6 | 34511385 | 34511028 | − | TAF |
| 29% | chr5 | 34008124 | 34007878 | − | ENST00000335606; ENST00000382072; | chr5 | 34007194 | 34006954 | − | TAF |

TABLE 49-continued

Transcript fusion for Prostate Adenocarcinoma (PRAD) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
|  |  |  |  |  | ENST00000506639; ENST00000382085; ENST00000502637; ENST00000441713; ENST00000426255; ENST00000512079; ENST00000382068 |  |  |  |  |  |
| 18% | chr10 | 120905865 | 120905748 | − | ENST00000355697; ENST00000330036 | chr10 | 120901885 | 120901741 | − | TAF |
| 18% | chr10 | 120905865 | 120905748 | − | ENST00000355697; ENST00000330036 | chr10 | 120901885 | 120901741 | − | TAF |
| 17% | chr1 | 46876486 | 46876526 | + | ENST00000243167 | chr1 | 46877130 | 46877147 | + | TAF |
| 16% | chr19 | 51359567; 51359496; 51359590 | 51359655 | + | ENST00000601503; ENST00000326003; ENST00000422986; ENST00000597286; ENST00000597483; ENST00000593997; ENST00000595392; ENST00000595952; ENST00000360617; ENST00000598145 | chr19 | 51360009 | 51360064 | + | TAF |
| 16% | chr19 | 51359567; 51359496; 51359590 | 51359655 | + | ENST00000601503; ENST00000326003; ENST00000422986; ENST00000597286; ENST00000597483; ENST00000593997; ENST00000595392; ENST00000595952; ENST00000360617; ENST00000598145 | chr19 | 51360009 | 51360064 | + | TAF |
| 16% | chr19 | 51359567; 51359496; 51359590 | 51359655 | + | ENST00000601503; ENST00000326003; ENST00000422986; ENST00000597286; ENST00000597483; ENST00000593997; ENST00000595392; ENST00000595952; ENST00000360617; ENST00000598145 | chr19 | 51360009 | 51360064 | + | TAF |
| 16% | chr19 | 51359567; 51359496; 51359590 | 51359655 | + | ENST00000601503; ENST00000326003; ENST00000422986; ENST00000597286; ENST00000597483; ENST00000593997; ENST00000595392; ENST00000595952; ENST00000360617; ENST00000598145 | chr19 | 51360009 | 51360064 | + | TAF |
| 15% | chr19 | 44129402 | 44129230 | − | ENST00000222374 | chr19 | 44129055 | 44128921 | − | TAF |
| 14% | chr5 | 33998932; 33998887 | 33998746 | − | ENST00000335606; ENST00000382072; ENST00000506639; ENST00000382085; ENST00000502637; ENST00000441713; ENST00000426255; ENST00000512079; ENST00000382068 | chr5 | 33993480 | 33992996 | − | TSF |
| 14% | chr5 | 33998932; 33998887 | 33998746 | − | ENST00000335606; ENST00000382072; ENST00000506639; ENST00000382085; ENST00000502637; ENST00000441713; ENST00000426255; ENST00000512079; ENST00000382068 | chr5 | 33993480 | 33992996 | − | TSF |
| 14% | chr5 | 33998932; 33998887 | 33998746 | − | ENST00000335606; ENST00000382072; ENST00000506639; ENST00000382085; ENST00000502637; ENST00000441713; ENST00000426255; ENST00000512079; ENST00000382068 | chr5 | 33993480 | 33992996 | − | TSF |
| 13% | chr3 | 122103113 | 122103146 | + | ENST00000477892; ENST00000469967 | chr3 | 122112280 | 122112741 | + | TAF |
| 13% | chr9 | 5335597 | 5335468 | − | ENST00000223862 | chr9 | 5326315 | 5326232 | − | TAF |
| 11% | chr1 | 156256051 | 156256264 | + | ENST00000295694; ENST00000357501; ENST00000405535; ENST00000456810 | chr1 | 156259791 | 156259857 | + | TAF |
| 11% | chr1 | 156256051 | 156256264 | + | ENST00000295694; ENST00000357501; ENST00000405535; ENST00000456810 | chr1 | 156259791 | 156259857 | + | TAF |
| 11% | chr22 | 24323139 | 24323226 | + | ENST00000215780; ENST00000402588 | chr22 | 24324557 | 24324632 | + | TAF |
| 11% | chr6 | 11000397 | 11000320 | − | ENST00000354666 | chr6 | 11000151 | 11000002 | − | TAF |
| 10% | chr20 | 32247538; 32247356 | 32247303 | − | ENST00000246190; ENST00000375238; ENST00000480994 | chr20 | 32246861 | 32246725 | − | TAF |
| 10% | chr20 | 32247538; 32247356 | 32247303 | − | ENST00000246190; ENST00000375238; ENST00000480994 | chr20 | 32246861 | 32246725 | − | TAF |
| 10% | chr20 | 32247538; 32247356 | 32247303 | − | ENST00000246190; ENST00000375238; ENST00000480994 | chr20 | 32246861 | 32246725 | − | TAF |
| 10% | chr12 | 102074121 | 102074307 | + | ENST00000547405; ENST00000452455; ENST00000360610; ENST00000441232; ENST00000392934; ENST00000547509; ENST00000361685; ENST00000549145; ENST00000553190; ENST00000536007; ENST00000541119; ENST00000545503; ENST00000361466; ENST00000551300; ENST00000550270 | chr12 | 102089430 | 102089665 | + | TAF |
| 10% | chr12 | 102074121 | 102074307 | + | ENST00000547405; ENST00000452455; ENST00000360610; ENST00000441232; ENST00000392934; ENST00000547509; ENST00000361685; ENST00000549145; ENST00000553190; ENST00000536007; ENST00000541119; ENST00000545503; ENST00000361466; ENST00000551300; ENST00000550270 | chr12 | 102089430 | 102089665 | + | TAF |
| 10% | chr12 | 102074121 | 102074307 | + | ENST00000547405; ENST00000452455; ENST00000360610; ENST00000441232; ENST00000392934; ENST00000547509; | chr12 | 102089430 | 102089665 | + | TAF |

TABLE 49-continued

Transcript fusion for Prostate Adenocarcinoma (PRAD) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|----|----|
| 10% | chr12 | 102074121 | 102074307 | + | ENST00000547405; ENST00000452455; ENST00000360610; ENST00000441232; ENST00000392934; ENST00000547509; ENST00000361685; ENST00000549145; ENST00000553190; ENST00000536007; ENST00000541119; ENST00000545503; ENST00000361466; ENST00000551300; ENST00000550270 | chr12 | 102089430 | 102089665 | + | TAF |
| 10% | chr12 | 102074121 | 102074307 | + | ENST00000547405; ENST00000452455; ENST00000360610; ENST00000441232; ENST00000392934; ENST00000547509; ENST00000361685; ENST00000549145; ENST00000553190; ENST00000536007; ENST00000541119; ENST00000545503; ENST00000361466; ENST00000551300; ENST00000550270 | chr12 | 102089430 | 102089665 | + | TAF |
| 10% | chr12 | 102074121 | 102074307 | + | ENST00000547405; ENST00000452455; ENST00000360610; ENST00000441232; ENST00000392934; ENST00000547509; ENST00000361685; ENST00000549145; ENST00000553190; ENST00000536007; ENST00000541119; ENST00000545503; ENST00000361466; ENST00000551300; ENST00000550270 | chr12 | 102089430 | 102089665 | + | TAF |
| 10% | chr12 | 102074121 | 102074307 | + | ENST00000547405; ENST00000452455; ENST00000360610; ENST00000441232; ENST00000392934; ENST00000547509; ENST00000361685; ENST00000549145; ENST00000553190; ENST00000536007; ENST00000541119; ENST00000545503; ENST00000361466; ENST00000551300; ENST00000550270 | chr12 | 102089430 | 102089665 | + | TAF |
| 10% | chr12 | 102074121 | 102074307 | + | ENST00000547405; ENST00000452455; ENST00000360610; ENST00000441232; ENST00000392934; ENST00000547509; ENST00000361685; ENST00000549145; ENST00000553190; ENST00000536007; ENST00000541119; ENST00000545503; ENST00000361466; ENST00000551300; ENST00000550270 | chr12 | 102089430 | 102089665 | + | TAF |
| 10% | chr12 | 102074121 | 102074307 | + | ENST00000547405; ENST00000452455; ENST00000360610; ENST00000441232; ENST00000392934; ENST00000547509; ENST00000361685; ENST00000549145; ENST00000553190; ENST00000536007; ENST00000541119; ENST00000545503; ENST00000361466; ENST00000551300; ENST00000550270 | chr12 | 102089430 | 102089665 | + | TAF |
| 10% | chr12 | 102074121 | 102074307 | + | ENST00000547405; ENST00000452455; ENST00000360610; ENST00000441232; ENST00000392934; ENST00000547509; ENST00000361685; ENST00000549145; ENST00000553190; ENST00000536007; ENST00000541119; ENST00000545503; ENST00000361466; ENST00000551300; ENST00000550270 | chr12 | 102089430 | 102089665 | + | TAF |
| 9% | chr13 | 95686993 | 95686859 | − | ENST00000412704; ENST00000376887 | chr13 | 95659886 | 95659840 | − | TSF |
| 9% | chr13 | 95686993 | 95686859 | − | ENST00000412704; ENST00000376887 | chr13 | 95659886 | 95659840 | − | TSF |
| 7% | chr3 | 53707050 | 53707153 | + | ENST00000350061; ENST00000422281; ENST00000481478 | chr3 | 53713021 | 53713326 | + | TSF |
| 7% | chr3 | 53707050 | 53707153 | + | ENST00000350061; ENST00000422281; ENST00000481478 | chr3 | 53713021 | 53713326 | + | TSF |
| 7% | chr3 | 132063771 | 132063903 | + | ENST00000336375; ENST00000475741; ENST00000351273 | chr3 | 132063998 | 132064153 | + | TSF |
| 7% | chr3 | 132063771 | 132063903 | + | ENST00000336375; ENST00000475741; ENST00000351273 | chr3 | 132063998 | 132064153 | + | TSF |
| 6% | chr19 | 49714421 | 49714526 | + | ENST00000252826; ENST00000427978; ENST00000355712 | chr19 | 49739844 | 49739922 | + | TSF |
| 6% | chr19 | 49714421 | 49714526 | + | ENST00000252826; ENST00000427978; ENST00000355712 | chr19 | 49739844 | 49739922 | + | TSF |
| 6% | chr19 | 49714421 | 49714526 | + | ENST00000252826; ENST00000427978; | chr19 | 49739844 | 49739922 | + | TSF |

TABLE 49-continued

Transcript fusion for Prostate Adenocarcinoma (PRAD) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 5% | chr7 | 151573705 | 151573592 | − | ENST00000355712; ENST00000287878; ENST00000488258 | chr7 | 151532195 | 531151867 | − | TSF |
| 5% | chr2 | 193044420 | 193044394 | − | ENST00000392314; ENST00000272771; ENST00000409056 | chr2 | 193026176 | 193025896 | − | TSF |
| 4% | chr1 | 11115983; 11115877 | 11115838 | − | ENST00000376957; ENST00000490101 | chr1 | 11115464 | 11115178 | − | TSF |
| 4% | chr1 | 11115983; 11115877 | 11115838 | − | ENST00000376957; ENST00000490101 | chr1 | 11115464 | 15111178 | − | TSF |
| 4% | chr8 | 42924698; 42924750 | 42924802 | + | ENST00000534420; ENST00000302279; ENST00000533998; ENST00000342116; ENST00000531266; ENST00000525699; ENST00000529687; ENST00000533336 | chr8 | 42925245 | 42925476 | + | TSF |
| 4% | chr8 | 42924698; 42924750 | 42924802 | + | ENST00000534420; ENST00000302279; ENST00000533998; ENST00000342116; ENST00000531266; ENST00000525699; ENST00000529687; ENST00000533336 | chr8 | 42925245 | 42925476 | + | TSF |
| 4% | chr8 | 42924698; 42924750 | 42924802 | + | ENST00000534420; ENST00000302279; ENST00000533998; ENST00000342116; ENST00000531266; ENST00000525699; ENST00000529687; ENST00000533336 | chr8 | 42925245 | 42925476 | + | TSF |
| 4% | chr8 | 42924698; 42924750 | 42924802 | + | ENST00000534420; ENST00000302279; ENST00000533998; ENST00000342116; ENST00000531266; ENST00000525699; ENST00000529687; ENST00000533336 | chr8 | 42925245 | 42925476 | + | TSF |
| 4% | chr8 | 42924698; 42924750 | 42924802 | + | ENST00000534420; ENST00000302279; ENST00000533998; ENST00000342116; ENST00000531266; ENST00000525699; ENST00000529687; ENST00000533336 | chr8 | 42925245 | 42925476 | + | TSF |
| 4% | chr8 | 42924698; 42924750 | 42924802 | + | ENST00000534420; ENST00000302279; ENST00000533998; ENST00000342116; ENST00000531266; ENST00000525699; ENST00000529687; ENST00000533336 | chr8 | 42925245 | 42925476 | + | TSF |
| 4% | chr19 | 51376730 | 51376775 | + | ENST00000325321; ENST00000600690; ENST00000594174; ENST00000597727; ENST00000595316; ENST00000599121; ENST00000358049; ENST00000597439 | chr19 | 51382148 | 51382280 | + | TSF |
| 4% | chr5 | 70944924 | 70945080 | + | ENST00000340941; ENST00000323375; ENST00000509539 | chr10 | 1662872 | 1663598 | + | TSF |
| 4% | chr5 | 70944924 | 70945080 | + | ENST00000340941; ENST00000323375; ENST00000509539 | chr10 | 1662872 | 1663598 | + | TSF |
| 4% | chr5 | 70944924 | 70945080 | + | ENST00000340941; ENST00000323375; ENST00000509539 | chr10 | 1662872 | 1663598 | + | TSF |
| 3% | chr18 | 56807181 | 56807267 | + | ENST0000587834; ENST00000299714; ENST00000588875 | chr18 | 56814218 | 56814267 | + | TSF |
| 3% | chr21 | 39762964 | 39762917 | − | ENST00000398905; ENST00000398907; ENST00000288319; ENST00000398897; ENST00000398911; ENST00000398910; ENST00000417133; ENST00000442448; ENST00000453032; ENST00000398919 | chr21 | 39739570 | 39739188 | − | TSF |
| 3% | chr21 | 39762964 | 39762917 | − | ENST00000398905; ENST00000398907; ENST00000288319; ENST00000398897; ENST00000398911; ENST00000398910; ENST00000417133; ENST00000442448; ENST00000453032; ENST00000398919 | chr21 | 39739570 | 39739188 | − | TSF |
| 3% | chr21 | 39762964 | 39762917 | − | ENST00000398905; ENST00000398907; ENST00000288319; ENST00000398897; ENST00000398911; ENST00000398910; ENST00000417133; ENST00000442448; ENST00000453032; ENST00000398919 | chr21 | 39739570 | 39739188 | − | TSF |
| 3% | chr21 | 39762964 | 39762917 | − | ENST00000398905; ENST00000398907; ENST00000288319; ENST00000398897; ENST00000398911; ENST00000398910; ENST00000417133; ENST00000442448; ENST00000453032; ENST00000398919 | chr21 | 39739570 | 39739188 | − | TSF |
| 3% | chr21 | 39762964 | 39762917 | − | ENST00000398905; ENST00000398907; ENST00000288319; ENST00000398897; ENST00000398911; ENST00000398910; ENST00000417133; ENST00000442448; ENST00000453032; ENST00000398919 | chr21 | 39739570 | 39739188 | − | TSF |
| 3% | chr21 | 39762964 | 39762917 | − | ENST00000398905; ENST00000398907; ENST00000288319; ENST00000398897; ENST00000398911; ENST00000398910; ENST00000417133; ENST00000442448; ENST00000453032; ENST00000398919 | chr21 | 39739570 | 39739188 | − | TSF |
| 3% | chr21 | 39762964 | 39762917 | − | ENST00000398905; ENST00000398907; ENST00000288319; ENST00000398897; | chr21 | 39739570 | 39739188 | − | TSF |

TABLE 49-continued

Transcript fusion for Prostate Adenocarcinoma (PRAD) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 3% | chr21 | 39762964 | 39762917 | − | ENST00000398911; ENST00000398910; ENST00000417133; ENST00000442448; ENST00000453032; ENST00000398919 ENST00000398905; ENST00000398907; ENST00000288319; ENST00000398897; ENST00000398911; ENST00000398910; ENST00000417133; ENST00000442448; ENST00000453032; ENST00000398919 | chr21 | 39739570 | 39739188 | − | TSF |
| 3% | chr6 | 38851652 | 38851774 | + | ENST00000449981; ENST00000327475; ENST00000359357; ENST00000441566 | chr6 | 38852622 | 38852809 | + | TSF |
| 3% | chr6 | 38851652 | 38851774 | + | ENST00000449981; ENST00000327475; ENST00000359357; ENST00000441566 | chr6 | 38852622 | 38852809 | + | TSF |
| 3% | chr6 | 38851652 | 38851774 | + | ENST00000449981; ENST00000327475; ENST00000359357; ENST00000441566 | chr6 | 38852622 | 38852809 | + | TSF |
| 3% | chr6 | 38851652 | 38851774 | + | ENST00000449981; ENST00000327475; ENST00000359357; ENST00000441566 | chr6 | 38852622 | 38852809 | + | TSF |
| 3% | chr3 | 4927450 | 4927407 | − | ENST00000449914; ENST00000441894 | chr3 | 4898429 | 4898242 | − | TSF |
| 3% | chr5 | 79410474 | 79410337 | − | ENST00000509193 | chr5 | 79409445 | 79409319 | − | TSF |
| 3% | chr11 | 10050104 | 10049999 | − | ENST00000256190 | chr11 | 10038326 | 10038049 | − | TSF |
| 3% | chr11 | 49175479 | 49175398 | − | ENST00000256999; ENST00000356696; ENST00000343844; ENST00000340334; ENST00000533034 | chr11 | 49173831 | 49173562 | − | TSF |
| 3% | chr11 | 49175479 | 49175398 | − | ENST00000256999; ENST00000356696; ENST00000343844; ENST00000340334; ENST00000533034 | chr11 | 49173831 | 49173562 | − | TSF |
| 3% | chr11 | 49175479 | 49175398 | − | ENST00000256999; ENST00000356696; ENST00000343844; ENST00000340334; ENST00000533034 | chr11 | 49173831 | 49173562 | − | TSF |
| 3% | chr3 | 4872702 | 4872631 | − | ENST00000449914; ENST00000441894 | chr3 | 4871958 | 4871639 | − | TSF |
| 2% | chr17 | 11166683 | 11166843 | + | ENST00000432116; ENST00000441885; ENST00000409168; ENST00000343478 | chr17 | 11172072 | 11172130 | + | TSF |
| 2% | chr17 | 11166683 | 11166843 | + | ENST00000432116; ENST00000441885; ENST00000409168; ENST00000343478 | chr17 | 11172072 | 11172130 | + | TSF |
| 2% | chr12 | 63061109 | 63060958 | − | ENST00000228705 | chr12 | 63057027 | 63056997 | − | TSF |
| 2% | chr9 | 17143286 | 17143374 | + | ENST00000380647; ENST00000262360; ENST00000425824; ENST00000380641 | chr9 | 17166816 | 17167136 | + | TSF |
| 2% | chr19 | 51361715 | 51361851 | + | ENST00000326003; ENST00000597483; ENST00000593997; ENST00000595952; ENST00000360617; ENST00000598145 | chr19 | 51369527 | 51369763 | + | TSF |
| 2% | chr19 | 51361715 | 51361851 | + | ENST00000326003; ENST00000597483; ENST00000593997; ENST00000595952; ENST00000360617; ENST00000598145 | chr19 | 51369527 | 51369763 | + | TSF |
| 2% | chr19 | 51361715 | 51361851 | + | ENST00000326003; ENST00000597483; ENST00000593997; ENST00000595952; ENST00000360617; ENST00000598145 | chr19 | 51369527 | 51369763 | + | TSF |
| 2% | chr10 | 79796952 | 79797062 | + | ENST00000435275; ENST00000440692; ENST00000372360; ENST00000360830 | chr4 | 176584518 | 176584519 | + | TSF |
| 2% | chr20 | 29632611 | 29632721 | + | ENST00000278882; ENST00000358464 | chr20 | 29652086 | 29652324 | + | TSF |
| 2% | chr4 | 57319769 | 57319927 | + | ENST00000514888; ENST00000264221; ENST00000505164; ENST00000399688; ENST00000512576 | chr4 | 57321183 | 57321327 | + | TSF |
| 2% | chr4 | 57319769 | 57319927 | + | ENST00000514888; ENST00000264221; ENST00000505164; ENST00000399688; ENST00000512576 | chr4 | 57321183 | 57321327 | + | TSF |
| 2% | chr4 | 57319769 | 57319927 | + | ENST00000514888; ENST00000264221; ENST00000505164; ENST00000399688; ENST00000512576 | chr4 | 57321183 | 57321327 | + | TSF |
| 2% | chr5 | 172341717 | 172341841 | + | ENST00000393784; ENST00000520326; ENST00000523291; ENST00000518247; ENST00000326654; ENST00000519567 | chr5 | 172345344 | 172345395 | + | TSF |
| 2% | chr5 | 172341717 | 172341841 | + | ENST00000393784; ENST00000520326; ENST00000523291; ENST00000518247; ENST00000326654; ENST00000519567 | chr5 | 172345344 | 172345395 | + | TSF |
| 2% | chr5 | 172341717 | 172341841 | + | ENST00000393784; ENST00000520326; ENST00000523291; ENST00000518247; ENST00000326654; ENST00000519567 | chr5 | 172345344 | 172345395 | + | TSF |
| 2% | chr9 | 125054028 | 125054119 | + | ENST00000297908; ENST00000344641; ENST00000373723; ENST00000373729; ENST00000394315 | chr9 | 125068067 | 125068171 | + | TSF |
| 2% | chr9 | 125054028 | 125054119 | + | ENST00000297908; ENST00000344641; ENST00000373723; ENST00000373729; ENST00000394315 | chr9 | 125068067 | 125068171 | + | TSF |
| 2% | chr9 | 125054028 | 125054119 | + | ENST00000297908; ENST00000344641; ENST00000373723; ENST00000373729; ENST00000394315 | chr9 | 125068067 | 125068171 | + | TSF |
| 2% | chr21 | 43967213 | 43967250 | + | ENST00000398341; ENST00000352133 | chr21 | 43968760 | 43968869 | + | TSF |

TABLE 49-continued

Transcript fusion for Prostate Adenocarcinoma (PRAD) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|----|----|
| 2% | chr1 | 227842037 | 227843464 | + | ENST00000397097; ENST00000343776 | chr1 | 227864880 | 227866572 | + | TSF |
| 2% | chr1 | 227842037 | 227843464 | + | ENST00000397097; ENST00000343776 | chr1 | 227864880 | 227866572 | + | TSF |
| 2% | chr6 | 43005749 | 43005597 | − | ENST00000265348; ENST00000535468 | chr6 | 43005086 | 43004995 | − | TSF |
| 2% | chr6 | 43005749 | 43005597 | − | ENST00000265348; ENST00000535468 | chr6 | 43005086 | 43004995 | − | TSF |
| 2% | chr16 | 450219 | 450294 | + | ENST00000397722; ENST00000444498; ENST00000382940; ENST00000219479; ENST00000450036 | chr16 | 452708 | 452993 | + | TSF |
| 2% | chr16 | 450219 | 450294 | + | ENST00000397722; ENST00000444498; ENST00000382940; ENST00000219479; ENST00000450036 | chr16 | 452708 | 452993 | + | TSF |
| 2% | chr16 | 450219 | 450294 | + | ENST00000397722; ENST00000444498; ENST00000382940; ENST00000219479; ENST00000450036 | chr16 | 452708 | 452993 | + | TSF |
| 2% | chr4 | 106557560 | 106557577 | + | ENST00000420470 | chr4 | 106563757 | 106563879 | + | TSF |
| 2% | chr4 | 106557560 | 106557577 | + | ENST00000420470 | chr4 | 106563763 | 106563879 | + | TSF |
| 2% | chr5 | 59481425 | 59481384 | − | ENST00000502484; ENST00000546160; ENST00000509368; ENST00000505507; ENST00000514552; ENST00000515835 | chr5 | 59443721 | 59443367 | − | TSF |
| 2% | chr19 | 52380630 | 52380535 | − | ENST00000412216; ENST00000301399; ENST00000420592; ENST00000451628; ENST00000458390 | chr19 | 52359220 | 52358662 | − | TSF |
| 2% | chr9 | 130213596 | 130213560 | − | ENST00000361436; ENST00000536368 | chr9 | 130213398 | 130213359 | − | TSF |
| 2% | chr7 | 14017105 | 14017052 | − | ENST00000430479; ENST00000399357; ENST00000405192; ENST00000405358; ENST00000403527; ENST00000405218; ENST00000443137; ENST00000443608; ENST00000421381; ENST00000431887 | chr7 | 14014711 | 14014667 | − | TSF |
| 2% | chr7 | 14017105 | 14017052 | − | ENST00000430479; ENST00000399357; ENST00000405192; ENST00000405358; ENST00000403527; ENST00000405218; ENST00000443137; ENST00000443608; ENST00000421381; ENST00000431887 | chr7 | 14014711 | 14014667 | − | TSF |
| 2% | chr7 | 14017105 | 14017052 | − | ENST00000430479; ENST00000399357; ENST00000405192; ENST00000405358; ENST00000403527; ENST00000405218; ENST00000443137; ENST00000443608; ENST00000421381; ENST00000431887 | chr7 | 14014711 | 14014667 | − | TSF |
| 1% | chr22 | 29884838 | 29886410 | + | ENST00000310624 | chr22 | 29909572 | 29909695 | + | TSF |
| 1% | chr19 | 58758112; 58758077 | 58758160 | + | ENST00000599227; ENST00000269829; ENST00000597240; ENST00000594384; ENST00000596825; ENST00000333581; ENST00000596652; ENST00000596677; ENST00000596929; ENST00000595981 | chr19 | 58785766 | 58786010 | + | TSF |
| 1% | chr19 | 58758112; 58758077 | 58758160 | + | ENST00000599227; ENST00000269829; ENST00000597240; ENST00000594384; ENST00000596825; ENST00000333581; ENST00000596652; ENST00000596677; ENST00000596929; ENST00000595981 | chr19 | 58785766 | 58786010 | + | TSF |
| 1% | chr1 | 2492063 | 2492153 | + | ENST00000426449; ENST00000434817; ENST00000435221; ENST00000451778; ENST00000409119; ENST00000355716 | chr1 | 2508457 | 2508463 | + | TSF |
| 1% | chr21 | 42720519 | 42720651 | + | ENST00000357985; ENST00000398647; ENST00000398652; ENST00000398646 | chr21 | 42720974 | 42721052 | + | TSF |
| 1% | chr21 | 42720519 | 42720651 | + | ENST00000357985; ENST00000398647; ENST00000398652; ENST00000398646 | chr21 | 42720974 | 42721052 | + | TSF |
| 1% | chr21 | 42720519 | 42720651 | + | ENST00000357985; ENST00000398647; ENST00000398652; ENST00000398646 | chr21 | 42720974 | 42721052 | + | TSF |
| 1% | chr21 | 42720519 | 42720651 | + | ENST00000357985; ENST00000398647; ENST00000398652; ENST00000398646 | chr21 | 42720974 | 42721052 | + | TSF |
| 1% | chr15 | 75105196 | 75105370 | + | ENST00000309664; ENST00000379709 | chr15 | 75108232 | 75108281 | + | TSF |
| 1% | chr11 | 49186324 | 49186257 | − | ENST00000256999; ENST00000356696; ENST00000343844; ENST00000340334; ENST00000533034 | chr11 | 49184464 | 49182294 | − | TSF |
| 1% | chr11 | 49186324 | 49186257 | − | ENST00000256999; ENST00000356696; ENST00000343844; ENST00000340334; ENST00000533034 | chr11 | 49184464 | 49182294 | − | TSF |
| 1% | chr11 | 49186324 | 49186257 | − | ENST00000256999; ENST00000356696; ENST00000343844; ENST00000340334; ENST00000533034 | chr11 | 49184464 | 49182294 | − | TSF |
| 1% | chr13 | 95686993 | 95686859 | − | ENST00000412704; ENST00000376887 | chr13 | 95659875 | 95659840 | − | TSF |
| 1% | chr13 | 95686993 | 95686859 | − | ENST00000412704; ENST00000376887 | chr13 | 95659875 | 95659840 | − | TSF |
| 1% | chr11 | 61290746 | 61290547 | − | ENST00000263846; ENST00000540677; ENST00000539008; ENST00000542836; ENST00000542670; ENST00000535826 | chr11 | 61289967 | 61289967 | − | TSF |
| 1% | chr11 | 61290746 | 61290547 | − | ENST00000263846; ENST00000540677; ENST00000539008; ENST00000542836; | chr11 | 61289967 | 61289967 | − | TSF |

TABLE 49-continued

Transcript fusion for Prostate Adenocarcinoma (PRAD) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 1% | chr11 | 61290746 | 61290547 | − | ENST00000542670; ENST00000535826 ENST00000263846; ENST00000540677; ENST00000539008; ENST00000542836 | chr11 | 61289967 | 61289967 | − | TSF |
| 1% | chr11 | 61290746 | 61290547 | − | ENST00000542670; ENST00000535826 ENST00000263846; ENST00000540677; ENST00000539008; ENST00000542836 | chr11 | 61289967 | 61289967 | − | TSF |
| 1% | chr11 | 61290746 | 61290547 | − | ENST00000542670; ENST00000535826 ENST00000263846; ENST00000540677; ENST00000539008; ENST00000542836 | chr11 | 61289967 | 61289967 | − | TSF |
| 1% | chr11 | 61290746 | 61290547 | − | ENST00000542670; ENST00000535826 ENST00000263846; ENST00000540677; ENST00000539008; ENST00000542836 | chr11 | 61289967 | 61289967 | − | TSF |
| 1% | chr6 | 46673038 | 46672890 | − | ENST00000274793; ENST00000537365 | chr6 | 46667004 | 46666386 | − | TSF |
| 1% | chr6 | 144612965 | 144613043 | + | ENST00000433557; ENST00000367545 | chr6 | 144629111 | 144629489 | + | TSF |
| 1% | chr12 | 93873164 | 93873248 | + | ENST00000549982; ENST00000361630; ENST00000552217; ENST00000393128; ENST00000547098; ENST00000549561; ENST00000548545 | chr12 | 93876129 | 93876286 | + | TSF |
| 1% | chr12 | 93873164 | 93873248 | + | ENST00000549982; ENST00000361630; ENST00000552217; ENST00000393128; ENST00000547098; ENST00000549561; ENST00000548545 | chr12 | 93876129 | 93876286 | + | TSF |
| 1% | chr22 | 40760884; 40761043 | 40761060 | + | ENST00000216194; ENST00000454266; ENST00000498234 | chr22 | 40796700 | 40796751 | + | TSF |
| 1% | chr22 | 40760884; 40761043 | 40761060 | + | ENST00000216194; ENST00000454266; ENST00000498234 | chr22 | 40796700 | 40796751 | + | TSF |
| 1% | chr22 | 40760884; 40761043 | 40761060 | + | ENST00000216194; ENST00000454266; ENST00000498234 | chr22 | 40796700 | 40796751 | + | TSF |
| 1% | chr22 | 48885405 | 48885516 | + | ENST00000402357; ENST00000336769 | chr22 | 48915770 | 48916108 | + | TSF |
| 1% | chr2 | 131128772 | 131128860 | + | ENST00000175756; ENST00000347849; ENST00000409022 | chr2 | 131129120 | 131129406 | + | TSF |
| 1% | chr2 | 131128772 | 131128860 | + | ENST00000175756; ENST00000347849; ENST00000409022 | chr2 | 131129120 | 131129406 | + | TSF |
| 1% | chr2 | 131128772 | 131128860 | + | ENST00000175756; ENST00000347849; ENST00000409022 | chr2 | 131129120 | 131129406 | + | TSF |
| 1% | chr7 | 81964567 | 81964451 | − | ENST00000356860; ENST00000356253; ENST00000423588 | chr7 | 81929467 | 81929190 | − | TSF |
| 1% | chr15 | 55516210 | 55516087 | − | ENST00000396307; ENST00000336787; ENST00000564609; ENST00000569493; ENST00000566877 | chr15 | 55512776 | 55512769 | − | TSF |
| 1% | chr11 | 57256462 | 57256389 | − | ENST00000278426; ENST00000528450; ENST00000525764 | chr11 | 57255085 | 57254993 | − | TSF |
| 1% | chr11 | 57256462 | 57256389 | − | ENST00000278426; ENST00000528450; ENST00000525764 | chr11 | 57255085 | 57254993 | − | TSF |
| 1% | chr7 | 44294206 | 44294141 | − | ENST00000350811; ENST00000457475; ENST00000395749; ENST00000440254; ENST00000358707; ENST00000353625; ENST00000353185; ENST00000258682; ENST00000346990; ENST00000347193; ENST00000395747; ENST00000415369; ENST00000424197; ENST00000421607 | chr7 | 44293110 | 44292801 | − | TSF |
| 1% | chr7 | 44294206 | 44294141 | − | ENST00000350811; ENST00000457475; ENST00000395749; ENST00000440254; ENST00000358707; ENST00000353625; ENST00000353185; ENST00000258682; ENST00000346990; ENST00000347193; ENST00000395747; ENST00000415369; ENST00000424197; ENST00000421607 | chr7 | 44293110 | 44292801 | − | TSF |
| 1% | chr6 | 35547998 | 35547813 | − | ENST00000539068; ENST00000536438; ENST00000357266; ENST00000540787 | chr6 | 35531291 | 35531039 | − | TSF |
| 1% | chr6 | 35547998 | 35547813 | − | ENST00000539068; ENST00000536438; ENST00000357266; ENST00000540787 | chr6 | 35531291 | 31035539 | − | TSF |
| 1% | chr1 | 2340297 | 2339891 | − | ENST00000288774; ENST00000447513; ENST00000507596 | chr1 | 2339399 | 2339300 | − | TSF |
| 1% | chr1 | 40779939 | 40779877 | − | ENST00000372748; ENST00000417105 | chr1 | 40778630 | 40778617 | − | TSF |
| 1% | chr1 | 40779939 | 40779877 | − | ENST00000372748; ENST00000417105 | chr1 | 40778630 | 40778617 | − | TSF |
| 1% | chr11 | 49229961 | 49229844 | − | ENST00000256999; ENST00000356696; ENST00000525826; ENST00000533510; ENST00000529648 | chr11 | 49228751 | 49228576 | − | TSF |
| 1% | chr2 | 193044420 | 193044394 | − | ENST00000392314; ENST00000272771; ENST00000409056 | chr2 | 192957935 | 192957907 | − | TSF |
| 1% | chr5 | 79442057 | 79441913 | − | ENST00000507668; ENST00000509193; ENST00000512972; ENST00000512721 | chr5 | 79407525 | 79407007 | − | TSF |
| 1% | chr5 | 79442057 | 79441913 | − | ENST00000507668; ENST00000509193; ENST00000512972; ENST00000512721 | chr5 | 79407525 | 79407007 | − | TSF |

TABLE 49-continued

Transcript fusion for Prostate Adenocarcinoma (PRAD) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|----|----|

TABLE 50

Transcript fusion for Prostate Adenocarcinoma (PRAD) Coordinates of the fusion sequences for which the donor is the T

| 1 | 2' | 3' | 4' | 5' | 6' | 7' | 8' | 9' | 10' | 11' |
|---|----|----|----|----|----|----|----|----|-----|-----|
| 79% | chr5 | 34010561 | 34010276 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TAF |
| 79% | chr5 | 34010561 | 34010276 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TAF |
| 79% | chr5 | 34010561 | 34010276 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TAF |
| 79% | chr5 | 34010561 | 34010276 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TAF |
| 79% | chr5 | 34010561 | 34010276 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TAF |
| 79% | chr5 | 34010561 | 34010276 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TAF |
| 79% | chr5 | 34010561 | 34010276 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TAF |
| 79% | chr5 | 34010561 | 34010276 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TAF |
| 79% | chr5 | 34010561 | 34010276 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TAF |
| 70% | chr5 | 34006954 | 34006922 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TAF |
| 70% | chr5 | 34006954 | 34006922 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TAF |
| 70% | chr5 | 34006954 | 34006922 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TAF |
| 70% | chr5 | 34006954 | 34006922 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TAF |
| 70% | chr5 | 34006954 | 34006922 | − | chr5 | 34006004 | 34005861 | − | ENST00000335606; ENST00000382072; | TAF |

TABLE 50-continued

Transcript fusion for Prostate Adenocarcinoma (PRAD) Coordinates of the fusion sequences for which the donor is the T

| 1 | 2' | 3' | 4' | 5' | 6' | 7' | 8' | 9' | 10' | 11' |
|---|---|---|---|---|---|---|---|---|---|---|
| 70% | chr5 | 34006954 | 34006922 | – | chr5 | 34006004 | 34005861 | – | ENST00000382079; ENST00000506639; ENST00000382085; ENST00000502637; ENST00000441713; ENST00000426255; ENST00000512079; ENST00000382068 ENST00000335606; ENST00000382072; ENST00000382079; ENST00000506639; ENST00000382085; ENST00000502637; ENST00000441713; ENST00000426255; ENST00000512079; ENST00000382068 | TAF |
| 70% | chr5 | 34006954 | 34006922 | – | chr5 | 34006004 | 34005861 | – | ENST00000335606; ENST00000382072; ENST00000382079; ENST00000506639; ENST00000382085; ENST00000502637; ENST00000441713; ENST00000426255; ENST00000512079; ENST00000382068 | TAF |
| 70% | chr5 | 34006954 | 34006922 | – | chr5 | 34006004 | 34005861 | – | ENST00000335606; ENST00000382072; ENST00000382079; ENST00000506639; ENST00000382085; ENST00000502637; ENST00000441713; ENST00000426255; ENST00000512079; ENST00000382068 | TAF |
| 70% | chr5 | 34006954 | 34006922 | – | chr5 | 34006004 | 34005861 | – | ENST00000335606; ENST00000382072; ENST00000382079; ENST00000506639; ENST00000382085; ENST00000502637; ENST00000441713; ENST00000426255; ENST00000512079; ENST00000382068 | TAF |
| 69% | chr7 | 38312003 | 383111882 | – | chr7 | 38305279 | 38304950 | – | ENST00000443402 | TAF |
| 42% | chr7 | 38312003 | 38311882 | – | chr7 | 38289173 | 38288844 | – | ENST00000436911 | TAF |
| 40% | chr8 | 39710096 | 39709866 | – | chr8 | 39694731 | 39694655 | – | ENST00000347580; ENST00000379853; ENST00000265708; ENST00000521880 | TAF |
| 40% | chr8 | 39710096 | 39709866 | – | chr8 | 39694731 | 39694655 | – | ENST00000347580; ENST00000379853; ENST00000265708; ENST00000521880 | TAF |
| 40% | chr8 | 39710096 | 39709866 | – | chr8 | 39694731 | 39694655 | – | ENST00000347580; ENST00000379853; ENST00000265708; ENST00000521880 | TAF |
| 40% | chr8 | 39710096 | 39709866 | – | chr8 | 39694731 | 39694655 | – | ENST00000347580; ENST00000379853; ENST00000265708; ENST00000521880 | TAF |
| 39% | chr11 | 49228772 | 49228638 | – | chr11 | 49227724 | 49227619 | – | ENST00000256999; ENST00000356696; ENST00000525826; ENST00000340334; ENST00000533034 | TAF |
| 39% | chr11 | 49228772 | 49228638 | – | chr11 | 49227724 | 49227619 | – | ENST00000256999; ENST00000356696; ENST00000525826; ENST00000340334; ENST00000533034 | TAF |
| 39% | chr11 | 49228772 | 49228638 | – | chr11 | 49227724 | 49227619 | – | ENST00000256999; ENST00000356696; ENST00000525826; ENST00000340334; ENST00000533034 | TAF |
| 28% | chr10 | 135190204 | 135190164 | – | chr10 | 135184261 | 135184064 | – | ENST00000368547 | TAF |
| 26% | chr10 | 100147690 | 100147622 | – | chr10 | 100147064 | 100146958 | – | ENST00000370575 | TAF |
| 25% | chr1 | 40748073 | 40748159 | + | chr1 | 40751597 | 40751701 | + | ENST00000372759 | TAF |
| 23% | chr5 | 34006954 | 34006915 | – | chr5 | 34006004 | 34005861 | – | ENST00000335606; ENST00000382072; ENST00000382079; ENST00000506639; ENST00000382085; ENST00000502637; ENST00000441713; ENST00000426255; ENST00000512079; ENST00000382068 | TSF |
| 23% | chr5 | 34006954 | 34006915 | – | chr5 | 34006004 | 34005861 | – | ENST00000335606; ENST00000382072; ENST00000382079; ENST00000506639; ENST00000382085; ENST00000502637; ENST00000441713; ENST00000426255; ENST00000512079; ENST00000382068 | TSF |
| 23% | chr5 | 34006954 | 34006915 | – | chr5 | 34006004 | 34005861 | – | ENST00000335606; ENST00000382072; ENST00000382079; ENST00000506639; ENST00000382085; ENST00000502637; ENST00000441713; ENST00000426255; ENST00000512079; ENST00000382068 | TSF |
| 23% | chr5 | 34006954 | 34006915 | – | chr5 | 34006004 | 34005861 | – | ENST00000335606; ENST00000382072; ENST00000382079; ENST00000506639; ENST00000382085; ENST00000502637; ENST00000441713; ENST00000426255; ENST00000512079; ENST00000382068 | TSF |
| 23% | chr5 | 34006954 | 34006915 | – | chr5 | 34006004 | 34005861 | – | ENST00000335606; ENST00000382072; ENST00000382079; ENST00000506639; ENST00000382085; ENST00000502637; ENST00000441713; ENST00000426255; ENST00000512079; ENST00000382068 | TSF |
| 23% | chr5 | 34006954 | 34006915 | – | chr5 | 34006004 | 34005861 | – | ENST00000335606; ENST00000382072; ENST00000382079; ENST00000506639; ENST00000382085; ENST00000502637; ENST00000441713; ENST00000426255; ENST00000512079; ENST00000382068 | TSF |

TABLE 50-continued

Transcript fusion for Prostate Adenocarcinoma (PRAD) Coordinates of the fusion sequences for which the donor is the T

| 1 | 2' | 3' | 4' | 5' | 6' | 7' | 8' | 9' | 10' | 11' |
|---|---|---|---|---|---|---|---|---|---|---|
| 23% | chr5 | 34006954 | 34006915 | – | chr5 | 34006004 | 34005861 | – | ENST00000335606; ENST00000382072; ENST00000382079; ENST00000506639; ENST00000382085; ENST00000502637; ENST00000441713; ENST00000426255; ENST00000512079; ENST00000382068 | TSF |
| 23% | chr5 | 34006954 | 34006915 | – | chr5 | 34006004 | 34005861 | – | ENST00000335606; ENST00000382072; ENST00000382079; ENST00000506639; ENST00000382085; ENST00000502637; ENST00000441713; ENST00000426255; ENST00000512079; ENST00000382068 | TSF |
| 23% | chr5 | 34006954 | 34006915 | – | chr5 | 34006004 | 34005861 | – | ENST00000335606; ENST00000382072; ENST00000382079; ENST00000506639; ENST00000382085; ENST00000502637; ENST00000441713; ENST00000426255; ENST00000512079; ENST00000382068 | TSF |
| 22% | chr19 | 49121994 | 49121817 | – | chr19 | 49121134 | 49121048 | – | ENST00000549920; ENST00000547897; ENST00000084795; ENST00000550645; ENST00000549370; ENST00000549273 | TAF |
| 22% | chr19 | 49121994 | 49121817 | – | chr19 | 49121134 | 49121048 | – | ENST00000549920; ENST00000547897; ENST00000084795; ENST00000550645; ENST00000549370; ENST00000549273 | TAF |
| 22% | chr19 | 49121994 | 49121817 | – | chr19 | 49121134 | 49121048 | – | ENST00000549920; ENST00000547897; ENST00000084795; ENST00000550645; ENST00000549370; ENST00000549273 | TFA |
| 22% | chr19 | 49121994 | 49121817 | – | chr19 | 49121134 | 49121048 | – | ENST00000549920; ENST00000547897; ENST00000084795; ENST00000550645; ENST00000549370; ENST00000549273 | TAF |
| 22% | chr19 | 49121994 | 49121817 | – | chr19 | 49121134 | 49121048 | – | ENST00000549920; ENST00000547897; ENST00000084795; ENST00000550645; ENST00000549370; ENST00000549273 | TAF |
| 22% | chr10 | 120902016 | 120901765 | – | chr10 | 120900831 | 120900754 | – | ENST00000355697; ENST00000330036 | TAF |
| 21% | chr7 | 89911392 | 89911485 | + | chr7 | 89912206 | 89912370 | + | ENST00000316089; ENST00000389297; ENST00000497910; ENST00000457170; ENST00000449577 | TAF |
| 21% | chr7 | 89911392 | 89911485 | + | chr7 | 89912206 | 89912370 | + | ENST00000316089; ENST00000389297; ENST00000497910; ENST00000457170; ENST00000449577 | TAF |
| 21% | chr7 | 89911392 | 89911485 | + | chr7 | 89912206 | 89912370 | + | ENST00000316089; ENST00000389297; ENST00000497910; ENST00000457170; ENST00000449577 | TAF |
| 19% | chr1 | 40781678 | 40781517 | – | chr1 | 40781336 | 40781262 | – | ENST00000372748; ENST00000417105; ENST00000372736 | TAF |
| 19% | chr1 | 40781678 | 40781517 | – | chr1 | 40781336 | 40781262 | – | ENST00000372748; ENST00000417105; ENST00000372736 | TAF |
| 19% | chr1 | 40781678 | 40781517 | – | chr1 | 40781336 | 40781262 | – | ENST00000372748; ENST00000417105; ENST00000372736 | TAF |
| 18% | chr5 | 34010561 | 34010259 | – | chr5 | 34006004 | 34005861 | – | ENST00000335606; ENST00000382072; ENST00000382079; ENST00000506639; ENST00000382085; ENST00000502637; ENST00000441713; ENST00000426255; ENST00000512079; ENST00000382068 | TSF |
| 18% | chr5 | 34010561 | 34010259 | – | chr5 | 34006004 | 34005861 | – | ENST00000335606; ENST00000382072; ENST00000382079; ENST00000506639; ENST00000382085; ENST00000502637; ENST00000441713; ENST00000426255; ENST00000512079; ENST00000382068 | TSF |
| 18% | chr5 | 34010561 | 34010259 | – | chr5 | 34006004 | 34005861 | – | ENST00000335606; ENST00000382072; ENST00000382079; ENST00000506639; ENST00000382085; ENST00000502637; ENST00000441713; ENST00000426255; ENST00000512079; ENST00000382068 | TSF |
| 18% | chr5 | 34010561 | 34010259 | – | chr5 | 34006004 | 34005861 | – | ENST00000335606; ENST00000382072; ENST00000382079; ENST00000506639; ENST00000382085; ENST00000502637; ENST00000441713; ENST00000426255; ENST00000512079; ENST00000382068 | TSF |
| 18% | chr5 | 34010561 | 34010259 | – | chr5 | 34006004 | 34005861 | – | ENST00000335606; ENST00000382072; ENST00000382079; ENST00000506639; ENST00000382085; ENST00000502637; ENST00000441713; ENST00000426255; ENST00000512079; ENST00000382068 | TSF |
| 18% | chr5 | 34010561 | 34010259 | – | chr5 | 34006004 | 34005861 | – | ENST00000335606; ENST00000382072; ENST00000382079; ENST00000506639; ENST00000382085; ENST00000502637; ENST00000441713; ENST00000426255; ENST00000512079; ENST00000382068 | TSF |

TABLE 50-continued

Transcript fusion for Prostate Adenocarcinoma (PRAD) Coordinates of the fusion sequences for which the donor is the T

| 1 | 2' | 3' | 4' | 5' | 6' | 7' | 8' | 9' | 10' | 11' |
|---|---|---|---|---|---|---|---|---|---|---|
| 18% | chr5 | 34010561 | 34010259 | – | chr5 | 34006004 | 34005861 | – | ENST00000335606; ENST00000382072; ENST00000382079; ENST00000506639; ENST00000382085; ENST00000502637; ENST00000441713; ENST00000426255; ENST00000512079; ENST00000382068 | TSF |
| 18% | chr5 | 34010561 | 34010259 | – | chr5 | 34006004 | 34005861 | – | ENST00000335606; ENST00000382072; ENST00000382079; ENST00000506639; ENST00000382085; ENST00000502637; ENST00000441713; ENST00000426255; ENST00000512079; ENST00000382068 | TSF |
| 18% | chr5 | 34010561 | 34010259 | – | chr5 | 34006004 | 34005861 | – | ENST00000335606; ENST00000382072; ENST00000382079; ENST00000506639; ENST00000382085; ENST00000502637; ENST00000441713; ENST00000426255; ENST00000512079; ENST00000382068 | TSF |
| 16% | chr11 | 118401084 | 118401227 | + | chr11 | 118401369 | 118401631 | + | ENST00000302783; ENST00000539546 | TAF |
| 16% | chr4 | 147298390 | 147297909 | – | chr4 | 147247148 | 147247113 | – | ENST00000432059; ENST00000335472; ENST00000507030; ENST00000394062 | TAF |
| 16% | chr4 | 147298390 | 147297909 | – | chr4 | 147247148 | 147247113 | – | ENST00000432059; ENST00000335472; ENST00000507030; ENST00000394062 | TAF |
| 16% | chr6 | 34509454 | 345 09380 | – | chr6 | 34508958 | 34508761 | – | ENST00000374037; ENST00000544425 | TAF |
| 16% | chr6 | 34509454 | 34509380 | – | chr6 | 34508958 | 34508761 | – | ENST00000374037; ENST00000544425 | TAF |
| 16% | chr5 | 34010561 | 34010327 | – | chr5 | 34006004 | 34005861 | – | ENST00000335606; ENST00000382072; ENST00000382079; ENST00000506639; ENST00000382085; ENST00000502637; ENST00000441713; ENST00000426255; ENST00000512079; ENST00000382068 | TSF |
| 16% | chr5 | 34010561 | 34010327 | – | chr5 | 34006004 | 34005861 | – | ENST00000335606; ENST00000382072; ENST00000382079; ENST00000506639; ENST00000382085; ENST00000502637; ENST00000441713; ENST00000426255; ENST00000512079; ENST00000382068 | TSF |
| 16% | chr5 | 34010561 | 34010327 | – | chr5 | 34006004 | 34005861 | – | ENST00000335606; ENST00000382072; ENST00000382079; ENST00000506639; ENST00000382085; ENST00000502637; ENST00000441713; ENST00000426255; ENST00000512079; ENST00000382068 | TSF |
| 16% | chr5 | 34010561 | 34010327 | – | chr5 | 34006004 | 34005861 | – | ENST00000335606; ENST00000382072; ENST00000382079; ENST00000506639; ENST00000382085; ENST00000502637; ENST00000441713; ENST00000426255; ENST00000512079; ENST00000382068 | TSF |
| 16% | chr5 | 34010561 | 34010327 | – | chr5 | 34006004 | 34005861 | – | ENST00000335606; ENST00000382072; ENST00000382079; ENST00000506639; ENST00000382085; ENST00000502637; ENST00000441713; ENST00000426255; ENST00000512079; ENST00000382068 | TSF |
| 16% | chr5 | 34010561 | 34010327 | – | chr5 | 34006004 | 34005861 | – | ENST00000335606; ENST00000382072; ENST00000382079; ENST00000506639; ENST00000382085; ENST00000502637; ENST00000441713; ENST00000426255; ENST00000512079; ENST00000382068 | TSF |
| 16% | chr5 | 34010561 | 34010327 | – | chr5 | 34006004 | 34005861 | – | ENST00000335606; ENST00000382072; ENST00000382079; ENST00000506639; ENST00000382085; ENST00000502637; ENST00000441713; ENST00000426255; ENST00000512079; ENST00000382068 | TSF |
| 16% | chr5 | 34010561 | 34010327 | – | chr5 | 34006004 | 34005861 | – | ENST00000335606; ENST00000382072; ENST00000382079; ENST00000506639; ENST00000382085; ENST00000502637; ENST00000441713; ENST00000426255; ENST00000512079; ENST00000382068 | TSF |
| 15% | chr22 | 36007706 | 36007617 | – | chr22 | 36007153 | 36006931; 36007017 | – | ENST00000397326; ENST00000397328; ENST00000359787; ENST00000406324; ENST00000443033; ENST00000451685; ENST00000447607; ENST00000419229 | TAF |
| 15% | chr22 | 36007706 | 36007617 | – | chr22 | 36007153 | 36007017 36006931; | – | ENST00000397326; ENST00000397328; ENST00000359787; ENST00000406324; ENST00000443033; ENST00000451685; ENST00000447607; ENST00000419229 | TAF |
| 15% | chr22 | 36007706 | 36007617 | – | chr22 | 36007153 | 36007017 | – | ENST00000397326; ENST00000397328; | TAF |

TABLE 50-continued

Transcript fusion for Prostate Adenocarcinoma (PRAD) Coordinates of the fusion sequences for which the donor is the T

| 1 | 2' | 3' | 4' | 5' | 6' | 7' | 8' | 9' | 10' | 11' |
|---|---|---|---|---|---|---|---|---|---|---|
| | | | | | | | 36006931; | ENST00000359787; ENST00000406324; ENST00000443033; ENST00000451685; ENST00000447607; ENST00000419229 | |
| 15% | chr22 | 36007706 | 36007617 | − | chr22 | 36007153 | 36007017; 36006931; | − | ENST00000397326; ENST00000397328; ENST00000359787; ENST00000406324; ENST00000443033; ENST00000451685; ENST00000447607; ENST00000419229 | TAF |
| 15% | chr4 | 95574306 | 95574522 | + | chr4 | 95575611 | 95575791 | + | ENST00000437932; ENST00000317968; ENST00000503974; ENST00000542407; ENST00000514743; ENST00000506632 | TAF |
| 15% | chr4 | 95574306 | 95574522 | + | chr4 | 95575611 | 95575791 | + | ENST00000437932; ENST00000317968; ENST00000503974; ENST00000542407; ENST00000514743; ENST00000506632 | TAF |
| 15% | chr4 | 95574306 | 95574522 | + | chr4 | 95575611 | 95575791 | + | ENST00000437932; ENST00000317968; ENST00000503974; ENST00000542407; ENST00000514743; ENST00000506632 | TAF |
| 15% | chr9 | 100831854 | 100832020 | + | chr9 | 100839200 | 100839299 | + | ENST00000210444 | TAF |
| 14% | chr11 | 76630955 | 76631299 | + | chr11 | 76637601 | 76637711; 76637616 | + | ENST00000532485; ENST00000525194; ENST00000525861; ENST00000531461; ENST00000531352; ENST00000278544 | TAF |
| 14% | chr11 | 76630955 | 76631299 | + | chr11 | 76637601 | 76637711; 76637616 | + | ENST00000532485; ENST00000525194; ENST00000525861; ENST00000531461; ENST00000531352; ENST00000278544 | TAF |
| 14% | chr11 | 76630955 | 76631299 | + | chr11 | 76637601 | 76637711; 76637616 | + | ENST00000532485; ENST00000525194; ENST00000525861; ENST00000531461; ENST00000531352; ENST00000278544 | TAF |
| 14% | chr11 | 76630955 | 76631299 | + | chr11 | 76637601 | 76637711; 76637616 | + | ENST00000532485; ENST00000525194; ENST00000525861; ENST00000531461; ENST00000531352; ENST00000278544 | TAF |
| 14% | chr11 | 76630955 | 76631299 | + | chr11 | 76637601 | 76637711; 76637616 | + | ENST00000532485; ENST00000525194; ENST00000525861; ENST00000531461; ENST00000531352; ENST00000278544 | TAF |
| 14% | chr14 | 52930122 | 52929530 | − | chr14 | 52923892 | 52923808 | − | ENST00000281741 | TAF |
| 14% | chr14 | 24631729 | 24631779 | + | chr14 | 24632175 | 24632358; 24632191 | + | ENST00000396864; ENST00000561342; ENST00000559284; ENST00000560275; ENST00000560852 | TAF |
| 14% | chr14 | 24631729 | 24631779 | + | chr14 | 24632175 | 24632358; 24632191 | + | ENST00000396864; ENST00000561342; ENST00000559284; ENST00000560275; ENST00000560852 | TAF |
| 14% | chr14 | 24631729 | 24631779 | + | chr14 | 24632175 | 24632358; 24632191 | + | ENST00000396864; ENST00000561342; ENST00000559284; ENST00000560275; ENST00000560852 | TAF |
| 14% | chr14 | 24631729 | 24631779 | + | chr14 | 24632175 | 24632358; 24632191 | + | ENST00000396864; ENST00000561342; ENST00000559284; ENST00000560275; ENST00000560852 | TAF |
| 14% | chr5 | 34007349 | 34007048 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TSF |
| 14% | chr5 | 34007349 | 34007048 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TSF |
| 14% | chr5 | 34007349 | 34007048 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TSF |
| 14% | chr5 | 34007349 | 34007048 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TSF |
| 14% | chr5 | 34007349 | 34007048 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TSF |
| 14% | chr5 | 34007349 | 34007048 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TSF |
| 14% | chr5 | 34007349 | 34007048 | − | chr5 | 34006004 | 34005861 | − | ENST00000335606; ENST00000382072; | TSF |

TABLE 50-continued

Transcript fusion for Prostate Adenocarcinoma (PRAD) Coordinates of the fusion sequences for which the donor is the T

| 1 | 2' | 3' | 4' | 5' | 6' | 7' | 8' | 9' | 10' | 11' |
|---|---|---|---|---|---|---|---|---|---|---|
| 14% | chr5 | 34007349 | 34007048 | − | chr5 | 34006004 | 34005861 | − | ENST00000382079; ENST00000506639; ENST00000382085; ENST00000502637; ENST00000441713; ENST00000426255; ENST00000512079; ENST00000382068 ENST00000335606; ENST00000382072; ENST00000382079; ENST00000506639; ENST00000382085; ENST00000502637; ENST00000441713; ENST00000426255; ENST00000512079; ENST00000382068 | TSF |
| 14% | chr5 | 34007349 | 34007048 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TSF |
| 13% | chr21 | 44307009 | 44307069 | + | chr21 | 44317037 | 44317157 | + | ENST00000354250; ENST00000340344 | TAF |
| 13% | chr21 | 44307009 | 44307069 | + | chr21 | 44317037 | 44317157 | + | ENST00000354250; ENST00000340344 | TAF |
| 12% | chr5 | 70927667 | 70927725 | + | chr5 | 70927948 | 70928012 | + | ENST00000512218; ENST00000340941; ENST00000509358; ENST00000323375; ENST00000509539 | TAF |
| 12% | chr5 | 70927667 | 70927725 | + | chr5 | 70927948 | 70928012 | + | ENST00000512218; ENST00000340941; ENST00000509358; ENST00000323375; ENST00000509539 | TAF |
| 12% | chr5 | 70927667 | 70927725 | + | chr5 | 70927948 | 70928012 | + | ENST00000512218; ENST00000340941; ENST00000509358; ENST00000323375; ENST00000509539 | TAF |
| 12% | chr5 | 70927667 | 70927725 | + | chr5 | 70927948 | 70928012 | + | ENST00000512218; ENST00000340941; ENST00000509358; ENST00000323375; ENST00000509539 | TAF |
| 12% | chr6 | 111205094 | 111205591 | + | chr6 | 111208708 | 111208794 | + | ENST00000368885 | TAF |
| 12% | chr21 | 42882831 | 42882786 | − | chr21 | 42870116 | 42870046 | − | ENST00000398585 | TAF |
| 12% | chr13 | 95757645 | 95757300 | − | chr13 | 95748433 | 95748389 | − | ENST00000536256; ENST00000431522 | TSF |
| 12% | chr3 | 131480308 | 131308085 | − | chr3 | 131306426 | 131306328 | − | ENST00000512055; ENST00000429747; ENST00000512332; ENST00000511604; ENST00000502818 | TSF |
| 12% | chr13 | 24331567 | 24331229 | − | chr13 | 24330757 | 24330684 | − | ENST00000433710; ENST00000382172 | TSF |
| 12% | chr13 | 24331567 | 24331229 | − | chr13 | 24330757 | 24330684 | − | ENST00000433710; ENST00000382172 | TSF |
| 11% | chr19 | 51340308 | 51340387 | + | chr19 | 51359496 | 51359655 | + | ENST00000326003; ENST00000422986; ENST00000597483; ENST00000593997; ENST00000595392; ENST00000595952; ENST00000360617; ENST00000598145 | TAF |
| 11% | chr19 | 51340308 | 51340387 | + | chr19 | 51359496 | 51359655 | + | ENST00000326003; ENST00000422986; ENST00000597483; ENST00000593997; ENST00000595392; ENST00000595952; ENST00000360617; ENST00000598145 | TAF |
| 11% | chr19 | 51340308 | 51340387 | + | chr19 | 51359496 | 51359655 | + | ENST00000326003; ENST00000422986; ENST00000597483; ENST00000593997; ENST00000595392; ENST00000595952; ENST00000360617; ENST00000598145 | TAF |
| 11% | chr19 | 51340308 | 51340387 | + | chr19 | 51359496 | 51359655 | + | ENST00000326003; ENST00000422986; ENST00000597483; ENST00000593997; ENST00000595392; ENST00000595952; ENST00000360617; ENST00000598145 | TAF |
| 11% | chr19 | 51340308 | 51340387 | + | chr19 | 51359496 | 51359655 | + | ENST00000326003; ENST00000422986; ENST00000597483; ENST00000593997; ENST00000595392; ENST00000595952; ENST00000360617; ENST00000598145 | TAF |
| 11% | chr19 | 51340308 | 51340387 | + | chr19 | 51359496 | 51359655 | + | ENST00000326003; ENST00000422986; ENST00000597483; ENST00000593997; ENST00000595392; ENST00000595952; ENST00000360617; ENST00000598145 | TAF |
| 11% | chr19 | 51340308 | 51340387 | + | chr19 | 51359496 | 51359655 | + | ENST00000326003; ENST00000422986; ENST00000597483; ENST00000593997; ENST00000595392; ENST00000595952; ENST00000360617; ENST00000598145 | TAF |
| 11% | chr19 | 51340308 | 51340387 | + | chr19 | 51359496 | 51359655 | + | ENST00000326003; ENST00000422986; ENST00000597483; ENST00000593997; ENST00000595392; ENST00000595952; ENST00000360617; ENST00000598145 | TAF |
| 11% | chr5 | 54722535 | 54722306 | − | chr5 | 54721867 | 54721691 | − | ENST00000264775; ENST00000307259 | TAF |
| 11% | chr8 | 82194688 | 82194727 | + | chr8 | 82195601 | 82195773 | + | ENST00000297258 | TAF |
| 11% | chr21 | 42884787 | 42883790 | − | chr21 | 42861520 | 42861434 | − | ENST00000332149; ENST00000398585; ENST00000458356; ENST00000454499; ENST00000424093 | TSF |
| 11% | chr21 | 42884787 | 42883790 | − | chr21 | 42861520 | 42861434 | − | ENST00000332149; ENST00000398585; ENST00000458356; ENST00000454499; ENST00000424093 | TSF |

TABLE 50-continued

Transcript fusion for Prostate Adenocarcinoma (PRAD) Coordinates of the fusion sequences for which the donor is the T

| 1 | 2' | 3' | 4' | 5' | 6' | 7' | 8' | 9' | 10' | 11' |
|---|---|---|---|---|---|---|---|---|---|---|
| 11% | chr21 | 42884787 | 42883790 | – | chr21 | 42861520 | 42861434 | – | ENST00000332149; ENST00000398585; ENST00000458356; ENST00000454499; ENST00000424093 | TSF |
| 11% | chr21 | 42884787 | 42883790 | – | chr21 | 42866505 | 42866283 | – | ENST00000332149; ENST00000398585; ENST00000458356; ENST00000454499; ENST00000424093; ENST00000455813 | TSF |
| 11% | chr21 | 42884787 | 42883790 | – | chr21 | 42866505 | 42866283 | – | ENST00000332149; ENST00000398585; ENST00000458356; ENST00000454499; ENST00000424093; ENST00000455813 | TSF |
| 11% | chr21 | 42884787 | 42883790 | – | chr21 | 42866505 | 42866283 | – | ENST00000332149; ENST00000398585; ENST00000458356; ENST00000454499; ENST00000424093; ENST00000455813 | TSF |
| 11% | chr21 | 42884787 | 42883790 | – | chr21 | 42866505 | 42866283 | – | ENST00000332149; ENST00000398585; ENST00000458356; ENST00000454499; ENST00000424093; ENST00000455813 | TSF |
| 11% | chr2 | 192947147 | 192946999 | – | chr2 | 192922501 | 192922405 | – | ENST00000392314; ENST00000272771 | TSF |
| 11% | chr2 | 192947147 | 192946999 | – | chr2 | 192922501 | 192922405 | – | ENST00000392314; ENST00000272771 | TSF |
| 10% | chr17 | 79057181 | 79057207 | + | chr17 | 79058632 | 79058693 | + | ENST00000575750; ENST00000575989; ENST00000321280; ENST00000572329; ENST00000428708; ENST00000575712; ENST00000575245; ENST00000435091; ENST00000321300; ENST00000571530; ENST00000572918; ENST00000575958; ENST00000573659; ENST00000572073; ENST00000573677; ENST00000574804 | TAF |
| 10% | chr17 | 79057181 | 79057207 | + | chr17 | 79058632 | 79058693 | + | ENST00000575750; ENST00000575989; ENST00000321280; ENST00000572329; ENST00000428708; ENST00000575712; ENST00000575245; ENST00000435091; ENST00000321300; ENST00000571530; ENST00000572918; ENST00000575958; ENST00000573659; ENST00000572073; ENST00000573677; ENST00000574804 | TAF |
| 10% | chr17 | 79057181 | 79057207 | + | chr17 | 79058632 | 79058693 | + | ENST00000575750; ENST00000575989; ENST00000321280; ENST00000572329; ENST00000428708; ENST00000575712; ENST00000575245; ENST00000435091; ENST00000321300; ENST00000571530; ENST00000572918; ENST00000575958; ENST00000573659; ENST00000572073; ENST00000573677; ENST00000574804 | TAF |
| 10% | chr17 | 79057181 | 79057207 | + | chr17 | 79058632 | 79058693 | + | ENST00000575750; ENST00000575989; ENST00000321280; ENST00000572329; ENST00000428708; ENST00000575712; ENST00000575245; ENST00000435091; ENST00000321300; ENST00000571530; ENST00000572918; ENST00000575958; ENST00000573659; ENST00000572073; ENST00000573677; ENST00000574804 | TAF |
| 10% | chr17 | 79057181 | 79057207 | + | chr17 | 79058632 | 79058693 | + | ENST00000575750; ENST00000575989; ENST00000321280; ENST00000572329; ENST00000428708; ENST00000575712; ENST00000575245; ENST00000435091; ENST00000321300; ENST00000571530; ENST00000572918; ENST00000575958; ENST00000573659; ENST00000572073; ENST00000573677; ENST00000574804 | TAF |
| 10% | chr17 | 79057181 | 79057207 | + | chr17 | 79058632 | 79058693 | + | ENST00000575750; ENST00000575989; ENST00000321280; ENST00000572329; ENST00000428708; ENST00000575712; ENST00000575245; ENST00000435091; ENST00000321300; ENST00000571530; ENST00000572918; ENST00000575958; ENST00000573659; ENST00000572073; ENST00000573677; ENST00000574804 | TAF |
| 10% | chr17 | 79057181 | 79057207 | + | chr17 | 79058632 | 79058693 | + | ENST00000575750; ENST00000575989; ENST00000321280; ENST00000572329; ENST00000428708; ENST00000575712; ENST00000575245; ENST00000435091; ENST00000321300; ENST00000571530; ENST00000572918; ENST00000575958; ENST00000573659; ENST00000572073; ENST00000573677; ENST00000574804 | TAF |
| 10% | chr17 | 79057181 | 79057207 | + | chr17 | 79058632 | 79058693 | + | ENST00000575750; ENST00000575989; ENST00000321280; ENST00000572329; ENST00000428708; ENST00000575712; | TAF |

TABLE 50-continued

Transcript fusion for Prostate Adenocarcinoma (PRAD) Coordinates of the fusion sequences for which the donor is the T

| 1 | 2' | 3' | 4' | 5' | 6' | 7' | 8' | 9' | 10' | 11' |
|---|---|---|---|---|---|---|---|---|---|---|
| 10% | chr17 | 79057181 | 79057207 | + | chr17 | 79058632 | 79058693 | + | ENST00000575245; ENST00000435091; ENST00000321300; ENST00000571530; ENST00000572918; ENST00000575958; ENST00000573659; ENST00000572073; ENST00000573677; ENST00000574804 ENST00000575750; ENST00000575989; ENST00000321280; ENST00000572329; ENST00000428708; ENST00000575712; | TAF |
| 10% | chr17 | 79057181 | 79057207 | + | chr17 | 79058632 | 79058693 | + | ENST00000575245; ENST00000435091; ENST00000321300; ENST00000571530; ENST00000572918; ENST00000575958; ENST00000573659; ENST00000572073; ENST00000573677; ENST00000574804 ENST00000575750; ENST00000575989; ENST00000321280; ENST00000572329; ENST00000428708; ENST00000575712; | TAF |
| 10% | chr17 | 79057181 | 79057207 | + | chr17 | 79058632 | 79058693 | + | ENST00000575245; ENST00000435091; ENST00000321300; ENST00000571530; ENST00000572918; ENST00000575958; ENST00000573659; ENST00000572073; ENST00000573677; ENST00000574804 ENST00000575750; ENST00000575989; ENST00000321280; ENST00000572329; ENST00000428708; ENST00000575712; | TAF |
| 10% | chr17 | 79057181 | 79057207 | + | chr17 | 79058632 | 79058693 | + | ENST00000575245; ENST00000435091; ENST00000321300; ENST00000571530; ENST00000572918; ENST00000575958; ENST00000573659; ENST00000572073; ENST00000573677; ENST00000574804 ENST00000575750; ENST00000575989; ENST00000321280; ENST00000572329; ENST00000428708; ENST00000575712; | TAF |
| 10% | chr17 | 79057181 | 79057207 | + | chr17 | 79058632 | 79058693 | + | ENST00000575245; ENST00000435091; ENST00000321300; ENST00000571530; ENST00000572918; ENST00000575958; ENST00000573659; ENST00000572073; ENST00000573677; ENST00000574804 ENST00000575750; ENST00000575989; ENST00000321280; ENST00000572329; ENST00000428708; ENST00000575712; | TAF |
| 10% | chr17 | 79057181 | 79057207 | + | chr17 | 79058632 | 79058693 | + | ENST00000575245; ENST00000435091; ENST00000321300; ENST00000571530; ENST00000572918; ENST00000575958; ENST00000573659; ENST00000572073; ENST00000573677; ENST00000574804 | TAF |
| 10% | chr12 | 64687157 | 64687061 | − | chr12 | 64679840 | 64679734 | − | ENST00000543942; ENST00000333722 | TAF |
| 8% | chr13 | 95757645 | 57395700 | − | chr13 | 95735544 | 95735394 | − | ENST00000412704; ENST00000376887 | TSF |
| 8% | chr19 | 51410961 | 51410894 | − | chr19 | 51410342 | 51410190; 51410338 | − | ENST00000324041; ENST00000431178 | TSF |
| 8% | chr19 | 51410961 | 51410894 | − | chr19 | 51410342 | 51410190; 51410338 | − | ENST00000324041; ENST00000431178 | TSF |
| 7% | chrX | 123618682 | 123617816 | − | chrX | 123615814 | 123615582 | − | ENST00000371130; ENST00000422452 | TSF |
| 6% | chr20 | 45337040 | 45337192 | + | chr20 | 45353680 | 45354963 | + | ENST00000359271 | TSF |
| 6% | chr19 | 51360137 | 51360236 | + | chr19 | 51361285 | 51361342; 51361571; 51361430; 51361589 | + | ENST00000601503; ENST00000326003; ENST00000422986; ENST00000597286; ENST00000593997; ENST00000595392; ENST00000360617; ENST00000598145 | TSF |
| 6% | chr19 | 51360137 | 51360236 | + | chr19 | 51361285 | 51361571; 51361342; 51361430; 51361589 | + | ENST00000601503; ENST00000326003; ENST00000422986; ENST00000597286; ENST00000593997; ENST00000595392; ENST00000360617; ENST00000598145 | TSF |
| 6% | chr19 | 51360137 | 51360236 | + | chr19 | 51361285 | 51361571; 51361342; 51361430; 51361589 | + | ENST00000601503; ENST00000326003; ENST00000422986; ENST00000597286; ENST00000593997; ENST00000595392; ENST00000360617; ENST00000598145 | TSF |
| 6% | chr19 | 51360137 | 51360236 | + | chr19 | 51361285 | 51361571; 51361342; 51361430; | + | ENST00000601503; ENST00000326003; ENST00000422986; ENST00000597286; ENST00000593997; ENST00000595392; | TSF |

TABLE 50-continued

Transcript fusion for Prostate Adenocarcinoma (PRAD) Coordinates of the fusion sequences for which the donor is the T

| 1 | 2' | 3' | 4' | 5' | 6' | 7' | 8' | 9' | 10' | 11' |
|---|---|---|---|---|---|---|---|---|---|---|
| 6% | chr19 | 51360137 | 51360236 | + | chr19 | 51361285 | 51361589 51361342; 51361571; 51361430; 51361589 | + | ENST00000360617; ENST00000598145 ENST00000601503; ENST00000326003; ENST00000422986; ENST00000597286; ENST00000593997; ENST00000595392 | TSF |
| 6% | chr19 | 51360137 | 51360236 | + | chr19 | 51361285 | 51361571; 51361342; 51361430; 51361589 | + | ENST00000360617; ENST00000598145 ENST00000601503; ENST00000326003; ENST00000422986; ENST00000597286; ENST00000593997; ENST00000595392 | TSF |
| 6% | chr19 | 51360137 | 51360236 | + | chr19 | 51361285 | 51361342; 51361571; 51361430; 51361589 | + | ENST00000360617; ENST00000598145 ENST00000601503; ENST00000326003; ENST00000422986; ENST00000597286; ENST00000593997; ENST00000595392 | TSF |
| 6% | chr19 | 51360137 | 51360236 | + | chr19 | 51361285 | 51361342; 51361571; 51361430; 51361589 | + | ENST00000360617; ENST00000598145 ENST00000601503; ENST00000326003; ENST00000422986; ENST00000597286; ENST00000593997; ENST00000595392 | TSF |
| 6% | chr16 | 28932484 | 28932384 | − | chr16 | 28931264 | 28931107 | − | ENST00000357573; ENST00000358201; ENST00000544477; ENST00000568703; ENST00000567483 | TSF |
| 6% | chr16 | 28932484 | 28932384 | − | chr16 | 28931264 | 28931107 | − | ENST00000357573; ENST00000358201; ENST00000544477; ENST00000568703; ENST00000567483 | TSF |
| 6% | chr16 | 28932484 | 28932384 | − | chr16 | 28931264 | 28931107 | − | ENST00000357573; ENST00000358201; ENST00000544477; ENST00000568703; ENST00000567483 | TSF |
| 6% | chr16 | 28932484 | 28932384 | − | chr16 | 28931264 | 28931107 | − | ENST00000357573; ENST00000358201; ENST00000544477; ENST00000568703; ENST00000567483 | TSF |
| 5% | chr2 | 207633144 | 207633327 | + | chr2 | 207634815 | 207634918 | + | ENST00000236980; ENST00000402774; ENST00000403094 | TSF |
| 5% | chr21 | 42884787 | 42883790 | − | chr21 | 42852529 | 42852403 | − | ENST00000332149; ENST00000398585; ENST00000458356; ENST00000454499; ENST00000424093 | TSF |
| 5% | chr21 | 42884787 | 42883790 | − | chr21 | 42852529 | 42852403 | − | ENST00000332149; ENST00000398585; ENST00000458356; ENST00000454499; ENST00000424093 | TSF |
| 5% | chr21 | 42884787 | 42883790 | − | chr21 | 42852529 | 42852403 | − | ENST00000332149; ENST00000398585; ENST00000458356; ENST00000454499; ENST00000424093 | TSF |
| 5% | chr5 | 120012572 | 120012614 | + | chr5 | 120021649 | 120022404 | + | ENST00000407149; ENST00000379551 | TSF |
| 4% | chr13 | 95887439 | 95887439 | − | chr13 | 95887088 | 95886864 | − | ENST00000412704; ENST00000376887; ENST00000431522 | TSF |
| 4% | chr13 | 95887439 | 95887439 | − | chr13 | 95887088 | 95886864 | − | ENST00000412704; ENST00000376887; ENST00000431522 | TSF |
| 4% | chr13 | 95887439 | 95887439 | − | chr13 | 95887088 | 95886864 | − | ENST00000412704; ENST00000376887; ENST00000431522 | TSF |
| 4% | chr5 | 70911418 | 70912053 | + | chr5 | 70922467 | 70922580 | + | ENST00000340941; ENST00000509358 | TSF |
| 4% | chr5 | 70911418 | 12070953 | + | chr5 | 70922467 | 70922580 | + | ENST00000340941; ENST00000509358 | TSF |
| 4% | chr1 | 222838237 | 222838312 | + | chr1 | 222838651 | 222838961 | + | ENST00000344922; ENST00000344441; ENST00000340535 | TSF |
| 4% | chr21 | 44193636 | 44193728 | + | chr21 | 44195390 | 44195403 | + | ENST00000335512; ENST00000539837; ENST00000291539; ENST00000328862; ENST00000335440; ENST00000380328; ENST00000398225; ENST00000398227; ENST00000398229; ENST00000398232; ENST00000398234; ENST00000398236; ENST00000349112; ENST00000398224 | TSF |
| 4% | chr3 | 9823188 | 9823088 | − | chr3 | 9822233 | 9822041 | − | ENST00000301964; ENST00000440161 | TSF |
| 4% | chr6 | 111198749 | 111198849 | + | chr6 | 111208708 | 111208794 | + | ENST00000368885 | TSF |
| 4% | chr1 | 213316012 | 213316144 | + | chr1 | 213341201 | 213341316 | + | ENST00000543470; ENST00000366959; ENST00000366960 | TSF |
| 4% | chr1 | 213316012 | 213316144 | + | chr1 | 213341201 | 213341316 | + | ENST00000543470; ENST00000366959; ENST00000366960 | TSF |
| 3% | chr5 | 33993714 | 33993278 | − | chr5 | 33989607 | 33989198; 33989589; 33989216 | − | ENST00000335606; ENST00000382072; ENST00000382085; ENST00000502637 | TSF |
| 3% | chr5 | 33993714 | 33993278 | − | chr5 | 33989607 | 33989198; 33989589; 33989216 | − | ENST00000335606; ENST00000382072; ENST00000382085; ENST00000502637 | TSF |
| 3% | chr5 | 33993714 | 33993278 | − | chr5 | 33989607 | 33989198; 33989589; 33989216 | − | ENST00000335606; ENST00000382072; ENST00000382085; ENST00000502637 | TSF |
| 3% | chr5 | 33993714 | 33993278 | − | chr5 | 33989607 | 33989198; 33989589; 33989216 | − | ENST00000335606; ENST00000382072; ENST00000382085; ENST00000502637 | TSF |

TABLE 50-continued

Transcript fusion for Prostate Adenocarcinoma (PRAD) Coordinates of the fusion sequences for which the donor is the T

| 1 | 2' | 3' | 4' | 5' | 6' | 7' | 8' | 9' | 10' | 11' |
|---|---|---|---|---|---|---|---|---|---|---|
| 3% | chr5 | 33993714 | 33993278 | − | chr5 | 33989607 | 33989198; 33989589; 33989216 | − | ENST00000335606; ENST00000382072; ENST00000382085; ENST00000502637 | TSF |
| 3% | chr5 | 33993714 | 33993278 | − | chr5 | 33989607 | 33989198; 33989589; 33989216 | − | ENST00000335606; ENST00000382072; ENST00000382085; ENST00000502637 | TSF |
| 3% | chr5 | 70911418 | 70912053 | + | chr5 | 70927948 | 70928012 | + | ENST00000512218; ENST00000340941; ENST00000509358; ENST00000323375; ENST00000509539 | TSF |
| 3% | chr5 | 70911418 | 70912053 | + | chr5 | 70927948 | 70928012 | + | ENST00000512218; ENST00000340941; ENST00000509358; ENST00000323375; ENST00000509539 | TSF |
| 3% | chr5 | 70911418 | 70912053 | + | chr5 | 70927948 | 70928012 | + | ENST00000512218; ENST00000340941; ENST00000509358; ENST00000323375; ENST00000509539 | TSF |
| 3% | chr5 | 70911418 | 70912053 | + | chr5 | 70927948 | 70928012 | + | ENST00000512218; ENST00000340941; ENST00000509358; ENST00000323375; ENST00000509539 | TSF |
| 3% | chr12 | 21426370 | 21426215 | − | chr12 | 21422701 | 21422482 | − | ENST00000307378; ENST00000452078; ENST00000458504; ENST00000537524 | TSF |
| 3% | chr7 | 148982749 | 148982787 | + | chr7 | 148984656 | 148984699; 148984867 | + | ENST00000378052; ENST00000476295; ENST00000418158 | TSF |
| 3% | chr7 | 148982749 | 148982787 | + | chr7 | 148984656 | 148984699; 148984867 | + | ENST00000378052; ENST00000476295; ENST00000418158 | TSF |
| 3% | chr15 | 74004214 | 74004264 | + | chr15 | 74005275 | 74005297 | + | ENST00000318443; ENST00000537340; ENST00000318424; ENST00000564751; ENST00000561176; ENST00000559073 | TSF |
| 3% | chr3 | 4858133 | 4857857 | − | chr3 | 4856115 | 4856088 | − | ENST00000449914; ENST00000441894 | TSF |
| 3% | chr5 | 70945258 | 170945361 | + | chr5 | 70945896 | 70946010 | + | ENST00000340941; ENST00000323375; ENST00000509539 | TSF |
| 3% | chr5 | 70945258 | 70945361 | + | chr5 | 70945896 | 70946010 | + | ENST00000340941; ENST00000323375; ENST00000509539 | TSF |
| 3% | chr14 | 69855378 | 69855278 | − | chr14 | 69853800 | 69853680; 69853676 | − | ENST00000557016; ENST00000555373 | TSF |
| 3% | chr14 | 69855378 | 69855278 | − | chr14 | 69853800 | 69853676 69853680; | − | ENST00000557016; ENST00000555373 | TSF |
| 3% | chr1 | 246478956 | 246478829 | − | chr1 | 246093239 | 246093172; 246093200 | − | ENST00000541742; ENST00000490107; ENST00000388985; ENST00000453676 | TSF |
| 3% | chr1 | 246478956 | 246478829 | − | chr1 | 246093239 | 246093172; 246093200 | − | ENST00000541742; ENST00000490107; ENST00000388985; ENST00000453676 | TSF |
| 3% | chr3 | 4859338 | 4859117 | − | chr3 | 4856115 | 4856088 | − | ENST00000449914; ENST00000441894 | TSF |
| 3% | chr21 | 42882831 | 42882427 | − | chr21 | 42870116 | 42870046 | − | ENST00000398585 | TSF |
| 2% | chr3 | 132047242 | 132047426 | + | chr3 | 132050491 | 132050577 | + | ENST00000336375; ENST00000475741; ENST00000351273 | TSF |
| 2% | chr3 | 132047242 | 132047426 | + | chr3 | 132050491 | 132050577 | + | ENST00000336375; ENST00000475741; ENST00000351273 | TSF |
| 2% | chr3 | 132047242 | 132047426 | + | chr3 | 132050491 | 132050577 | + | ENST00000336375; ENST00000475741; ENST00000351273 | TSF |
| 2% | chr17 | 72951257 | 72951178 | − | chr17 | 72950460 | 72950233 | − | ENST00000425042 | TSF |
| 2% | chr14 | 68160667 | 68160511 | − | chr14 | 68159769 | 68159651; 68159690 | − | ENST00000381346; ENST00000553384; ENST00000428130; ENST00000557273; ENST00000557726 | TSF |
| 2% | chr14 | 68160667 | 68160511 | − | chr14 | 68159769 | 68159651; 68159690 | − | ENST00000381346; ENST00000553384; ENST00000428130; ENST00000557273; ENST00000557726 | TSF |
| 2% | chr14 | 68160667 | 68160511 | − | chr14 | 68159769 | 68159651; 68159690 | − | ENST00000381346; ENST00000553384; ENST00000428130; ENST00000557273; ENST00000557726 | TSF |
| 2% | chr14 | 68160667 | 68160511 | − | chr14 | 68159769 | 68159651; 68159690 | − | ENST00000381346; ENST00000553384; ENST00000428130; ENST00000557273; ENST00000557726 | TSF |
| 2% | chr14 | 68160667 | 68160511 | − | chr14 | 68159769 | 68159651; 68159690 | − | ENST00000381346; ENST00000553384; ENST00000428130; ENST00000557273; ENST00000557726 | TSF |
| 2% | chr11 | 114311118 | 114311184 | + | chr11 | 114311378 | 114311461 | + | ENST00000265881; ENST00000544196; ENST00000539754; ENST00000539275; ENST00000541703; ENST00000538198; ENST00000544827 | TSF |
| 2% | chr11 | 114311118 | 114311184 | + | chr11 | 114311378 | 114311461 | + | ENST00000265881; ENST00000544196; ENST00000539754; ENST00000539275; ENST00000541703; ENST00000538198; ENST00000544827 | TSF |
| 2% | chr11 | 114311118 | 114311184 | + | chr11 | 114311378 | 114311461 | + | ENST00000265881; ENST00000544196; ENST00000539754; ENST00000539275; ENST00000541703; ENST00000538198; ENST00000544827 | TSF |

TABLE 50-continued

Transcript fusion for Prostate Adenocarcinoma (PRAD) Coordinates of the fusion sequences for which the donor is the T

| 1 | 2' | 3' | 4' | 5' | 6' | 7' | 8' | 9' | 10' | 11' |
|---|---|---|---|---|---|---|---|---|---|---|
| 2% | chr11 | 114311118 | 114311184 | + | chr11 | 114311378 | 114311461 | + | ENST00000265881; ENST00000544196; ENST00000539754; ENST00000539275; ENST00000541703; ENST00000538198; ENST00000544827 | TSF |
| 2% | chr11 | 114311118 | 114311184 | + | chr11 | 114311378 | 114311461 | + | ENST00000265881; ENST00000544196; ENST00000539754; ENST00000539275; ENST00000541703; ENST00000538198; ENST00000544827 | TSF |
| 2% | chr11 | 114311118 | 114311184 | + | chr11 | 114311378 | 114311461 | + | ENST00000265881; ENST00000544196; ENST00000539754; ENST00000539275; ENST00000541703; ENST00000538198; ENST00000544827 | TSF |
| 2% | chr16 | 77234898 | 77235039 | + | chr16 | 77240338 | 77240397 | + | ENST00000378644 | TSF |
| 2% | chr19 | 51143477 | 51143477 | + | chr19 | 51159307 | 51159379 | + | ENST00000425202 | TSF |
| 2% | chr1 | 37979411 | 37979373 | − | chr1 | 37979139 | 37979024 | − | ENST00000373075; ENST00000296214; ENST00000373074; ENST00000373073; ENST00000448519 | TSF |
| 2% | chr1 | 37979411 | 37979373 | − | chr1 | 37979139 | 37979024 | − | ENST00000373075; ENST00000296214; ENST00000373074; ENST00000373073; ENST00000448519 | TSF |
| 2% | chr1 | 37979411 | 37979373 | − | chr1 | 37979139 | 37979024 | − | ENST00000373075; ENST00000296214; ENST00000373074; ENST00000373073; ENST00000448519 | TSF |
| 2% | chr1 | 37979411 | 37979373 | − | chr1 | 37979139 | 37979024 | − | ENST00000373075; ENST00000296214; ENST00000373074; ENST00000373073; ENST00000448519 | TSF |
| 2% | chr1 | 37979411 | 37979373 | − | chr1 | 37979139 | 37979024 | − | ENST00000373075; ENST00000296214; ENST00000373074; ENST00000373073; ENST00000448519 | TSF |
| 2% | chr1 | 37979411 | 37979373 | − | chr1 | 37979139 | 37979024 | − | ENST00000373075; ENST00000296214; ENST00000373074; ENST00000373073; ENST00000448519 | TSF |
| 2% | chr1 | 37979411 | 37979373 | − | chr1 | 37979139 | 37979024 | − | ENST00000373075; ENST00000296214; ENST00000373074; ENST00000373073; ENST00000448519 | TSF |
| 2% | chr1 | 37979411 | 37979373 | − | chr1 | 37979139 | 37979024 | − | ENST00000373075; ENST00000296214; ENST00000373074; ENST00000373073; ENST00000448519 | TSF |
| 2% | chr8 | 144691011 | 144690934 | − | chr8 | 144690296 | 144690232 | − | ENST00000220966; ENST00000433751 | TSF |
| 2% | chr8 | 144691011 | 144690934 | − | chr8 | 144690296 | 144690232 | − | ENST00000220966; ENST00000433751 | TSF |
| 2% | chr3 | 132052633 | 132052733 | + | chr3 | 132056300 | 132056398 | + | ENST00000336375; ENST00000495911; ENST00000351273 | TSF |
| 2% | chr3 | 132052633 | 132052733 | + | chr3 | 132056300 | 132056398 | + | ENST00000336375; ENST00000495911; ENST00000351273 | TSF |
| 2% | chr3 | 132052633 | 132052733 | + | chr3 | 132056300 | 132056398 | + | ENST00000336375; ENST00000495911; ENST00000351273 | TSF |
| 2% | chr19 | 51340308 | 51340387 | + | chr19 | 51359590 | 51359655 | + | ENST00000601503; ENST00000326003; ENST00000422986; ENST00000597286; ENST00000597483; ENST00000593997; ENST00000595392; ENST00000595952; ENST00000360617; ENST00000598145 | TSF |
| 2% | chr19 | 51340308 | 51340387 | + | chr19 | 51359590 | 51359655 | + | ENST00000601503; ENST00000326003; ENST00000422986; ENST00000597286; ENST00000597483; ENST00000593997; ENST00000595392; ENST00000595952; ENST00000360617; ENST00000598145 | TSF |
| 2% | chr19 | 51340308 | 51340387 | + | chr19 | 51359590 | 51359655 | + | ENST00000601503; ENST00000326003; ENST00000422986; ENST00000597286; ENST00000597483; ENST00000593997; ENST00000595392; ENST00000595952; ENST00000360617; ENST00000598145 | TSF |
| 2% | chr19 | 51340308 | 51340387 | + | chr19 | 51359590 | 51359655 | + | ENST00000601503; ENST00000326003; ENST00000422986; ENST00000597286; ENST00000597483; ENST00000593997; ENST00000595392; ENST00000595952; ENST00000360617; ENST00000598145 | TSF |
| 2% | chr19 | 51340308 | 51340387 | + | chr19 | 51359590 | 51359655 | + | ENST00000601503; ENST00000326003; ENST00000422986; ENST00000597286; ENST00000597483; ENST00000593997; ENST00000595392; ENST00000595952; ENST00000360617; ENST00000598145 | TSF |
| 2% | chr19 | 51340308 | 51340387 | + | chr19 | 51359590 | 51359655 | + | ENST00000601503; ENST00000326003; ENST00000422986; ENST00000597286; ENST00000597483; ENST00000593997; ENST00000595392; ENST00000595952; ENST00000360617; ENST00000598145 | TSF |

TABLE 50-continued

Transcript fusion for Prostate Adenocarcinoma (PRAD) Coordinates of the fusion sequences for which the donor is the T

| 1 | 2' | 3' | 4' | 5' | 6' | 7' | 8' | 9' | 10' | 11' |
|---|---|---|---|---|---|---|---|---|---|---|
| 2% | chr19 | 51340308 | 51340387 | + | chr19 | 51359590 | 51359655 | + | ENST00000601503; ENST00000326003; ENST00000422986; ENST00000597286; ENST00000597483; ENST00000593997; ENST00000595392; ENST00000595952; ENST00000360617; ENST00000598145 | TSF |
| 2% | chr19 | 51340308 | 51340387 | + | chr19 | 51359590 | 51359655 | + | ENST00000601503; ENST00000326003; ENST00000422986; ENST00000597286; ENST00000597483; ENST00000593997; ENST00000595392; ENST00000595952; ENST00000360617; ENST00000598145 | TSF |
| 2% | chr19 | 51340308 | 51340387 | + | chr19 | 51359590 | 51359655 | + | ENST00000601503; ENST00000326003; ENST00000422986; ENST00000597286; ENST00000597483; ENST00000593997; ENST00000595392; ENST00000595952; ENST00000360617; ENST00000598145 | TSF |
| 2% | chr19 | 51340308 | 51340387 | + | chr19 | 51359590 | 51359655 | + | ENST00000601503; ENST00000326003; ENST00000422986; ENST00000597286; ENST00000597483; ENST00000593997; ENST00000595392; ENST00000595952; ENST00000360617; ENST00000598145 | TSF |
| 2% | chr1 | 222838237 | 222838358 | + | chr1 | 222838651 | 222838961 | + | ENST00000344922; ENST00000344441; ENST00000340535 | TSF |
| 2% | chr2 | 192851958 | 192851903 | − | chr2 | 192821104 | 192820981 | − | ENST00000392314; ENST00000272771 | TSF |
| 2% | chr2 | 192851958 | 192851903 | − | chr2 | 192821104 | 192820981 | − | ENST00000392314; ENST00000272771 | TSF |
| 2% | chr21 | 38273278 | 38272892 | − | chr21 | 38269431 | 38269160 | − | ENST00000336648; ENST00000399120 | TSF |
| 2% | chr22 | 43223671 | 43223414 | − | chr22 | 43223005 | 43222946 | − | ENST00000263245; ENST00000429508; ENST00000437119; ENST00000453516; ENST00000454099 | TSF |
| 2% | chr22 | 43223671 | 43223414 | − | chr22 | 43223005 | 43222946 | − | ENST00000263245; ENST00000429508; ENST00000437119; ENST00000453516; ENST00000454099 | TSF |
| 2% | chr22 | 43223671 | 43223414 | − | chr22 | 43223005 | 43222946 | − | ENST00000263245; ENST00000429508; ENST00000437119; ENST00000453516; ENST00000454099 | TSF |
| 2% | chr2 | 168968104 | 168968047 | − | chr2 | 168931741 | 168931619 | − | ENST00000355999 | TSF |
| 2% | chr11 | 49185698 | 49184098 | − | chr11 | 49179595 | 49179504 | − | ENST00000256999; ENST00000356696; ENST00000343844; ENST00000340334; ENST00000533034 | TSF |
| 2% | chr11 | 49185698 | 49184098 | − | chr11 | 49179595 | 49179504 | − | ENST00000256999; ENST00000356696; ENST00000343844; ENST00000340334; ENST00000533034 | TSF |
| 2% | chr1 | 55349965 | 55349772 | − | chr1 | 55349446 | 55349291 | − | ENST00000371269; ENST00000535035 | TSF |
| 2% | chr7 | 44158417 | 44158351 | − | chr7 | 44157663 | 44157542 | − | ENST00000406581; ENST00000223361; ENST00000452185; ENST00000433715; ENST00000456038; ENST00000418438 | TSF |
| 2% | chr7 | 44158417 | 44158351 | − | chr7 | 44157663 | 44157542 | − | ENST00000406581; ENST00000223361; ENST00000452185; ENST00000433715; ENST00000456038; ENST00000418438 | TSF |
| 2% | chr7 | 44158417 | 44158351 | − | chr7 | 44157663 | 44157542 | − | ENST00000406581; ENST00000223361; ENST00000452185; ENST00000433715; ENST00000456038; ENST00000418438 | TSF |
| 2% | chr7 | 44158417 | 44158351 | − | chr7 | 44157663 | 44157542 | − | ENST00000406581; ENST00000223361; ENST00000452185; ENST00000433715; ENST00000456038; ENST00000418438 | TSF |
| 2% | chr7 | 44158417 | 44158351 | − | chr7 | 44157663 | 44157542 | − | ENST00000406581; ENST00000223361; ENST00000452185; ENST00000433715; ENST00000456038; ENST00000418438 | TSF |
| 2% | chr19 | 51363647 | 51363679 | + | chr19 | 51381765 | 51381815; 51381861 | + | ENST00000325321; ENST00000391810; ENST00000595050 | TSF |
| 2% | chr19 | 51363647 | 51363679 | + | chr19 | 51381765 | 51381815; 51381861 | + | ENST00000325321; ENST00000391810; ENST00000595050 | TSF |
| 2% | chrX | 21965424 | 21965489 | + | chrX | 21985314 | 21985434 | + | ENST00000404933; ENST00000379404; ENST00000457085 | TSF |
| 2% | chrX | 21965424 | 21965489 | + | chrX | 21985314 | 21985434 | + | ENST00000404933; ENST00000379404; ENST00000457085 | TSF |
| 2% | chrX | 21965424 | 21965489 | + | chrX | 21985314 | 21985434 | + | ENST00000404933; ENST00000379404; ENST00000457085 | TSF |
| 2% | chr19 | 51360137 | 51360205 | + | chr19 | 51361285 | 51361342; 51361571; 51361430; 51361589 | + | ENST00000601503; ENST00000326003; ENST00000422986; ENST00000597286; ENST00000593997; ENST00000595392; ENST00000360617; ENST00000598145 | TSF |
| 2% | chr19 | 51360137 | 51360205 | + | chr19 | 51361285 | 51361571; 51361342; 51361430; 51361589 | + | ENST00000601503; ENST00000326003; ENST00000422986; ENST00000597286; ENST00000593997; ENST00000595392; ENST00000360617; ENST00000598145 | TSF |
| 2% | chr19 | 51360137 | 51360205 | + | chr19 | 51361285 | 51361342; | + | ENST00000601503; ENST00000326003; | TSF |

TABLE 50-continued

Transcript fusion for Prostate Adenocarcinoma (PRAD) Coordinates of the fusion sequences for which the donor is the T

| 1 | 2' | 3' | 4' | 5' | 6' | 7' | 8' | 9' | 10' | 11' |
|---|---|---|---|---|---|---|---|---|---|---|
| 2% | chr19 | 51360137 | 51360205 | + | chr19 | 51361285 | 51361571; 51361430; 51361589 51361571; 51361342; 51361430; 51361589 | + | ENST00000422986; ENST00000597286; ENST00000593997; ENST00000595392; ENST00000360617; ENST00000598145 ENST00000601503; ENST00000326003; ENST00000422986; ENST00000597286; ENST00000593997; ENST00000595392; ENST00000360617; ENST00000598145 | TSF |
| 2% | chr19 | 51360137 | 51360205 | + | chr19 | 51361285 | 51361571; 51361342; 51361430; 51361589 | + | ENST00000601503; ENST00000326003; ENST00000422986; ENST00000597286; ENST00000593997; ENST00000595392; ENST00000360617; ENST00000598145 | TSF |
| 2% | chr19 | 51360137 | 51360205 | + | chr19 | 51361285 | 51361571; 51361342; 51361430; 51361589 | + | ENST00000601503; ENST00000326003; ENST00000422986; ENST00000597286; ENST00000593997; ENST00000595392; ENST00000360617; ENST00000598145 | TSF |
| 2% | chr19 | 51360137 | 51360205 | + | chr19 | 51361285 | 51361571; 51361342; 51361430; 51361589 | + | ENST00000601503; ENST00000326003; ENST00000422986; ENST00000597286; ENST00000593997; ENST00000595392; ENST00000360617; ENST00000598145 | TSF |
| 2% | chr19 | 51360137 | 51360205 | + | chr19 | 51361285 | 51361571; 51361342; 51361430; 51361589 | + | ENST00000601503; ENST00000326003; ENST00000422986; ENST00000597286; ENST00000593997; ENST00000595392; ENST00000360617; ENST00000598145 | TSF |
| 2% | chr1 | 109725208 | 109725274 | + | chr1 | 109727667 | 109727755 | + | ENST00000369939; ENST00000457623 | TSF |
| 2% | chr1 | 109725208 | 109725274 | + | chr1 | 109727667 | 109727755 | + | ENST00000369939; ENST00000457623 | TSF |
| 2% | chr2 | 207634479 | 207634640 | + | chr2 | 207634815 | 207634918 | + | ENST00000236980; ENST00000402774; ENST00000403094 | TSF |
| 2% | chr13 | 95872419 | 95872224 | − | chr13 | 95863035 | 95862946 | − | ENST00000412704; ENST00000376887; ENST00000536256; ENST00000431522 | TSF |
| 2% | chr13 | 95872419 | 95872224 | − | chr13 | 95863035 | 95862946 | − | ENST00000412704; ENST00000376887; ENST00000536256; ENST00000431522 | TSF |
| 2% | chr13 | 95872419 | 95872224 | − | chr13 | 95863035 | 95862946 | − | ENST00000412704; ENST00000376887; ENST00000536256; ENST00000431522 | TSF |
| 2% | chr5 | 34010561 | 34010287 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TSF |
| 2% | chr5 | 34010561 | 34010287 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TSF |
| 2% | chr5 | 34010561 | 34010287 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TSF |
| 2% | chr5 | 34010561 | 34010287 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TSF |
| 2% | chr5 | 34010561 | 34010287 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TSF |
| 2% | chr5 | 34010561 | 34010287 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TSF |
| 2% | chr5 | 34010561 | 34010287 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TSF |
| 2% | chr5 | 34010561 | 34010287 | − | chr5 | 34006004 | 34005861 | − | ENST00000335606; ENST00000382072; ENST00000382079; ENST00000506639; ENST00000382085; ENST00000502637; | TSF |

TABLE 50-continued

Transcript fusion for Prostate Adenocarcinoma (PRAD) Coordinates of the fusion sequences for which the donor is the T

| 1 | 2' | 3' | 4' | 5' | 6' | 7' | 8' | 9' | 10' | 11' |
|---|---|---|---|---|---|---|---|---|---|---|
| 2% | chr1 | 52306889 | 52306849 | − | chr1 | 52306186 | 52305898 | − | ENST00000441713; ENST00000426255; ENST00000512079; ENST00000382068 ENST00000352171; ENST00000354831 | TSF |
| 2% | chr1 | 52306889 | 52306849 | − | chr1 | 52306186 | 52305898 | − | ENST00000352171; ENST00000354831 | TSF |
| 2% | chr4 | 102080353 | 102080228 | − | chr4 | 102030235 | 102030111 | − | ENST00000394854; ENST00000323055; ENST00000394853; ENST00000523694; ENST00000529324; ENST00000525819 | TSF |
| 2% | chr4 | 102080353 | 102080228 | − | chr4 | 102030235 | 102030111 | − | ENST00000394854; ENST00000323055; ENST00000394853; ENST00000523694; ENST00000529324; ENST00000525819 | TSF |
| 2% | chr4 | 102080353 | 102080228 | − | chr4 | 102030235 | 102030111 | − | ENST00000394854; ENST00000323055; ENST00000394853; ENST00000523694; ENST00000529324; ENST00000525819 | TSF |
| 2% | chr4 | 102080353 | 102080228 | − | chr4 | 102030235 | 102030111 | − | ENST00000394854; ENST00000323055; ENST00000394853; ENST00000523694; ENST00000529324; ENST00000525819 | TSF |
| 2% | chr4 | 102080353 | 102080228 | − | chr4 | 102030235 | 102030111 | − | ENST00000394854; ENST00000323055; ENST00000394853; ENST00000523694; ENST00000529324; ENST00000525819 | TSF |
| 2% | chr11 | 49185698 | 49184443 | − | chr11 | 49179595 | 49179504 | − | ENST00000256999; ENST00000356696; ENST00000343844; ENST00000340334; ENST00000533034 | TSF |
| 2% | chr11 | 49185698 | 49184443 | − | chr11 | 49179595 | 49179504 | − | ENST00000256999; ENST00000356696; ENST00000343844; ENST00000340334; ENST00000533034 | TSF |
| 2% | chr8 | 117816470 | 117816753 | + | chr8 | 117861127 | 117861256; 117861276 | + | ENST00000517820; ENST00000520733 | TSF |
| 2% | chr8 | 117816470 | 117816753 | + | chr8 | 117861127 | 117861256; 117861276 | + | ENST00000517820; ENST00000520733 | TSF |
| 2% | chr5 | 118865267 | 118865382 | + | chr5 | 118865589 | 118865675 | + | ENST00000256216; ENST00000515320; ENST00000510025; ENST00000504811; ENST00000414835; ENST00000513628; ENST00000509514 | TSF |
| 2% | chr2 | 131117443 | 131117848 | + | chr2 | 131126706 | 131126774 | + | ENST00000175756; ENST00000347849 | TSF |
| 2% | chr5 | 54723913 | 54723765 | − | chr5 | 54721867 | 54721691 | − | ENST00000264775; ENST00000307259 | TSF |
| 2% | chr11 | 49229295 | 49229182 | − | chr11 | 49227724 | 49227619 | − | ENST00000256999; ENST00000356696; ENST00000525826; ENST00000340334; ENST00000533034 | TSF |
| 2% | chr11 | 49229295 | 49229182 | − | chr11 | 49227724 | 49227619 | − | ENST00000256999; ENST00000356696; ENST00000525826; ENST00000340334; ENST00000533034 | TSF |
| 2% | chr11 | 49229295 | 49229182 | − | chr11 | 49227724 | 49227619 | − | ENST00000256999; ENST00000356696; ENST00000525826; ENST00000340334; ENST00000533034 | TSF |
| 2% | chr13 | 95690828 | 95690729 | − | chr13 | 95686993 | 95686859 | − | ENST00000412704; ENST00000376887 | TSF |
| 1% | chr8 | 102609579 | 102609842 | + | chr8 | 102611285 | 102611379 | + | ENST00000251808; ENST00000395927 | TSF |
| 1% | chr1 | 228782545 | 228782677 | + | chr1 | 228873420 | 228873478 | + | ENST00000366691 | TSF |
| 1% | chr19 | 50174724 | 50174836 | + | chr19 | 50176955 | 50177034; 50177005; | + | ENST00000441864; ENST00000246785; ENST00000600947; ENST00000598306 | TSF |
| 1% | chr19 | 50174724 | 50174836 | + | chr19 | 50176955 | 50177005; 50177034 | + | ENST00000441864; ENST00000246785; ENST00000600947; ENST00000598306 | TSF |
| 1% | chr14 | 37888149 | 37888315 | + | chr14 | 37892060 | 37892154 | + | ENST00000536774; ENST00000327441; ENST00000539062; ENST00000556451; ENST00000555870; ENST00000396294; ENST00000545536; ENST00000537471 | TSF |
| 1% | chr14 | 37888149 | 37888315 | + | chr14 | 37892060 | 37892154 | + | ENST00000536774; ENST00000327441; ENST00000539062; ENST00000556451; ENST00000555870; ENST00000396294; ENST00000545536; ENST00000537471 | TSF |
| 1% | chr14 | 37888149 | 37888315 | + | chr14 | 37892060 | 37892154 | + | ENST00000536774; ENST00000327441; ENST00000539062; ENST00000556451; ENST00000555870; ENST00000396294; ENST00000545536; ENST00000537471 | TSF |
| 1% | chr2 | 44523867 | 44524132 | + | chr2 | 44527110 | 44527229 | + | ENST00000260649; ENST00000409387; ENST00000409741; ENST00000410056; ENST00000409229; ENST00000409380; ENST00000427285 | TSF |
| 1% | chr2 | 44523867 | 44524132 | + | chr2 | 44527110 | 44527229 | + | ENST00000260649; ENST00000409387; ENST00000410056; ENST00000409741; ENST00000409229; ENST00000409380; ENST00000427285 | TSF |
| 1% | chr2 | 44523867 | 44524132 | + | chr2 | 44527110 | 44527229 | + | ENST00000260649; ENST00000409387; ENST00000410056; ENST00000409741; ENST00000409229; ENST00000409380; ENST00000427285 | TSF |
| 1% | chr2 | 44523867 | 44524132 | + | chr2 | 44527110 | 44527229 | + | ENST00000260649; ENST00000409387; | TSF |

TABLE 50-continued

Transcript fusion for Prostate Adenocarcinoma (PRAD) Coordinates of the fusion sequences for which the donor is the T

| 1 | 2' | 3' | 4' | 5' | 6' | 7' | 8' | 9' | 10' | 11' |
|---|---|---|---|---|---|---|---|---|---|---|
| 1% | chr2 | 44523867 | 44524132 | + | chr2 | 44527110 | 44527229 | + | ENST00000410056; ENST00000409741; ENST00000409229; ENST00000409380; ENST00000427285 ENST00000260649; ENST00000409387; ENST00000410056; ENST00000409741; ENST00000409229; ENST00000409380; ENST00000427285 | TSF |
| 1% | chr2 | 44523867 | 44524132 | + | chr2 | 44527110 | 44527229 | + | ENST00000260649; ENST00000409387; ENST00000410056; ENST00000409741; ENST00000409229; ENST00000409380; ENST00000427285 | TSF |
| 1% | chr4 | 95574306 | 95574373 | + | chr4 | 95575611 | 95575791 | + | ENST00000437932; ENST00000317968; ENST00000503974; ENST00000542407; ENST00000514743; ENST00000506632 | TSF |
| 1% | chr4 | 95574306 | 95574373 | + | chr4 | 95575611 | 95575791 | + | ENST00000437932; ENST00000317968; ENST00000503974; ENST00000542407; ENST00000514743; ENST00000506632 | TSF |
| 1% | chr4 | 95574306 | 95574373 | + | chr4 | 95575611 | 95575791 | + | ENST00000437932; ENST00000317968; ENST00000503974; ENST00000542407; ENST00000514743; ENST00000506632 | TSF |
| 1% | chr5 | 34007349 | 34007309 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TSF |
| 1% | chr5 | 34007349 | 34007309 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TSF |
| 1% | chr5 | 34007349 | 34007309 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TSF |
| 1% | chr5 | 34007349 | 34007309 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TSF |
| 1% | chr5 | 34007349 | 34007309 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TSF |
| 1% | chr5 | 34007349 | 34007309 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TSF |
| 1% | chr5 | 34007349 | 34007309 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TSF |
| 1% | chr5 | 34007349 | 34007309 | − | chr5 | 34006004 | 34005861 | − | ENST00000335606; ENST00000382072; ENST00000382079; ENST00000506639; ENST00000382085; ENST00000502637; ENST00000441713; ENST0000512079; ENST00000382068 | TSF |
| 1% | chr5 | 34007349 | 34007309 | − | chr5 | 34006004 | 34005861 | − | ENST00000335606; ENST00000382072; ENST00000382079; ENST00000506639; ENST00000382085; ENST00000502637; ENST00000441713; ENST00000426255; ENST00000512079; ENST00000382068 | TSF |
| 1% | chr4 | 151647998 | 151647737 | − | chr4 | 151604869 | 151604703 | − | ENST00000535741; ENST00000510413; ENST00000357115; ENST00000509835; ENST00000507224 | TSF |
| 1% | chr4 | 151647998 | 151647737 | − | chr4 | 151604869 | 151604703 | − | ENST00000535741; ENST00000510413; ENST00000357115; ENST00000509835; ENST00000507224 | TSF |
| 1% | chr4 | 151647998 | 151647737 | − | chr4 | 151604869 | 151604703 | − | ENST00000535741; ENST00000510413; ENST00000357115; ENST00000509835; ENST00000507224 | TSF |
| 1% | chr4 | 151647998 | 151647737 | − | chr4 | 151604869 | 151604703 | − | ENST00000535741; ENST00000510413; ENST00000357115; ENST00000509835; | TSF |

TABLE 50-continued

Transcript fusion for Prostate Adenocarcinoma (PRAD) Coordinates of the fusion sequences for which the donor is the T

| 1 | 2' | 3' | 4' | 5' | 6' | 7' | 8' | 9' | 10' | 11' |
|---|---|---|---|---|---|---|---|---|---|---|
| 1% | chr2 | 165806067 | 165805999 | − | chr2 | 165802237 | 165802103 | − | ENST00000507224; ENST00000303735; ENST00000409149; ENST00000409058; ENST00000409662 | TSF |
| 1% | chr2 | 165806067 | 165805999 | − | chr2 | 165802237 | 165802103 | − | ENST00000303735; ENST00000409149; ENST00000409058; ENST00000409662 | TSF |
| 1% | chr1 | 37979411 | 37979375 | − | chr1 | 37979139 | 37979024 | − | ENST00000373075; ENST00000296214; ENST00000373074; ENST00000373073; ENST00000448519 | TSF |
| 1% | chr1 | 37979411 | 37979375 | − | chr1 | 37979139 | 37979024 | − | ENST00000373075; ENST00000296214; ENST00000373074; ENST00000373073; ENST00000448519 | TSF |
| 1% | chr1 | 37979411 | 37979375 | − | chr1 | 37979139 | 37979024 | − | ENST00000373075; ENST00000296214; ENST00000373074; ENST00000373073; ENST00000448519 | TSF |
| 1% | chr1 | 37979411 | 37979375 | − | chr1 | 37979139 | 37979024 | − | ENST00000373075; ENST00000296214; ENST00000373074; ENST00000373073; ENST00000448519 | TSF |
| 1% | chr8 | 19324621 | 19324413 | − | chr8 | 19316153 | 19315937 | − | ENST00000454498; ENST00000332246; ENST00000397998; ENST00000311540; ENST00000522854; ENST00000544602; ENST00000519222 | TSF |
| 1% | chr8 | 19324621 | 193 24413 | − | chr8 | 19316153 | 19315937 | − | ENST00000454498; ENST00000332246; ENST00000397998; ENST00000311540; ENST00000522854; ENST00000544602; ENST00000519222 | TSF |
| 1% | chr4 | 171005986 | 171005876 | − | chr4 | 170999734 | 170999660 | − | ENST00000337664; ENST00000509167; ENST00000515480; ENST00000353187; ENST00000510340; ENST00000507375; ENST00000502392 | TSF |
| 1% | chr4 | 171005986 | 171005876 | − | chr4 | 170999734 | 170999660 | − | ENST00000337664; ENST00000509167; ENST00000515480; ENST00000353187; ENST00000510340; ENST00000507375; ENST00000502392 | TSF |
| 1% | chr4 | 171005986 | 171005876 | − | chr4 | 170999734 | 170999660 | − | ENST00000337664; ENST00000509167; ENST00000515480; ENST00000353187; ENST00000510340; ENST00000507375; ENST00000502392 | TSF |
| 1% | chr4 | 171005986 | 171005876 | − | chr4 | 170999734 | 170999660 | − | ENST00000337664; ENST00000509167; ENST00000515480; ENST00000353187; ENST00000510340; ENST00000507375; ENST00000502392 | TSF |
| 1% | chr12 | 93806814 | 93806392 | − | chr12 | 93805075 | 93804829; 93804647; 93804902 | − | ENST00000318066; ENST00000550657; ENST00000549490; ENST00000552442 | TSF |
| 1% | chr12 | 93806814 | 93806392 | − | chr12 | 93805075 | 93804829; 93804647; 93804902 | − | ENST00000318066; ENST00000550657; ENST00000549490; ENST00000552442 | TSF |
| 1% | chr12 | 93806814 | 93806392 | − | chr12 | 93805075 | 93804829; 93804647; 93804902 | − | ENST00000318066; ENST00000550657; ENST00000549490; ENST00000552442 | TSF |
| 1% | chr12 | 93806814 | 93806392 | − | chr12 | 93805075 | 93804647; 93804829; 93804902 | − | ENST00000318066; ENST00000550657; ENST00000549490; ENST00000552442 | TSF |
| 1% | chr4 | 142977397 | 142977072 | − | chr4 | 142950067 | 142949935 | − | ENST00000513000; ENST00000262992; ENST00000308502; ENST00000508116 | TSF |
| 1% | chr15 | 73055826 | 73055759 | − | chr15 | 73052868 | 73052760; 73052748 | − | ENST00000569534; ENST00000311669; ENST00000563907; ENST00000565814 | TSF |
| 1% | chr15 | 73055826 | 73055759 | − | chr15 | 73052868 | 73052760; 73052748 | − | ENST00000569534; ENST00000311669; ENST00000563907; ENST00000565814 | TSF |
| 1% | chr15 | 73055826 | 73055759 | − | chr15 | 73052868 | 73052760; 73052748 | − | ENST00000569534; ENST00000311669; ENST00000563907; ENST00000565814 | TSF |
| 1% | chr15 | 73055826 | 73055759 | − | chr15 | 73052868 | 73052760; 73052748 | − | ENST00000569534; ENST00000311669; ENST00000563907; ENST00000565814 | TSF |
| 1% | chr3 | 141923156 | 141923059 | − | chr3 | 141917775 | 141917644 | − | ENST00000492097; ENST00000480757; ENST00000392993; ENST00000544571 | TSF |
| 1% | chr3 | 141923156 | 141923059 | − | chr3 | 141917775 | 141917644 | − | ENST00000492097; ENST00000480757; ENST00000392993; ENST00000544571 | TSF |
| 1% | chr12 | 56160733 | 56160521 | − | chr12 | 56154424 | 56154335; 56154284 | − | ENST00000546604; ENST00000444631; ENST00000336133; ENST00000546837; ENST00000552080 | TSF |
| 1% | chr12 | 56160733 | 561160521 | − | chr12 | 56154424 | 56154284 56154335; | − | ENST00000546604; ENST00000444631; ENST00000336133; ENST00000546837; ENST00000552080 | TSF |
| 1% | chr16 | 81057014 | 81057064 | + | chr16 | 81058320 | 81058383 | + | ENST00000305850; ENST00000439957; ENST00000393335; ENST00000428963 | TSF |
| 1% | chr16 | 81057014 | 81057064 | + | chr16 | 81058320 | 81058383 | + | ENST00000305850; ENST00000439957; | TSF |

TABLE 50-continued

Transcript fusion for Prostate Adenocarcinoma (PRAD) Coordinates of the fusion sequences for which the donor is the T

| 1 | 2' | 3' | 4' | 5' | 6' | 7' | 8' | 9' | 10' | 11' |
|---|---|---|---|---|---|---|---|---|---|---|
| 1% | chr17 | 7947105 | 7947155 | + | chr17 | 7948147 | 7948319 | + | ENST00000393335; ENST00000428963 ENST00000380183; ENST00000572022; ENST00000380173; ENST00000573359 | TSF |
| 1% | chr17 | 7947105 | 7947155 | + | chr17 | 7948147 | 7948319 | + | ENST00000380183; ENST00000572022; ENST00000380173; ENST00000573359 | TSF |
| 1% | chr17 | 7947105 | 7947155 | + | chr17 | 7948147 | 7948319 | + | ENST00000380183; ENST00000572022; ENST00000380173; ENST00000573359 | TSF |
| 1% | chr17 | 7947105 | 7947155 | + | chr17 | 7948147 | 7948319 | + | ENST00000380183; ENST00000572022; ENST00000380173; ENST00000573359 | TSF |
| 1% | chr5 | 79371074 | 79371193 | + | chr5 | 79372678 | 79372871 | + | ENST00000350881; ENST00000511733 | TSF |
| 1% | chr19 | 51345545 | 51345748 | + | chr19 | 51359496 | 51359655 | + | ENST00000326003; ENST00000422986; ENST00000597483; ENST00000593997; ENST00000595392; ENST00000595952; ENST00000360617; ENST00000598145 | TSF |
| 1% | chr19 | 51345545 | 51345748 | + | chr19 | 51359496 | 51359655 | + | ENST00000326003; ENST00000422986; ENST00000597483; ENST00000593997; ENST00000595392; ENST00000595952; ENST00000360617; ENST00000598145 | TSF |
| 1% | chr19 | 51345545 | 51345748 | + | chr19 | 51359496 | 51359655 | + | ENST00000326003; ENST00000422986; ENST00000597483; ENST00000593997; ENST00000595392; ENST00000595952; ENST00000360617; ENST00000598145 | TSF |
| 1% | chr19 | 51345545 | 51345748 | + | chr19 | 51359496 | 51359655 | + | ENST00000326003; ENST00000422986; ENST00000597483; ENST00000593997; ENST00000595392; ENST00000595952; ENST00000360617; ENST00000598145 | TSF |
| 1% | chr19 | 51345545 | 51345748 | + | chr19 | 51359496 | 51359655 | + | ENST00000326003; ENST00000422986; ENST00000597483; ENST00000593997; ENST00000595392; ENST00000595952; ENST00000360617; ENST00000598145 | TSF |
| 1% | chr19 | 51345545 | 51345748 | + | chr19 | 51359496 | 51359655 | + | ENST00000326003; ENST00000422986; ENST00000597483; ENST00000593997; ENST00000595392; ENST00000595952; ENST00000360617; ENST00000598145 | TSF |
| 1% | chr19 | 51345545 | 45513748 | + | chr19 | 51359496 | 51359655 | + | ENST00000326003; ENST00000422986; ENST00000597483; ENST00000593997; ENST00000595392; ENST00000595952; ENST00000360617; ENST00000598145 | TSF |
| 1% | chr19 | 51345545 | 51345748 | + | chr19 | 51359496 | 51359655 | + | ENST00000326003; ENST00000422986; ENST00000597483; ENST00000593997; ENST00000595392; ENST00000595952; ENST00000360617; ENST00000598145 | TSF |
| 1% | chr15 | 89717587 | 89717675 | + | chr15 | 89719043 | 89719226 | + | ENST00000352732; ENST00000565973; ENST00000355100 | TSF |
| 1% | chr9 | 100821079 | 100821131 | + | chr9 | 100823064 | 100823279 | + | ENST00000210444 | TSF |
| 1% | chr7 | 24325099 | 24325188 | + | chr7 | 24329118 | 24329198 | + | ENST00000242152; ENST00000407573; ENST00000405982 | TSF |
| 1% | chr19 | 35551883 | 35551974 | + | chr19 | 35556154 | 35556249 | + | ENST00000262626; ENST00000392226; ENST00000597419 | TSF |
| 1% | chr9 | 100807994 | 100808487 | + | chr9 | 100823064 | 100823279 | + | ENST00000210444 | TSF |
| 1% | chr8 | 128749913 | 128749923 | + | chr8 | 128750494 | 128751265 | + | ENST00000377970 | TSF |
| 1% | chr3 | 175506179 | 175506380 | + | chr3 | 175520793 | 175520991 | + | ENST00000454872 | TSF |
| 1% | chr8 | 19325038 | 19325000 | − | chr8 | 19316153 | 19315937 | − | ENST00000454498; ENST00000332246; ENST00000397998; ENST00000311540; ENST00000522854; ENST00000544602; ENST00000519222 | TSF |
| 1% | chr8 | 19325038 | 19325000 | − | chr8 | 19316153 | 19315937 | − | ENST00000454498; ENST00000332246; ENST00000397998; ENST00000311540; ENST00000522854; ENST00000544602; ENST00000519222 | TSF |
| 1% | chr13 | 95715443 | 95715253 | − | chr13 | 95715113 | 95714958 | − | ENST00000412704; ENST00000376887 | TSF |
| 1% | chr2 | 99311548 | 99315517 | − | chr2 | 99294934 | 99294767 | − | ENST00000264968; ENST00000393487; ENST00000409391 | TSF |
| 1% | chr6 | 46618224 | 46617893 | − | chr6 | 46610035 | 46609900 | − | ENST00000275016 | TSF |
| 1% | chr21 | 34823925 | 34823642 | − | chr21 | 34823170 | 34823125 | − | ENST00000420455; ENST00000542230 | TSF |
| 1% | chr2 | 25015386 | 25015253 | − | chr2 | 25013450 | 25013280 | − | ENST00000328379 | TSF |
| 1% | chr10 | 73858281 | 73858277 | − | chr10 | 73857208 | 73857092; 73857201 | − | ENST00000394919; ENST00000317168; ENST00000486689; ENST00000530394; ENST00000317126; ENST00000545550 | TSF |
| 1% | chr10 | 73858281 | 73858277 | − | chr10 | 73857208 | 73857092; 73857201 | − | ENST00000394919; ENST00000317168; ENST00000486689; ENST00000530394; ENST00000317126; ENST00000545550 | TSF |

TABLE 51

Transcript fusion for Rectum adenocarcinoma (READ) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 37% | chr12 | 71928895 | 71928966 | + | ENST00000266674; ENST00000536515; ENST00000540815 | chr12 | 71938771 | 71938901 | + | TSF |
| 34% | chr13 | 44433033 | 44432917 | − | ENST00000444614; ENST00000281508 | chr13 | 44413224 | 44412729 | − | TAF |
| 30% | chr13 | 43659904 | 43659974 | + | ENST00000379221 | chr13 | 43670953 | 43671210 | + | TAF |
| 28% | chr11 | 428199 | 428088 | − | ENST00000332826 | chr11 | 424187 | 423924 | − | TAF |
| 28% | chr3 | 49927493 | 49927357 | − | ENST00000296474; ENST00000344206 | chr3 | 49927248 | 49927204 | − | TAF |
| 28% | chr3 | 49927493 | 49927357 | − | ENST00000296474; ENST00000344206 | chr3 | 49927248 | 49927204 | − | TAF |
| 27% | chr1 | 24463799 | 24463621 | − | ENST00000270800 | chr1 | 24461426 | 24461370 | − | TAF |
| 24% | chr20 | 9453926 | 9454012 | + | ENST00000334005; ENST00000378473; ENST00000278655; ENST00000414679; ENST00000378493; ENST00000378501 | chr20 | 9484605 | 9485169 | + | TAF |
| 24% | chr20 | 9453926 | 9454012 | + | ENST00000334005; ENST00000378473; ENST00000278655; ENST00000414679; ENST00000378493; ENST00000378501 | chr20 | 9484605 | 9485169 | + | TAF |
| 23% | chr13 | 115030625 | 115030715 | + | ENST00000360383; ENST00000375312; ENST00000356221; ENST00000375310; ENST00000252457; ENST00000375308; ENST00000252458 | chr13 | 115035038 | 115035171 | + | TAF |
| 23% | chr13 | 115030625 | 115030715 | + | ENST00000360383; ENST00000375312; ENST00000356221; ENST00000375310; ENST00000252457; ENST00000375308; ENST00000252458 | chr13 | 115035038 | 115035171 | + | TAF |
| 23% | chr13 | 115030625 | 115030715 | + | ENST00000360383; ENST00000375312; ENST00000356221; ENST00000375310; ENST00000252457; ENST00000375308; ENST00000252458 | chr13 | 115035038 | 115035171 | + | TAF |
| 23% | chr13 | 115030625 | 115030715 | + | ENST00000360383; ENST00000375312; ENST00000356221; ENST00000375310; ENST00000252457; ENST00000375308; ENST00000252458 | chr13 | 115035038 | 115035171 | + | TAF |
| 23% | chr7 | 75442741 | 75442624 | − | ENST00000222902; ENST00000416943 | chr7 | 75441450 | 75441417 | − | TAF |
| 20% | chr20 | 47768284 | 47768119 | − | ENST00000371828; ENST00000340954; ENST00000347458; ENST00000360426; ENST00000371792; ENST00000371802; ENST00000371856; ENST00000437404; ENST00000456866 | chr20 | 47761186 | 47760181 | − | TAF |
| 20% | chr20 | 47768284 | 47768119 | − | ENST00000371828; ENST00000340954; ENST00000347458; ENST00000360426; ENST00000371792; ENST00000371802; ENST00000371856; ENST00000437404; ENST00000456866 | chr20 | 47761186 | 47760181 | − | TAF |
| 20% | chr20 | 47768284 | 47768119 | − | ENST00000371828; ENST00000340954; ENST00000347458; ENST00000360426; ENST00000371792; ENST00000371802; ENST00000371856; ENST00000437404; ENST00000456866 | chr20 | 47761186 | 47760181 | − | TAF |
| 19% | chr9 | 125054028 | 125054119 | + | ENST00000297908; ENST00000344641; ENST00000373723; ENST00000373729; ENST00000394315 | chr9 | 125068067 | 125068171 | + | TSF |
| 19% | chr9 | 125054028 | 125054119 | + | ENST00000297908; ENST00000344641; ENST00000373723; ENST00000373729; ENST00000394315 | chr9 | 125068067 | 125068171 | + | TSF |
| 19% | chr9 | 125054028 | 125054119 | + | ENST00000297908; ENST00000344641; ENST00000373723; ENST00000373729; ENST00000394315 | chr9 | 125068067 | 125068171 | + | TSF |
| 18% | chr20 | 33137782 | 33137833 | + | ENST00000374837 | chr20 | 33138384 | 33138773 | + | TSF |
| 17% | chr13 | 113849439 | 113849385 | − | ENST00000337344; ENST00000375477; ENST00000375479; ENST00000375459; ENST00000246505; ENST00000375457 | chr13 | 113848640 | 113848038 | − | TAF |
| 17% | chr13 | 113849439 | 113849385 | − | ENST00000337344; ENST00000375477; ENST00000375479; ENST00000375459; ENST00000246505; ENST00000375457 | chr13 | 113848640 | 113848038 | − | TAF |
| 17% | chr13 | 113849439 | 113849385 | − | ENST00000337344; ENST00000375477; ENST00000375479; ENST00000375459; ENST00000246505; ENST00000375457 | chr13 | 113848640 | 113848038 | − | TAF |
| 17% | chr20 | 9382137 | 9382237 | + | ENST00000334005; ENST00000378473; ENST00000278655; ENST00000414679; ENST00000378493; ENST00000378501 | chr20 | 9383648 | 9383757 | + | TSF |
| 15% | chr16 | 50583333 | 50583466 | + | ENST00000268459 | chr16 | 50614862 | 50614981 | + | TSF |
| 14% | chr6 | 1960205 | 1960101 | − | ENST00000530927; ENST00000380815 | chr6 | 1955184 | 1955013 | − | TAF |
| 14% | chr6 | 1960205 | 1960101 | − | ENST00000530927; ENST00000380815 | chr6 | 1955184 | 1955013 | − | TAF |
| 14% | chr16 | 4409386 | 4409297 | − | ENST00000572467; ENST00000251166; ENST00000539968; ENST00000537233; ENST00000574025; ENST00000576637 | chr16 | 4409070 | 4408945 | − | TAF |
| 14% | chr16 | 4409386 | 4409297 | − | ENST00000572467; ENST00000251166; | chr16 | 4409070 | 4408945 | − | TAF |

TABLE 51-continued

Transcript fusion for Rectum adenocarcinoma (READ) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 14% | chr16 | 4409386 | 4409297 | − | ENST00000539968; ENST00000537233; ENST00000574025; ENST00000576637 ENST00000572467; ENST00000251166; ENST00000539968; ENST00000537233; ENST00000574025; ENST00000576637 | chr16 | 4409070 | 4408945 | − | TAF |
| 14% | chr16 | 4409386 | 4409297 | − | ENST00000572467; ENST00000251166; ENST00000539968; ENST00000537233; ENST00000574025; ENST00000576637 | chr16 | 4409070 | 4408945 | − | TAF |
| 14% | chr16 | 4409386 | 4409297 | − | ENST00000572467; ENST00000251166; ENST00000539968; ENST00000537233; ENST00000574025; ENST00000576637 | chr16 | 4409070 | 4408945 | − | TAF |
| 14% | chr16 | 50659396 | 50659491 | + | ENST00000268459 | chr16 | 50663933 | 50663990 | + | TSF |
| 13% | chr3 | 14520593 | 14520693 | + | ENST00000454876; ENST00000360861 | chr3 | 14521628 | 14521634 | + | TAF |
| 13% | chr5 | 82554349 | 82554496 | + | ENST00000282268; ENST00000338635; ENST00000396027; ENST00000511817 | chr5 | 82606608 | 82606935 | + | TAF |
| 13% | chr10 | 120905865 | 120905748 | − | ENST00000355697; ENST00000330036 | chr10 | 120901885 | 120901741 | − | TAF |
| 13% | chr10 | 120905865 | 120905748 | − | ENST00000355697; ENST00000330036 | chr10 | 120901885 | 120901741 | − | TAF |
| 12% | chr1 | 32696528 | 32696620 | + | ENST00000373586 | chr1 | 32696861 | 32697110 | + | TAF |
| 12% | chr9 | 99122503 | 99122436 | − | ENST00000253270; ENST00000375259; ENST00000375257 | chr9 | 99115925 | 99115627 | − | TAF |
| 11% | chr6 | 10749855; 10749898 | 10749931 | + | ENST00000379542; ENST00000473166; ENST00000463448; ENST00000460341; ENST00000480294; ENST00000473807; ENST00000461342; ENST00000475942; ENST00000379530; ENST00000463100; ENST00000481240; ENST00000467317; ENST00000478732 | chr6 | 10829240 | 10829256 | + | TAF |
| 11% | chr6 | 10749855; 10749898 | 10749931 | + | ENST00000379542; ENST00000473166; ENST00000463448; ENST00000460341; ENST00000480294; ENST00000473807; ENST00000461342; ENST00000475942; ENST00000379530; ENST00000463100; ENST00000481240; ENST00000467317; ENST00000478732 | chr6 | 10829240 | 10829256 | + | TAF |
| 9% | chr4 | 57319769 | 57319927 | + | ENST00000514888; ENST00000264221; ENST00000505164; ENST00000399688; ENST00000512576 | chr4 | 57321183 | 57321327 | + | TSF |
| 9% | chr4 | 57319769 | 57319927 | + | ENST00000514888; ENST00000264221; ENST00000505164; ENST00000399688; ENST00000512576 | chr4 | 57321183 | 57321327 | + | TSF |
| 9% | chr4 | 57319769 | 57319927 | + | ENST00000514888; ENST00000264221; ENST00000505164; ENST00000399688; ENST00000512576 | chr4 | 57321183 | 57321327 | + | TSF |
| 9% | chr8 | 42924698; 42924750 | 429248102 | + | ENST00000534420; ENST00000302279; ENST00000533998; ENST00000342116; ENST00000531266; ENST00000525699; ENST00000529687; ENST00000533336 | chr8 | 42925245 | 42925476 | + | TSF |
| 9% | chr8 | 42924698; 42924750 | 42924802 | + | ENST00000534420; ENST00000302279; ENST00000533998; ENST00000342116; ENST00000531266; ENST00000525699; ENST00000529687; ENST00000533336 | chr8 | 42925245 | 42925476 | + | TSF |
| 9% | chr8 | 42924698; 42924750 | 42924802 | + | ENST00000534420; ENST00000302279; ENST00000533998; ENST00000342116; ENST00000531266; ENST00000525699; ENST00000529687; ENST00000533336 | chr8 | 42925245 | 42925476 | + | TSF |
| 9% | chr8 | 42924 698; 42924750 | 42924802 | + | ENST00000534420; ENST00000302279; ENST00000533998; ENST00000342116; ENST00000531266; ENST00000525699; ENST00000529687; ENST00000533336 | chr8 | 42925245 | 42925476 | + | TSF |
| 9% | chr8 | 42924698; 42924750 | 42924802 | + | ENST00000534420; ENST00000302279; ENST00000533998; ENST00000342116; ENST00000531266; ENST00000525699; ENST00000529687; ENST00000533336 | chr8 | 42925245 | 42925476 | + | TSF |
| 9% | chr8 | 42924698; 42924750 | 42924802 | + | ENST00000534420; ENST00000302279; ENST00000533998; ENST00000342116; ENST00000531266; ENST00000525699; ENST00000529687; ENST00000533336 | chr8 | 42925245 | 42925476 | + | TSF |
| 9% | chr16 | 72153988; 72154048 | 72153750 | − | ENST00000537465; ENST00000237353; ENST00000355636 | chr16 | 72150929 | 72150229 | − | TSF |
| 9% | chr16 | 72153988; 72154048 | 72153750 | − | ENST00000537465; ENST00000237353; ENST00000355636 | chr16 | 72150929 | 72150229 | − | TSF |
| 9% | chr16 | 72153988; 72154048 | 72153750 | − | ENST00000537465; ENST00000237353; ENST00000355636 | chr16 | 72150929 | 72150229 | − | TSF |
| 7% | chr16 | 50642205 | 50642271 | + | ENST00000268459 | chr16 | 50651664 | 50651770 | + | TSF |
| 7% | chr2 | 241555805 | 241555928 | + | ENST00000270364 | chr2 | 241556208 | 241556489 | + | TSF |

TABLE 51-continued

Transcript fusion for Rectum adenocarcinoma (READ) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 6% | chr7 | 73973957 | 73973985 | + | ENST00000265755; ENST00000455841; ENST00000424337; ENST00000476977; ENST00000470715 | chr7 | 73985447 | 73985582 | + | TSF |
| 6% | chr7 | 73973957 | 73973985 | + | ENST00000265755; ENST00000455841; ENST00000424337; ENST00000476977; ENST00000470715 | chr7 | 73985417 | 73985582 | + | TSF |
| 6% | chr7 | 73973957 | 73973985 | + | ENST00000265755; ENST00000455841; ENST00000424337; ENST00000476977; ENST00000470715 | chr7 | 73985447 | 73985582 | + | TSF |
| 6% | chr7 | 73973957 | 73973985 | + | ENST00000265755; ENST00000455841; ENST00000424337; ENST00000476977; ENST00000470715 | chr7 | 73985447 | 73985582 | + | TSF |

TABLE 52

Transcript fusion for Rectum adenocarcinoma (READ) Coordinates of the fusion sequences for which the donor is the exon.

| 1 | 2' | 3' | 4' | 5' | 6' | 7' | 8' | 9' | 10' | 11' |
|---|---|---|---|---|---|---|---|---|---|---|
| 55% | chr11 | 93468219 | 93468129 | − | chr11 | 93467826 | 93467791; 93467814 | − | ENST00000393259; ENST00000527169 | TAF |
| 55% | chr11 | 93468219 | 93468129 | − | chr11 | 93467826 | 93467791; 93467814 | − | ENST00000393259; ENST00000527169 | TAF |
| 51% | chr9 | 6248332 | 6248555 | + | chr9 | 6250474 | 6250599 | + | ENST00000456383; ENST00000381434 | TAF |
| 51% | chr9 | 6248332 | 6248555 | + | chr9 | 6250474 | 6250599 | + | ENST00000456383; ENST00000381434 | TAF |
| 36% | chr8 | 104389530 | 104389551 | + | chr8 | 104390255 | 104390471 | + | ENST00000330295; ENST00000520337 | TAF |
| 34% | chr13 | 28224759 | 28225489 | + | chr13 | 28239823 | 28240090 | + | ENST00000399697 | TAF |
| 33% | chr11 | 424193 | 423942 | − | chr11 | 421198 | 421141 | − | ENST00000332826 | TAF |
| 30% | chr13 | 43628887 | 43629679 | + | chr13 | 43643066 | 43643139 | + | ENST00000379221 | TAF |
| 28% | chr14 | 51360331 | 51362440 | + | chr14 | 51368547 | 51368629 | + | ENST00000337334; ENST00000353130; ENST00000395752 | TSF |
| 27% | chr17 | 79911953 | 79911734 | − | chr17 | 79911143 | 79910837 | − | ENST00000409678 | TAF |
| 24% | chr20 | 44420870 | 44421070 | + | chr20 | 44421316 | 44421386 | + | ENST00000372622; ENST00000449078; ENST00000456939 | TAF |
| 24% | chr20 | 44420870 | 44421070 | + | chr20 | 44421316 | 44421386 | + | ENST00000372622; ENST00000449078; ENST00000456939 | TAF |
| 24% | chr20 | 44420870 | 44421070 | + | chr20 | 44421316 | 44421386 | + | ENST00000372622; ENST00000449078; ENST00000456939 | TAF |
| 24% | chr13 | 43628887 | 43629679 | + | chr13 | 43639822 | 43639873 | + | ENST00000379221 | TAF |
| 24% | chr13 | 101090702 | 101090970 | + | chr13 | 101101506 | 101101559 | + | ENST00000376279; ENST00000376286; ENST00000376285; ENST00000458283; ENST00000413170 | TSF |
| 24% | chr13 | 101090702 | 101090970 | + | chr13 | 101101506 | 101101559 | + | ENST00000376279; ENST00000376286; ENST00000376285; ENST00000458283; ENST00000413170 | TSF |
| 24% | chr13 | 101090702 | 101090970 | + | chr13 | 101101506 | 101101559 | + | ENST00000376279; ENST00000376286; ENST00000376285; ENST00000458283; ENST00000413170 | TSF |
| 23% | chr14 | 65406849 | 65406835 | − | chr14 | 65406556 | 65406206 | − | ENST00000389614; ENST00000557049 | TAF |
| 20% | chr2 | 85053636 | 85053622 | − | chr2 | 85051328 | 85051077 | − | ENST00000335459; ENST00000409520 | TSF |
| 19% | chr5 | 135398466 | 135398602 | + | chr5 | 135398875 | 135398915; 135398898 | + | ENST00000442011; ENST00000305126; ENST00000514554; ENST00000508076; ENST00000503087 | TAF |
| 19% | chr5 | 135398466 | 135398602 | + | chr5 | 135398875 | 135398915; 135398898 | + | ENST00000442011; ENST00000305126; ENST00000514554; ENST00000508076; ENST00000503087 | TAF |
| 18% | chr13 | 76173531 | 76175706 | + | chr13 | 76178905 | 76178963 | + | ENST00000377595; ENST00000419068 | TAF |
| 18% | chrX | 100125243 | 100124234 | − | chrX | 100118584 | 100118474 | − | ENST00000372966; ENST00000372964; ENST00000217885 | TAF |
| 18% | chrX | 100125243 | 100124234 | − | chrX | 100118584 | 100118474 | − | ENST00000372966; ENST00000372964; ENST00000217885 | TAF |
| 18% | chrX | 100125243 | 100124234 | − | chrX | 100118584 | 100118474 | − | ENST00000372966; ENST00000372964; ENST00000217885 | TAF |
| 18% | chr1 | 59980221 | 59980497 | + | chr1 | 60019796 | 60019899 | + | ENST00000371218; ENST00000303721; ENST00000430447; ENST00000371212 | TSF |
| 18% | chr1 | 59980221 | 59980497 | + | chr1 | 60019796 | 60019899 | + | ENST00000371218; ENST00000303721; ENST00000430447; ENST00000371212 | TSF |
| 18% | chr1 | 59980221 | 59980497 | + | chr1 | 60019796 | 60019899 | + | ENST00000371218; ENST00000303721; ENST00000430447; ENST00000371212 | TSF |
| 17% | chr20 | 61301271 | 61301405 | + | chr20 | 61303102 | 61303245 | + | ENST00000217159; ENST00000370507; ENST00000451793 | TAF |

TABLE 52-continued

Transcript fusion for Rectum adenocarcinoma (READ) Coordinates of the fusion sequences for which the donor is the exon.

| 1 | 2' | 3' | 4' | 5' | 6' | 7' | 8' | 9' | 10' | 11' |
|---|---|---|---|---|---|---|---|---|---|---|
| 16% | chr12 | 20780314 | 20780410 | + | chr12 | 20782842 | 20783061 | + | ENST00000359062 | TAF |
| 15% | chr13 | 43659219 | 43659268 | + | chr13 | 43659904 | 43659974 | + | ENST00000379221 | TAF |
| 15% | chr7 | 116364854 | 116364901 | + | chr7 | 116371722 | 116371913 | + | ENST00000397752; ENST00000318493; ENST00000436117 | TAF |
| 15% | chr7 | 116364854 | 116364901 | + | chr7 | 116371722 | 116371913 | + | ENST00000397752; ENST00000318493; ENST00000436117 | TAF |
| 15% | chr7 | 116364854 | 116364901 | + | chr7 | 116371722 | 116371913 | + | ENST00000397752; ENST00000318493; ENST00000436117 | TAF |
| 15% | chr20 | 33601951 | 33601885 | − | chr20 | 33600869 | 33600811 | − | ENST00000451813; ENST00000252015; ENST00000539834; ENST00000432634 | TAF |
| 15% | chr7 | 100850556 | 100850506 | − | chr7 | 100850185 | 100850060 | − | ENST00000454310; ENST00000223127 | TSF |
| 14% | chr2 | 99797199 | 99797170 | − | chr2 | 99790479 | 99790378 | − | ENST00000422537; ENST00000289359; ENST00000409107 | TAF |
| 14% | chr2 | 99797199 | 99797170 | − | chr2 | 99790479 | 99790378 | − | ENST00000422537; ENST00000289359; ENST00000409107 | TAF |
| 14% | chr2 | 85059551 | 85059512 | − | chr2 | 85059269 | 85059179 | | ENST00000335459; ENST00000409520 | TAF |
| 13% | chr16 | 718049 | 718154 | + | chr16 | 718353 | 718411 | + | ENST00000315082; ENST00000561983; ENST00000563134; ENST00000563637; ENST00000570280; ENST00000562333; ENST00000561929 | TAF |
| 13% | chr16 | 718049 | 718154 | + | chr16 | 718353 | 718411 | + | ENST00000315082; ENST00000561983; ENST00000563134; ENST00000563637; ENST00000570280; ENST00000562333; ENST00000561929 | TAF |
| 13% | chr16 | 718049 | 718154 | + | chr16 | 718353 | 718411 | + | ENST00000315082; ENST00000561983; ENST00000563134; ENST00000563637; ENST00000570280; ENST00000562333; ENST00000561929 | TAF |
| 13% | chr16 | 718049 | 718154 | + | chr16 | 718353 | 718411 | + | ENST00000315082; ENST00000561983; ENST00000563134; ENST00000563637; ENST00000570280; ENST00000562333; ENST00000561929 | TAF |
| 13% | chr16 | 718049 | 718154 | + | chr16 | 718353 | 718411 | + | ENST00000315082; ENST00000561983; ENST00000563134; ENST00000563637; ENST00000570280; ENST00000562333; ENST00000561929 | TAF |
| 13% | chr3 | 9953662 | 9953735 | + | chr3 | 9955640 | 9955708 | + | ENST00000421412; ENST00000295980; ENST00000383814; ENST00000454190 | TAF |
| 13% | chr3 | 9953662 | 9953735 | + | chr3 | 9955640 | 9955708 | + | ENST00000421412; ENST00000295980; ENST00000383814; ENST00000454190 | TAF |
| 13% | chr1 | 165863702 | 165863816 | + | chr1 | 165865427 | 165865569 | + | ENST00000367879 | TAF |
| 13% | chr9 | 128362212 | 128362114 | − | chr9 | 128348006 | 128347834 | − | ENST00000373511; ENST00000373498; ENST00000350766; ENST00000265960; ENST00000394060; ENST00000468896 | TAF |
| 13% | chr9 | 128362212 | 128362114 | − | chr9 | 128348006 | 128347834 | − | ENST00000373511; ENST00000373498; ENST00000350766; ENST00000265960; ENST00000394060; ENST00000468896 | TAF |
| 13% | chr9 | 128362212 | 128362114 | − | chr9 | 128348006 | 128347834 | − | ENST00000373511; ENST00000373498; ENST00000350766; ENST00000265960; ENST00000394060; ENST00000468896 | TAF |
| 13% | chr9 | 128362212 | 128362114 | − | chr9 | 128348006 | 128347834 | − | ENST00000373511; ENST00000373498; ENST00000350766; ENST00000265960; ENST00000394060; ENST00000468896 | TAF |
| 13% | chr9 | 128362212 | 128362114 | − | chr9 | 128348006 | 128347834 | − | ENST00000373511; ENST00000373498; ENST00000350766; ENST00000265960; ENST00000394060; ENST00000468896 | TAF |
| 13% | chr10 | 120902016 | 120901765 | − | chr10 | 120900831 | 120900754 | − | ENST00000355697; ENST00000330036 | TAF |
| 13% | chr1 | 59843828 | 59844080 | + | chr1 | 59844421 | 59844509 | + | ENST00000413489; ENST00000371218; ENST00000303721; ENST00000430447; ENST00000371212 | TSF |
| 13% | chr1 | 59843828 | 59844080 | + | chr1 | 59844421 | 59844509 | + | ENST00000413489; ENST00000371218; ENST00000303721; ENST00000430447; ENST00000371212 | TSF |
| 13% | chr1 | 59843828 | 59844080 | + | chr1 | 59844421 | 59844509 | + | ENST00000413489; ENST00000371218; ENST00000303721; ENST00000430447; ENST00000371212 | TSF |
| 13% | chr1 | 59843828 | 59844080 | + | chr1 | 59844421 | 59844509 | + | ENST00000413489; ENST00000371218; ENST00000303721; ENST00000430447; ENST00000371212 | TSF |
| 13% | chr12 | 15701006 | 15701267 | + | chr12 | 15702028 | 15702160 | + | ENST00000281171; ENST00000348962; ENST00000535311 | TSF |

TABLE 52-continued

Transcript fusion for Rectum adenocarcinoma (READ) Coordinates of the fusion sequences for which the donor is the exon.

| 1 | 2' | 3' | 4' | 5' | 6' | 7' | 8' | 9' | 10' | 11' |
|---|---|---|---|---|---|---|---|---|---|---|
| 13% | chr12 | 15701006 | 15701267 | + | chr12 | 15702028 | 15702160 | + | ENST00000281171; ENST00000348962; ENST00000535311 | TSF |
| 13% | chr12 | 15701006 | 15701267 | + | chr12 | 15702028 | 15702160 | + | ENST00000281171; ENST00000348962; ENST00000535311 | TSF |
| 12% | chr4 | 107241932 | 107242850 | + | chr4 | 107246142 | 107246275 | + | ENST00000394701 | TAF |
| 12% | chr13 | 98628730 | 98628756 | + | chr13 | 98628947 | 98629040; 98629046 | + | ENST00000460070; ENST00000481455; ENST00000261574; ENST00000493281; ENST00000490369; ENST00000463157; ENST00000489058; ENST00000481689; ENST00000480611; ENST00000485433; ENST00000496368; ENST00000421861 | TAF |
| 12% | chr13 | 98628730 | 98628756 | + | chr13 | 98628947 | 98629040; 98629046 | + | ENST00000460070; ENST00000481455; ENST00000261574; ENST00000493281; ENST00000490369; ENST00000463157; ENST00000489058; ENST00000481689; ENST00000480611; ENST00000485433; ENST00000496368; ENST00000421861 | TAF |
| 12% | chr13 | 98628730 | 98628756 | + | chr13 | 98628947 | 98629040; 98629046 | + | ENST00000460070; ENST00000481455; ENST00000261574; ENST00000493281; ENST00000490369; ENST00000463157; ENST00000489058; ENST00000481689; ENST00000480611; ENST00000485433; ENST00000496368; ENST00000421861 | TAF |
| 12% | chr13 | 98628730 | 98628756 | + | chr13 | 98628947 | 98629040; 98629046 | + | ENST00000460070; ENST00000481455; ENST00000261574; ENST00000493281; ENST00000490369; ENST00000463157; ENST00000489058; ENST00000481689; ENST00000480611; ENST00000485433; ENST00000496368; ENST00000421861 | TAF |
| 12% | chr13 | 98628730 | 98628756 | + | chr13 | 98628947 | 98629040; 98629046 | + | ENST00000460070; ENST00000481455; ENST00000261574; ENST00000493281; ENST00000490369; ENST00000463157; ENST00000489058; ENST00000481689; ENST00000480611; ENST00000485433; ENST00000496368; ENST00000421861 | TAF |
| 12% | chr13 | 98628730 | 98628756 | + | chr13 | 98628947 | 98629040; 98629046 | + | ENST00000460070; ENST00000481455; ENST00000261574; ENST00000493281; ENST00000490369; ENST00000463157; ENST00000489058; ENST00000481689; ENST00000480611; ENST00000485433; ENST00000496368; ENST00000421861 | TAF |
| 12% | chr13 | 98628730 | 98628756 | + | chr13 | 98628947 | 98629040; 98629046 | + | ENST00000460070; ENST00000481455; ENST00000261574; ENST00000493281; ENST00000490369; ENST00000463157; ENST00000489058; ENST00000481689; ENST00000480611; ENST00000485433; ENST00000496368; ENST00000421861 | TAF |
| 12% | chr13 | 98628730 | 98628756 | + | chr13 | 98628947 | 98629040; 98629046 | + | ENST00000460070; ENST00000481455; ENST00000261574; ENST00000493281; ENST00000490369; ENST00000463157; ENST00000489058; ENST00000481689; ENST00000480611; ENST00000485433; ENST00000496368; ENST00000421861 | TAF |
| 12% | chr13 | 98628730 | 98628756 | + | chr13 | 98628947 | 98629040; 98629046 | + | ENST00000460070; ENST00000481455; ENST00000261574; ENST00000493281; ENST00000490369; ENST00000463157; ENST00000489058; ENST00000481689; ENST00000480611; ENST00000485433; ENST00000496368; ENST00000421861 | TAF |
| 12% | chr13 | 98628730 | 98628756 | + | chr13 | 98628947 | 98629040; 98629046 | + | ENST00000460070; ENST00000481455; ENST00000261574; ENST00000493281; ENST00000490369; ENST00000463157; ENST00000489058; ENST00000481689; ENST00000480611; ENST00000485433; ENST00000496368; ENST00000421861 | TAF |
| 12% | chr13 | 98628730 | 98628756 | + | chr13 | 98628947 | 98629040; 98629046 | + | ENST00000460070; ENST00000481455; ENST00000261574; ENST00000493281; ENST00000490369; ENST00000463157; ENST00000489058; ENST00000481689; | TAF |

TABLE 52-continued

Transcript fusion for Rectum adenocarcinoma (READ) Coordinates of the fusion sequences for which the donor is the exon.

| 1 | 2' | 3' | 4' | 5' | 6' | 7' | 8' | 9' | 10' | 11' |
|---|---|---|---|---|---|---|---|---|---|---|
| 11% | chr21 | 42597177 | 42597622 | + | chr21 | 42598193 | 42598281 | + | ENST00000480611; ENST00000485433; ENST00000496368; ENST00000421861 ENST00000328735; ENST00000330333; ENST00000347667 | TAF |
| 11% | chr21 | 42597177 | 42597622 | + | chr21 | 42598193 | 42598281 | + | ENST00000328735; ENST00000330333; ENST00000347667 | TAF |
| 11% | chr21 | 42597177 | 42597622 | + | chr21 | 42598193 | 42598281 | + | ENST00000328735; ENST00000330333; ENST00000347667 | TAF |
| 11% | chr20 | 35844460 | 35844528 | + | chr20 | 35852281 | 35852372 | + | ENST00000237530; ENST00000373622 | TAF |
| 11% | chr20 | 35844460 | 35844528 | + | chr20 | 35852281 | 35852372 | + | ENST00000237530; ENST00000373622 | TAF |
| 11% | chr11 | 63953789 | 63953882 | + | chr11 | 63960550 | 63960759 | + | ENST00000358794; ENST00000305218; ENST00000536973; ENST00000538945; ENST00000543847 | TAF |
| 11% | chr11 | 63953789 | 63953882 | + | chr11 | 63960550 | 63960759 | + | ENST00000358794; ENST00000305218; ENST00000536973; ENST00000538945; ENST00000543847 | TAF |
| 11% | chr11 | 63953789 | 63953882 | + | chr11 | 63960550 | 63960759 | + | ENST00000358794; ENST00000305218; ENST00000536973; ENST00000538945; ENST00000543847 | TAF |
| 11% | chr11 | 63953789 | 63953882 | + | chr11 | 63960550 | 63960759 | + | ENST00000358794; ENST00000305218; ENST00000536973; ENST00000538945; ENST00000543847 | TAF |
| 11% | chr9 | 33787120 | 33787393 | + | chr9 | 33796641 | 33796800 | + | ENST00000361005; ENST00000457896; ENST00000342836; ENST00000429677; ENST00000379405 | TAF |
| 11% | chr9 | 33787120 | 33787393 | + | chr9 | 33796641 | 33796800 | + | ENST00000361005; ENST00000457896; ENST00000342836; ENST00000429677; ENST00000379405 | TAF |
| 11% | chr13 | 41835911 | 41835827 | − | chr13 | 41835051 | 41834629 | − | ENST00000430347 | TAF |
| 11% | chr5 | 173041966 | 173041919 | − | chr5 | 173040258 | 173040134 | − | ENST00000311086; ENST00000285908 | TAF |
| 11% | chr5 | 173041966 | 173041919 | − | chr5 | 173040258 | 173040134 | − | ENST00000311086; ENST00000285908 | TAF |
| 7% | chr13 | 34394352 | 34394605 | + | chr13 | 34395269 | 34395406 | + | ENST00000380071; ENST00000434425 | TSF |
| 7% | chr13 | 34394352 | 34394605 | + | chr13 | 34395269 | 34395406 | + | ENST00000380071; ENST00000434425 | TSF |
| 7% | chr14 | 51360331 | 51360476 | + | chr14 | 51368547 | 51368629 | + | ENST00000337334; ENST00000353130; ENST00000395752 | TSF |
| 6% | chr20 | 9311166 | 9311205 | + | chr20 | 9317773 | 9317853 | + | ENST00000407043; ENST00000441846; ENST00000334005; ENST00000378473; ENST00000437503; ENST00000416836; ENST00000278655; ENST00000414679; ENST00000378493; ENST00000378501 | TSF |
| 6% | chr20 | 9311166 | 9311205 | + | chr20 | 9317773 | 9317853 | + | ENST00000407043; ENST00000441846; ENST00000334005; ENST00000378473; ENST00000437503; ENST00000416836; ENST00000278655; ENST00000414679; ENST00000378493; ENST00000378501 | TSF |
| 6% | chr20 | 9311166 | 9311205 | + | chr20 | 9317773 | 9317853 | + | ENST00000407043; ENST00000441846; ENST00000334005; ENST00000378473; ENST00000437503; ENST00000416836; ENST00000278655; ENST00000414679; ENST00000378493; ENST00000378501 | TSF |
| 6% | chr20 | 9311166 | 9311205 | + | chr20 | 9317773 | 9317853 | + | ENST00000407043; ENST00000441846; ENST00000334005; ENST00000378473; ENST00000437503; ENST00000416836; ENST00000278655; ENST00000414679; ENST00000378493; ENST00000378501 | TSF |
| 6% | chr20 | 9311166 | 9311205 | + | chr20 | 9317773 | 9317853 | + | ENST00000407043; ENST00000441846; ENST00000334005; ENST00000378473; ENST00000437503; ENST00000416836; ENST00000278655; ENST00000414679; ENST00000378493; ENST00000378501 | TSF |
| 6% | chr20 | 9311166 | 9311205 | + | chr20 | 9317773 | 9317853 | + | ENST00000407043; ENST00000441846; ENST00000334005; ENST00000378473; ENST00000437503; ENST00000416836; ENST00000278655; ENST00000414679; ENST00000378493; ENST00000378501 | TSF |
| 6% | chr20 | 9311166 | 9311205 | + | chr20 | 9317773 | 9317853 | + | ENST00000407043; ENST00000441846; ENST00000334005; ENST00000378473; ENST00000437503; ENST00000416836; ENST00000278655; ENST00000414679; ENST00000378493; ENST00000378501 | TSF |
| 6% | chr7 | 117315827 | 117316035 | + | chr7 | 117355812 | 117355913 | + | ENST00000600166 | TSF |
| 6% | chr8 | 128749913 | 128749923 | + | chr8 | 128750494 | 128751265 | + | ENST00000377970 | TSF |
| 6% | chr21 | 40180090 | 40180187 | + | chr21 | 40181959 | 40182030 | + | ENST00000360214; ENST00000360938; ENST00000432278; ENST00000456966 | TSF |
| 6% | chr21 | 40180090 | 40180187 | + | chr21 | 40181959 | 40182030 | + | ENST00000360214; ENST00000360938; | TSF |

TABLE 52-continued

Transcript fusion for Rectum adenocarcinoma (READ) Coordinates of the fusion sequences for which the donor is the exon.

| 1 | 2' | 3' | 4' | 5' | 6' | 7' | 8' | 9' | 10' | 11' |
|---|---|---|---|---|---|---|---|---|---|---|
| 6% | chr21 | 40180090 | 40180187 | + | chr21 | 40181959 | 40182030 | + | ENST00000432278; ENST00000456966 ENST00000360214; ENST00000360938; ENST00000432278; ENST00000456966 | TSF |
| 6% | chr19 | 48627094 | 48627044 | − | chr19 | 48626575 | 48626431 | − | ENST00000263274; ENST00000536218; ENST00000594759; ENST00000427526; ENST00000601091 | TSF |
| 6% | chr19 | 48627094 | 48627044 | − | chr19 | 48626575 | 48626431 | − | ENST00000263274; ENST00000536218; ENST00000594759; ENST00000427526; ENST00000601091 | TSF |

TABLE 53

Transcript fusion for Sarcoma (SARC) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 22% | chr12 | 6943089 | 6943213 | + | ENST00000251761; ENST00000396725; ENST00000606935 | chr12 | 6943989 | 6944119 | + | TAF |
| 22% | chr12 | 6943089 | 6943213 | + | ENST00000251761; ENST00000396725; ENST00000606935 | chr12 | 6943989 | 6944119 | + | TAF |
| 22% | chr12 | 6943089 | 6943213 | + | ENST00000251761; ENST00000396725; ENST00000606935 | chr12 | 6943989 | 6944119 | + | TAF |
| 20% | chr20 | 48124601 | 48124521 | − | ENST00000244043 | chr20 | 48123357 | 48123321 | − | TAF |
| 18% | chr15 | 79054907 | 79054745 | − | ENST00000388820 | chr15 | 79054428 | 79054400 | − | TAF |
| 18% | chr9 | 131002264 | 131002275 | + | ENST00000475805; ENST00000341179; ENST00000372923; ENST00000393594; ENST00000486160 | chr9 | 131002706 | 131002973 | + | TAF |
| 18% | chr9 | 131002264 | 131002275 | + | ENST00000475805; ENST00000341179; ENST00000372923; ENST00000393594; ENST00000486160 | chr9 | 131002706 | 131002973 | + | TAF |
| 18% | chr11 | 74414012 | 74413839 | − | ENST00000263671; ENST00000376332; ENST00000528789 | chr11 | 74412552 | 74412398 | − | TAF |
| 18% | chr11 | 74414012 | 74413839 | − | ENST00000263671; ENST00000376332; ENST00000528789 | chr11 | 74412552 | 74412398 | − | TAF |
| 16% | chr1 | 11115983; 11115877 | 11115838 | − | ENST00000376957; ENST00000490101 | chr1 | 11115464 | 11115178 | − | TSF |
| 16% | chr1 | 11115983; 11115877 | 11115838 | − | ENST00000376957; ENST00000490101 | chr1 | 11115464 | 11115178 | − | TSF |
| 15% | chr20 | 3654143 | 3654001 | − | ENST00000356518; ENST00000379861; ENST00000350009 | chr20 | 3653870 | 3653815 | − | TAF |
| 15% | chr16 | 15844188 | 15843995 | − | ENST00000396324; ENST00000452625; ENST00000576790; ENST00000300036 | chr16 | 15842631 | 15842472 | − | TAF |
| 15% | chr16 | 15844188 | 15843995 | − | ENST00000396324; ENST00000452625; ENST00000576790; ENST00000300036 | chr16 | 15842631 | 15842472 | − | TAF |
| 14% | chr22 | 38074490 | 38074661 | + | ENST00000215909 | chr22 | 38079136 | 38079241 | + | TAF |
| 14% | chr8 | 74939024 | 74939076 | + | ENST00000284818; ENST00000518893 | chr8 | 74944554 | 74944936 | + | TAF |
| 14% | chr8 | 74939024 | 74939076 | + | ENST00000284818; ENST00000518893 | chr8 | 74944554 | 74944936 | + | TAF |
| 14% | chr8 | 121282274 | 121282413 | + | ENST00000309791; ENST00000297848; ENST00000247781 | chr8 | 121289724 | 121290171 | + | TSF |
| 14% | chr8 | 121282274 | 121282413 | + | ENST00000309791; ENST00000297848; ENST00000247781 | chr8 | 121289724 | 121290171 | + | TSF |
| 12% | chrX | 152730513 | 152730446 | − | ENST00000370211; ENST00000370212; ENST00000370210 | chrX | 152728559 | 152728505 | − | TAF |
| 12% | chrX | 152730513 | 152730446 | − | ENST00000370211; ENST00000370212; ENST00000370210 | chrX | 152728559 | 152728505 | − | TAF |
| 12% | chr20 | 53092486 | 53092551 | + | ENST00000262593 | chr20 | 53111339 | 53111426 | + | TAF |
| 11% | chr16 | 4409386 | 4409297 | − | ENST00000572467; ENST00000251166; ENST00000539968; ENST00000537233; ENST00000574025; ENST00000576637 | chr16 | 4409070 | 4408945 | − | TAF |
| 11% | chr16 | 4409386 | 4409297 | − | ENST00000572467; ENST00000251166; ENST00000539968; ENST00000537233; ENST00000574025; ENST00000576637 | chr16 | 4409070 | 4408945 | − | TAF |
| 11% | chr16 | 4409386 | 4409297 | − | ENST00000572467; ENST00000251166; ENST00000539968; ENST00000537233; ENST00000574025; ENST00000576637 | chr16 | 4409070 | 4408945 | − | TAF |
| 11% | chr16 | 4409386 | 4409297 | − | ENST00000572467; ENST00000251166; ENST00000539968; ENST00000537233; ENST00000574025; ENST00000576637 | chr16 | 4409070 | 4408945 | − | TAF |
| 11% | chr16 | 4409386 | 4409297 | − | ENST00000572467; ENST00000251166; ENST00000539968; ENST00000537233; ENST00000574025; ENST00000576637 | chr16 | 4409070 | 4408945 | − | TAF |

TABLE 53-continued

Transcript fusion for Sarcoma (SARC) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 11% | chr20 | 35842163 | 35842268 | + | ENST00000237530; ENST00000373622 | chr20 | 35844460 | 35844765 | + | TAF |
| 11% | chr20 | 35842163 | 35842268 | + | ENST00000237530; ENST00000373622 | chr20 | 35844460 | 35844765 | + | TAF |
| 11% | chr6 | 10749855; 10749898 | 10749931 | + | ENST00000379542; ENST00000473166; ENST00000463448; ENST00000460341; ENST00000480294; ENST00000473807; ENST00000461342; ENST00000475942; ENST 00000379530; ENST00000463100; ENST00000481240; ENST00000467317; ENST00000478732 | chr6 | 10829240 | 10829256 | + | TAF |
| 11% | chr6 | 10749855; 10749898 | 10749931 | + | ENST00000379542; ENST00000473166; ENST00000463448; ENST00000460341; ENST00000480294; ENST00000473807; ENST00000461342; ENST00000475942; ENST00000379530; ENST00000463100; ENST00000481240; ENST00000467317; ENST00000478732 | chr6 | 10829240 | 10829256 | + | TAF |
| 10% | chr4 | 1742553 | 1742713 | + | ENST00000313288 | chr4 | 1745122 | 1745307 | + | TAF |
| 10% | chr9 | 101984828 | 101984925 | + | ENST00000223641 | chr9 | 101986374 | 101986588 | + | TAF |
| 10% | chr11 | 74412691 | 74412637 | − | ENST00000263671 | chr11 | 74412552 | 74412398 | − | TAF |
| 10% | chr13 | 111138002 | 111138183 | + | ENST00000360467 | chr13 | 111139687 | 111139825 | + | TSF |
| 8% | chr12 | 58024115 | 58023935 | − | ENST00000341156; ENST00000418555; ENST00000552798; ENST00000549391; ENST00000449184; ENST00000550764; ENST00000552350; ENST00000548888 | chr12 | 58023079 | 58022983 | − | TSF |
| 8% | chr12 | 58024115 | 58023935 | − | ENST00000341156; ENST00000418555; ENST00000552798; ENST00000549391; ENST00000449184; ENST00000550764; ENST00000552350; ENST00000548888 | chr12 | 58023079 | 58022983 | − | TSF |
| 8% | chr12 | 58024115 | 58023935 | − | ENST00000341156; ENST00000418555; ENST00000552798; ENST00000549391; ENST00000449184; ENST00000550764; ENST00000552350; ENST00000548888 | chr12 | 58023079 | 58022983 | − | TSF |
| 8% | chr12 | 58024115 | 58023935 | − | ENST00000341156; ENST00000418555; ENST00000552798; ENST00000549391; ENST00000449184; ENST00000550764; ENST00000552350; ENST00000548888 | chr12 | 58023079 | 58022983 | − | TSF |
| 8% | chr15 | 74219125 | 74220226 | + | ENST00000566011; ENST00000261921 | chr15 | 74234853 | 74234966 | + | TSF |
| 8% | chr7 | 73459552 | 73459623 | + | ENST00000445912; ENST00000252034; ENST00000358929; ENST00000320492; ENST00000438906; ENST00000414324; ENST00000380562; ENST00000380575; ENST 00000380584; ENST00000458204; ENST00000357036; ENST00000429192; ENST00000380576; ENST00000320399 | chr7 | 73460337 | 73460377 | + | TSF |
| 8% | chr7 | 73459552 | 73459623 | + | ENST00000445912; ENST00000252034; ENST00000358929; ENST00000320492; ENST00000438906; ENST00000414324; ENST00000380562; ENST00000380575; ENST00000380584; ENST00000458204; ENST00000357036; ENST00000429192; ENST00000380576; ENST00000320399 | chr7 | 73460337 | 73460377 | + | TSF |
| 8% | chr7 | 73459552 | 73459623 | + | ENST00000445912; ENST00000252034; ENST00000358929; ENST00000320492; ENST00000438906; ENST00000414324; ENST00000380562; ENST00000380575; ENST00000380584; ENST00000458204; ENST00000357036; ENST00000429192; ENST00000380576; ENST00000320399 | chr7 | 73460337 | 73460377 | + | TSF |
| 8% | chr7 | 73459552 | 73459623 | + | ENST00000445912; ENST00000252034; ENST00000358929; ENST00000320492; ENST00000438906; ENST00000414324; ENST00000380562; ENST00000380575; ENST00000380584; ENST00000458204; ENST00000357036; ENST00000429192; ENST00000380576; ENST00000320399 | chr7 | 73460337 | 73460377 | + | TSF |
| 8% | chr7 | 73459552 | 73459623 | + | ENST00000445912; ENST00000252034; ENST00000358929; ENST00000320492; ENST00000438906; ENST00000414324; ENST00000380562; ENST00000380575; ENST00000380584; ENST00000458204; ENST00000357036; ENST00000429192; ENST00000380576; ENST00000320399 | chr7 | 73460337 | 73460377 | + | TSF |
| 7% | chr3 | 48716169 | 48715997 | − | ENST00000341520; ENST00000416649; ENST00000294129; ENST00000413374 | chr3 | 48702393 | 48702198 | − | TSF |
| 7% | chr3 | 48716169 | 48715997 | − | ENST00000341520; ENST00000416649; | chr3 | 48702393 | 48702198 | − | TSF |

TABLE 53-continued

Transcript fusion for Sarcoma (SARC) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|----|----|
| 7% | chr3 | 48716169 | 48715997 | – | ENST00000294129; ENST00000413374; ENST00000341520; ENST00000416649; ENST00000294129; ENST00000413374 | chr3 | 48702393 | 48702198 | – | TSF |
| 7% | chr12 | 8807077 | 8807033 | – | ENST00000535411; ENST00000359478; ENST00000396549; ENST00000543369; ENST00000544211; ENST00000535336; ENST00000540087; ENST00000537009; ENST00000544889 | chr12 | 8793960 | 8793803 | – | TSF |
| 7% | chr12 | 8807077 | 8807033 | – | ENST00000535411; ENST00000359478; ENST00000396549; ENST00000543369; ENST00000544211; ENST00000535336; ENST00000540087; ENST00000537009; ENST00000544889 | chr12 | 8793960 | 8793803 | – | TSF |
| 7% | chr12 | 8807077 | 8807033 | – | ENST00000535411; ENST00000359478; ENST00000396549; ENST00000543369; ENST00000544211; ENST00000535336; ENST00000540087; ENST00000537009; ENST00000544889 | chr12 | 8793960 | 8793803 | – | TSF |
| 5% | chr1 | 25891664 | 25891698 | + | ENST00000374338 | chr1 | 25916660 | 25916675 | + | TSF |
| 5% | chr10 | 81901900; 81901838 | 81901935 | + | ENST00000372270; ENST00000372267; ENST00000372263 | chr10 | 81903525 | 81903598 | + | TSF |
| 5% | chr10 | 81901900; 81901838 | 81901935 | + | ENST00000372270; ENST00000372267; ENST00000372263 | chr10 | 81903525 | 81903598 | + | TSF |
| 5% | chr20 | 48184653 | 48184580 | – | ENST00000244043 | chr20 | 48177475 | 48177085 | – | TSF |
| 4% | chr19 | 55178148; 55178145 | 55178200 | + | ENST00000391736; ENST00000270452; ENST00000430952; ENST00000391734; ENST00000391733; ENST00000434286 | chr19 | 55178294 | 55178458 | + | TSF |
| 4% | chr19 | 55178148; 55178145 | 55178200 | + | ENST00000391736; ENST00000270452; ENST00000430952; ENST00000391734; ENST00000391733; ENST00000434286 | chr19 | 55178294 | 55178458 | + | TSF |
| 4% | chr19 | 55178148; 55178145 | 55178200 | + | ENST00000391736; ENST00000270452; ENST00000430952; ENST00000391734; ENST00000391733; ENST00000434286 | chr19 | 55178294 | 55178458 | + | TSF |
| 4% | chr1 | 225156461 | 225156576 | + | ENST00000430092; ENST00000400952; ENST00000366849; ENST00000439375 | chr1 | 225157336 | 225158402 | + | TSF |
| 4% | chr1 | 225156461 | 225156576 | + | ENST00000430092; ENST00000400952; ENST00000366849; ENST00000439375 | chr1 | 225157336 | 225158402 | + | TSF |
| 4% | chr2 | 28352138 | 28352247 | + | ENST00000344773; ENST00000379624; ENST00000342045; ENST00000361704; ENST00000379632; ENST00000379629 | chr2 | 28362015 | 28362218 | + | TSF |
| 4% | chr15 | 65687596 | 65687432 | – | ENST00000352385 | chr15 | 65687004 | 65686908 | – | TSF |
| 4% | chr6 | 85448309 | 85448215 | – | ENST00000606784; ENST00000369663 | chr6 | 85377422 | 85377053 | – | TSF |
| 4% | chr6 | 85448309 | 85448215 | – | ENST00000606784; ENST00000369663 | chr6 | 85377422 | 85377053 | – | TSF |
| 3% | chr3 | 13659576 | 13659785 | + | ENST00000535798; ENST00000404922; ENST00000295760; ENST00000492059 | chr3 | 13660222 | 13660288 | + | TSF |
| 3% | chr3 | 13659576 | 13659785 | + | ENST00000535798; ENST00000404922; ENST00000295760; ENST00000492059 | chr3 | 13660222 | 13660288 | + | TSF |
| 3% | chr2 | 112933291 | 112933416 | + | ENST00000331203; ENST00000409903; ENST00000409450; ENST00000441565 | chr2 | 112935633 | 112935771 | + | TSF |
| 3% | chr2 | 112933291 | 112933416 | + | ENST00000331203; ENST00000409903; ENST00000409450; ENST00000441565 | chr2 | 112935633 | 112935771 | + | TSF |
| 3% | chr20 | 29632611 | 29632721 | + | ENST00000278882; ENST00000358464 | chr20 | 29652086 | 29652324 | + | TSF |
| 3% | chr15 | 74234216 | 74234399 | + | ENST00000566011 | chr15 | 74234853 | 74234966 | + | TSF |
| 3% | chr1 | 161968139 | 161967615 | – | ENST00000294794; ENST00000367940 | chr1 | 161962049 | 161961535 | – | TSF |
| 3% | chr1 | 161968139 | 161967615 | – | ENST00000294794; ENST00000367940 | chr1 | 161962049 | 161961535 | – | TSF |
| 3% | chr17 | 66972154 | 66972092 | – | ENST00000340001; ENST00000453985 | chr17 | 66971441 | 66970995 | – | TSF |
| 3% | chr17 | 66972154 | 66972092 | – | ENST00000340001; ENST00000453985 | chr17 | 66971441 | 66970995 | – | TSF |
| 3% | chr10 | 127483547 | 127483449 | – | ENST00000368797; ENST00000368786 | chr10 | 127473829 | 127473633 | – | TSF |
| 3% | chr7 | 22532348 | 22532184 | – | ENST00000406890; ENST00000404369; ENST00000424363 | chr7 | 22512853 | 22512669 | – | TSF |
| 3% | chr7 | 22532348 | 22532184 | – | ENST00000406890; ENST00000404369; ENST00000424363 | chr7 | 22512853 | 22512669 | – | TSF |
| 3% | chr1 | 25883644 | 25883758 | + | ENST00000374338 | chr1 | 25916660 | 25916675 | + | TSF |
| 3% | chr3 | 13659576 | 13659785 | + | ENST00000535798; ENST00000404922; ENST00000295760; ENST00000492059 | chr3 | 13660219 | 13660288 | + | TSF |
| 3% | chr3 | 13659576 | 13659785 | + | ENST00000535798; ENST00000404922; ENST00000295760; ENST00000492059 | chr3 | 13660219 | 13660288 | + | TSF |
| 3% | chr1 | 2492063 | 2492153 | + | ENST00000426449; ENST00000434817; ENST00000435221; ENST00000451778; ENST00000409119; ENST00000355716 | chr1 | 2508457 | 2508463 | + | TSF |
| 3% | chr7 | 91509397 | 91509369 | – | ENST00000351870; ENST00000442961 | chr7 | 91430582 | 91429696 | – | TSF |
| 3% | chr5 | 121405863 | 121405748 | – | ENST00000231004 | chr5 | 121403052 | 121403016 | – | TSF |
| 3% | chr7 | 75617128 | 75617036 | – | ENST00000493111 | chr7 | 75603302 | 75603295 | – | TSF |
| 3% | chr8 | 52287291 | 52287157 | – | ENST00000522628; ENST00000356297; ENST00000543296 | chr8 | 52286772 | 52286772 | – | TSF |

TABLE 53-continued

Transcript fusion for Sarcoma (SARC) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|----|----|
| 3% | chr8 | 52287291 | 52287157 | − | ENST00000522628; ENST00000356297; ENST00000543296 | chr8 | 52286772 | 52286772 | − | TSF |
| 3% | chr4 | 83626566 | 83626436 | − | ENST00000319540; ENST00000273908; ENST0000282709 | chr4 | 83616035 | 83615829 | − | TSF |
| 3% | chr10 | 128019078 | 128018981 | − | ENST00000368679; ENST00000368676; ENST00000448723 | chr10 | 127981199 | 127981183 | − | TSF |
| 3% | chr17 | 73887428 | 73887358 | − | ENST00000591668; ENST00000592642; ENST00000269383; ENST00000543309 | chr17 | 73885428 | 73885139 | − | TSF |
| 3% | chr17 | 73887428 | 73887358 | − | ENST00000591668; ENST00000592642; ENST00000269383; ENST00000543309 | chr17 | 73885428 | 73885139 | − | TSF |
| 3% | chr17 | 73887428 | 73887358 | − | ENST00000591668; ENST00000592642; ENST00000269383; ENST00000543309 | chr17 | 73885428 | 73885139 | − | TSF |
| 3% | chr17 | 73887428 | 73887358 | − | ENST00000591668; ENST00000592642; ENST00000269383; ENST00000543309 | chr17 | 73885428 | 73885139 | − | TSF |
| 3% | chr19 | 41838186 | 41838033 | − | ENST00000598758; ENST00000221930 | chr19 | 41818843 | 41818697 | − | TSF |
| 3% | chr19 | 41838186 | 41838033 | − | ENST00000598758; ENST00000221930 | chr19 | 41818843 | 41818697 | − | TSF |
| 2% | chr16 | 30783410 | 30783511 | + | ENST00000324685; ENST00000402121; ENST00000563683; ENST00000357890 | chr16 | 30785136 | 30785155 | + | TSF |
| 2% | chr16 | 30783410 | 30783511 | + | ENST00000324685; ENST00000402121; ENST00000563683; ENST00000357890 | chr16 | 30785136 | 30785155 | + | TSF |
| 2% | chr16 | 30783410 | 30783511 | + | ENST00000324685; ENST00000402121; ENST00000563683; ENST00000357890 | chr16 | 30785136 | 30785155 | + | TSF |
| 2% | chr16 | 30783410 | 30783511 | + | ENST00000324685; ENST00000402121; ENST00000563683; ENST00000357890 | chr16 | 30785136 | 30785155 | + | TSF |
| 2% | chr8 | 41387722 | 41387817 | + | ENST00000276533; ENST00000520354; ENST00000520710; ENST00000518671; ENST00000523277 | chr8 | 41388646 | 41388815 | + | TSF |
| 2% | chr9 | 17143286 | 17143374 | + | ENST00000380647; ENST00000262360; ENST00000425824; ENST00000380641 | chr9 | 17166816 | 17167136 | + | TSF |
| 2% | chr9 | 133301074 | 133301311 | + | ENST00000428715 | chr9 | 133302166 | 133302266 | + | TSF |
| 2% | chr13 | 114157811 | 114157903 | + | ENST00000434316; ENST00000375391 | chr13 | 114159741 | 114159770 | + | TSF |
| 2% | chr19 | 48830778 | 48830880 | + | ENST00000599704; ENST00000270221; ENST00000599255; ENST00000597279 | chr19 | 48832237 | 48832399 | + | TSF |
| 2% | chr12 | 69656249 | 69656342 | + | ENST00000551516 | chr12 | 69673004 | 69673309 | + | TSF |
| 2% | chr1 | 170705189 | 170705309 | + | ENST00000239461 | chr1 | 170706854 | 170706973 | + | TSF |
| 2% | chr12 | 113623819 | 113623826 | + | ENST00000552495 | chr12 | 113623998 | 113624117 | + | TSF |
| 2% | chr5 | 179315312 | 179315103 | − | ENST00000355235; ENST00000356834 | chr5 | 179312136 | 179312132 | − | TSF |
| 2% | chrX | 41598709 | 41598637 | − | ENST00000421587; ENST00000318588; ENST00000361962; ENST00000378163; ENST00000378158; ENST00000378166; ENST00000442742; ENST00000378154 | chrX | 41557348 | 41557057 | − | TSF |
| 2% | chr5 | 54993786 | 54993674 | − | ENST00000396865; ENST00000539768; ENST00000318672; ENST00000508124; ENST00000511233; ENST00000503891; ENST00000513993; ENST00000505563; ENST 00000506624; ENST00000507109 | chr5 | 54993040 | 54992544 | − | TSF |
| 2% | chr17 | 17127457 | 17127236 | − | ENST00000285071; ENST00000389169; ENST00000417064 | chr17 | 17126584 | 17126403 | − | TSF |
| 2% | chr17 | 17127457 | 17127236 | − | ENST00000285071; ENST00000389169; ENST00000417064 | chr17 | 17126584 | 17126403 | − | TSF |
| 2% | chr15 | 89456550 | 89456478 | − | ENST00000558018; ENST00000268151; ENST00000268150; ENST00000566497; ENST00000542878; ENST00000558029 | chr15 | 89453897 | 89453853 | − | TSF |
| 2% | chr5 | 147281336 | 147281192 | − | ENST00000318315; ENST00000515291 | chr5 | 147230105 | 147229718 | − | TSF |
| 2% | chr20 | 42789047 | 42788258 | − | ENST00000372980 | chr20 | 42726338 | 42726029 | − | TSF |
| 2% | chr4 | 28372431 | 28372322 | − | ENST00000507759 | chr4 | 28319160 | 28318916 | − | TSF |
| 2% | chr3 | 194325174; 194325170 | 194325016 | − | ENST00000392432; ENST00000273580; ENST00000432352; ENST00000381975; ENST00000347147; ENST00000473092; ENST00000452358 | chr3 | 194296178 | 194295847 | − | TSF |
| 2% | chr3 | 194325174; 194325170 | 194325016 | − | ENST00000392432; ENST00000273580; ENST00000432352; ENST00000381975; ENST00000347147; ENST00000473092; ENST00000452358 | chr3 | 194296178 | 194295847 | − | TSF |
| 2% | chr3 | 194325174; 194325170 | 194325016 | − | ENST00000392432; ENST00000273580; ENST00000432352; ENST00000381975; ENST00000347147; ENST00000473092; ENST00000452358 | chr3 | 194296178 | 194295847 | − | TSF |
| 2% | chr3 | 194325174; 194325170 | 194325016 | − | ENST00000392432; ENST00000273580; ENST00000432352; ENST00000381975; ENST00000347147; ENST00000473092; ENST00000452358 | chr3 | 194296178 | 194295847 | − | TSF |
| 2% | chr3 | 194325174; 194325170 | 194325016 | − | ENST00000392432; ENST00000273580; ENST00000432352; ENST00000381975; ENST00000347147; ENST00000473092; | chr3 | 194296178 | 194295847 | − | TSF |

TABLE 53-continued

Transcript fusion for Sarcoma (SARC) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| | | | | | ENST00000452358 | | | | | |

TABLE 54

Transcript fusion for Sarcoma (SARC) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 57% | chr8 | 104389530 | 104389551 | + | chr8 | 104390255 | 104390471 | + | ENST00000330295; ENST00000520337 | TAF |
| 36% | chr2 | 28190037 | 28190310 | + | chr2 | 28210860 | 28210954 | + | ENST00000436924; ENST00000344773; ENST00000379624; ENST00000342045; ENST00000361704; ENST00000379632; ENST00000379629; ENST00000604932 | TAF |
| 36% | chr2 | 28190037 | 28190310 | + | chr2 | 28210860 | 28210954 | + | ENST00000436924; ENST00000344773; ENST00000379624; ENST00000342045; ENST00000361704; ENST00000379632; ENST00000379629; ENST00000604932 | TAF |
| 36% | chr2 | 28190037 | 28190310 | + | chr2 | 28210860 | 28210954 | + | ENST00000436924; ENST00000344773; ENST00000379624; ENST00000342045; ENST00000361704; ENST00000379632; ENST00000379629; ENST00000604932 | TAF |
| 36% | chr2 | 28190037 | 28190310 | + | chr2 | 28210860 | 28210954 | + | ENST00000436924; ENST00000344773; ENST00000379624; ENST00000342045; ENST00000361704; ENST00000379632; ENST00000379629; ENST00000604932 | TAF |
| 36% | chr2 | 28190037 | 28190310 | + | chr2 | 28210860 | 28210954 | + | ENST00000436924; ENST00000344773; ENST00000379624; ENST00000342045; ENST00000361704; ENST00000379632; ENST00000379629; ENST00000604932 | TAF |
| 36% | chr2 | 28190037 | 28190310 | + | chr2 | 28210860 | 28210954 | + | ENST00000436924; ENST00000344773; ENST00000379624; ENST00000342045; ENST00000361704; ENST00000379632; ENST00000379629; ENST00000604932 | TAF |
| 34% | chr9 | 131189761 | 131190058 | + | chr9 | 131190581 | 131190700; 131190702 | + | ENST00000372842; ENST00000420512; ENST00000372838 | TAF |
| 34% | chr9 | 131189761 | 131190058 | + | chr9 | 131190581 | 131190700; 131190702 | + | ENST00000372842; ENST00000420512; ENST00000372838 | TAF |
| 31% | chr7 | 2289080 | 2289115 | + | chr7 | 2289492 | 2289637 | + | ENST00000356714; ENST00000397049; ENST00000397046; ENST00000397048; ENST00000339737; ENST00000343985 | TAF |
| 23% | chr9 | 131002678 | 131002811 | + | chr9 | 131004511 | 131004624 | + | ENST00000475805; ENST00000341179; ENST00000372923; ENST00000393594; ENST00000486160 | TAF |
| 23% | chr9 | 131002678 | 131002811 | + | chr9 | 131004511 | 131004624 | + | ENST00000475805; ENST00000341179; ENST00000372923; ENST00000393594; ENST00000486160 | TAF |
| 22% | chr7 | 2289080 | 2289194 | + | chr7 | 2289492 | 2289637 | + | ENST00000356714; ENST00000397049; ENST00000397046; ENST00000397048; ENST00000339737; ENST00000343985 | TAF |
| 22% | chr2 | 28191829 | 28192099 | + | chr2 | 28210860 | 28210954 | + | ENST00000436924; ENST00000344773; ENST00000379624; ENST00000342045; ENST00000361704; ENST00000379632; ENST00000379629; ENST00000604932 | TSF |
| 22% | chr2 | 28191829 | 28192099 | + | chr2 | 28210860 | 28210954 | + | ENST00000436924; ENST00000344773; ENST00000379624; ENST00000342045; ENST00000361704; ENST00000379632; ENST00000379629; ENST00000604932 | TSF |
| 22% | chr2 | 28191829 | 28192099 | + | chr2 | 28210860 | 28210954 | + | ENST00000436924; ENST00000344773; ENST00000379624; ENST00000342045; ENST00000361704; ENST00000379632; ENST00000379629; ENST00000604932 | TSF |
| 22% | chr2 | 28191829 | 28192099 | + | chr2 | 28210860 | 28210954 | + | ENST00000436924; ENST00000344773; ENST00000379624; ENST00000342045; ENST00000361704; ENST00000379632; ENST00000379629; ENST00000604932 | TSF |
| 22% | chr2 | 28191829 | 28192099 | + | chr2 | 28210860 | 28210954 | + | ENST00000436924; ENST00000344773; ENST00000379624; ENST00000342045; ENST00000361704; ENST00000379632; ENST00000379629; ENST00000604932 | TSF |
| 22% | chr2 | 28191829 | 28192099 | + | chr2 | 28210860 | 28210954 | + | ENST00000436924; ENST00000344773; ENST00000379624; ENST00000342045; ENST00000361704; ENST00000379632; ENST00000379629; ENST00000604932 | TSF |
| 21% | chr17 | 79214190 | 79214239 | + | chr17 | 79214787 | 79214816; 79214953 | + | ENST00000431388; ENST00000576002 | TAF |
| 21% | chr17 | 79214190 | 79214239 | + | chr17 | 79214787 | 79214816; 79214953 | + | ENST00000431388; ENST00000576002 | TAF |
| 20% | chr7 | 150938296 | 150938250 | − | chr7 | 150937608 | 150937511 | − | ENST00000262188; ENST00000392811; ENST00000356800 | TAF |
| 19% | chr19 | 41732717 | 41732817 | + | chr19 | 41736872 | 41736952 | + | ENST00000301178; ENST00000359092 | TAF |
| 19% | chr19 | 41732717 | 41732817 | + | chr19 | 41736872 | 41736952 | + | ENST00000301178; ENST00000359092 | TAF |
| 19% | chr7 | 73466655 | 73466891 | + | chr7 | 73467493 | 73467639 | + | ENST00000445912; ENST00000252034; ENST00000358929; ENST00000320492; ENST00000414324; ENST00000380562; ENST00000380575; ENST00000380584; ENST00000458204; ENST00000357036; ENST00000429192; ENST00000380553; ENST00000380576; ENST00000320399 | TAF |
| 19% | chr7 | 73466655 | 73466891 | + | chr7 | 73467493 | 73467639 | + | ENST00000445912; ENST00000252034; ENST00000358929; ENST00000320492; ENST00000414324; ENST00000380562; | TAF |

TABLE 54-continued

Transcript fusion for Sarcoma (SARC) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 19% | chr7 | 73466655 | 73466891 | + | chr7 | 73467493 | 73467639 | + | ENST00000380575; ENST00000380584; ENST00000458204; ENST00000357036; ENST00000429192; ENST00000380553; ENST00000380576; ENST00000320399 ENST00000445912; ENST00000252034; ENST00000358929; ENST00000320492; ENST00000414324; ENST00000380562; ENST00000380575; ENST00000380584; ENST00000458204; ENST00000357036; ENST00000429192; ENST00000 380553; ENST00000380576; ENST00000320399 | TAF |
| 19% | chr7 | 73466655 | 173466891 | + | chr7 | 73467493 | 73467639 | + | ENST00000445912; ENST00000252034; ENST00000358929; ENST00000320492; ENST00000414324; ENST00000380562; ENST00000380575; ENST00000380584; ENST00000458204; ENST00000357036; ENST00000429192; ENST00000 380553; ENST00000380576; ENST00000320399 | TAF |
| 19% | chr7 | 73466655 | 73466891 | + | chr7 | 73467493 | 73467639 | + | ENST00000445912; ENST00000252034; ENST00000358929; ENST00000320492; ENST00000414324; ENST00000380562; ENST00000380575; ENST00000380584; ENST00000458204; ENST00000357036; ENST00000429192; ENST00000380553; ENST00000380576; ENST00000320399 | TAF |
| 19% | chr7 | 73466655 | 73466891 | + | chr7 | 73467493 | 73467639 | + | ENST00000445912; ENST00000252034; ENST00000358929; ENST00000320492; ENST00000414324; ENST00000380562; ENST00000380575; ENST00000380584; ENST00000458204; ENST00000357036; ENST00000429192; ENST00000380553; ENST00000380576; ENST00000320399 | TAF |
| 19% | chr7 | 73466655 | 73466891 | + | chr7 | 73467493 | 73467639 | + | ENST00000445912; ENST00000252034; ENST00000358929; ENST00000320492; ENST00000414324; ENST00000380562; ENST00000380575; ENST00000380584; ENST00000458204; ENST00000357036; ENST00000429192; ENST00000380553; ENST00000380576; ENST00000320399 | TAF |
| 19% | chr7 | 73466655 | 73466891 | + | chr7 | 73467493 | 73467639 | + | ENST00000445912; ENST00000252034; ENST00000358929; ENST00000320492; ENST00000414324; ENST00000380562; ENST00000380575; ENST00000380584; ENST00000458204; ENST00000357036; ENST00000429192; ENST00000 380553; ENST00000380576; ENST00000320399 | TAF |
| 19% | chr7 | 73466655 | 73466891 | + | chr7 | 73467493 | 73467639 | + | ENST00000445912; ENST00000252034; ENST00000358929; ENST00000320492; ENST00000414324; ENST00000380562; ENST00000380575; ENST00000380584; ENST00000458204; ENST00000357036; ENST00000429192; ENST00000380553; ENST00000380576; ENST00000320399 | TAF |
| 17% | chr17 | 39974832 | 39974854 | + | chr17 | 39975462 | 39975651 | + | ENST00000321562 | TAF |
| 17% | chr1 | 246581335 | 246580598 | − | chr1 | 246518396 | 246518333 | − | ENST00000388985; ENST00000403792 | TSF |
| 17% | chr1 | 246581335 | 246580598 | − | chr1 | 246518396 | 246518333 | − | ENST00000388985; ENST00000403792 | TSF |
| 16% | chr6 | 5498702 | 5498789 | + | chr6 | 5545413 | 5545573 | + | ENST00000324331; ENST00000274680 | TSF |
| 15% | chr11 | 93468219 | 93468129 | − | chr11 | 93467826 | 93467791; 93467814 | − | ENST00000393259; ENST00000527169 | TAF |
| 15% | chr11 | 93468219 | 93468129 | − | chr11 | 93467826 | 93467791; 93467814 | | ENST00000393259; ENST00000527169 | TAF |
| 15% | chr6 | 26474324 | 26474624 | + | chr6 | 26476389 | 26476396 | + | ENST00000480218 | TAF |
| 14% | chr2 | 28200909 | 28201241 | + | chr2 | 28210860 | 28210954 | + | ENST00000436924; ENST00000344773; ENST00000379624; ENST00000342045; ENST00000361704; ENST00000379632; ENST00000379629; ENST00000604932 | TAF |
| 14% | chr2 | 28200909 | 28201241 | + | chr2 | 28210860 | 28210954 | + | ENST00000436924; ENST00000344773; ENST00000379624; ENST00000342045; ENST00000361704; ENST00000379632; ENST00000379629; ENST00000604932 | TAF |
| 14% | chr2 | 28200909 | 28201241 | + | chr2 | 28210860 | 28210954 | + | ENST00000436924; ENST00000344773; ENST00000379624; ENST00000342045; ENST00000361704; ENST00000379632; ENST00000379629; ENST00000604932 | TAF |
| 14% | chr2 | 28200909 | 28201241 | + | chr2 | 28210860 | 28210954 | + | ENST00000436924; ENST00000344773; ENST00000379624; ENST00000342045; ENST00000361704; ENST00000379632; ENST00000379629; ENST00000604932 | TAF |
| 14% | chr2 | 28200909 | 28201241 | + | chr2 | 28210860 | 28210954 | + | ENST00000436924; ENST00000344773; ENST00000379624; ENST00000342045; ENST00000361704; ENST00000379632; ENST00000379629; ENST00000604932 | TAF |
| 14% | chr2 | 28200909 | 28201241 | + | chr2 | 28210860 | 28210954 | + | ENST00000436924; ENST00000344773; ENST00000379624; ENST00000342045; ENST00000361704; ENST00000379632; ENST00000379629; ENST00000604932 | TAF |
| 14% | chr9 | 131193013 | 131193223 | + | chr9 | 131193538 | 131193582 | + | ENST00000372842; ENST00000372838 | TAF |
| 14% | chr5 | 135398466 | 135398602 | + | chr5 | 135398875 | 135398915; 135398898 | + | ENST00000442011; ENST00000305126; ENST00000514554; ENST00000508076; ENST00000503087 | TAF |
| 14% | chr5 | 135398466 | 135398602 | + | chr5 | 135398875 | 135398915; 135398898 | | ENST00000442011; ENST00000305126; ENST00000514554; ENST00000508076; ENST00000503087 | TAF |
| 14% | chr17 | 39976225 | 39976301 | + | chr17 | 39976521 | 39976713 | + | ENST00000321562; ENST00000455106; ENST00000544340 | TSF |
| 14% | chr12 | 58023123 | 58023062 | − | chr12 | 58022929 | 58022831; 58022905 | − | ENST00000341156; ENST00000418555; ENST00000552798; ENST00000549391 | TSF |
| 14% | chr12 | 58023123 | 58023062 | − | chr12 | 58022929 | 58022831; 58022905 | − | ENST00000341156; ENST00000418555; ENST00000552798; ENST00000549391 | TSF |

TABLE 54-continued

Transcript fusion for Sarcoma (SARC) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 14% | chr17 | 39974832 | 39974893 | + | chr17 | 39975462 | 39975651 | + | ENST00000321562 | TSF |
| 13% | chr17 | 80440912 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |
| 13% | chr17 | 80440912 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |
| 13% | chr17 | 80440912 | 80441180 | + | chr17 | 80441592 | 80441655; 48041659 | + | ENST00000390006; ENST00000309794; ENST00000345415; ENST00000457415; ENST00000412079; ENST00000577432; ENST00000584513 | TAF |
| 13% | chr17 | 80440912 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |
| 13% | chr12 | 6602868 | 6602840 | − | chr12 | 6602138 | 6602028 | − | ENST00000229238 | TAF |
| 12% | chr19 | 3966211 | 3966171 | − | chr19 | 3964989 | 3964629 | − | ENST00000545797; ENST00000301264; ENST00000596311; ENST00000601824; ENST00000593844 | TAF |
| 12% | chr19 | 3966211 | 3966171 | − | chr19 | 3964989 | 3964629 | − | ENST00000545797; ENST00000301264; ENST00000596311; ENST00000601824; ENST00000593844 | TAF |
| 12% | chr19 | 3966211 | 3966171 | − | chr19 | 3964989 | 3964629 | − | ENST00000545797; ENST00000301264; ENST00000596311; ENST00000601824; ENST00000593844 | TAF |
| 12% | chr19 | 3966211 | 3966171 | − | chr19 | 3964989 | 3964629 | − | ENST00000545797; ENST00000301264; ENST00000596311; ENST00000601824; ENST00000593844 | TAF |
| 12% | chr17 | 57885458 | 57885650 | + | chr17 | 57886157 | 57886237; 57886196 | + | ENST00000262291; ENST00000537567; ENST00000539763; ENST00000536180; ENST00000545362; ENST00000592619; ENST00000591877 | TSF |
| 12% | chr17 | 57885458 | 57885650 | + | chr17 | 57886157 | 57886237; 57886196 | + | ENST00000262291; ENST00000537567; ENST00000539763; ENST00000536180; ENST00000545362; ENST00000592619; ENST00000591877 | TSF |
| 12% | chr17 | 57885458 | 57885650 | + | chr17 | 57886157 | 57886237; 57886196 | + | ENST00000262291; ENST00000537567; ENST00000539763; ENST00000536180; ENST00000545362; ENST00000592619; ENST00000591877 | TSF |
| 12% | chr1 | 59843828 | 59844080 | + | chr1 | 59844421 | 59844509 | + | ENST00000413489; ENST00000371218; ENST00000303721; ENST00000430447; ENST00000371212 | TSF |
| 12% | chr1 | 59843828 | 59844080 | + | chr1 | 59844421 | 59844509 | + | ENST00000413489; ENST00000371218; ENST00000303721; ENST00000430447; ENST00000371212 | TSF |
| 12% | chr1 | 59843828 | 59844080 | + | chr1 | 59844421 | 59844509 | + | ENST00000413489; ENST00000371218; ENST00000303721; ENST00000430447; ENST00000371212 | TSF |
| 12% | chr1 | 59843828 | 59844080 | + | chr1 | 59844421 | 59844509 | + | ENST00000413489; ENST00000371218; ENST00000303721; ENST00000430447; ENST00000371212 | TSF |
| 12% | chr15 | 74004214 | 74004264 | + | chr15 | 74005275 | 74005297 | + | ENST00000318443; ENST00000537340; ENST00000318424; ENST00000564751; ENST00000561176; ENST00000559073 | TSF |
| 11% | chr4 | 55109748 | 55109839 | + | chr4 | 55124924 | 55124984 | + | ENST00000512143 | TAF |
| 11% | chr4 | 55096091 | 55096106 | + | chr4 | 55124924 | 55124984 | + | ENST00000512143 | TAF |
| 10% | chr19 | 48832400 | 48832441 | + | chr19 | 48832609 | 48832696; 34882749 | + | ENST00000599704; ENST00000270221; ENST00000597279; ENST00000593437 | TAF |
| 10% | chr19 | 48832400 | 48832441 | + | chr19 | 48832609 | 48832696; 48832749 | + | ENST00000599704; ENST00000270221; ENST00000597279; ENST00000593437 | TAF |
| 10% | chr19 | 48832400 | 48832441 | + | chr19 | 48832609 | 48832696; 48832749 | + | ENST00000599704; ENST00000270221; ENST00000597279; ENST00000593437 | TAF |
| 10% | chr1 | 40781678 | 40781517 | − | chr1 | 40781336 | 40781262 | − | ENST00000372748; ENST00000417105; ENST00000372736 | TAF |
| 10% | chr1 | 40781678 | 40781517 | − | chr1 | 40781336 | 40781262 | − | ENST00000372748; ENST00000417105; ENST00000372736 | TAF |
| 10% | chr1 | 40781678 | 40781517 | − | chr1 | 40781336 | 40781262 | − | ENST00000372748; ENST00000417105; ENST00000372736 | TAF |
| 10% | chr2 | 1675865 | 1675811 | − | chr2 | 1670258 | 1669986 | − | ENST00000252804; ENST00000433670 | TAF |
| 10% | chr2 | 1675865 | 1675811 | − | chr2 | 1670258 | 1669986 | − | ENST00000252804; ENST00000433670 | TAF |
| 10% | chr20 | 44410585 | 44410081 | − | chr20 | 44404241 | 44404056 | − | ENST00000337205; ENST00000243938; ENST00000372632; ENST00000372630 | TAF |
| 9% | chr9 | 117824597 | 117824593 | − | chr9 | 117822281 | 117822009 | − | ENST00000350763; ENST00000341037; ENST00000423613 | TSF |
| 9% | chr9 | 117824597 | 117824593 | − | chr9 | 117822281 | 117822009 | − | ENST00000350763; ENST00000341037; ENST00000423613 | TSF |
| 9% | chr9 | 117824597 | 117824593 | − | chr9 | 117822281 | 117822009 | − | ENST00000350763; ENST00000341037; ENST00000423613 | TSF |
| 8% | chr11 | 86380764 | 86380517 | − | chr11 | 86270855 | 86270732 | − | ENST00000393324; ENST00000359636; ENST00000543262; ENST00000524826; ENST00000526504; ENST00000530335 | TSF |
| 8% | chr11 | 86380764 | 86380517 | − | chr11 | 86270865 | 86270732 | − | ENST00000393324; ENST00000359636; ENST00000543262; ENST00000524826; ENST00000526504; ENST00000530335 | TSF |
| 8% | chr11 | 86380764 | 86380517 | − | chr11 | 86270865 | 86270732 | − | ENST00000393324; ENST00000359636; ENST00000543262; ENST00000524826; ENST00000526504; ENST00000530335 | TSF |
| 8% | chr11 | 86380764 | 86380517 | − | chr11 | 86270865 | 86270732 | − | ENST00000393324; ENST00000359636; ENST00000543262; ENST00000524826; ENST00000526504; ENST00000530335 | TSF |
| 8% | chr20 | 44409050 | 44409038 | − | chr20 | 44404241 | 44404056 | − | ENST00000337205; ENST00000243938; ENST00000372632; ENST00000372630 | TSF |
| 7% | chr8 | 104389530 | 104389536 | + | chr8 | 104390255 | 104390471 | + | ENST00000330295; ENST00000520337 | TSF |
| 7% | chr14 | 32035785 | 32036132 | + | chr14 | 32068495 | 32068585 | + | ENST00000281081; ENST00000547839; ENST00000549838; ENST00000551314; ENST00000536705 | TSF |
| 7% | chr14 | 32035785 | 32036132 | + | chr14 | 32068495 | 32068585 | + | ENST00000281081; ENST00000547839; ENST00000549838; ENST00000551314; ENST00000536705 | TSF |
| 7% | chr14 | 32035785 | 32036132 | + | chr14 | 32068495 | 32068585 | + | ENST00000281081; ENST00000547839; ENST00000549838; | TSF |

TABLE 54-continued

Transcript fusion for Sarcoma (SARC) Coordinates of the fusion sequences for which the donor is the TE.

| 1 | 2' | 3' | 4' | 5' | 6' | 7' | 8' | 9' | 10' | 11' |
|---|----|----|----|----|----|----|----|----|-----|-----|
| 7% | chr14 | 32035785 | 32036132 | + | chr14 | 32068495 | 32068585 | + | ENST00000551314; ENST00000536705 ENST00000281081; ENST00000547839; ENST00000549838; ENST00000551314; ENST00000536705 | TSF |
| 7% | chr9 | 124090761 | 124090761 | + | chr9 | 124091169 | 124091293 | + | ENST00000373823; ENST00000341272; ENST00000373808; ENST00000394353; ENST00000412819; ENST00000436847; ENST00000449733; ENST00000545652; ENST00000373818; ENST00000373807; ENST00000373806 | TSF |
| 7% | chr9 | 124090761 | 124090761 | + | chr9 | 124091169 | 124091293 | + | ENST00000373823; ENST00000341272; ENST00000373808; ENST00000394353; ENST00000412819; ENST00000436847; ENST00000449733; ENST00000545652; ENST00000373818; ENST00000373807; ENST00000373806 | TSF |
| 6% | chr2 | 74762302 | 74762039 | − | chr2 | 74761901 | 74761658 | − | ENST00000264094; ENST00000393937; ENST00000409549; ENST00000409986 | TSF |
| 6% | chr2 | 74762302 | 74762039 | − | chr2 | 74761901 | 74761658 | − | ENST00000264094; ENST00000393937; ENST00000409549; ENST00000409986 | TSF |
| 6% | chr11 | 74426175 | 74426167 | − | chr11 | 74424524 | 74424431 | − | ENST00000263671; ENST00000376332; ENST00000534276; ENST00000528789 | TSF |
| 6% | chr11 | 74426175 | 74426167 | − | chr11 | 74424524 | 74424431 | − | ENST00000263671; ENST00000376332; ENST00000534276; ENST00000528789 | TSF |
| 6% | chr11 | 74426175 | 74426167 | − | chr11 | 74424524 | 174424431 | − | ENST00000263671; ENST00000376332; ENST00000534276; ENST00000528789 | TSF |
| 6% | chr11 | 74426175 | 74426167 | − | chr11 | 74424524 | 174424431 | − | ENST00000263671; ENST00000376332; ENST00000534276; ENST00000528789 | TSF |
| 6% | chr15 | 82386123 | 82386575 | + | chr15 | 82387823 | 82387869 | + | ENST00000559788 | TSF |
| 5% | chr20 | 42754178 | 42754145 | − | chr20 | 42747263 | 42747145 | − | ENST00000372980 | TSF |
| 5% | chr3 | 133881128 | 133880716 | − | chr3 | 133878217 | 133878081 | − | ENST00000460933; ENST00000296084; ENST00000427044 | TSF |
| 5% | chr22 | 22899971 | 22899965 | − | chr22 | 22893511 | 22893189; 22893185; 22893481; 22893274 | − | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |
| 5% | chr22 | 22899971 | 22899965 | − | chr22 | 22893511 | 22893189; 92283185; 22893481; 22893274 | − | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |
| 5% | chr22 | 22899971 | 22899965 | − | chr22 | 22893511 | 22893189; 22893185; 22893481; 22893274 | − | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |
| 5% | chr22 | 22899971 | 22899965 | − | chr22 | 22893511 | 22893189; 22893185; 22893481; 22893274 | − | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |
| 5% | chr22 | 22899971 | 22899965 | − | chr22 | 22893511 | 22893189; 22893185; 22893481; 22893274 | − | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |
| 5% | chr22 | 22899971 | 22899965 | − | chr22 | 22893511 | 22893189; 22893185; 22893481; 22893274 | − | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |
| 5% | chr22 | 22899971 | 22899965 | − | chr22 | 22893511 | 22893189; 22893185; 22893481; 22893274 | − | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |
| 5% | chr7 | 94018505 | 94018589 | + | chr7 | 94057748 | 94057789 | + | ENST00000297268 | TSF |
| 5% | chr5 | 79371074 | 79371193 | + | chr5 | 79372678 | 79372871 | + | ENST00000350881; ENST00000511733 | TSF |
| 5% | chr7 | 2059680 | 2059649 | − | chr7 | 2054277 | 2054137 | − | ENST00000402746; ENST00000399654; ENST00000406869; ENST00000265854; ENST00000438959 | TSF |
| 5% | chr7 | 2059680 | 2059649 | − | chr7 | 2054277 | 2054137 | − | ENST00000402746; ENST00000399654; ENST00000406869; ENST00000265854; ENST00000438959 | TSF |
| 5% | chr15 | 91529041 | 91528993 | − | chr15 | 91528055 | 91527923 | − | ENST00000394249; ENST00000361919; ENST00000361188; ENST00000442656; ENST00000557905; ENST00000559811 | TSF |
| 5% | chr15 | 91529041 | 91528993 | − | chr15 | 91528055 | 91527923 | − | ENST00000394249; ENST00000361919; ENST00000361188; ENST00000442656; ENST00000557905; ENST00000559811 | TSF |
| 5% | chr15 | 91529041 | 91528993 | − | chr15 | 91528055 | 91527923 | − | ENST00000394249; ENST00000361919; ENST00000361188; ENST00000442656; ENST00000557905; ENST00000559811 | TSF |
| 5% | chr15 | 91529041 | 91528993 | − | chr15 | 91528055 | 91527923 | − | ENST00000394249; ENST00000361919; ENST00000361188; ENST00000442656; ENST00000557905; ENST00000559811 | TSF |
| 5% | chr15 | 91529041 | 91528993 | − | chr15 | 91528055 | 91527923 | − | ENST00000394249; ENST00000361919; ENST00000361188; ENST00000442656; ENST00000557905; ENST00000559811 | TSF |
| 5% | chr15 | 91529041 | 91528993 | − | chr15 | 91528055 | 91527923 | − | ENST00000394249; ENST00000361919; ENST00000361188; ENST00000442656; ENST00000557905; ENST00000559811 | TSF |
| 5% | chr15 | 69718867 | 69718995 | + | chr15 | 69721450 | 69721552 | + | ENST00000559279; ENST00000395392; ENST00000352331; ENST00000260363; ENST00000558585; ENST00000559283; ENST00000537891 | TSF |

TABLE 54-continued

Transcript fusion for Sarcoma (SARC) Coordinates of the
fusion sequences for which the donor is the TE.

| 1 | 2' | 3' | 4' | 5' | 6' | 7' | 8' | 9' | 10' | 11' |
|---|---|---|---|---|---|---|---|---|---|---|
| 5% | chr15 | 69718867 | 69718995 | + | chr15 | 69721450 | 69721552 | + | ENST00000559279; ENST00000395392; ENST00000352331; ENST00000260363; ENST00000558585; ENST00000559283; ENST00000537891 | TSF |
| 5% | chr15 | 69718867 | 69718995 | + | chr15 | 69721450 | 69721552 | + | ENST00000559279; ENST00000395392; ENST00000352331; ENST00000260363; ENST00000558585; ENST00000559283; ENST00000537891 | TSF |
| 5% | chr15 | 69718867 | 69718995 | + | chr15 | 69721450 | 69721552 | + | ENST00000559279; ENST00000395392; ENST00000352331; ENST00000260363; ENST00000558585; ENST00000559283; ENST00000537891 | TSF |
| 5% | chr12 | 58023123 | 58023062 | − | chr12 | 58022686 | 58022496; 58022484 | − | ENST00000341156; ENST00000418555; ENST00000449184 | TSF |
| 5% | chr12 | 58023123 | 58023062 | − | chr12 | 58022686 | 58022496; 58022484 | − | ENST00000341156; ENST00000418555; ENST00000449184 | TSF |
| 5% | chr5 | 33794481 | 33794368 | − | chr5 | 33751653 | 33751509; 33751444 | | ENST00000504830; ENST00000352040; ENST00000515401 | TSF |
| 5% | chr5 | 33794481 | 33794368 | − | chr5 | 33751653 | 33751509; 33751444 | | ENST00000504830; ENST00000352040; ENST00000515401 | TSF |
| 5% | chr5 | 33794481 | 33794368 | − | chr5 | 33751653 | 33751509; 33751444 | − | ENST00000504830; ENST00000352040; ENST00000515401 | TSF |
| 4% | chr1 | 41465686 | 41465756 | + | chr1 | 41466701 | 41466789 | + | ENST00000372621; ENST00000541520; ENST00000372616 | TSF |
| 4% | chr1 | 53070435 | 530170501 | + | chr1 | 53072356 | 53072617 | + | ENST00000361314 | TSF |
| 4% | chr1 | 23762222 | 23762216 | − | chr1 | 23761111 | 23761026 | − | ENST00000495646; ENST00000336689; ENST00000437606 | TSF |
| 4% | chr12 | 6602868 | 6602754 | − | chr12 | 6602138 | 6602028 | − | ENST00000229238 | TSF |
| 4% | chr11 | 66048968 | 66049045 | + | chr11 | 66049730 | 66049798; 66049824 | + | ENST00000528852; ENST00000311445; ENST00000528063 | TSF |
| 4% | chr11 | 66048968 | 66049045 | + | chr11 | 66049730 | 66049798; 66049824 | + | ENST00000528852; ENST00000311445; ENST00000528063 | TSF |
| 4% | chr11 | 66048968 | 66049045 | + | chr11 | 66049730 | 66049798; 66049824 | + | ENST00000528852; ENST00000311445; ENST00000528063 | TSF |
| 4% | chr11 | 1891186 | 1891243 | + | chr11 | 1901317 | 1901454 | + | ENST00000311604; ENST00000381775; ENST00000457279; ENST00000429923; ENST00000418975 | TSF |
| 4% | chr11 | 1891186 | 1891243 | + | chr11 | 1901317 | 1901454 | + | ENST00000311604; ENST00000381775; ENST00000457279; ENST00000429923; ENST00000418975 | TSF |
| 4% | chr11 | 1891186 | 1891243 | + | chr11 | 1901317 | 1901454 | + | ENST00000311604; ENST00000381775; ENST00000457279; ENST00000429923; ENST00000418975 | TSF |
| 4% | chr11 | 1891186 | 1891243 | + | chr11 | 1901317 | 1901454 | − | ENST00000311604; ENST00000381775; ENST00000457279; ENST00000429923; ENST00000418975 | TSF |
| 4% | chr1 | 169819657 | 169819707 | + | chr1 | 169820958 | 169821077 | + | ENST00000359326; ENST00000286031 | TSF |
| 4% | chr17 | 13442614 | 13442384 | − | chr17 | 13400135 | 13399514 | − | ENST00000284110 | TSF |
| 4% | chr5 | 178696659 | 178696386 | − | chr5 | 178634716 | 178634514 | − | ENST00000251582; ENST00000274609 | TSF |
| 4% | chr5 | 178696659 | 178696386 | − | chr5 | 178634716 | 178634514 | − | ENST00000251582; ENST00000274609 | TSF |
| 4% | chr1 | 32152700 | 32152171 | − | chr1 | 32151880 | 32151845 | − | ENST00000271069; ENST00000373672; ENST00000373668 | TSF |
| 4% | chr1 | 32152700 | 32152171 | − | chr1 | 32151880 | 32151845 | − | ENST00000271069; ENST00000373672; ENST00000373668 | TSF |
| 4% | chr1 | 32152700 | 32152171 | − | chr1 | 32151880 | 32151845 | − | ENST00000271069; ENST00000373672; ENST00000373668 | TSF |
| 3% | chr4 | 1745002 | 1745264 | + | chr4 | 1746245 | 1746351 | + | ENST00000313288 | TSF |
| 3% | chr2 | 48949534 | 48949869 | + | chr2 | 49003419 | 49003454 | + | ENST00000402114 | TSF |
| 3% | chr14 | 70466641 | 70466673 | + | chr14 | 70477471 | 70477663 | + | ENST00000361956; ENST00000381280 | TSF |
| 3% | chr14 | 70466641 | 70466673 | + | chr14 | 70477471 | 70477663 | + | ENST00000361956; ENST00000381280 | TSF |
| 3% | chr3 | 111532965 | 111533310 | + | chr3 | 111564668 | 111564716 | + | ENST00000393934 | TSF |
| 3% | chr9 | 35657501 | 35657683 | + | chr9 | 35658573 | 35658724 | + | ENST00000378407; ENST00000378406; ENST00000426546; ENST00000327351; ENST00000421582; ENST00000378409 | TSF |
| 3% | chr9 | 35657501 | 35657683 | + | chr9 | 35658573 | 35658724 | + | ENST00000378407; ENST00000378406; ENST00000426546; ENST00000327351; ENST00000421582; ENST00000378409 | TSF |
| 3% | chr9 | 35657501 | 35657683 | + | chr9 | 35658573 | 35658724 | + | ENST00000378407; ENST00000378406; ENST00000426546; ENST00000327351; ENST00000421582; ENST00000378409 | TSF |
| 3% | chr9 | 35657501 | 35657683 | + | chr9 | 35658573 | 35658724 | + | ENST00000378407; ENST00000378406; ENST00000426546; ENST00000327351; ENST00000421582; ENST00000378409 | TSF |
| 3% | chr9 | 35657501 | 35657683 | + | chr9 | 35658573 | 35658724 | + | ENST00000378407; ENST00000378406; ENST00000426546; ENST00000327351; ENST00000421582; ENST00000378409 | TSF |
| 3% | chr9 | 35657501 | 356157683 | + | chr9 | 35658573 | 35658724 | + | ENST00000378407; ENST00000378406; ENST00000426546; ENST00000327351; ENST00000421582; ENST00000378409 | TSF |
| 3% | chr2 | 189864980 | 189865248 | + | chr2 | 189866123 | 189866176 | + | ENST00000304636; ENST00000317840 | TSF |
| 3% | chr2 | 189864980 | 189865248 | + | chr2 | 189866123 | 189866176 | + | ENST00000304636; ENST00000317840 | TSF |
| 3% | chr4 | 28378393 | 28378035 | − | chr4 | 28372431 | 28372322 | − | ENST00000507759 | TSF |
| 3% | chr1 | 246581335 | 246580598 | − | chr1 | 246498776 | 246498669 | − | ENST00000541742; ENST00000490107; ENST00000388985; ENST00000453676; ENST00000403792; ENST00000455277 | TSF |
| 3% | chr1 | 246581335 | 246580598 | − | chr1 | 246498776 | 246498669 | − | ENST00000541742; ENST00000490107; ENST00000388985; ENST00000453676; ENST00000403792; ENST00000455277 | |
| 3% | chr1 | 246581335 | 246580598 | − | chr1 | 246498776 | 246498669 | − | ENST00000541742; ENST00000490107; ENST00000388985; ENST00000453676; ENST00000403792; ENST00000455277 | TSF |
| 3% | chr1 | 246581335 | 246580598 | − | chr1 | 246498776 | 246498669 | − | ENST00000541742; ENST00000490107; ENST00000388985; ENST00000453676; ENST00000403792; ENST00000455277 | TSF |
| 3% | chr5 | 148770827 | 148770728 | − | chr5 | 148756588 | 148756299 | − | ENST00000261796 | TSF |
| 3% | chr17 | 17126706 | 17126441 | − | chr17 | 17125975 | 17125815 | − | ENST00000285071; ENST00000389169 | TSF |
| 3% | chr17 | 17126706 | 17126441 | − | chr17 | 17125975 | 17125815 | − | ENST00000285071; ENST00000389169 | TSF |

TABLE 54-continued

Transcript fusion for Sarcoma (SARC) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 3% | chr15 | 67546688 | 67546562 | − | chr15 | 67529158 | 67528968 | − | ENST00000261880 | TSF |
| 3% | chr2 | 85811874 | 85811992 | + | chr2 | 85818852 | 85818985 | + | ENST00000306384 | TSF |
| 3% | chrX | 48394106 | 48394426 | + | chrX | 48417285 | 48417412; 48417354 | + | ENST00000376771; ENST00000481090; ENST00000418627 | TSF |
| 3% | chrX | 48394106 | 48394426 | + | chrX | 48417285 | 48417412; 48417354 | + | ENST00000376771; ENST00000481090; ENST00000418627 | TSF |
| 3% | chrX | 48394106 | 48394426 | + | chrX | 48417285 | 48417412; 48417354 | + | ENST00000376771; ENST00000481090; ENST00000418627 | TSF |
| 3% | chr14 | 100942914 | 100942918 | + | chr14 | 100950331 | 100950461; 100950378 | + | ENST00000554998; ENST00000402312; ENST00000335290; ENST00000557710; ENST00000542471 | TSF |
| 3% | chr14 | 100942914 | 100942918 | + | chr14 | 100950331 | 100950461; 100950378 | + | ENST00000554998; ENST00000402312; ENST00000335290; ENST00000557710; ENST00000542471 | TSF |
| 3% | chr15 | 73976790 | 73976801 | + | chr15 | 73994596 | 73994914; 73994934; 73994926; 73994838; 73994671 | + | ENST00000567189; ENST00000318443; ENST00000318424; ENST00000558689; ENST00000560786; ENST00000561213; ENST00000563584; ENST00000561416; ENST00000560995; ENST00000561260; ENST00000564751 | TSF |
| 3% | chr15 | 73976790 | 73976801 | + | chr15 | 73994596 | 73994914; 73994934; 73994926; 73994838; 73994671 | + | ENST00000567189; ENST00000318443; ENST00000318424; ENST00000558689; ENST00000560786; ENST00000561213; ENST00000563584; ENST00000561416; ENST00000560995; ENST00000561260; ENST00000564751 | TSF |
| 3% | chr15 | 73976790 | 73976801 | + | chr15 | 73994596 | 73994914; 73994934; 73994926; 73994838; 73994671 | + | ENST00000567189; ENST00000318443; ENST00000318424; ENST00000558689; ENST00000560786; ENST00000561213; ENST00000563584; ENST00000561416; ENST00000560995; ENST00000561260; ENST00000564751 | TSF |
| 3% | chr15 | 73976790 | 73976801 | + | chr15 | 73994596 | 73994914; 73994934; 73994926; 73994838; 73994671 | + | ENST00000567189; ENST00000318443; ENST00000318424; ENST00000558689; ENST00000560786; ENST00000561213; ENST00000563584; ENST00000561416; ENST00000560995; ENST00000561260; ENST00000564751 | TSF |
| 3% | chr15 | 73976790 | 73976801 | + | chr15 | 73994596 | 73994914; 73994934; 73994926; 73994838; 73994671 | + | ENST00000567189; ENST00000318443; ENST00000318424; ENST00000558689; ENST00000560786; ENST00000561213; ENST00000563584; ENST00000561416; ENST00000560995; ENST00000561260; ENST00000564751 | TSF |
| 3% | chr15 | 73976790 | 73976801 | + | chr15 | 73994596 | 73994914; 73994934; 73994926; 73994838; 73994671 | + | ENST00000567189; ENST00000318443; ENST00000318424; ENST00000558689; ENST00000560786; ENST00000561213; ENST00000563584; ENST00000561416; ENST00000560995; ENST00000561260; ENST00000564751 | TSF |
| 3% | chr15 | 73976790 | 73976801 | + | chr15 | 73994596 | 73994914; 73994934; 73994926; 73994838; 73994671 | + | ENST00000567189; ENST00000318443; ENST00000318424; ENST00000558689; ENST00000560786; ENST00000561213; ENST00000563584; ENST00000561416; ENST00000560995; ENST00000561260; ENST00000564751 | TSF |
| 3% | chr15 | 73976790 | 73976801 | + | chr15 | 73994596 | 73994914; 73994934; 73994926; 73994838; 73994671 | + | ENST00000567189; ENST00000318443; ENST00000318424; ENST00000558689; ENST00000560786; ENST00000561213; 1ENST00000563584; ENST0000056416; ENST00000560995; ENST00000561260; ENST00000564751 | TSF |
| 3% | chr10 | 23383125 | 23383689 | + | chr10 | 23393073 | 23393173 | + | ENST00000376510; ENST00000472663 | TSF |
| 3% | chr10 | 23383125 | 23383689 | + | chr10 | 23393073 | 23393173 | + | ENST00000376510; ENST00000472663 | TSF |
| 3% | chr6 | 45627086 | 45627095 | + | chr6 | 45630852 | 45631459 | + | ENST00000576263 | TSF |
| 3% | chr2 | 189861720 | 189861722 | + | chr2 | 189861891 | 189861944 | + | ENST00000304636; ENST00000317840 | TSF |
| 3% | chr2 | 189861720 | 189861722 | + | chr2 | 189861891 | 189861944 | + | ENST00000304636; ENST00000317840 | TSF |
| 3% | chr18 | 2873127 | 2873305 | + | chr18 | 2891239 | 2892484 | + | ENST00000254528 | TSF |
| 3% | chr8 | 27834814 | 27834547 | − | chr8 | 27779762 | 27779088 | − | ENST00000354914; ENST00000524352; ENST00000518030; ENST00000301906 | TSF |
| 3% | chr8 | 27834814 | 27834547 | − | chr8 | 27779762 | 27779088 | − | ENST00000354914; ENST00000524352; ENST00000518030; ENST00000301906 | TSF |
| 3% | chr7 | 82523973 | 82523713 | − | chr7 | 82508778 | 82508653 | − | ENST00000333891; ENST00000423517; ENST00000413807; ENST00000456006 | TSF |
| 3% | chr7 | 82523973 | 82523713 | − | chr7 | 82508778 | 82508653 | − | ENST00000333891; ENST00000423517; ENST00000413807; ENST00000456006 | TSF |
| 3% | chr7 | 82523973 | 82523713 | − | chr7 | 82508778 | 82508653 | − | ENST00000333891; ENST00000423517; ENST00000413807; ENST00000456006 | TSF |
| 3% | chr7 | 82523973 | 82523713 | − | chr7 | 82508778 | 82508653 | − | ENST00000333891; ENST00000423517; ENST00000413807; ENST00000456006 | TSF |

TABLE 54-continued

Transcript fusion for Sarcoma (SARC) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 3% | chr5 | 33794481 | 33794291 | − | chr5 | 33751653 | 33751509; 33751444 | − | ENST00000504830; ENST00000352040; ENST00000515401 | TSF |
| 3% | chr5 | 33794481 | 33794291 | − | chr5 | 33751653 | 33751509; 33751444 | − | ENST00000504830; ENST00000352040; ENST00000515401 | TSF |
| 3% | chr5 | 33794481 | 33794291 | − | chr5 | 33751653 | 33751509; 33751444 | − | ENST00000504830; ENST00000352040; ENST00000515401 | TSF |
| 3% | chrX | 19668715 | 19668432 | − | chrX | 19663593 | 19663518; 61963535 | − | ENST00000397821; ENST00000379716; ENST00000379698; ENST00000379726; ENST00000379697; ENST00000432234 | TSF |
| 3% | chrX | 19668715 | 19668432 | − | chrX | 19663593 | 19663518; 19663535 | − | ENST00000397821; ENST00000379716; ENST00000379698; ENST00000379726; ENST00000379697; ENST00000432234 | TSF |
| 3% | chrX | 19668715 | 19668432 | − | chrX | 19663593 | 19663518; 19663535 | − | ENST00000397821; ENST00000379716; ENST00000379698; ENST00000379726; ENST00000379697; ENST00000432234 | TSF |
| 3% | chrX | 19668715 | 19668468 | − | chrX | 19663593 | 19663518; 61963535 | − | ENST00000397821; ENST00000379716; ENST00000379698; ENST00000379726; ENST00000379697; ENST00000432234 | TSF |
| 3% | chrX | 19668715 | 19668468 | − | chrX | 19663593 | 19663518; 19663535 | − | ENST00000397821; ENST00000379716; ENST00000379698; ENST00000379726; ENST00000379697; ENST00000432234 | TSF |
| 3% | chrX | 19668715 | 19668468 | − | chrX | 19663593 | 19663518; 19663535 | − | ENST00000397821; ENST00000379716; ENST00000379698; ENST00000379726; ENST00000379697; ENST00000432234 | TSF |
| 3% | chr5 | 178594221 | 178594154 | − | chr5 | 178585880 | 178585724 | − | ENST00000251582; ENST00000274609 | TSF |
| 3% | chr5 | 178594221 | 178594154 | − | chr5 | 178585880 | 178585724 | − | ENST00000251582; ENST00000274609 | TSF |
| 3% | chr6 | 114321437 | 114321165 | − | chr6 | 114281182 | 114281070 | − | ENST00000519065; ENST00000398283; ENST00000425835; ENST00000521163 | TSF |
| 3% | chr6 | 114321437 | 114321165 | − | chr6 | 114281182 | 114281070 | − | ENST00000519065; ENST00000398283; ENST00000425835; ENST00000521163 | TSF |
| 3% | chr6 | 114321437 | 114321165 | − | chr6 | 114281182 | 114281070 | − | ENST00000519065; ENST00000398283; ENST00000425835; ENST00000521163 | TSF |
| 3% | chr7 | 100850556 | 100850506 | − | chr7 | 100850185 | 100850060 | − | ENST00000454310; ENST00000223127 | TSF |
| 3% | chr5 | 148780664 | 148780258 | − | chr5 | 148756588 | 148756299 | − | ENST00000261796 | TSF |
| 3% | chr19 | 18506969 | 18506886 | − | chr19 | 18502935 | 18502797 | − | ENST00000339007; ENST00000595840 | TSF |
| 2% | chr6 | 168927975 | 168928062 | + | chr6 | 168944305 | 168944352 | + | ENST00000354536; ENST00000356284 | TSF |
| 2% | chr6 | 168927975 | 168928062 | + | chr6 | 168944305 | 168944352 | + | ENST00000354536; ENST00000356284 | TSF |
| 2% | chr5 | 15934695 | 15934710 | + | chr5 | 15936559 | 15937295 | + | ENST00000504595; ENST00000510662; ENST00000329673 | TSF |
| 2% | chr10 | 118177984 | 118178265 | + | chr10 | 118202567 | 118202686 | + | ENST00000369230 | TSF |
| 2% | chr15 | 68577054 | 68577315 | + | chr15 | 68581945 | 68583580 | + | ENST00000306917 | TSF |
| 2% | chr2 | 36993390 | 36993533 | + | chr2 | 36994237 | 36994428 | + | ENST00000379242; ENST00000389975; ENST00000404084; ENST00000379241; ENST00000401530 | TSF |
| 2% | chr2 | 36993390 | 36993533 | + | chr2 | 36994237 | 36994428 | + | ENST00000379242; ENST00000389975; ENST00000404084; ENST00000379241; ENST00000401530 | TSF |
| 2% | chr2 | 36993390 | 36993533 | + | chr2 | 36994237 | 36994428 | + | ENST00000379242; ENST00000389975; ENST00000404084; ENST00000379241; ENST00000401530 | TSF |
| 2% | chr2 | 36993390 | 36993533 | + | chr2 | 36994237 | 36994428 | + | ENST00000379242; ENST00000389975; ENST00000404084; ENST00000379241; ENST00000401530 | TSF |
| 2% | chr2 | 36993390 | 36993533 | + | chr2 | 36994237 | 36994428 | + | ENST00000379242; ENST00000389975; ENST00000404084; ENST00000379241; ENST00000401530 | TSF |
| 2% | chrX | 80517692 | 80518225 | + | chrX | 80532483 | 80532668 | + | ENST00000373212 | TSF |
| 2% | chr7 | 23290404 | 23290481 | + | chr7 | 23292926 | 23293078 | + | ENST00000258733; ENST00000381990; ENST00000409458; ENST00000453162 | TSF |
| 2% | chr7 | 23290404 | 23290481 | + | chr7 | 23292926 | 23293078 | + | ENST00000258733; ENST00000381990; ENST00000409458; ENST00000453162 | TSF |
| 2% | chr7 | 23290404 | 23290481 | + | chr7 | 23292926 | 23293078 | + | ENST00000258733; ENST00000381990; ENST00000409458; ENST00000453162 | TSF |
| 2% | chr7 | 23290404 | 23290481 | + | chr7 | 23292926 | 23293078 | + | ENST00000258733; ENST00000381990; ENST00000409458; ENST00000453162 | TSF |
| 2% | chr11 | 46321227 | 46321229 | + | chr11 | 46321486 | 46321714 | + | ENST00000529193; ENST00000288400 | TSF |
| 2% | chr21 | 47278635 | 47278724 | + | chr21 | 47316122 | 47316276 | + | ENST00000400314; ENST00000400310; ENST00000449640; ENST00000400308; ENST00000400309 | TSF |
| 2% | chr21 | 47278635 | 47278724 | + | chr21 | 47316122 | 47316276 | + | ENST00000400314; ENST00000400310; ENST00000449640; ENST00000400308; ENST00000400309 | TSF |
| 2% | chr21 | 47278635 | 47278724 | + | chr21 | 47316122 | 47316276 | + | ENST00000400314; ENST00000400310; ENST00000449640; ENST00000400308; ENST00000400309 | TSF |
| 2% | chr21 | 47278635 | 47278724 | + | chr21 | 47316122 | 47316276 | + | ENST00000400314; ENST00000400310; ENST00000449640; ENST00000400308; ENST00000400309 | TSF |
| 2% | chr20 | 55815985 | 55815709 | − | chr20 | 55803477 | 55803285 | − | ENST00000395863; ENST00000395864; ENST00000450594; ENST00000433911 | TSF |
| 2% | chr20 | 55815985 | 55815709 | − | chr20 | 55803477 | 55803285 | − | ENST00000395863; ENST00000395864; ENST00000450594; ENST00000433911 | TSF |
| 2% | chr20 | 55815985 | 55815709 | − | chr20 | 55803477 | 55803285 | − | ENST00000395863; ENST00000395864; ENST00000450594; ENST00000433911 | TSF |
| 2% | chr20 | 55815985 | 55815709 | − | chr20 | 55803477 | 55803285 | − | ENST00000395863; ENST00000395864; ENST00000450594; ENST00000433911 | TSF |
| 2% | chr3 | 11645847 | 11645798 | − | chr3 | 11643496 | 11643307 | − | ENST00000273038; ENST00000430365; ENST00000404339; ENST00000445411; ENST00000418000; ENST00000458499; ENST00000417206; ENST00000419541 | TSF |
| 2% | chr3 | 11645847 | 11645798 | − | chr3 | 11643496 | 11643307 | − | ENST00000273038; ENST00000430365; ENST00000404339; ENST00000445411; ENST00000418000; ENST00000458499; | TSF |

TABLE 54-continued

Transcript fusion for Sarcoma (SARC) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 2% | chr3 | 11645847 | 11645798 | − | chr3 | 11643496 | 11643307 | − | ENST00000417206; ENST00000419541 ENST00000273038; ENST00000430365; ENST00000404339; ENST00000445411; ENST00000418000; ENST00000458499; | TSF |
| 2% | chr3 | 11645847 | 11645798 | − | chr3 | 11643496 | 11643307 | − | ENST00000417206; ENST00000419541 ENST00000273038; ENST00000430365; ENST00000404339; ENST00000445411; ENST00000418000; ENST00000458499; | TSF |
| 2% | chr3 | 11645847 | 11645798 | − | chr3 | 11643496 | 11643307 | − | ENST00000417206; ENST00000419541 ENST00000273038; ENST00000430365; ENST00000404339; ENST00000445411; ENST00000418000; ENST00000458499; | TSF |
| 2% | chr3 | 11645847 | 11645798 | − | chr3 | 11643496 | 11643307 | − | ENST00000417206; ENST00000419541 ENST00000273038; ENST00000430365; ENST00000404339; ENST00000445411; ENST00000418000; ENST00000458499; ENST00000417206; ENST00000419541 | TSF |
| 2% | chr9 | 132580720 | 132580632 | − | chr9 | 132576501 | 132576251 | − | ENST00000351698 | TSF |
| 2% | chr22 | 21355965 | 21355808 | − | chr22 | 21355700 | 21355545 | − | ENST00000215742; ENST00000399133 | TSF |
| 2% | chr2 | 38983894 | 38983253 | − | chr2 | 38977336 | 38977156 | − | ENST00000313117; ENST00000425778; ENST00000425941; ENST00000446327; ENST00000409276; ENST00000431066; ENST00000443213 | TSF |
| 2% | chr2 | 38983894 | 38983253 | − | chr2 | 38977336 | 38977156 | − | ENST00000313117; ENST00000425778; ENST00000425941; ENST00000446327; ENST00000409276; ENST00000431066; ENST00000443213 | TSF |
| 2% | chr2 | 38983894 | 38983253 | − | chr2 | 38977336 | 38977156 | − | ENST00000313117; ENST00000425778; ENST00000425941; ENST00000446327; ENST00000409276; ENST00000431066; ENST00000443213 | TSF |
| 2% | chr2 | 38983894 | 38983253 | − | chr2 | 38977336 | 38977156 | − | ENST00000313117; ENST00000425778; ENST00000425941; ENST00000446327; ENST00000409276; ENST00000431066; ENST00000443213 | TSF |
| 2% | chr2 | 38983894 | 38983253 | − | chr2 | 38977336 | 38977156 | − | ENST00000313117; ENST00000425778; ENST00000425941; ENST00000446327; ENST00000409276; ENST00000431066; ENST00000443213 | TSF |

TABLE 55

Transcript fusion for skin cutaneous melanoma (SKCM) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 93% | chr11 | 88960991 | 88961138 | + | ENST00000263321 | chr11 | 88974422 | 88974649 | + | TAF |
| 68% | chr8 | 54793576 | 54793644 | + | ENST00000276500 | chr8 | 54826057 | 54826421 | + | TAF |
| 68% | chr19 | 3544937 | 3544807 | − | ENST00000389395; ENST00000398558; ENST00000588918; ENST00000355415; ENST00000589063 | chr19 | 3538708 | 3538306 | − | TAF |
| 68% | chr19 | 3544937 | 3544807 | − | ENST00000389395; ENST00000398558; ENST00000588918; ENST00000355415; ENST00000589063 | chr19 | 3538708 | 3538306 | − | TAF |
| 68% | chr19 | 3544937 | 3544807 | − | ENST00000389395; ENST00000398558; ENST00000588918; ENST00000355415; ENST00000589063 | chr19 | 3538708 | 3538306 | − | TAF |
| 67% | chr12 | 110511233 | 110511227 | − | ENST00000548191 | chr12 | 110496968 | 110496909 | − | TAF |
| 37% | chr11 | 89017941 | 89018122 | + | ENST00000263321 | chr11 | 89022608 | 89022727 | + | TSF |
| 33% | chr20 | 35842163 | 35842268 | + | ENST00000237530; ENST00000373622 | chr20 | 35844460 | 35844765 | + | TAF |
| 33% | chr20 | 35842163 | 35842268 | + | ENST00000237530; ENST00000373622 | chr20 | 35844460 | 35844765 | + | TAF |
| 27% | chr12 | 110495101 | 110494994 | − | ENST00000309050 | chr12 | 110493610 | 110493335 | − | TAF |
| 27% | chr8 | 54791818 | 54792162 | + | ENST00000297313 | chr8 | 54826057 | 54826421 | + | TSF |
| 24% | chr6 | 36762426 | 36762367 | − | ENST00000244751 | chr6 | 36760223 | 36760189 | − | TAF |
| 22% | chr7 | 98991652 | 98991742 | + | ENST00000252725; ENST00000451682 | chr7 | 98994840 | 98994900 | + | TAF |
| 21% | chr4 | 108999538 | 108999376 | − | ENST00000265165; ENST00000379951; ENST00000438313; ENST00000510624 | chr4 | 108994190 | 108994089 | − | TAF |
| 21% | chr4 | 108999538 | 108999376 | − | ENST00000265165; ENST00000379951; ENST00000438313; ENST00000510624 | chr4 | 108994190 | 108994089 | − | TAF |
| 21% | chr4 | 108999538 | 108999376 | − | ENST00000265165; ENST00000379951; ENST00000438313; ENST00000510624 | chr4 | 108994190 | 108994089 | − | TAF |
| 21% | chr11 | 57191501 | 57191455 | − | ENST00000395123; ENST00000395124; ENST00000352187; ENST00000529554; ENST00000533524; ENST00000530005; ENST00000529113; ENST00000525474; ENST00000529112; ENST00000528187 | chr11 | 57191196 | 57190890 | − | TAF |
| 21% | chr11 | 57191501 | 57191455 | − | ENST00000395123; ENST00000395124; ENST00000352187; ENST00000529554; ENST00000533524; ENST00000530005; ENST00000529113; ENST00000525474; ENST00000529112; ENST00000528187 | chr11 | 57191196 | 57190890 | − | TAF |
| 21% | chr11 | 57191501 | 57191455 | − | ENST00000395123; ENST00000395124; ENST00000352187; ENST00000529554; ENST00000533524; ENST00000530005; ENST00000529113; ENST00000525474; ENST00000529112; ENST00000528187 | chr11 | 57191196 | 57190890 | − | TAF |

TABLE 55-continued

Transcript fusion for skin cutaneous melanoma (SKCM) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 20% | chr7 | 22532348 | 22532184 | − | ENST00000406890; ENST00000404369; ENST00000424363 | chr7 | 22512853 | 22512669 | − | TSF |
| 20% | chr7 | 22532348 | 22532184 | − | ENST00000406890; ENST00000404369; ENST00000424363 | chr7 | 22512853 | 22512669 | − | TSF |
| 19% | chr1 | 32696528 | 32696620 | + | ENST00000373586 | chr1 | 32696861 | 32697110 | + | TAF |
| 18% | chr3 | 196753630 | 196753531 | − | ENST00000296350; ENST00000296351; ENST00000439320 | chr3 | 196753047 | 196752998 | − | TAF |
| 17% | chr1 | 12010414 | 12010577 | + | ENST00000449038; ENST00000376369; ENST00000429000; ENST00000196061 | chr1 | 12010679 | 12010856 | + | TAF |
| 17% | chr1 | 12010414 | 12010577 | + | ENST00000449038; ENST00000376369; ENST00000429000; ENST00000196061 | chr1 | 12010679 | 12010856 | + | TAF |
| 16% | chr16 | 4409386 | 4409297 | − | ENST00000572467; ENST00000251166; ENST00000539968; ENST00000537233; ENST00000574025; ENST00000576637 | chr16 | 4409070 | 4408945 | − | TAF |
| 16% | chr16 | 4409386 | 4409297 | − | ENST00000572467; ENST00000251166; ENST00000539968; ENST00000537233; ENST00000574025; ENST00000576637 | chr16 | 4409070 | 4408945 | − | TAF |
| 16% | chr16 | 4409386 | 4409297 | − | ENST00000572467; ENST00000251166; ENST00000539968; ENST00000537233; ENST00000574025; ENST00000576637 | chr16 | 4409070 | 4408945 | − | TAF |
| 16% | chr16 | 4409386 | 4409297 | − | ENST00000572467; ENST00000251166; ENST00000539968; ENST00000537233; ENST00000574025; ENST00000576637 | chr16 | 4409070 | 4408945 | − | TAF |
| 16% | chr16 | 4409386 | 4409297 | − | ENST00000572467; ENST00000251166; ENST00000539968; ENST00000537233; ENST00000574025; ENST00000576637 | chr16 | 4409070 | 4408945 | − | TAF |
| 16% | chr19 | 14063948 | 14063931 | − | ENST00000538517; ENST00000538371; ENST00000585607 | chr19 | 14060442 | 14060422 | − | TAF |
| 16% | chr6 | 11000397 | 11000320 | − | ENST00000354666 | chr6 | 11000151 | 11000002 | − | TAF |
| 16% | chr11 | 88960991 | 88961082 | + | ENST00000263321 | chr11 | 88974422 | 88974649 | + | TSF |
| 16% | chr7 | 100854953; 100854997 | 100854872 | − | ENST00000454310; ENST00000223127; ENST00000440925; ENST00000421736 | chr7 | 100854207 | 100854151 | − | TSF |
| 16% | chr7 | 100854953; 100854997 | 100854872 | − | ENST00000454310; ENST00000223127; ENST00000440925; ENST00000421736 | chr7 | 100854207 | 100854151 | − | TSF |
| 16% | chr7 | 100854953; 100854997 | 100854872 | − | ENST00000454310; ENST00000223127; ENST00000440925; ENST00000421736 | chr7 | 100854207 | 100854151 | − | TSF |
| 16% | chr7 | 100854953; 100854997 | 100854872 | − | ENST00000454310; ENST00000223127; ENST00000440925; ENST00000421736 | chr7 | 100854207 | 100854151 | − | TSF |
| 15% | chr1 | 11115983; 11115877 | 11115838 | − | ENST00000376957; ENST00000490101 | chr1 | 11115464 | 11115178 | − | TSF |
| 15% | chr1 | 11115983; 11115877 | 11115838 | − | ENST00000376957; ENST00000490101 | chr1 | 11115464 | 11115178 | − | TSF |
| 14% | chr8 | 74939024 | 74939076 | + | ENST00000284818; ENST00000518893 | chr8 | 74944554 | 74944936 | + | TAF |
| 14% | chr8 | 74939024 | 74939076 | + | ENST00000284818; ENST00000518893 | chr8 | 74944554 | 74944936 | + | TAF |
| 14% | chr15 | 89011139 | 89011255 | + | ENST00000560708; ENST00000325844; ENST00000353598 | chr15 | 89011993 | 89012264 | + | TAF |
| 14% | chr4 | 57319769 | 57319927 | + | ENST00000514888; ENST00000264221; ENST00000505164; ENST00000399688; ENST00000512576 | chr4 | 57321183 | 57321327 | + | TSF |
| 14% | chr4 | 57319769 | 57319927 | + | ENST00000514888; ENST00000264221; ENST00000505164; ENST00000399688; ENST00000512576 | chr4 | 57321183 | 57321327 | + | TSF |
| 14% | chr4 | 57319769 | 57319927 | + | ENST00000514888; ENST00000264221; ENST00000505164; ENST00000399688; ENST00000512576 | chr4 | 57321183 | 57321327 | + | TSF |
| 13% | chr19 | 35996667 | 35996620 | − | ENST00000434389; ENST00000402589; ENST00000339686; ENST00000436012; ENST00000414866; ENST00000480502; ENST00000467637; ENST00000429837; ENST00000419602; ENST00000443640; ENST00000597212; ENST00000472252; ENST00000492341; ENST00000602781; ENST00000602679; ENST00000474928; ENST00000488892; ENST00000461300; ENST00000447113; ENST00000392206; ENST00000440396; ENST00000458071; ENST00000418261; ENST00000424570; ENST00000451297; ENST00000450261 | chr19 | 35995923 | 35995655 | − | TAF |
| 13% | chr19 | 35996667 | 35996620 | − | ENST00000434389; ENST00000402589; ENST00000339686; ENST00000436012; ENST00000414866; ENST00000480502; ENST00000467637; ENST00000429837; ENST00000419602; ENST00000443640; ENST00000597212; ENST00000472252; ENST00000492341; ENST00000602781; ENST00000602679; ENST00000474928; ENST00000488892; ENST00000461300; ENST00000447113; ENST00000392206; ENST00000440396; ENST00000458071; ENST00000418261; ENST00000424570; ENST00000451297; ENST00000450261 | chr19 | 35995923 | 35995655 | − | TAF |
| 13% | chr19 | 35996667 | 35996620 | − | ENST00000434389; ENST00000402589; ENST00000339686; ENST00000436012; ENST00000414866; ENST00000480502; ENST00000467637; ENST00000429837; ENST00000419602; ENST00000443640; ENST00000597212; ENST00000472252; ENST00000492341; ENST00000602781; ENST00000602679; ENST00000474928; ENST00000488892; ENST00000461300; ENST00000447113; ENST00000392206; ENST00000440396; ENST00000458071; ENST00000418261; ENST00000424570; ENST00000451297; ENST00000450261 | chr19 | 35995923 | 35995655 | − | TAF |
| 13% | chr19 | 35996667 | 35996620 | − | ENST00000434389; ENST00000402589; ENST00000339686; ENST00000436012; ENST00000414866; ENST00000480502; ENST00000467637; ENST00000429837; ENST00000419602; ENST00000443640; ENST00000597212; ENST00000472252; ENST00000492341; ENST00000602781; ENST00000602679; ENST00000474928; ENST00000488892; ENST00000461300; | chr19 | 35995923 | 35995655 | − | TAF |

TABLE 55-continued

Transcript fusion for skin cutaneous melanoma (SKCM) Coordinates
of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 13% | chr19 | 35996667 | 35996620 | − | ENST00000434389; ENST00000402589; ENST00000339686; ENST00000436012; ENST00000414866; ENST00000480502; ENST00000467637; ENST00000429837; ENST00000419602; ENST00000443640; ENST00000597212; ENST00000472252; ENST00000492341; ENST00000602781; ENST00000602679; ENST00000474928; ENST00000488892; ENST00000461300; ENST00000447113; ENST00000392206; ENST00000440396; ENST00000458071; ENST00000418261; ENST00000424570; ENST00000451297; ENST00000450261 | chr19 | 35995923 | 35995655 | − | TAF |
| 13% | chr19 | 35996667 | 35996620 | − | ENST00000434389; ENST00000402589; ENST00000339686; ENST00000436012; ENST00000414866; ENST00000480502; ENST00000467637; ENST00000429837; ENST00000419602; ENST00000443640; ENST00000597212; ENST00000472252; ENST00000492341; ENST00000602781; ENST00000602679; ENST00000474928; ENST00000488892; ENST00000461300; ENST00000447113; ENST00000392206; ENST00000440396; ENST00000458071; ENST00000418261; ENST00000424570; ENST00000451297; ENST00000450261 | chr19 | 35995923 | 35995655 | − | TAF |
| 13% | chr19 | 35996667 | 35996620 | − | ENST00000434389; ENST00000402589; ENST00000339686; ENST00000436012; ENST00000414866; ENST00000480502; ENST00000467637; ENST00000429837; ENST00000419602; ENST00000443640; ENST00000597212; ENST00000472252; ENST00000492341; ENST00000602781; ENST00000602679; ENST00000474928; ENST00000488892; ENST00000461300; ENST00000447113; ENST00000392206; ENST00000440396; ENST00000458071; ENST00000418261; ENST00000424570; ENST00000451297; ENST00000450261 | chr19 | 351995923 | 35995655 | − | TAF |
| 13% | chr19 | 35996667 | 35996620 | − | ENST00000434389; ENST00000402589; ENST00000339686; ENST00000436012; ENST00000414866; ENST00000480502; ENST00000467637; ENST00000429837; ENST00000419602; ENST00000443640; ENST00000597212; ENST00000472252; ENST00000492341; ENST00000602781; ENST00000602679; ENST00000474928; ENST00000488892; ENST00000461300; ENST00000447113; ENST00000392206; ENST00000440396; ENST00000458071; ENST00000418261; ENST00000424570; ENST00000451297; ENST00000450261 | chr19 | 35995923 | 35995655 | − | TAF |
| 13% | chr19 | 35996667 | 35996620 | − | ENST00000434389; ENST00000402589; ENST00000339686; ENST00000436012; ENST00000414866; ENST00000480502; ENST00000467637; ENST00000429837; ENST00000419602; ENST00000443640; ENST00000597212; ENST00000472252; ENST00000492341; ENST00000602781; ENST00000602679; ENST00000474928; ENST00000488892; ENST00000461300; ENST00000447113; ENST00000392206; ENST00000440396; ENST00000458071; ENST00000418261; ENST00000424570; ENST00000451297; ENST00000450261 | chr19 | 35995923 | 35995655 | − | TAF |
| 13% | chr19 | 35996667 | 35996620 | − | ENST00000434389; ENST00000402589; ENST00000339686; ENST00000436012; ENST00000414866; ENST00000480502; ENST00000467637; ENST00000429837; ENST00000419602; ENST00000443640; ENST00000597212; ENST00000472252; ENST00000492341; ENST00000602781; ENST00000602679; ENST00000474928; ENST00000488892; ENST00000461300; ENST00000447113; ENST00000392206; ENST00000440396; ENST00000458071; ENST00000418261; ENST00000424570; ENST00000451297; ENST00000450261 | chr19 | 35995923 | 35995655 | − | TAF |
| 13% | chr19 | 35996667 | 35996620 | − | ENST00000434389; ENST00000402589; ENST00000339686; ENST00000436012; ENST00000414866; ENST00000480502; ENST00000467637; ENST00000429837; ENST00000419602; ENST00000443640; ENST00000597212; ENST00000472252; ENST00000492341; ENST00000602781; ENST00000602679; ENST00000474928; ENST00000488892; ENST00000461300; ENST00000447113; ENST00000392206; ENST00000440396; ENST00000458071; ENST00000418261; ENST00000424570; ENST00000451297; ENST00000450261 | chr19 | 35995923 | 35995655 | − | TAF |
| 13% | chr19 | 35996667 | 35996620 | − | ENST00000434389; ENST00000402589; ENST00000339686; ENST00000436012; ENST00000414866; ENST00000480502; ENST00000467637; ENST00000429837; ENST00000419602; ENST00000443640; ENST00000597212; ENST00000472252; ENST00000492341; ENST00000602781; ENST00000602679; ENST00000474928; ENST00000488892; ENST00000461300; ENST00000447113; ENST00000392206; ENST00000440396; ENST00000458071; ENST00000418261; ENST00000424570; ENST00000451297; ENST00000450261 | chr19 | 35995923 | 35995655 | − | TAF |

TABLE 55-continued

Transcript fusion for skin cutaneous melanoma (SKCM) Coordinates
of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 13% | chr19 | 35996667 | 35996620 | − | ENST00000434389; ENST00000402589; ENST00000339686; ENST00000436012; ENST00000414866; ENST00000480502; ENST00000467637; ENST00000429837; ENST00000419602; ENST00000443640; ENST00000597212; ENST00000472252; ENST00000492341; ENST00000602781; ENST00000602679; ENST00000474928; ENST00000488892; ENST00000461300; ENST00000447113; ENST00000392206; ENST00000440396; ENST00000458071; ENST00000418261; ENST00000424570; ENST00000451297; ENST00000450261 | chr19 | 35995923 | 35995655 | − | TAF |
| 13% | chr19 | 35996667 | 35996620 | − | ENST00000434389; ENST00000402589; ENST00000339686; ENST00000436012; ENST00000414866; ENST00000480502; ENST00000467637; ENST00000429837; ENST00000419602; ENST00000443640; ENST00000597212; ENST00000472252; ENST00000492341; ENST00000602781; ENST00000602679; ENST00000474928; ENST00000488892; ENST00000461300; ENST00000447113; ENST00000392206; ENST00000440396; ENST00000458071; ENST00000418261; ENST00000424570; ENST00000451297; ENST00000450261 | chr19 | 35995923 | 35995655 | − | TAF |
| 13% | chr19 | 35996667 | 35996620 | − | ENST00000434389; ENST00000402589; ENST00000339686; ENST00000436012; ENST00000414866; ENST00000480502; ENST00000467637; ENST00000429837; ENST00000419602; ENST00000443640; ENST00000597212; ENST00000472252; ENST00000492341; ENST00000602781; ENST00000602679; ENST00000474928; ENST00000488892; ENST00000461300; ENST00000447113; ENST00000392206; ENST00000440396; ENST00000458071; ENST00000418261; ENST00000424570; ENST00000451297; ENST00000450261 | chr19 | 35995923 | 35995655 | − | TAF |
| 13% | chr19 | 35996667 | 35996620 | − | ENST00000434389; ENST00000402589; ENST00000339686; ENST00000436012; ENST00000414866; ENST00000480502; ENST00000467637; ENST00000429837; ENST00000419602; ENST00000443640; ENST00000597212; ENST00000472252; ENST00000492341; ENST00000602781; ENST00000602679; ENST00000474928; ENST00000488892; ENST00000461300; ENST00000447113; ENST00000392206; ENST00000440396; ENST00000458071; ENST00000418261; ENST00000424570; ENST00000451297; ENST00000450261 | chr19 | 35995923 | 35995655 | − | TAF |
| 12% | chr11 | 88924370 | 88924586 | + | ENST00000263321 | chr11 | 88953763 | 88953776 | + | TSF |
| 12% | chr1 | 31347435 | 31347144 | − | ENST00000336798; ENST00000339394 | chr1 | 31340352 | 31340311 | − | TSF |
| 12% | chr1 | 31347435 | 31347144 | − | ENST00000336798; ENST00000339394 | chr1 | 31340352 | 31340311 | − | TSF |
| 12% | chr19 | 3546166 | 3546072 | − | ENST00000389395; ENST00000398558; ENST00000588918; ENST00000355415; ENST00000589063; ENST00000589995 | chr19 | 3538708 | 3538306 | − | TSF |
| 12% | chr19 | 3546166 | 3546072 | − | ENST00000389395; ENST00000398558; ENST00000588918; ENST00000355415; ENST00000589063; ENST00000589995 | chr19 | 3538708 | 3538306 | − | TSF |
| 12% | chr19 | 3546166 | 3546072 | − | ENST00000389395; ENST00000398558; ENST00000588918; ENST00000355415; ENST00000589063; ENST00000589995 | chr19 | 3538708 | 3538306 | − | TSF |
| 12% | chr19 | 3546166 | 3546072 | − | ENST00000389395; ENST00000398558; ENST00000588918; ENST00000355415; ENST00000589063; ENST00000589995 | chr19 | 3538708 | 3538306 | − | TSF |
| 11% | chr22 | 24323139 | 24323226 | + | ENST00000215780; ENST00000402588 | chr22 | 24324557 | 24324632 | + | TAF |
| 11% | chr12 | 121775196; 121775195 | 121775094 | − | ENST00000539079; ENST00000441917; ENST00000541887; ENST00000261819; ENST00000344395; ENST00000536366; ENST00000544442 | chr12 | 121766988 | 121766947 | − | TAF |
| 11% | chr12 | 121775196; 121775195 | 121775094 | − | ENST00000539079; ENST00000441917; ENST00000541887; ENST00000261819; ENST00000344395; ENST00000536366; ENST00000544442 | chr12 | 121766988 | 121766947 | − | TAF |
| 11% | chr12 | 121775196; 121775195 | 121775094 | − | ENST00000539079; ENST00000441917; ENST00000541887; ENST00000261819; ENST00000344395; ENST00000536366; ENST00000544442 | chr12 | 121766988 | 121766947 | − | TAF |
| 11% | chr12 | 121775196; 121775195 | 121775094 | − | ENST00000539079; ENST00000441917; ENST00000541887; ENST00000261819; ENST00000344395; ENST00000536366; ENST00000544442 | chr12 | 121766988 | 121766947 | − | TAF |
| 11% | chr15 | 28090198 | 28090105 | − | ENST00000353809; ENST00000354638 | chr15 | 27964474 | 27964338 | − | TSF |
| 11% | chr15 | 28090198 | 28090105 | − | ENST00000353809; ENST00000354638 | chr15 | 27964474 | 27964338 | − | TSF |
| 10% | chr12 | 56742407 | 56742313 | − | ENST00000314128; ENST00000557235 | chr12 | 56740986 | 56740975 | − | TSF |
| 10% | chr12 | 56742407 | 56742313 | − | ENST00000314128; ENST00000557235 | chr12 | 56740986 | 56740975 | − | TSF |
| 10% | chr13 | 95095891 | 95095690 | − | ENST00000377028; ENST00000446125 | chr13 | 95063527 | 95063301 | − | TSF |
| 10% | chr13 | 95095891 | 95095690 | − | ENST00000377028; ENST00000446125 | chr13 | 95063527 | 95063301 | − | TSF |
| 10% | chr3 | 98600611; 98600498 | 98600384 | − | ENST00000326840; ENST00000326857; ENST00000449482 | chr3 | 98586282 | 98584565 | − | TSF |
| 10% | chr3 | 98600611; 98600498 | 98600384 | − | ENST00000326840; ENST00000326857; ENST00000449482 | chr3 | 98586282 | 98584565 | − | TSF |
| 10% | chr15 | 33149308 | 33149216 | − | ENST00000334528; ENST00000561249; ENST00000559047; ENST00000559610 | chr15 | 33129775 | 33129703 | − | TSF |
| 10% | chr15 | 33149308 | 33149216 | − | ENST00000334528; ENST00000561249; ENST00000559047; ENST00000559610 | chr15 | 33129775 | 33129703 | − | TSF |
| 10% | chr15 | 33149308 | 33149216 | − | ENST00000334528; ENST00000561249; ENST00000559047; | chr15 | 33129775 | 33129703 | − | TSF |

TABLE 55-continued

Transcript fusion for skin cutaneous melanoma (SKCM) Coordinates
of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 10% | chr15 | 33149308 | 33149216 | − | ENST00000334528; ENST00000561249; ENST00000559047; ENST00000559610 | chr15 | 33129775 | 33129703 | − | TSF |
| 9% | chr21 | 42540191 | 42540502 | + | ENST00000328735; ENST00000330333; ENST00000347667 | chr21 | 42572645 | 42572848 | + | TSF |
| 9% | chr7 | 116660662 | 116660683 | + | ENST00000465133; ENST00000393444; ENST00000393447 | chr7 | 116738667 | 116738692 | + | TSF |
| 9% | chr3 | 48716169 | 48715997 | − | ENST00000341520; ENST00000416649; ENST00000294129; ENST00000413374 | chr3 | 48702393 | 48702198 | − | TSF |
| 9% | chr3 | 48716169 | 48715997 | − | ENST00000341520; ENST00000416649; ENST00000294129; ENST00000413374 | chr3 | 48702393 | 48702198 | − | TSF |
| 9% | chr3 | 48716169 | 48715997 | − | ENST00000341520; ENST00000416649; ENST00000294129; ENST00000413374 | chr3 | 48702393 | 48702198 | − | TSF |
| 9% | chr17 | 1028702; 1028625 | 1028518 | − | ENST00000302538; ENST00000544583; ENST00000574437; ENST00000575934; ENST00000574139; ENST00000570525; ENST00000574266 | chr17 | 1005267 | 1004964 | − | TSF |
| 9% | chr17 | 1028702; 1028625 | 1028518 | − | ENST00000302538; ENST00000544583; ENST00000574437; ENST00000575934; ENST00000574139; ENST00000570525; ENST00000574266 | chr17 | 1005267 | 1004964 | − | TSF |
| 8% | chr1 | 25891664 | 25891698 | + | ENST00000374338 | chr1 | 25916660 | 25916675 | + | TSF |
| 8% | chr8 | 42924698; 42924750 | 42924802 | + | ENST00000534420; ENST00000302279; ENST00000533998; ENST00000342116; ENST00000531266; ENST00000525699; ENST00000529687; ENST00000533336 | chr8 | 42925245 | 42925476 | + | TSF |
| 8% | chr8 | 42924698; 42924750 | 42924802 | + | ENST00000534420; ENST00000302279; ENST00000533998; ENST00000342116; ENST00000531266; ENST00000525699; ENST00000529687; ENST00000533336 | chr8 | 42925245 | 42925476 | + | TSF |
| 8% | chr8 | 42924698; 42924750 | 42924802 | + | ENST00000534420; ENST00000302279; ENST00000533998; ENST00000342116; ENST00000531266; ENST00000525699; ENST00000529687; ENST00000533336 | chr8 | 42925245 | 42925476 | + | TSF |
| 8% | chr8 | 42924698; 42924750 | 42924802 | + | ENST00000534420; ENST00000302279; ENST00000533998; ENST00000342116; ENST00000531266; ENST00000525699; ENST00000529687; ENST00000533336 | chr8 | 42925245 | 42925476 | + | TSF |
| 8% | chr8 | 42924698; 42924750 | 42924802 | + | ENST00000534420; ENST00000302279; ENST00000533998; ENST00000342116; ENST00000531266; ENST00000525699; ENST00000529687; ENST00000533336 | chr8 | 42925245 | 42925476 | + | TSF |
| 8% | chr8 | 42924698; 42924750 | 42924802 | + | ENST00000534420; ENST00000302279; ENST00000533998; 0ENST00000342116; ENST0000531266; ENST00000525699; ENST00000529687; ENST00000533336 | chr8 | 42925245 | 42925476 | + | TSF |
| 7% | chr19 | 48830778 | 48830880 | + | ENST00000599704; ENST00000270221; ENST00000599255; ENST00000597279 | chr19 | 48832237 | 48832399 | + | TSF |
| 7% | chr20 | 29632611 | 29632721 | + | ENST00000278882; ENST00000358464 | chr20 | 29652086 | 29652324 | + | TSF |
| 7% | chr7 | 23313140 | 23313233 | + | ENST00000258733; ENST00000381990; ENST00000539136; ENST00000453162 | chr7 | 23322924 | 23323223 | + | TSF |
| 7% | chr7 | 23313140 | 23313233 | + | ENST00000258733; ENST00000381990; ENST00000539136; ENST00000453162 | chr7 | 23322924 | 23323223 | + | TSF |
| 7% | chr7 | 23313140 | 23313233 | + | ENST00000258733; ENST00000381990; ENST00000539136; ENST00000453162 | chr7 | 23322924 | 23323223 | + | TSF |
| 7% | chr7 | 23313140 | 23313233 | + | ENST00000258733; ENST00000381990; ENST00000539136; ENST00000453162 | chr7 | 23322924 | 23323223 | + | TSF |
| 7% | chr8 | 11872558 | 11872340 | − | ENST00000527396 | chr8 | 11761114 | 11760831 | − | TSF |
| 7% | chr2 | 74762581 | 74762419 | − | ENST00000264094; ENST00000393937; ENST00000409549; ENST00000409986 | chr2 | 74762269 | 74761994 | − | TSF |
| 7% | chr2 | 74762581 | 74762419 | − | ENST00000264094; ENST00000393937; ENST00000409549; ENST00000409986 | chr2 | 74762269 | 74761994 | − | TSF |
| 7% | chr2 | 74762581 | 74762419 | − | ENST00000264094; ENST00000393937; ENST00000409549; ENST00000409986 | chr2 | 74762269 | 74761994 | − | TSF |
| 6% | chr7 | 23300075 | 23300392 | + | ENST00000258733; ENST00000381990; ENST00000539136; ENST00000453162 | chr7 | 23300981 | 23301414 | + | TSF |
| 6% | chr7 | 23300075 | 23300392 | + | ENST00000258733; ENST00000381990; ENST00000539136; ENST00000453162 | chr7 | 23300981 | 23301414 | + | TSF |
| 6% | chr7 | 23300075 | 23300392 | + | ENST00000258733; ENST00000381990; ENST00000539136; ENST00000453162 | chr7 | 23300981 | 23301414 | + | TSF |
| 6% | chr1 | 2492063 | 2492153 | + | ENST00000426449; ENST00000434817; ENST00000435221; ENST00000451778; ENST00000409119; ENST00000355716 | chr1 | 2508457 | 2508463 | + | TSF |
| 6% | chr2 | 127413840 | 127413888 | + | ENST00000259254; ENST00000409836 | chr2 | 127447276 | 127447440 | + | TSF |
| 6% | chr22 | 40258012 | 40257770 | − | ENST00000325157 | chr22 | 40254656 | 40253648 | − | TSF |
| 6% | chr15 | 89456550 | 89456478 | − | ENST00000558018; ENST00000268151; ENST00000268150; ENST00000566497; ENST00000542878; ENST00000558029 | chr15 | 89453897 | 89453853 | − | TSF |

TABLE 56

Transcript fusion for skin cutaneous melanoma (SKCM) Coordinates
of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 83% | chr16 | 1521687 | 1521625 | − | chr16 | 1515339 | 1515268 | − | ENST00000382745; ENST00000564568 | TAF |
| 83% | chr16 | 1521687 | 1521625 | − | chr16 | 1515339 | 1515268 | − | ENST00000382745; ENST00000564568 | TAF |
| 66% | chr22 | 22899971 | 22899965 | − | chr22 | 22893511 | 22893189; 22893185; 22893481; 22893274 | − | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |
| 66% | chr22 | 22899971 | 22899965 | − | chr22 | 22893511 | 22893189; 22893185; 22893481; 22893274 | − | ENST00000398743; ENST00000398741; ENST00000543184; ENST00000405655; ENS T00000402697; ENST00000439106; ENST00000438888; ENST00000420709; ENST00000406503; ENST00000442481; ENST00000403441 | TSF |
| 66% | chr22 | 22899971 | 22899965 | − | chr22 | 22893511 | 22893189; 22893185; 22893481; 22893274 | − | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |
| 66% | chr22 | 22899971 | 22899965 | − | chr22 | 22893511 | 22893189; 22893185; 22893481; 22893274 | − | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |
| 66% | chr22 | 22899971 | 22899965 | − | chr22 | 22893511 | 22893189; 22893185; 22893481; 22893274 | − | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |
| 66% | chr22 | 22899971 | 22899965 | − | chr22 | 22893511 | 22893189; 22893185; 22893481; 22893274 | − | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |
| 66% | chr22 | 22899971 | 22899965 | − | chr22 | 22893511 | 22893189; 22893185; 22893481; 22893274 | − | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |
| 63% | chr8 | 104389530 | 104389551 | + | chr8 | 104390255 | 104390471 | + | ENST00000330295; ENST00000520337 | TAF |
| 61% | chr14 | 102691697 | 102691432 | − | chr14 | 102691131 | 102691116 | − | ENST00000559838 | TAF |
| 53% | chr11 | 87906665 | 87906580 | − | chr11 | 87883123 | 87882843 | − | ENST00000243662; ENST00000526372 | TAF |
| 52% | chr7 | 2289080 | 2289115 | + | chr7 | 2289492 | 2289637 | + | ENST00000356714; ENST00000397049; ENST00000397046; ENST00000397048; ENST00000339737; ENST00000343985 | TAF |
| 51% | chr12 | 110610148 | 110610836 | + | chr12 | 110618227 | 110618376 | + | ENST00000552912; ENST00000242591; ENST00000550156 | TAF |
| 51% | chr12 | 110610148 | 110610836 | + | chr12 | 110618227 | 110618376 | + | ENST00000552912; ENST00000242591; ENST00000550156 | TAF |
| 50% | chr21 | 42597177 | 42597622 | + | chr21 | 42598193 | 42598281 | + | ENST00000328735; ENST00000330333; ENST00000347667 | TAF |
| 50% | chr21 | 42597177 | 42597622 | + | chr21 | 42598193 | 42598281 | + | ENST00000328735; ENST00000330333; ENST00000347667 | TAF |
| 50% | chr21 | 42597177 | 42597622 | + | chr21 | 42598193 | 42598281 | + | ENST00000328735; ENST00000330333; ENST00000347667 | TAF |
| 50% | chr3 | 98482258 | 98482283 | + | chr3 | 98487274 | 98487373 | + | ENST00000492254 | TAF |
| 50% | chr15 | 93221696 | 93221360 | − | chr15 | 93173575 | 93173444 | − | ENST00000327355 | TAF |
| 42% | chr7 | 2289080 | 2289194 | + | chr7 | 2289492 | 2289637 | + | ENST00000356714; ENST00000397049; ENST00000397046; ENST00000397048; ENST00000339737; ENST00000343985 | TAF |
| 40% | chr17 | 30850448 | 30850415 | − | chr17 | 30821933 | 30821777 | − | ENST00000318217; ENST00000394649 | TSF |
| 39% | chr17 | 80440912 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |
| 39% | chr17 | 80440912 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |
| 39% | chr17 | 80440912 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |
| 39% | chr17 | 80440912 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |
| 35% | chr11 | 88974419 | 88974474 | − | chr11 | 89017941 | 89018122 | + | ENST00000263321 | TSF |
| 35% | chr12 | 110610148 | 110610701 | + | chr12 | 110618227 | 110618376 | + | ENST00000552912; ENST00000242591; ENST00000550156 | TSF |
| 35% | chr12 | 110610148 | 110610701 | + | chr12 | 110618227 | 110618376 | + | ENST00000552912; ENST00000242591; ENST00000550156 | TSF |
| 34% | chr9 | 5907671 | 5907721 | + | chr9 | 5908640 | 5908708 | + | ENST00000381477; ENST00000381476; ENST00000381471 | TSF |
| 34% | chr22 | 40270249 | 40269979 | − | chr22 | 40258012 | 40257770 | − | ENST00000325157 | TSF |
| 34% | chr22 | 140270249 | 40269979 | − | chr22 | 40231963 | 40231845 | − | ENST00000325157 | TSF |
| 33% | chr12 | 56363784 | 56363834 | + | chr12 | 56364828 | 56365031 | + | ENST00000266970; ENST00000553376; ENST00000440311; ENST00000354056 | TSF |
| 32% | chr12 | 56353740 | 56353706 | − | chr12 | 56352391 | 56352257; 56352273; 56352331 | − | ENST00000449260; ENST00000552882; ENST00000550464; ENST00000548747; ENST00000539511; ENST00000548493; ENST00000550447; ENST00000548803; ENST00000547137; ENST00000546543; ENST00000549418; ENST00000549233 | TSF |
| 32% | chr12 | 56353740 | 56353706 | − | chr12 | 56352391 | 56352257; 56352273; 56352331 | − | ENST00000449260; ENST00000552882; ENST00000550464; ENST00000548747; ENST00000539511; ENST00000548493; ENST00000550447; ENST00000548803; ENST00000547137; ENST00000546543; ENST00000549418; ENST00000549233 | TSF |
| 32% | chr12 | 56353740 | 56353706 | − | chr12 | 56352391 | 56352257; 56352273; | − | ENST00000449260; ENST00000552882; ENST00000550464; ENST00000548747; ENST00000539511; ENST00000548493; | TSF |

TABLE 56-continued

Transcript fusion for skin cutaneous melanoma (SKCM) Coordinates
of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 32% | chr12 | 56353740 | 56353706 | − | chr12 | 56352391 | 56352257; 56352273; 56352331 | − | ENST00000550447; ENST00000548803; ENST00000547137; ENST00000546543; ENST00000549418; ENST00000549233 ENST00000449260; ENST00000552882; ENST00000550464; ENST00000548747; ENST00000539511; ENST00000548493 | TSF |
| 32% | chr12 | 56353740 | 56353706 | − | chr12 | 56352391 | 56352257; 56352273; 56352331 | − | ENST00000550447; ENST00000548803; ENST00000547137; ENST00000546543; ENST00000549418; ENST00000549233 ENST00000449260; ENST00000552882; ENST00000550464; ENST00000548747; ENST00000539511; ENST00000548493 | TSF |
| 32% | chr12 | 56353740 | 56353706 | − | chr12 | 56352391 | 56352257; 56352273; 56352331 | − | ENST00000550447; ENST00000548803; ENST00000547137; ENST00000546543; ENST00000549418; ENST00000549233 ENST00000449260; ENST00000552882; ENST00000550464; ENST00000548747; ENST00000539511; ENST00000548493 | TSF |
| 32% | chr12 | 56353740 | 56353706 | − | chr12 | 56352391 | 56352257; 56352273; 56352331 | − | ENST00000550447; ENST00000548803; ENST00000547137; ENST00000546543; ENST00000549418; ENST00000549233 ENST00000449260; ENST00000552882; ENST00000550464; ENST00000548747; ENST00000539511; ENST00000548493 | TSF |
| 32% | chr12 | 56353740 | 56353706 | − | chr12 | 56352391 | 56352257; 56352273; 56352331 | − | ENST00000550447; ENST00000548803; ENST00000547137; ENST00000546543; ENST00000549418; ENST00000549233 ENST00000449260; ENST00000552882; ENST00000550464; ENST00000548747; ENST00000539511; ENST00000548493 | TSF |
| 28% | chr7 | 98974090 | 98974197 | + | chr7 | 98983325 | 98983401 | + | ENST00000432884 | TAF |
| 28% | chr13 | 60978922 | 60979204 | + | chr13 | 61013822 | 61013906 | + | ENST00005535286 | TAF |
| 23% | chr1 | 31346734 | 31346686 | − | chr1 | 31346224 | 31346058 | − | ENST00000336798; ENST00000339394 | TAF |
| 23% | chr20 | 45199908 | 45199655 | − | chr20 | 45195029 | 45194868; 45194995 | − | ENST00000396360; ENST00000435032; ENST00000290317; ENST00000279027; ENST00000472148; ENST00000413164; ENST00000495082; ENST00000468915 | TSF |
| 23% | chr20 | 45199908 | 45199655 | − | chr20 | 45195029 | 45194868; 45194995 | − | ENST00000396360; ENST00000435032; ENST00000290317; ENST00000279027; ENST00000472148; ENST00000413164; ENST00000495082; ENST00000468915 | TSF |
| 22% | chr17 | 426168 | 426165 | − | chr17 | 424978 | 424841 | − | ENST00000437048 | TAF |
| 22% | chr7 | 23290404 | 23290481 | + | chr7 | 23292926 | 23293078 | + | ENST00000258733; ENST00000381990; ENST00000409458; ENST00000453162 | TSF |
| 22% | chr7 | 23290404 | 23290481 | + | chr7 | 23292926 | 23293078 | + | ENST00000258733; ENST00000381990; ENST00000409458; ENST00000453162 | TSF |
| 22% | chr7 | 23290404 | 23290481 | + | chr7 | 23292926 | 23293078 | + | ENST00000258733; ENST00000381990; ENST00000409458; ENST00000453162 | TSF |
| 22% | chr7 | 23290404 | 23290481 | + | chr7 | 23292926 | 23293078 | + | ENST00000258733; ENST00000381990; ENST00000409458; ENST00000453162 | TSF |
| 20% | chr11 | 126273341 | 126273381 | + | chr11 | 126275991 | 126276045 | + | ENST00000534733 | TAF |
| 20% | chr1 | 183600359 | 183599874 | − | chr1 | 183599772 | 183599596 | − | ENST00000367534; ENST00000359856; ENST00000294742 | TAF |
| 20% | chr1 | 183600359 | 183599874 | − | chr1 | 183599772 | 183599596 | − | ENST00000367534; ENST00000359856; ENST00000294742 | TAF |
| 20% | chr11 | 65378293 | 65378283 | − | chr11 | 65375919 | 65375739 | − | ENST00000309100 | TSF |
| 19% | chr8 | 143751981 | 143751986 | + | chr8 | 143762745 | 143762852; 143762884 | + | ENST00000301258; ENST00000513264 | TAF |
| 19% | chr8 | 143751981 | 143751986 | + | chr8 | 143762745 | 143762852; 143762884 | + | ENST00000301258; ENST00000513264 | TAF |
| 19% | chr7 | 73098299 | 73098330 | + | chr7 | 73100966 | 73101061 | + | ENST00000265758; ENST00000432522; ENST00000421744; ENST00000428163; ENST00000423166; ENST00000423497 | TAF |
| 19% | chr7 | 73098299 | 73098330 | + | chr7 | 73100966 | 73101061 | + | ENST00000265758; ENST00000432522; ENST00000421744; ENST00000428163; ENST00000423166; ENST00000423497 | TAF |
| 19% | chr7 | 73098299 | 73098330 | + | chr7 | 73100966 | 73101061 | + | ENST00000265758; ENST00000432522; ENST00000421744; ENST00000428163; ENST00000423166; ENST00000423497 | TAF |
| 19% | chr7 | 73098299 | 73098330 | + | chr7 | 73100966 | 73101061 | + | ENST00000265758; ENST00000432522; ENST00000421744; ENST00000428163; ENST00000423166; ENST00000423497 | TAF |
| 19% | chr7 | 73098299 | 73098330 | + | chr7 | 73100966 | 73101061 | + | ENST00000265758; ENST00000432522; ENST00000421744; ENST00000428163; ENST00000423166; ENST00000423497 | TAF |
| 18% | chr1 | 240569724 | 240569786 | + | chr1 | 240601361 | 240601510 | + | ENST00000319653; ENST00000545751 | TAF |
| 18% | chr12 | 110654593 | 110654638 | + | chr12 | 110655849 | 110656031 | + | ENST00000552912; ENST00000242591 | TAF |
| 18% | chr12 | 94167005 | 94167262 | + | chr12 | 94243746 | 94244047 | + | ENST00000332896; ENST00000542893 | TAF |
| 18% | chr11 | 322262 | 322206 | − | chr11 | 320772 | 320565 | − | ENST00000399808 | TAF |
| 18% | chr11 | 321450 | 321426 | − | chr11 | 320772 | 320565 | − | ENST00000399808 | TAF |
| 18% | chr11 | 321638 | 321543 | − | chr11 | 320772 | 320565 | − | ENST00000399808 | TAF |
| 18% | chr11 | 321638 | 321504 | − | chr11 | 320772 | 320565 | − | ENST00000399808 | TAF |
| 18% | chr11 | 321488 | 321465 | − | chr11 | 320772 | 320565 | − | ENST00000399808 | TAF |
| 18% | chr11 | 322580 | 322557 | − | chr11 | 320772 | 320565 | − | ENST00000399808 | TAF |
| 18% | chr11 | 321410 | 321387 | − | chr11 | 320772 | 320565 | − | ENST00000399808 | TAF |
| 18% | chr11 | 321638 | 321582 | − | chr11 | 320772 | 320565 | − | ENST00000399808 | TAF |
| 18% | chr11 | 321716 | 321660 | − | chr11 | 320772 | 320565 | − | ENST00000399808 | TAF |
| 18% | chr11 | 322067 | 322011 | − | chr11 | 320772 | 320565 | − | ENST00000399808 | TAF |
| 18% | chr11 | 322457 | 322401 | − | chr11 | 320772 | 320565 | − | ENST00000399808 | TAF |
| 18% | chr11 | 321911 | 321855 | − | chr11 | 320772 | 320565 | − | ENST00000399808 | TAF |
| 17% | chr11 | 93468219 | 93468129 | − | chr11 | 93467826 | 93467791; 93467814 | − | ENST00000393259; ENST00000527169 | TAF |

TABLE 56-continued

Transcript fusion for skin cutaneous melanoma (SKCM) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 17% | chr11 | 93468219 | 93468129 | − | chr11 | 93467826 | 93467791; 93467814 | − | ENST00000393259; ENST00000527169 | TAF |
| 17% | chr5 | 171488028 | 171487971 | − | chr5 | 171484477 | 171484353 | − | ENST00000176763; ENST00000520476 | TAF |
| 17% | chr5 | 171488028 | 171487971 | − | chr5 | 171484477 | 171484353 | − | ENST00000176763; ENST00000520476 | TAF |
| 17% | chr7 | 150730019 | 150730148 | + | chr7 | 150730692 | 150730929; 150731004; 150730700 | + | ENST00000461373; ENST00000358849; ENST00000489192; ENST00000297504; ENST00000356058; ENST00000498578; ENST00000477719; ENST00000477092 | TAF |
| 17% | chr7 | 150730019 | 150730148 | + | chr7 | 150730692 | 150730929; 150731004; 150730700 | + | ENST00000461373; ENST00000358849; ENST00000489192; ENST00000297504; ENST00000356058; ENST00000498578; ENST00000477719; ENST00000477092 | TAF |
| 17% | chr7 | 150730019 | 150730148 | + | chr7 | 150730692 | 150730929; 150731004; 150730700 | + | ENST00000461373; ENST00000358849; ENST00000489192; ENST00000297504; ENST00000356058; ENST00000498578; ENST00000477719; ENST00000477092 | TAF |
| 17% | chr7 | 150730019 | 150730148 | + | chr7 | 150730692 | 150730929; 150731004; 150730700 | + | ENST00000461373; ENST00000358849; ENST00000489192; ENST00000297504; ENS T00000356058; ENST00000498578; ENST00000477719; ENST00000477092 | TAF |
| 17% | chr7 | 150730019 | 150730148 | + | chr7 | 150730692 | 150730929; 150731004; 150730700 | + | ENST00000461373; ENST00000358849; ENST00000489192; ENST00000297504; ENST00000356058; ENST00000498578; ENST00000477719; ENST00000477092 | TAF |
| 17% | chr7 | 150730019 | 150730148 | + | chr7 | 150730692 | 150730929; 150731004; 150730700 | + | ENST00000461373; ENST00000358849; ENST00000489192; ENST00000297504; ENS T00000356058; ENST00000498578; ENST00000477719; ENST00000477092 | TAF |
| 17% | chr7 | 150730019 | 150730148 | + | chr7 | 150730692 | 150730929; 150731004; 150730700 | + | ENST00000461373; ENST00000358849; ENST00000489192; ENST00000297504; ENST00000356058; ENST00000498578; ENST00000477719; ENST00000477092 | TAF |
| 17% | chr1 | 6380703 | 6380649 | − | chr1 | 6378638 | 6378552 | − | ENST00000608083; ENST00000377842; ENST00000377845; ENST00000377855; ENST00000377860; ENST00000418124; ENST00000545482; ENST00000361521; ENST00000473466; ENST00000541130 | TAF |
| 17% | chr1 | 6380703 | 6380649 | − | chr1 | 6378638 | 6378552 | − | ENST00000608083; ENST00000377842; ENST00000377845; ENST00000377855; ENS T00000377860; ENST00000418124; ENST00000545482; ENST00000361521; ENST00000473466; ENST00000541130 | TAF |
| 17% | chr1 | 6380703 | 6380649 | − | chr1 | 6378638 | 6378552 | − | ENST00000608083; ENST00000377842; ENST00000377845; ENST00000377855; ENS T00000377860; ENST00000418124; ENST00000545482; ENST00000361521; ENST00000473466; ENST00000541130 | TAF |
| 17% | chr1 | 6380703 | 6380649 | − | chr1 | 6378638 | 6378552 | − | ENST00000608083; ENST00000377842; ENST00000377845; ENST00000377855; ENST00000377860; ENST00000418124; ENST00000545482; ENST00000361521; ENST00000473466; ENST00000541130 | TAF |
| 17% | chr1 | 6380703 | 6380649 | − | chr1 | 16378638 | 6378552 | − | ENST00000608083; ENST00000377842; ENST00000377845; ENST00000377855; ENS T00000377860; ENST00000418124; ENST00000545482; ENST00000361521; ENST00000473466; ENST00000541130 | TAF |
| 17% | chr17 | 39976225 | 39976301 | + | chr17 | 39976521 | 39976713 | + | ENST00000321562; ENST00000455106; ENST00000544340 | TSF |
| 17% | chr2 | 37569837 | 37570066 | + | chr2 | 37579932 | 37580078 | + | ENST00000338415 | TSF |
| 17% | chr19 | 48627094 | 48627044 | − | chr19 | 48626575 | 48626431 | − | ENST00000263274; ENST00000536218; ENST00000594759; ENST00000427526; ENST00000601091 | TSF |
| 17% | chr19 | 48627094 | 48627044 | − | chr19 | 48626575 | 48626431 | − | ENST00000263274; ENST00000536218; ENST00000594759; ENST00000427526; ENST00000601091 | TSF |
| 16% | chr19 | 46196448 | 46196481 | + | chr19 | 46196671 | 46196814 | + | ENST00000012049; ENST00000366382; ENST00000591606 | TSF |
| 16% | chr19 | 46196448 | 46196481 | + | chr19 | 46196671 | 46196814 | + | ENST00000012049; ENST00000366382; ENST00000591606 | TSF |
| 16% | chr19 | 46196448 | 46196481 | + | chr19 | 46196671 | 46196814 | + | ENST00000012049; ENST00000366382; ENST00000591606 | TSF |
| 16% | chr2 | 74762302 | 74762039 | − | chr2 | 74761901 | 74761658 | − | ENST00000264094; ENST00000393937; ENST00000409549; ENST00000409986 | TSF |
| 16% | chr2 | 74762302 | 74762039 | − | chr2 | 74761901 | 74761658 | − | ENST00000264094; ENST00000393937; ENST00000409549; ENST00000409986 | TSF |
| 15% | chr8 | 145134058 | 145134309 | + | chr8 | 145134846 | 145135052; 145134924 | + | ENST00000316052; ENST00000525936; ENST00000527954 | TAF |
| 15% | chr 8 | 145134058 | 145134309 | + | chr8 | 145134846 | 145135052; 145134924 | + | ENST00000316052; ENST00000525936; ENST00000527954 | TAF |
| 15% | chr8 | 145134058 | 145134309 | + | chr8 | 145134846 | 145135052; 145134924 | + | ENST00000316052; ENST00000525936; ENST00000527954 | TAF |
| 15% | chr10 | 100147690 | 100147622 | − | chr10 | 100147064 | 100146958 | − | ENST00000370575 | TAF |
| 15% | chr12 | 50380548 | 50380303 | − | chr12 | 50370842 | 50370733 | − | ENST00000548961 | TSF |
| 15% | chr7 | 100850556 | 100850506 | − | chr7 | 100850185 | 100850060 | − | ENST00000454310; ENST00000223127 | TSF |
| 14% | chr4 | 107241932 | 107242850 | + | chr4 | 107246142 | 107246275 | + | ENST00000394701 | TAF |
| 14% | chr17 | 39974832 | 39974854 | + | chr17 | 39975462 | 39975651 | + | ENST00000321562 | TAF |
| 14% | chr19 | 49121994 | 49121817 | − | chr19 | 49121134 | 49121048 | − | ENST00000549920; ENST00000547897; ENST00000084795; ENST00000550645; ENST00000549370; ENST00000549273 | TAF |
| 14% | chr19 | 49121994 | 49121817 | − | chr19 | 49121134 | 49121048 | − | ENST00000549920; ENST00000547897; ENST00000084795; ENST00000550645; ENST00000549370; ENST00000549273 | TAF |
| 14% | chr19 | 49121994 | 49121817 | − | chr19 | 49121134 | 49121048 | − | ENST00000549920; ENST00000547897; ENST00000084795; ENST00000550645; ENST00000549370; ENST00000549273 | TAF |

TABLE 56-continued

Transcript fusion for skin cutaneous melanoma (SKCM) Coordinates
of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 14% | chr19 | 49121994 | 49121817 | − | chr19 | 49121134 | 49121048 | − | ENST00000549920; ENST00000547897; ENST00000084795; ENST00000550645; ENST00000549370; ENST00000549273 | TAF |
| 14% | chr19 | 49121994 | 49121817 | − | chr19 | 49121134 | 49121048 | − | ENST00000549920; ENST00000547897; ENST00000084795; ENST00000550645; ENST00000549370; ENST00000549273 | TAF |
| 14% | chr17 | 74583012 | 74582951 | − | chr17 | 74574898 | 74574838; 74574881 | | ENST00000225276; ENST00000585736 | TAF |
| 14% | chr17 | 74583012 | 74582951 | − | chr17 | 74574898 | 74574838; 74574881 | − | ENST00000225276; ENST00000585736 | TAF |
| 14% | chr12 | 64427856 | 64428169 | + | chr12 | 64436570 | 64436752 | + | ENST00000355086; ENST00000357825; ENST00000543397 | TSF |
| 14% | chr12 | 64427856 | 64428169 | + | chr12 | 64436570 | 64436752 | + | ENST00000355086; ENST00000357825; ENST00000543397 | TSF |
| 14% | chr5 | 113768197 | 113769626 | + | chr5 | 113798746 | 113798887 | + | ENST00000512097; ENST00000264773 | TSF |
| 13% | chr1 | 156095197 | 156095265 | + | chr1 | 156100408 | 156100564 | + | ENST00000368301; ENST00000361308; ENST00000347559; ENST00000368300; ENST00000368299; ENST00000448611; ENST00000368297; ENST00000504687; ENST00000473598; ENST00000392353 | TAF |
| 13% | chr1 | 156095197 | 155095265 | + | chr1 | 156100408 | 156100564 | + | ENST00000368301; ENST00000361308; ENST00000347559; ENST00000368300; ENS T00000368299; ENST00000448611; ENST00000368297; ENST00000504687; ENST00000473598; ENST00000392353 | TAF |
| 13% | chr1 | 156095197 | 155095265 | + | chr1 | 156100408 | 156100564 | + | ENST00000368301; ENST00000361308; ENST00000347559; ENST00000368300; ENS T00000368299; ENST00000448611; ENST00000368297; ENST00000504687; ENST00000473598; ENST00000392353 | TAF |
| 13% | chr1 | 156095197 | 156095265 | + | chr1 | 156100408 | 156100564 | + | ENST00000368301; ENST00000361308; ENST00000347559; ENST00000368300; ENS T00000368299; ENST00000448611; ENST00000368297; ENST00000504687; ENST00000473598; ENST00000392353 | TAF |
| 13% | chr1 | 156095197 | 155095265 | + | chr1 | 156100408 | 156100564 | + | ENST00000368301; ENST00000361308; ENST00000347559; ENST00000368300; ENST00000368299; ENST00000448611; ENST00000368297; ENST00000504687; ENST000 00473598; ENST00000392353 | TAF |
| 13% | chr1 | 156095197 | 156095265 | + | chr1 | 156100408 | 156100564 | + | ENST00000368301; ENST00000361308; ENST00000347559; ENST00000368300; ENST00000368299; ENST00000448611; ENST00000368297; ENST00000504687; ENST00000473598; ENST00000392353 | TAF |
| 13% | chr17 | 79214190 | 79214239 | + | chr17 | 79214787 | 79214816; 79214953 | + | ENST00000431388; ENST00000576002 | TAF |
| 13% | chr17 | 79214190 | 79214239 | + | chr17 | 79214787 | 79214816; 79214953 | + | ENST00000431388; ENST00000576002 | TAF |
| 13% | chr9 | 131189761 | 131190058 | + | chr9 | 131190581 | 131190700; 131190702 | + | ENST00000372842; ENST00000420512; ENST00000372838 | TAF |
| 13% | chr9 | 131189761 | 131190058 | + | chr9 | 131190581 | 131190700; 131190702 | + | ENST00000372842; ENST00000420512; ENST00000372838 | TAF |
| 13% | chr15 | 41968651 | 41968463 | − | chr15 | 41815513 | 41815443 | − | ENST00000561603; ENST00000304330; ENST00000562303 | TAF |
| 13% | chr15 | 41968651 | 41968463 | − | chr15 | 41815513 | 41815443 | − | ENST00000561603; ENST00000304330; ENST00000562303 | TAF |
| 13% | chr15 | 41968651 | 41968463 | − | chr15 | 41815513 | 41815443 | − | ENST00000561603; ENST00000304330; ENST00000562303 | TAF |
| 13% | chr1 | 45139523 | 45139439 | − | chr1 | 45125967 | 45125846 | − | ENST00000372242; ENST00000372243; ENST00000372237; ENST00000372235; ENST00000420706 | TAF |
| 13% | chr1 | 45139523 | 45139439 | − | chr1 | 45125967 | 45125846 | − | ENST00000372242; ENST00000372243; ENST00000372237; ENST00000372235; ENST00000420706 | TAF |
| 13% | chr1 | 45139523 | 45139439 | − | chr1 | 45125967 | 45125846 | − | ENST00000372242; ENST00000372243; ENST00000372237; ENST00000372235; ENST00000420706 | TAF |
| 13% | chr1 | 45139523 | 45139439 | − | chr1 | 45125967 | 45125846 | − | ENST00000372242; ENST00000372243; ENST00000372237; ENST00000372235; ENST00000420706 | TAF |
| 13% | chr1 | 45139523 | 45139439 | − | chr1 | 45125967 | 45125846 | − | ENST00000372242; ENST00000372243; ENST00000372237; ENST00000372235; ENST00000420706 | TAF |
| 13% | chr10 | 90305421 | 90305214 | − | chr10 | 90122482 | 90122309 | − | ENST00000371947; ENST00000437752; ENST00000331772 | TAF |
| 13% | chr10 | 90305421 | 90305214 | − | chr10 | 90122482 | 90122309 | − | ENST00000371947; ENST00000437752; ENST00000331772 | TAF |
| 13% | chr17 | 41171108 | 41170991 | − | chr17 | 41170816 | 41170609; 41170766 | − | ENST00000355653; ENST00000587173; ENST00000587062 | TAF |
| 13% | chr17 | 41171108 | 41170991 | − | chr17 | 41170816 | 41170609; 41170766 | − | ENST00000355653; ENST00000587173; ENST00000587062 | TAF |
| 13% | chr6 | 111651498 | 111651389 | − | chr6 | 111650941 | 111650735 | − | ENST00000368802; ENST00000368805; ENST00000358835; ENST00000435970 | TAF |
| 13% | chr1 | 236326774 | 236327054 | + | chr1 | 236332006 | 236332055 | + | ENST00000366592; ENST00000454895 | TSF |
| 13% | chr1 | 236326774 | 236327054 | + | chr1 | 236332006 | 236332055 | + | ENST00000366592; ENST00000454895 | TSF |
| 13% | chr4 | 142977397 | 142977072 | − | chr4 | 142950067 | 142949935 | − | ENST00000513000; ENST00000262992; ENST00000308502; ENST00000508116 | TSF |
| 12% | chr16 | 23575135 | 23575430 | + | chr16 | 23578308 | 23578390 | + | ENST00000219638; ENST00000395878; ENST00000567212 | TAF |
| 12% | chr19 | 54631006 | 54631115 | + | chr19 | 54631448 | 54631575 | + | ENST00000321030; ENST00000419967 | TAF |
| 12% | chr19 | 54631006 | 54631115 | + | chr19 | 54631448 | 54631575 | + | ENST00000321030; ENST00000419967 | TAF |
| 12% | chr1 | 212594935 | 212595005 | + | chr1 | 212615911 | 212615967 | + | ENST00000366988 | TAF |
| 12% | chr9 | 139611399 | 139611665 | + | chr9 | 139612029 | 139612163 | + | ENST00000371692 | TAF |
| 12% | chr4 | 171310858 | 174310746 | − | chr4 | 174309546 | 174309492 | − | ENST00000296506 | TAF |
| 12% | chr7 | 150938296 | 150938250 | − | chr7 | 150937608 | 150937511 | − | ENST00000262188; ENST00000392811; ENST00000356800 | TAF |

TABLE 56-continued

Transcript fusion for skin cutaneous melanoma (SKCM) Coordinates
of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 12% | chr7 | 100854761 | 100854711 | − | chr7 | 100853725 | 100853612 | − | ENST00000454310; ENST00000223127 | TAF |
| 12% | chr7 | 100854761 | 100854711 | − | chr7 | 100853725 | 100853612 | − | ENST00000454310; ENST00000223127 | TAF |
| 12% | chr1 | 54879137 | 54879029 | − | chr1 | 54870603 | 54870531 | − | ENST00000371320; ENST00000371319; ENST00000357475 | TAF |
| 12% | chr1 | 54879137 | 54879029 | − | chr1 | 54870603 | 54870531 | − | ENST00000371320; ENST00000371319; ENST00000357475 | TAF |
| 12% | chr1 | 54879137 | 54879029 | − | chr1 | 54870603 | 54870531 | − | ENST00000371320; ENST00000371319; ENST00000357475 | TAF |
| 12% | chr5 | 54528691 | 54528595 | − | chr5 | 54528374 | 54528189 | − | ENST00000282572 | TAF |
| 12% | chr7 | 2276932 | 2276801 | − | chr7 | 2275199 | 2274757; 2275164 | − | ENST00000242257; ENST00000440306; ENST00000407040 | TAF |
| 12% | chr7 | 2276932 | 2276801 | − | chr7 | 2275199 | 2274757; 2275164 | − | ENST00000242257; ENST00000440306; ENST00000407040 | TAF |
| 12% | chr2 | 65243329 | 65243368 | + | chr2 | 65243574 | 65243807 | + | ENST00000234256 | TSF |
| 12% | chr11 | 88974419 | 88974474 | + | chr11 | 89028311 | 89028534 | + | ENST00000263321 | TSF |
| 11% | chr10 | 199667221 | 99666955 | − | chr10 | 99664571 | 99664426 | − | ENST00000413387; ENST00000370597; ENST00000298819; ENST00000309155; ENST00000370591 | TAF |
| 11% | chr10 | 199667221 | 99666955 | − | chr10 | 99664571 | 99664426 | − | ENST00000413387; ENST00000370597; ENST00000298819; ENST00000309155; ENST00000370591 | TAF |
| 11% | chr10 | 99667221 | 99666955 | − | chr10 | 99664571 | 99664426 | − | ENST00000413387; ENST00000370597; ENST00000298819; ENST00000309155; ENST00000370591 | TAF |
| 11% | chr10 | 90305421 | 90305146 | − | chr10 | 90122482 | 90122309 | − | ENST00000371947; ENST00000437752; ENST00000331772 | TAF |
| 11% | chr10 | 90305421 | 90305146 | − | chr10 | 90122482 | 90122309 | − | ENST00000371947; ENST00000437752; ENST00000331772 | TAF |
| 11% | chr21 | 47675413 | 47675316 | − | chr21 | 47674758 | 47674690 | − | ENST00000397708; ENST00000291688 | TAF |
| 11% | chr9 | 127176843 | 127176809 | − | chr9 | 127176284 | 127176187 | − | ENST00000259457; ENST00000536392; ENST00000441097 | TAF |
| 11% | chr9 | 127176843 | 127176809 | − | chr9 | 127176284 | 127176187 | − | ENST00000259457; ENST00000536392; ENST00000441097 | TAF |
| 11% | chr9 | 127176843 | 127176809 | − | chr9 | 127176284 | 127176187 | − | ENST00000259457; ENST00000536392; ENST00000441097 | TAF |
| 11% | chr5 | 113768197 | 113769590 | + | chr5 | 113798746 | 113798887 | + | ENST00000512097; ENST00000264773 | TSF |
| 11% | chr17 | 39974832 | 39974893 | + | chr17 | 39975462 | 39975651 | + | ENST00000321562 | TSF |
| 11% | chr7 | 20686966 | 20686997 | + | chr7 | 20687158 | 20687271 | + | ENST00000404938 | TSF |
| 11% | chr15 | 28127352 | 28127177 | − | chr15 | 28117068 | 28117009 | − | ENST00000353809; ENST00000354638 | TSF |
| 11% | chr7 | 82523973 | 82523713 | − | chr7 | 82508778 | 82508653 | − | ENST00000333891; ENST00000423517; ENST00000413807; ENST00000456006 | TSF |
| 11% | chr7 | 82523973 | 82523713 | − | chr7 | 82508778 | 82508653 | − | ENST00000333891; ENST00000423517; ENST00000413807; ENST00000456006 | TSF |
| 11% | chr7 | 82523973 | 82523713 | − | chr7 | 82508778 | 82508653 | − | ENST00000333891; ENST00000423517; ENST00000413807; ENST00000456006 | TSF |
| 11% | chr7 | 82523973 | 82523713 | − | chr7 | 82508778 | 82508653 | − | ENST00000333891; ENST00000423517; ENST00000413807; ENST00000456006 | TSF |
| 11% | chr6 | 13472490 | 13472213 | − | chr6 | 13470862 | 13470669 | − | ENST00000603223 | TSF |
| 10% | chr8 | 104389530 | 104389536 | + | chr8 | 104390255 | 104390471 | + | ENST00000330295; ENST00000520337 | TSF |
| 10% | chr2 | 97615730 | 97615723 | − | chr2 | 197613639 | 97613555 | | ENST00000327896; ENST00000417561; ENST00000490605 | TSF |
| 10% | chr14 | 102691697 | 102691557 | − | chr14 | 102691131 | 102691116 | − | ENST00000559838 | TSF |
| 10% | chr4 | 89198618 | 89198541 | − | chr4 | 89198395 | 89198295; 89198287 | | ENST00000608933; ENST00000295908; ENST00000315194; ENST00000514204 | TSF |
| 10% | chr4 | 89198618 | 89198541 | − | chr4 | 89198395 | 89198295; 89198287 | | ENST00000608933; ENST00000295908; ENST00000315194; ENST00000514204 | TSF |
| 10% | chr4 | 89198618 | 89198541 | − | chr4 | 89198395 | 89198295; 89198287 | − | ENST00000608933; ENST00000295908; ENST00000315194; ENST00000514204 | TSF |
| 10% | chr4 | 89198618 | 89198541 | − | chr4 | 89198395 | 89198295; 89198287 | − | ENST00000608933; ENST00000295908; ENST00000315194; ENST00000514204 | TSF |
| 10% | chr12 | 56357933 | 56357814 | − | chr12 | 56355516 | 56355406 | − | ENST00000449260; ENST00000552882; ENST00000548747; ENST00000360714; ENS T00000536427; ENST00000548493; ENST00000548803; ENST00000547137; ENST00000546543; ENST00000549418; ENST00000549233 | TSF |
| 10% | chr12 | 56357933 | 56357814 | − | chr12 | 56355516 | 56355406 | − | ENST00000449260; ENST00000552882; ENST00000548747; ENST00000360714; ENST00000536427; ENST00000548493; ENST00000548803; ENST00000547137; ENST00000546543; ENST00000549418; ENST00000549233 | TSF |
| 10% | chr12 | 56357933 | 56357814 | | chr12 | 56355516 | 56355406 | | ENST00000449260; ENST00000552882; ENST00000548747; ENST00000360714; ENS T00000536427; ENST00000548493; ENST00000548803; ENST00000547137; ENST00000546543; ENST00000549418; ENST00000549233 | TSF |
| 10% | chr12 | 56357933 | 56357814 | | chr12 | 56355516 | 56355406 | | ENST00000449260; ENST00000552882; ENST00000548747; ENST00000360714; ENS T00000536427; ENST00000548493; ENST00000548803; ENST00000547137; ENST00000546543; ENST00000549418; ENST00000549233 | TSF |
| 10% | chr12 | 56357933 | 56357814 | | chr12 | 56355516 | 56355406 | | ENST00000449260; ENST00000552882; ENST00000548747; ENST00000360714; ENS T00000536427; ENST00000548493; ENST00000548803; ENST00000547137; ENST00000546543; ENST00000549418; ENST00000549233 | TSF |
| 10% | chr12 | 56357933 | 56357814 | | chr12 | 56355516 | 56355406 | | ENST00000449260; ENST00000552882; ENST00000548747; ENST00000360714; ENS T00000536427; ENST00000548493; ENST00000548803; ENST00000547137; ENST00000546543; ENST00000549418; ENST00000549233 | TSF |
| 10% | chr12 | 56357933 | 56357814 | | chr12 | 56355516 | 56355406 | | ENST00000449260; ENST00000552882; ENST00000548747; ENST00000360714; ENST00000536427; ENST00000548493; ENST00000548803; ENST00000547137; ENST00000546543; | TSF |

TABLE 56-continued

Transcript fusion for skin cutaneous melanoma (SKCM) Coordinates
of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 10% | chr12 | 56357933 | 56357814 | − | chr12 | 56355516 | 56355406 | − | ENST00000549418; ENST00000549233 ENST00000449260; ENST00000552882; ENST00000548747; ENST00000360714; ENST00000536427; ENST00000548493; ENST00000548803; ENST00000547137; ENST00000546543 | TSF |
| 10% | chr12 | 56357933 | 56357814 | − | chr12 | 56355516 | 56355406 | − | ENST00000549418; ENST00000549233 ENST00000449260; ENST00000552882; ENST00000548747; ENST00000360714; ENST00000536427; ENST00000548493; ENST00000548803; ENST00000547137; ENST00000546543 | TSF |
| 9% | chr12 | 110610148 | 110610745 | + | chr12 | 110618227 | 110618376 | + | ENST00000549418; ENST00000549233 ENST00000552912; ENST00000242591; ENST00000550156 | TSF |
| 9% | chr12 | 110610148 | 110610745 | + | chr12 | 110618227 | 110618376 | + | ENST00000552912; ENST00000242591; ENST00000550156 | TSF |
| 8% | chr9 | 5907671 | 5907771 | + | chr9 | 5908640 | 5908708 | + | ENST00000381477; ENST00000381476; ENST00000381471 | TSF |
| 8% | chr12 | 66314250 | 66314527 | + | chr12 | 66345163 | 66345195; 66345213 | + | ENST00000403681; ENST00000541363; ENST00000393577 | TSF |
| 8% | chr12 | 66314250 | 66314527 | + | chr12 | 66345163 | 66345195; 66345213 | + | ENST00000403681; ENST00000541363; ENST00000393577 | TSF |
| 8% | chr12 | 66314250 | 66314527 | + | chr12 | 66345163 | 66345195; 66345213 | + | ENST00000403681; ENST00000541363; ENST00000393577 | TSF |
| 8% | chr18 | 20777402 | 20777408 | + | chr18 | 20793941 | 20794018; 20794082 | + | ENST00000400473; ENST00000579963; ENST00000256925; ENST00000582882; ENST00000420687 | TSF |
| 8% | chr18 | 20777402 | 20777408 | + | chr18 | 20793941 | 20794018; 20794082 | + | ENST00000400473; ENST00000579963; ENST00000256925; ENST00000582882; ENST00000420687 | TSF |
| 8% | chr18 | 20777402 | 20777408 | + | chr18 | 20793941 | 20794018; 20794082 | + | ENST00000400473; ENST00000579963; ENST00000256925; ENST00000582882; ENST00000420687 | TSF |
| 8% | chr1 | 212596286 | 212598077 | + | chr1 | 212617681 | 212617784 | + | ENST00000366988 | TSF |
| 8% | chr7 | 22512874 | 22512791 | − | chr7 | 22459455 | 22459423 | − | ENST00000406890 | TSF |
| 8% | chr16 | 90158266 | 90158141 | − | chr16 | 90141431 | 90141324 | − | ENST00000449207; ENST00000568473; ENST00000564210 | TSF |
| 8% | chr16 | 90158266 | 90158141 | − | chr16 | 90141431 | 90141324 | − | ENST00000449207; ENST00000568473; ENST00000564210 | TSF |
| 8% | chr16 | 90158266 | 90158141 | − | chr16 | 90141431 | 90141324 | − | ENST00000449207; ENST00000568473; ENST00000564210 | TSF |
| 8% | chr15 | 52752877 | 52752312 | − | chr15 | 52725482 | 52725372 | − | ENST00000399231; ENST00000356338; ENST00000358212; ENST00000399233; ENST00000553916; ENST00000556196 | TSF |
| 8% | chr15 | 52752877 | 52752312 | − | chr15 | 52725482 | 52725372 | − | ENST00000399231; ENST00000356338; ENST00000358212; ENST00000399233; ENST00000553916; ENST00000556196 | TSF |
| 8% | chr15 | 52752877 | 52752312 | − | chr15 | 52725482 | 52725372 | − | ENST00000399231; ENST00000356338; ENST00000358212; ENST00000399233; ENST00000553916; ENST00000556196 | TSF |
| 8% | chr15 | 52752877 | 52752312 | − | chr15 | 52725482 | 52725372 | − | ENST00000399231; ENST00000356338; ENST00000358212; ENST00000399233; ENST00000553916; ENST00000556196 | TSF |
| 8% | chr15 | 52752877 | 52752312 | − | chr15 | 52725482 | 52725372 | − | ENST00000399231; ENST00000356338; ENST00000358212; ENST00000399233; ENST00000553916; ENST00000556196 | TSF |
| 8% | chr15 | 52752877 | 52752312 | − | chr15 | 52725482 | 52725372 | − | ENST00000399231; ENST00000356338; ENST00000358212; ENST00000399233; ENST00000553916; ENST00000556196 | TSF |
| 8% | chr5 | 178696659 | 178696386 | − | chr5 | 178634716 | 178634514 | − | ENST00000251582; ENST00000274609 | TSF |
| 8% | chr5 | 178696659 | 178696386 | − | chr5 | 178634716 | 178634514 | − | ENST00000251582; ENST00000274609 | TSF |
| 8% | chr15 | 31367719 | 31365913 | − | chr15 | 31362429 | 31362234; 31362036 | − | ENST00000397795; ENST00000256552; ENST00000542188; ENST00000558445; ENST00000559177; ENST00000560658; ENST00000559179 | TSF |
| 8% | chr15 | 31367719 | 31365913 | − | chr15 | 31362429 | 31362234; 31362036 | − | ENST00000397795; ENST00000256552; ENST00000542188; ENST00000558445; ENST00000559177; ENST00000560658; ENST00000559179 | TSF |
| 8% | chr15 | 31367719 | 31365913 | − | chr15 | 31362429 | 31362234; 31362036 | − | ENST00000397795; ENST00000256552; ENST00000542188; ENST00000558445; ENST00000559177; ENST00000560658; ENST00000559179 | TSF |
| 8% | chr15 | 31367719 | 31365913 | − | chr15 | 31362429 | 31362234; 31362036 | − | ENST00000397795; ENST00000256552; ENST00000542188; ENST00000558445; ENST00000559177; ENST00000560658; ENST00000559179 | TSF |
| 8% | chr2 | 42615588 | 42615585 | − | chr2 | 42580483 | 42580352; 42580316 | − | ENST00000468711; ENST00000378669; ENST00000234301; ENST00000463055 | TSF |
| 8% | chr2 | 42615588 | 42615585 | − | chr2 | 42580483 | 42580352; 42580316 | − | ENST00000468711; ENST00000378669; ENST00000234301; ENST00000463055 | TSF |
| 8% | chr2 | 42615588 | 42615585 | − | chr2 | 42580483 | 42580352; 42580316 | − | ENST00000468711; ENST00000378669; ENST00000234301; ENST00000463055 | TSF |
| 7% | chr2 | 144377158 | 144377460 | + | chr2 | 144381702 | 144381836 | + | ENST00000295095 | TSF |
| 7% | chr5 | 50095496 | 50095792 | + | chr5 | 50111266 | 50111358 | + | ENST00000514342; ENST00000505697; ENST00000503750; ENST00000281631; ENST00000514067; ENST00000505554 | TSF |
| 7% | chr5 | 50095496 | 50095792 | + | chr5 | 50111266 | 50111358 | + | ENST00000514342; ENST00000505697; ENST00000503750; ENST00000281631; ENST00000514067; ENST00000505554 | TSF |
| 7% | chr5 | 50095496 | 50095792 | + | chr5 | 50111266 | 50111358 | + | ENST00000514342; ENST00000505697; ENST00000503750; ENST00000281631; ENST00000514067; ENST00000505554 | TSF |
| 7% | chr6 | 151188691 | 151188718 | + | chr6 | 151197226 | 151197310 | + | ENST00000367321; ENST00000367307; ENST00000367308 | TSF |
| 7% | chr6 | 151188691 | 151188718 | + | chr6 | 151197226 | 151197310 | + | ENST00000367321; ENST00000367307; ENST00000367308 | TSF |
| 7% | chr6 | 151188691 | 151188718 | + | chr6 | 151197226 | 151197310 | + | ENST00000367321; ENST00000367307; ENST00000367308 | TSF |
| 7% | chr12 | 56350811 | 56350835 | + | chr12 | 56350794 | 56350733 | − | ENST00000449260; ENST00000552882; ENST00000550464; | TSF |

TABLE 56-continued

Transcript fusion for skin cutaneous melanoma (SKCM) Coordinates
of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 7% | chr12 | 56350811 | 56350835 | + | chr12 | 56350794 | 56350733 | − | ENST00000548747; ENST00000360714; ENST00000536427; ENST00000539511; ENST00000548493; ENST00000549404; ENST00000548803 ENST00000449260; ENST00000552882; ENST00000550464; | TSF |
| 7% | chr12 | 56350811 | 56350835 | + | chr12 | 56350794 | 56350733 | − | ENST00000548747; ENST00000360714; ENST00000536427; ENST00000539511; ENST00000548493; ENST00000549404; ENST00000548803 ENST00000449260; ENST00000552882; ENST00000550464; | TSF |
| 7% | chr12 | 56350811 | 56350835 | + | chr12 | 56350794 | 56350733 | − | ENST00000548747; ENS T00000360714; ENST00000536427; ENST00000539511; ENST00000548493; ENST00000549404; ENST00000548803 ENST00000449260; ENST00000552882; ENST00000550464; | TSF |
| 7% | chr2 | 42615932 | 42615589 | − | chr2 | 42580483 | 42580352; 42580316 | − | ENST00000468711; ENST00000378669; ENST00000234301; ENST00000463055 | TSF |
| 7% | chr2 | 42615932 | 42615589 | − | chr2 | 42580483 | 42580352; 42580316 | − | ENST00000468711; ENST00000378669; ENST00000234301; ENST00000463055 | TSF |
| 7% | chr2 | 42615932 | 42615589 | − | chr2 | 42580483 | 42580352; 42580316 | − | ENST00000468711; ENST00000378669; ENST00000234301; ENST00000463055 | TSF |
| 7% | chr15 | 52752877 | 52752156 | − | chr15 | 52725482 | 52725372 | − | ENST00000399231; ENST00000356338; ENST00000358212; ENST00000399233; ENST00000553916; ENST00000556196 | TSF |
| 7% | chr15 | 52752877 | 52752156 | − | chr15 | 52725482 | 52725372 | − | ENST00000399231; ENST00000356338; ENST00000358212; ENST00000399233; ENST00000553916; ENST00000556196 | TSF |
| 7% | chr15 | 52752877 | 52752156 | − | chr15 | 52725482 | 52725372 | − | ENST00000399231; ENST00000356338; ENST00000358212; ENST00000399233; ENST00000553916; ENST00000556196 | TSF |
| 7% | chr15 | 52752877 | 52752156 | − | chr15 | 52725482 | 52725372 | − | ENST00000399231; ENST00000356338; ENST00000358212; ENST00000399233; ENST00000553916; ENST00000556196 | TSF |
| 7% | chr15 | 52752877 | 52752156 | − | chr15 | 52725482 | 52725372 | − | ENST00000399231; ENST00000356338; ENST00000358212; ENST00000399233; ENST00000553916; ENST00000556196 | TSF |
| 7% | chr15 | 52752877 | 52752156 | − | chr15 | 52725482 | 52725372 | − | ENST00000399231; ENST00000356338; ENST00000358212; ENST00000399233; ENST00000553916; ENST00000556196 | TSF |
| 7% | chr7 | 44158417 | 44158351 | − | chr7 | 44157663 | 44157542 | − | ENST00000406581; ENST00000223361; ENST00000452185; ENST00000433715; ENST00000456038; ENST00000418438 | TSF |
| 7% | chr7 | 44158417 | 44158351 | − | chr7 | 44157663 | 44157542 | − | ENST00000406581; ENST00000223361; ENST00000452185; ENST00000433715; ENST00000456038; ENST00000418438 | TSF |
| 7% | chr7 | 44158417 | 44158351 | − | chr7 | 44157663 | 44157542 | − | ENST00000406581; ENST00000223361; ENST00000452185; ENST00000433715; ENST00000456038; ENST00000418438 | TSF |
| 7% | chr7 | 44158417 | 44158351 | − | chr7 | 44157663 | 44157542 | − | ENST00000406581; ENST00000223361; ENST00000452185; ENST00000433715; ENST00000456038; ENST00000418438 | TSF |
| 7% | chr7 | 44158417 | 44158351 | − | chr7 | 44157663 | 44157542 | − | ENST00000406581; ENST00000223361; ENST00000452185; ENST00000433715; ENST00000456038; ENST00000418438 | TSF |
| 7% | chr13 | 78549747 | 78549606 | − | chr13 | 78492759 | 78492226 | − | ENST00000377211 | TSF |
| 6% | chr20 | 45199908 | 45199619 | − | chr20 | 45195029 | 45194868; 45194995 | − | ENST00000396360; ENST00000435032; ENST00000290317; ENST00000279027; ENST00000472148; ENST00000413164; ENST00000495082; ENST00000468915 | TSF |
| 6% | chr20 | 45199908 | 45199619 | − | chr20 | 45195029 | 45194868; 45194995 | − | ENST00000396360; ENST00000435032; ENST00000290317; ENST00000279027; ENST00000472148; ENST00000413164; ENST00000495082; ENST00000468915 | TSF |
| 6% | chr19 | 3552777 | 3552620 | − | chr19 | 3551192 | 3550982; 3551006 | − | ENST00000389395; ENST00000398558; ENST00000588918; ENST00000355415; ENST00000585814 | TSF |
| 6% | chr19 | 3552777 | 3552620 | − | chr19 | 3551192 | 3550982; 3551006 | − | ENST00000389395; ENST00000398558; ENST00000588918; ENST00000355415; ENST00000585814 | TSF |
| 6% | chr19 | 3552777 | 3552620 | − | chr19 | 3551192 | 3550982; 5351006 | − | ENST00000389395; ENST00000398558; ENST00000588918; ENST00000355415; ENST00000585814 | TSF |
| 6% | chr19 | 3552777 | 3552620 | − | chr19 | 3551192 | 3550982; 3551006 | − | ENST00000389395; ENST00000398558; ENST00000588918; ENST00000355415; ENST00000585814 | TSF |
| 6% | chr6 | 13321752 | 13321692 | − | chr6 | 13321327 | 13321140; 13320945; 13321064 | − | ENST00000606214; ENST00000421203; ENST00000356436; ENST00000379300; ENST00000379307; ENST00000343141; ENST00000607658; ENST00000450347; ENST00000452989; ENST00000422136; ENST00000446018; ENST00000420456; ENST00000428109; ENST00000416436; ENST00000379291; ENST00000606370; ENST00000606541 | TSF |
| 6% | chr6 | 13321752 | 13321692 | − | chr6 | 13321327 | 13321140; 13320945; 13321064 | − | ENST00000606214; ENST00000421203; ENST00000356436; ENST00000379300; ENS T00000379307; ENST00000343141; ENST00000607658; ENST00000450347; ENST00000452989; ENST00000422136; ENST00000446018; ENST00000420456; ENST0000042 8109; ENST00000416436; ENST00000379291; ENST00000606370; ENST00000606541 | TSF |
| 6% | chr6 | 13321752 | 13321692 | − | chr6 | 13321327 | 13321140; 13320945; 13321064 | − | ENST00000606214; ENST00000421203; ENST00000356436; ENST00000379300; ENST00000379307; ENST00000343141; ENST00000607658; ENST00000450347; ENST00000452989; ENST0000422136; ENST00000446018; ENST00000420456; ENST00000428109; ENST00000416436; ENST00000379291; | TSF |

TABLE 56-continued

Transcript fusion for skin cutaneous melanoma (SKCM) Coordinates
of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 6% | chr6 | 13321752 | 13321692 | – | chr6 | 13321327 | 13321140; 13320945; 13321064 | – | ENST00000606214; ENST00000421203; ENST00000356436; ENST00000379300; ENST00000379307; ENST00000343141; ENST00000607658; ENST00000450347; ENST00000452989; ENST00000422136; ENST00000446018; ENST00000420456; ENST0000042 8109; ENST00000416436; ENST00000379291; ENST00000606370; ENST00000606541 | TSF |
| 6% | chr6 | 13321752 | 13321692 | – | chr6 | 13321327 | 13321140; 13320945; 13321064 | – | ENST00000606214; ENST00000421203; ENST00000356436; ENST00000379300; ENS T00000379307; ENST00000343141; ENST00000607658; ENST00000450347; ENST00000452989; ENST00000422136; ENST00000446018; ENST00000420456; ENST0000042 8109; ENST00000416436; ENST00000379291; ENST00000606370; ENST00000606541 | TSF |
| 6% | chr6 | 13321752 | 13321692 | – | chr6 | 13321327 | 13321140; 13320945; 13321064 | – | ENST00000606214; ENST00000421203; ENST00000356436; ENST00000379300; ENST00000379307; ENST00000343141; ENST00000607658; ENST00000450347; ENST00000452989; ENST00000422136; ENST00000446018; ENST00000420456; ENST0000042 8109; ENST00000416436; ENST00000379291; ENST00000606370; ENST00000606541 | TSF |
| 6% | chr6 | 13321752 | 13321692 | – | chr6 | 13321327 | 13321140; 13320945; 13321064 | – | ENST00000606214; ENST00000421203; ENST00000356436; ENST00000379300; ENS T00000379307; ENST00000343141; ENST00000607658; ENST00000450347; ENST00000452989; ENST00000422136; ENST00000446018; ENST00000420456; ENST00000428109; ENST00000416436; ENST00000379291; ENST00000606370; ENST00000606541 | TSF |
| 6% | chr6 | 13321752 | 13321692 | – | chr6 | 13321327 | 13321140; 13320945; 13321064 | – | ENST00000606214; ENST00000421203; ENST00000356436; ENST00000379300; ENST00000379307; ENST00000343141; ENST00000607658; ENST00000450347; ENST00000452989; ENST00000422136; ENST00000446018; ENST00000420456; ENST0000042 8109; ENST00000416436; ENST00000379291; ENST00000606370; ENST00000606541 | TSF |
| 6% | chr6 | 13321752 | 13321692 | – | chr6 | 13321327 | 13321140; 13320945; 13321064 | – | ENST00000606214; ENST00000421203; ENST00000356436; ENST00000379300; ENST00000379307; ENST00000343141; ENST00000607658; ENST00000450347; ENST00000452989; ENST00000422136; ENST00000446018; ENST00000420456; ENST0000042 8109; ENST00000416436; ENST00000379291; ENST00000606370; ENST00000606541 | TSF |
| 6% | chr6 | 13321752 | 13321692 | – | chr6 | 13321327 | 13321140; 13320945; 13321064 | – | ENST00000606214; ENST00000421203; ENST00000356436; ENST00000379300; ENST00000379307; ENST00000343141; ENST00000607658; ENST00000450347; ENST00000452989; ENST00000422136; ENST00000446018; ENST00000420456; ENST00000428109; ENST00000416436; ENST00000379291; ENST00000606370; ENST00000606541 | TSF |
| 6% | chr6 | 13321752 | 13321692 | – | chr6 | 13321327 | 13321140; 13320945; 13321064 | – | ENST00000606214; ENST00000421203; ENST00000356436; ENST00000379300; ENST00000379307; ENST00000343141; ENST00000607658; ENST00000450347; ENST00000452989; ENST00000422136; ENST00000446018; ENST00000420456; ENST00000428109; ENST00000416436; ENST00000379291; ENST00000606370; ENST00000606541 | TSF |
| 6% | chr6 | 13321752 | 13321692 | – | chr6 | 13321327 | 13321140; 13320945; 13321064 | – | ENST00000606214; ENST00000421203; ENST00000356436; ENST00000379300; ENST00000379307; ENST00000343141; ENST00000607658; ENST00000450347; ENST00000452989; ENST00000422136; ENST00000446018; ENST00000420456; ENST0000042 8109; ENST00000416436; ENST00000379291; ENST00000606370; ENST00000606541 | TSF |
| 6% | chr6 | 13321752 | 13321692 | – | chr6 | 13321327 | 13321140; 13320945; 13321064 | – | ENST00000606214; ENST00000421203; ENST00000356436; ENST00000379300; ENST00000379307; ENST00000343141; ENST00000607658; ENST00000450347; ENST00000452989; ENST00000422136; ENST00000446018; ENST00000420456; ENST00000428109; ENST00000416436; ENST00000379291; ENST00000606370; ENST00000606541 | TSF |
| 6% | chrX | 153207989 | 153207921 | – | chrX | 153207484 | 153207403 | – | ENST00000393700; ENST00000369997 | TSF |
| 6% | chr15 | 28123956 | 28123431 | – | chr15 | 28117068 | 28117009 | – | ENST00000353809; ENST00000354638 | TSF |
| 6% | chr17 | 28255620 | 28255510 | – | chr17 | 28252573 | 28252490 | – | ENST00000582084; ENST00000590153 | TSF |

TABLE 57

Transcript fusion for Stomach adenocarcinoma (STAD) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 51% | chr20 | 47768284 | 47768119 | - | ENST00000371828; ENST00000340954; ENST00000347458; ENST00000360426; ENST00000371792; ENST00000371802; ENST00000371856; ENST00000437404; ENST00000456866 | chr20 | 47761186 | 47760181 | - | TAF |
| 51% | chr20 | 47768284 | 47768119 | - | ENST00000371828; ENST00000340954; ENST00000347458; ENST00000360426; ENST00000371792; ENST00000371802; ENST00000371856; ENST00000437404; ENST00000456866 | chr20 | 47761186 | 47760181 | - | TAF |
| 51% | chr20 | 47768284 | 47768119 | - | ENST00000371828; ENST00000340954; ENST00000347458; ENST00000360426; ENST00000371792; ENST00000371802; ENST00000371856; ENST00000437404; ENST00000456866 | chr20 | 47761186 | 47760181 | - | TAF |
| 46% | chr1 | 32696528 | 32696620 | + | ENST00000373586 | chr1 | 32696861 | 32697110 | + | TAF |
| 45% | chr1 | 24463799 | 24463621 | - | ENST00000270800 | chr1 | 24461426 | 24461370 | - | TAF |
| 37% | chr18 | 33767503 | 33767644 | + | ENST00000261326 | chr18 | 33773430 | 33773774 | + | TAF |
| 26% | chr3 | 57678745 | 57678509 | - | ENST00000311128 | chr3 | 57665452 | 57665436 | - | TAF |
| 24% | chr20 | 35842163 | 35842268 | + | ENST00000237530; ENST00000373622 | chr20 | 35844460 | 35844765 | + | TAF |
| 24% | chr20 | 35842163 | 35842268 | + | ENST00000237530; ENST00000373622 | chr20 | 35844460 | 35844765 | + | TAF |
| 22% | chr13 | 43659904 | 43659974 | + | ENST00000379221 | chr13 | 43670953 | 43671210 | + | TAF |
| 21% | chr19 | 42222047 | 42222099 | + | ENST00000398599; ENST00000221992; ENST00000405816 | chr19 | 42234250 | 42234353 | + | TSF |
| 21% | chr19 | 42222047 | 42222099 | + | ENST00000398599; ENST00000221992; ENST00000405816 | chr19 | 42234250 | 42234353 | + | TSF |
| 20% | chr11 | 118888255 | 118888078 | - | ENST00000527673 | chr11 | 118861152 | 118861045 | - | TSF |
| 20% | chr6 | 74228333 | 74228077 | - | ENST00000316292; ENST00000309268; ENST00000331523 | chr6 | 74195910 | 74195882 | - | TSF |
| 19% | chr6 | 1960205 | 1960101 | - | ENST00000530927; ENST00000380815 | chr6 | 1955184 | 1955013 | - | TAF |
| 19% | chr6 | 1960205 | 1960101 | - | ENST00000530927; ENST00000380815 | chr6 | 1955184 | 1955013 | - | TAF |
| 18% | chr21 | 45379563 | 45379740 | + | ENST00000291572; ENST00000448287; ENST00000398061; ENST00000327505; ENST00000445582; ENST00000398063; ENST00000398058; ENST00000457068; ENST00000422850; ENST00000546158 | chr21 | 45380513 | 45380695 | + | TAF |
| 17% | chr6 | 35314915 | 35314927 | + | ENST00000448077 | chr6 | 35351354 | 35351915 | + | TAF |
| 17% | chr2 | 24550951 | 24550921 | - | ENST00000361999; ENST00000355123; ENST00000406921; ENST00000412011 | chr2 | 24544749 | 24544681 | - | TAF |
| 17% | chr10 | 22171368 | 22171211 | - | ENST00000376980 | chr10 | 22168812 | 22168560 | - | TAF |
| 17% | chr19 | 16204346; 16204382 | 16204408 | + | ENST00000344824; ENST00000538887; ENST00000300933; ENST00000588032; ENST00000592822 | chr19 | 16213047 | 16213167 | + | TSF |
| 17% | chr19 | 16204346; 16204382 | 16204408 | + | ENST00000344824; ENST00000538887; ENST00000300933; ENST00000588032; ENST00000592822 | chr19 | 16213047 | 16213167 | + | TSF |
| 17% | chr19 | 16204346; 16204382 | 16204408 | + | ENST00000344824; ENST00000538887; ENST00000300933; ENST00000588032; ENST00000592822 | chr19 | 16213047 | 16213167 | + | TSF |
| 17% | chr19 | 16204346; 16204382 | 16204408 | + | ENST00000344824; ENST00000538887; ENST00000300933; ENST00000588032; ENST00000592822 | chr19 | 16213047 | 16213167 | + | TSF |
| 16% | chr12 | 57060050 | 57059988 | - | ENST00000262033; ENST00000414274; ENST00000436399; ENST00000456859 | chr12 | 57059571 | 57059432 | - | TAF |
| 16% | chr12 | 57060050 | 57059988 | - | ENST00000262033; ENST00000414274; ENST00000436399; ENST00000456859 | chr12 | 57059571 | 57059432 | - | TAF |
| 16% | chr12 | 57060050 | 57059988 | - | ENST00000262033; ENST00000414274; ENST00000436399; ENST00000456859 | chr12 | 57059571 | 57059432 | - | TAF |
| 16% | chr12 | 57060050 | 57059988 | - | ENST00000262033; ENST00000414274; ENST00000436399; ENST00000456859 | chr12 | 57059571 | 57059432 | - | TAF |
| 16% | chr10 | 75555297 | 75555421 | + | ENST00000604729; ENST00000603114; ENST00000604524; ENST00000398706; ENST00000605216; ENST00000433366; ENST00000492395; ENST00000603187; ENST00000412198; ENST00000604754 | chr10 | 75556079 | 75556138 | + | TSF |
| 16% | chr10 | 75555297 | 75555421 | + | ENST00000604729; ENST00000603114; ENST00000604524; ENST00000398706; ENST00000605216; ENST00000433366; ENST00000492395; ENST00000603187; ENST00000412198; ENST00000604754 | chr10 | 75556079 | 75556138 | + | TSF |
| 16% | chr10 | 75555297 | 75555421 | + | ENST00000604729; ENST00000603114; ENST00000604524; ENST00000398706; ENST00000605216; ENST00000433366; ENST00000492395; ENST00000603187; ENST00000412198; ENST00000604754 | chr10 | 75556079 | 75556138 | + | TSF |
| 16% | chr10 | 75555297 | 75555421 | + | ENST00000604729; ENST00000603114; | chr10 | 75556079 | 75556138 | + | TSF |

TABLE 57-continued

Transcript fusion for Stomach adenocarcinoma (STAD) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 16% | chr10 | 75555297 | 75555421 | + | ENST00000604524; ENST00000398706; ENST00000605216; ENST00000433366; ENST00000492395; ENST00000603187; ENST00000412198; ENST00000604754 ENST00000604729; ENST00000603114; | chr10 | 75556079 | 75556138 | + | TSF |
| 16% | chr10 | 75555297 | 75555421 | + | ENST00000604524; ENST00000398706; ENST00000605216; ENST00000433366; ENST00000492395; ENST00000603187; ENST00000412198; ENST00000604754 ENST00000604729; ENST00000603114; | chr10 | 75556079 | 75556138 | + | TSF |
| 16% | chr10 | 75555297 | 75555421 | + | ENST00000604524; ENST00000398706; ENST00000605216; ENST00000433366; ENST00000492395; ENST00000603187; ENST00000412198; ENST00000604754 ENST00000604729; ENST00000603114; | chr10 | 75556079 | 75556138 | + | TSF |
| 16% | chr10 | 75555297 | 75555421 | + | ENST00000604524; ENST00000398706; ENST00000605216; ENST00000433366; ENST00000492395; ENST00000603187; ENST00000412198; ENST00000604754 ENST00000604729; ENST00000603114; ENST00000604524; ENST00000398706; ENST00000605216; ENST00000433366; ENST00000492395; ENST00000603187; ENST00000412198; ENST00000604754 | chr10 | 75556079 | 75556138 | + | TSF |
| 15% | chr5 | 147207691 | 147207585 | − | ENST00000296695; ENST00000510027 | chr5 | 147185494 | 147185375 | − | TAF |
| 15% | chr10 | 47747112 | 47747132 | + | ENST00000340243; ENST00000374277; ENST00000449464; ENST00000538825 | chr10 | 48278725 | 48278896 | + | TAF |
| 14% | chr1 | 33272212 | 33272083 | − | ENST00000373477 | chr1 | 33270534 | 33269340 | − | TAF |
| 14% | chr2 | 86769435 | 86769375 | − | ENST00000263856; ENST00000409727; ENST00000439940; ENST00000604011 ENST00000440757 | chr2 | 86768487 | 86767721 | − | TAF |
| 14% | chr2 | 86769435 | 86769375 | − | ENST00000263856; ENST00000409727; ENST00000439940; ENST00000604011; ENST00000440757 | chr2 | 86768487 | 86767721 | − | TAF |
| 14% | chr2 | 86769435 | 86769375 | − | ENST00000263856; ENST00000409727; ENST00000439940; ENST00000604011; ENST00000440757 | chr2 | 86768487 | 86767721 | − | TAF |
| 14% | chr20 | 48273239 | 48273105 | − | ENST00000371711 | chr20 | 48264429 | 48264382 | − | TAF |
| 14% | chr11 | 18536388 | 18536225 | − | ENST00000536719; ENST00000251968 | chr11 | 18534149 | 18533862 | − | TAF |
| 14% | chr8 | 71619168 | 71619388 | + | ENST00000408926; ENST00000520030 | chr8 | 71625661 | 71625673 | + | TSF |
| 13% | chr13 | 44433033 | 44432917 | − | ENST00000444614; ENST00000281508 | chr13 | 44413224 | 44412729 | − | TAF |
| 13% | chr7 | 27582719 | 27582586 | − | ENST00000265395; ENST00000425715 | chr7 | 27581374 | 27579272 | − | TAF |
| 13% | chr7 | 27582719 | 27582586 | − | ENST00000265395; ENST00000425715 | chr7 | 27581374 | 27579272 | − | TAF |
| 13% | chr12 | 71509738 | 71509630 | − | ENST00000549357 | chr12 | 71504233 | 71503634 | − | TAF |
| 13% | chr16 | 68849418 | 68849662 | + | ENST00000261769; ENST00000566612; ENST00000422392 | chr16 | 68851395 | 68851859 | + | TAF |
| 13% | chr16 | 68849418 | 68849662 | + | ENST00000261769; ENST00000566612; ENST00000422392 | chr16 | 68851395 | 68851859 | + | TAF |
| 13% | chr19 | 42222047 | 42222099 | + | ENST00000398599; ENST00000221992; ENST00000405816 | chr19 | 42234246 | 42234353 | + | TSF |
| 13% | chr19 | 42222047 | 42222099 | + | ENST00000398599; ENST00000221992; ENST00000405816 | chr19 | 42234246 | 42234353 | + | TSF |
| 13% | chr4 | 169086398 | 169086477 | + | ENST00000359299 | chr4 | 169090666 | 169090754 | + | TSF |
| 12% | chr2 | 211342488 | 211342490 | + | ENST00000523702; ENST00000430249 | chr2 | 211384275 | 211384452 | + | TAF |
| 12% | chr6 | 2116114 | 2116005 | − | ENST00000530927; ENST00000380815 | chr6 | 2109630 | 2109512 | − | TAF |
| 12% | chr6 | 2116114 | 2116005 | − | ENST00000530927; ENST00000380815 | chr6 | 2109630 | 2109512 | − | TAF |
| 12% | chr3 | 49927493 | 49927357 | − | ENST00000296474; ENST00000344206 | chr3 | 49927248 | 49927204 | − | TAF |
| 12% | chr3 | 49927493 | 49927357 | − | ENST00000296474; ENST00000344206 | chr3 | 49927248 | 49927204 | − | TAF |
| 11% | chr2 | 242275390; 242275258 | 242275513 | + | ENST00000391973; ENST00000428282; ENST00000360051; ENST00000407017; ENST00000391971; ENST00000401990; ENST00000407971; ENST00000436795; ENST00000411484; ENST00000402092; ENST00000443492; ENST00000437066; ENST00000449239; ENST00000457874 | chr2 | 242276200 | 242276228 | + | TAF |
| 11% | chr2 | 242275390; 242275258 | 242275513 | + | ENST00000391973; ENST00000428282; ENST00000360051; ENST00000407017; ENST00000391971; ENST00000401990; ENST00000407971; ENST00000436795; ENST00000411484; ENST00000402092; ENST00000443492; ENST00000437066; ENST00000449239; ENST00000457874 | chr2 | 242276200 | 242276228 | + | TAF |
| 11% | chr2 | 242275390; 242275258 | 242275513 | + | ENST00000391973; ENST00000428282; ENST00000360051; ENST00000407017; ENST00000391971; ENST00000401990; ENST00000407971; ENST00000436795; | chr2 | 242276200 | 242276228 | + | TAF |

TABLE 57-continued

Transcript fusion for Stomach adenocarcinoma (STAD) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 11% | chr2 | 242275390; 242275258 | 242275513 | + | ENST00000411484; ENST00000402092; ENST00000443492; ENST00000437066; ENST00000449239; ENST00000457874 ENST00000391973; ENST00000428282; ENST00000360051; ENST00000407017; ENST00000391971; ENST00000401990; ENST00000407971; ENST00000436795; | chr2 | 242276200 | 242276228 | + | TAF |
| 11% | chr2 | 242275390; 242275258 | 242275513 | + | ENST00000411484; ENST00000402092; ENST00000443492; ENST00000437066; ENST00000449239; ENST00000457874 ENST00000391973; ENST00000428282; ENST00000360051; ENST00000407017; ENST00000391971; ENST00000401990; ENST00000407971; ENST00000436795; ENST00000411484; ENST00000402092; ENST00000443492; ENST00000437066; ENST00000449239; ENST00000457874 | chr2 | 242276200 | 242276228 | + | TAF |
| 11% | chr16 | 2825557; 2825626 | 2825452 | − | ENST00000262306; ENST00000409906; ENST00000409477; ENST00000494946 | chr16 | 2823834 | 2823809 | − | TAF |
| 11% | chr16 | 2825557; 2825626 | 2825452 | − | ENST00000262306; ENST00000409906; ENST00000409477; ENST00000494946 | chr16 | 2823834 | 2823809 | − | TAF |
| 11% | chr16 | 2825557; 2825626 | 2825452 | − | ENST00000262306; ENST00000409906; ENST00000409477; ENST00000494946 | chr16 | 2823834 | 2823809 | − | TAF |
| 11% | chr9 | 99122503 | 99122436 | − | ENST00000253270; ENST00000375259; ENST00000375257 | chr9 | 99115925 | 99115627 | − | TAF |
| 11% | chr1 | 183441756 | 183441784 | + | ENST00000440812; ENST00000444547; ENST00000347615; ENST00000507469; ENST00000515829 | chr1 | 183470266 | 183470283 | + | TSF |
| 11% | chr5 | 10748383 | 10748287 | − | ENST00000230895; ENST00000432074 | chr5 | 10732796 | 10732287 | − | TSF |
| 10% | chr6 | 34210489 | 34210572 | + | ENST00000447654; ENST00000311487; ENST00000347617; ENST00000401473; ENST00000374116 | chr6 | 34212756 | 34212817 | + | TSF |
| 10% | chr6 | 34210489 | 34210572 | + | ENST00000447654; ENST00000311487; ENST00000347617; ENST00000401473; ENST00000374116 | chr6 | 34212756 | 34212817 | + | TSF |
| 10% | chr1 | 20979220 | 20979114 | − | ENST00000602624; ENST00000375048; ENST00000415136 | chr1 | 20978611 | 20978295 | − | TSF |
| 10% | chr1 | 20979220 | 20979114 | − | ENST00000602624; ENST00000375048; ENST00000415136 | chr1 | 20978611 | 20978295 | − | TSF |
| 10% | chr1 | 20979220 | 20979114 | − | ENST00000602624; ENST00000375048; ENST00000415136 | chr1 | 20978611 | 20978295 |  | TSF |
| 10% | chr3 | 185414451 | 185414400 | − | ENST00000382199; ENST00000421047; ENST00000457616; ENST00000346192 | chr3 | 185411016 | 185410789 | − | TSF |
| 10% | chr3 | 185414451 | 185414400 | − | ENST00000382199; ENST00000421047; ENST00000457616; ENST00000346192 | chr3 | 185411016 | 185410789 | − | TSF |
| 10% | chr4 | 25759228 | 25759156 | − | ENST00000399878; ENST00000264868; ENST00000502949; ENST00000510448 | chr4 | 25723603 | 25723555 | − | TSF |
| 10% | chr4 | 25759228 | 25759156 | − | ENST00000399878; ENST00000264868; ENST00000502949; ENST00000510448 | chr4 | 25723603 | 25723555 | − | TSF |
| 10% | chr4 | 25759228 | 25759156 | − | ENST00000399878; ENST00000264868; ENST00000502949; ENST00000510448 | chr4 | 25723603 | 25723555 | − | TSF |
| 10% | chr4 | 25759228 | 25759156 | − | ENST00000399878; ENST00000264868; ENST00000502949; ENST00000510448 | chr4 | 25723603 | 25723555 | − | TSF |
| 10% | chr6 | 29910534 | 29910757 | + | ENST00000396634; ENST00000376806; ENST00000376809; ENST00000376802 | chr6 | 30349606 | 30349643 | + | TSF |
| 10% | chr12 | 113623819 | 113623826 | + | ENST00000552495 | chr12 | 113623998 | 113624117 | + | TSF |
| 10% | chr22 | 25202408 | 25202451 | + | ENST00000400358; ENST00000400359 | chr22 | 25209976 | 25210040 | + | TSF |
| 9% | chr14 | 31922550 | 31922481 | − | ENST00000549185; ENST00000547378; ENST00000310850; ENST00000356180 | chr14 | 31907346 | 31905965 | − | TSF |
| 9% | chr2 | 69173592 | 69173436 | − | ENST00000328895; ENST00000481498 | chr2 | 69171675 | 69168240 | − | TSF |
| 9% | chr1 | 32573732 | 32573735 | + | ENST00000373625; ENST00000471599 | chr1 | 32605356 | 32605563 | + | TSF |
| 8% | chr10 | 6019455 | 6019368 | − | ENST00000379977; ENST00000397251; ENST00000528354; ENST00000397250; ENST00000379971; ENST00000397255; ENST00000530685; ENST00000429135 | chr10 | 6010891 | 6010471 | − | TSF |
| 8% | chr16 | 2825557; 2825626 | 2825452 | − | ENST00000262306; ENST00000409906; ENST00000409477; ENST00000494946 | chr16 | 2823822 | 2823809 | − | TSF |
| 8% | chr16 | 2825557; 2825626 | 2825452 | − | ENST00000262306; ENST00000409906; ENST00000409477; ENST00000494946 | chr16 | 2823822 | 2823809 | − | TSF |
| 8% | chr16 | 2825557; 2825626 | 2825452 | − | ENST00000262306; ENST00000409906; ENST00000409477; ENST00000494946 | chr16 | 2823822 | 2823809 | − | TSF |
| 8% | chr12 | 102547647 | 102547754 | + | ENST00000327680; ENST00000378128; ENST00000541394; ENST00000358383; ENST00000392911; ENST00000412715; ENST00000417507; ENST00000457614 | chr12 | 102548605 | 102548938 | + | TSF |
| 8% | chr12 | 102547647 | 102547754 | + | ENST00000327680; ENST00000378128; | chr12 | 102548605 | 102548938 | + | TSF |

TABLE 57-continued

Transcript fusion for Stomach adenocarcinoma (STAD) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 8% | chr12 | 102547647 | 102547754 | + | ENST00000541394; ENST00000358383; ENST00000392911; ENST00000412715; ENST00000417507; ENST00000457614 ENST00000327680; ENST00000378128; | chr12 | 102548605 | 102548938 | + | TSF |
| 8% | chr12 | 102547647 | 102547754 | + | ENST00000541394; ENST00000358383; ENST00000392911; ENST00000412715; ENST00000417507; ENST00000457614 ENST00000327680; ENST00000378128; | chr12 | 102548605 | 102548938 | + | TSF |
| 8% | chr12 | 102547647 | 102547754 | + | ENST00000541394; ENST00000358383; ENST00000392911; ENST00000412715; ENST00000417507; ENST00000457614 ENST00000327680; ENST00000378128; | chr12 | 102548605 | 102548938 | + | TSF |
| 8% | chr2 | 241555805 | 241555928 | + | ENST00000270364 | chr2 | 241556208 | 241556489 | + | TSF |
| 7% | chr15 | 83102759 | 83103078 | + | ENST00000561062; ENST00000358583 | chr15 | 83193141 | 83193227 | + | TSF |
| 7% | chr12 | 71928895 | 71928966 | + | ENST00000266674; ENST00000536515; ENST00000540815 | chr12 | 71938771 | 71938901 | + | TSF |
| 7% | chr17 | 80656472 | 80656331 | − | ENST00000571995; ENST00000538809 | chr17 | 80634662 | 80634498 | − | TSF |
| 7% | chr16 | 15844188 | 15843995 | − | ENST00000396324; ENST00000452625; ENST00000576790; ENST00000300036 | chr16 | 15797541 | 15797467 | − | TSF |
| 7% | chr16 | 15844188 | 15843995 | − | ENST00000396324; ENST00000452625; ENST00000576790; ENST00000300036 | chr16 | 15797541 | 15797467 | − | TSF |
| 7% | chr19 | 45349783 | 45349870 | + | ENST00000252485; ENST00000252483 | chr19 | 45365316 | 45365390 | + | TSF |
| 7% | chr1 | 6531697 | 6531548 | − | ENST00000400913; ENST00000340850; ENST00000377748; ENST00000377725; ENST00000377728; ENST00000377732; ENST00000400915; ENST00000377740; ENST00000535355; ENST00000377737; ENST00000537245; ENST00000544978 | chr1 | 6531300 | 6531188 | − | TSF |
| 7% | chr1 | 6531697 | 6531548 | − | ENST00000400913; ENST00000340850; ENST00000377748; ENST00000377725; ENST00000377728; ENST00000377732; ENST00000400915; ENST00000377740; ENST00000535355; ENST00000377737; ENST00000537245; ENST00000544978 | chr1 | 6531300 | 6531188 | − | TSF |
| 7% | chr1 | 6531697 | 6531548 | − | ENST00000400913; ENST00000340850; ENST00000377748; ENST00000377725; ENST00000377728; ENST00000377732; ENST00000400915; ENST00000377740; ENST00000535355; ENST00000377737; ENST00000537245; ENST00000544978 | chr1 | 6531300 | 6531188 | − | TSF |
| 7% | chr1 | 6531697 | 6531548 | − | ENST00000400913; ENST00000340850; ENST00000377748; ENST00000377725; ENST00000377728; ENST00000377732; ENST00000400915; ENST00000377740; ENST00000535355; ENST00000377737; ENST00000537245; ENST00000544978 | chr1 | 6531300 | 6531188 | − | TSF |
| 7% | chr1 | 6531697 | 6531548 | − | ENST00000400913; ENST00000340850; ENST00000377748; ENST00000377725; ENST00000377728; ENST00000377732; ENST00000400915; ENST00000377740; ENST00000535355; ENST00000377737; ENST00000537245; ENST00000544978 | chr1 | 6531300 | 6531188 | − | TSF |
| 6% | chr22 | 50639466 | 50640019 | + | ENST00000380903 | chr22 | 50643348 | 50643731 | + | TSF |
| 6% | chr3 | 137906397; 137906427 | 137906441 | + | ENST00000469044; ENST00000461600; ENST00000461822; ENST00000470821; ENST00000471709; ENST00000393058; ENST00000538260; ENST00000463485 | chr3 | 137907243 | 137907252 | + | TSF |
| 6% | chr3 | 137906397; 137906427 | 137906441 | + | ENST00000469044; ENST00000461600; ENST00000461822; ENST00000470821; ENST00000471709; ENST00000393058; ENST00000538260; ENST00000463485 | chr3 | 137907243 | 137907252 | + | TSF |
| 6% | chr7 | 158282477 | 158282427 | − | ENST00000389413; ENST00000409483; ENST00000389418; ENST00000404321 | chr7 | 158229450 | 158229273 | − | TSF |
| 6% | chr7 | 158282477 | 158282427 | − | ENST00000389413; ENST00000409483; ENST00000389418; ENST00000404321 | chr7 | 158229450 | 158229273 | − | TSF |
| 6% | chrX | 14891811 | 14891880 | + | ENST00000380492; ENST00000482354; ENST00000497603 | chrX | 14899985 | 14900209 | + | TSF |

TABLE 57-continued

Transcript fusion for Stomach adenocarcinoma (STAD) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 5% | chr19 | 42222047 | 42222099 | + | ENST00000398599; ENST00000221992; ENST00000405816 | chr19 | 42233309 | 42233421 | + | TSF |
| 5% | chr19 | 42222047 | 42222099 | + | ENST00000398599; ENST00000221992; ENST00000405816 | chr19 | 42233309 | 42233421 | + | TSF |
| 5% | chr6 | 74228333 | 74228077 | − | ENST00000316292; ENST00000309268; ENST00000331523 | chr6 | 74202961 | 74202718 | − | TSF |
| 5% | chr1 | 63955889 | 63955754 | − | ENST00000371092; ENST00000271002; ENST00000489099; ENST00000283568 | chr1 | 63952444 | 63951983 | − | TSF |
| 5% | chr1 | 63955889 | 63955754 | − | ENST00000371092; ENST00000271002; ENST00000489099; ENST00000283568 | chr1 | 63952444 | 63951983 | − | TSF |
| 5% | chr14 | 106208132 | 106207921 | − | ENST00000390548; ENST00000390549; ENST00000390542 | chr14 | 106043673 | 106043390 | − | TSF |
| 5% | chr14 | 106208132 | 106207921 | − | ENST00000390548; ENST00000390549; ENST00000390542 | chr14 | 106043673 | 106043390 | − | TSF |
| 5% | chr8 | 25240190 | 25240294 | + | ENST00000276440 | chr8 | 25246325 | 25246384 | + | TSF |
| 5% | chr12 | 111803370 | 111803368 | − | ENST00000361483 | chr12 | 111803267 | 111803247 | − | TSF |
| 5% | chr20 | 36768056 | 36767968 | − | ENST00000361475; ENST00000536701; ENST00000536724 | chr20 | 36757686 | 36757563 | − | TSF |
| 5% | chr20 | 36768056 | 36767968 | − | ENST00000361475; ENST00000536701; ENST00000536724 | chr20 | 36757686 | 36757563 | − | TSF |
| 5% | chr20 | 36768056 | 36767968 | − | ENST00000361475; ENST00000536701; ENST00000536724 | chr20 | 36757686 | 36757563 | − | TSF |
| 4% | chr7 | 34888095 | 34888275 | + | ENST00000360581; ENST00000381542; ENST00000359791; ENST00000531252; ENST00000381539 | chr7 | 34935732 | 34935887 | + | TSF |
| 4% | chr7 | 34888095 | 34888275 | + | ENST00000360581; ENST00000381542; ENST00000359791; ENST00000531252; ENST00000381539 | chr7 | 34935732 | 34935887 | + | TSF |
| 4% | chr7 | 34888095 | 34888275 | + | ENST00000360581; ENST00000381542; ENST00000359791; ENST00000531252; ENST00000381539 | chr7 | 34935732 | 34935887 | + | TSF |
| 4% | chr20 | 33137782 | 33137833 | + | ENST00000374837 | chr20 | 33138384 | 33138773 | + | TSF |
| 4% | chr8 | 42924698; 42924750 | 42924802 | + | ENST00000534420; ENST00000302279; ENST00000533998; ENST00000342116; ENST00000531266; ENST00000525699; ENST00000529687; ENST00000533336 | chr8 | 42925245 | 42925476 | + | TSF |
| 4% | chr8 | 42924698; 42924750 | 42924802 | + | ENST00000534420; ENST00000302279; ENST00000533998; ENST00000342116; ENST00000531266; ENST00000525699; ENST00000529687; ENST00000533336 | chr8 | 42925245 | 42925476 | + | TSF |
| 4% | chr8 | 42924698; 42924750 | 42924802 | + | ENST00000534420; ENST00000302279; ENST00000533998; ENST00000342116; ENST00000531266; ENST00000525699; ENST00000529687; ENST00000533336 | chr8 | 42925245 | 42925476 | + | TSF |
| 4% | chr8 | 42924698; 42924750 | 42924802 | + | ENST00000534420; ENST00000302279; ENST00000533998; ENST00000342116; ENST00000531266; ENST00000525699; ENST00000529687; ENST00000533336 | chr8 | 42925245 | 42925476 | + | TSF |
| 4% | chr8 | 42924698; 42924750 | 42924802 | + | ENST00000534420; ENST00000302279; ENST00000533998; ENST00000342116; ENST00000531266; ENST00000525699; ENST00000529687; ENST00000533336 | chr8 | 42925245 | 42925476 | + | TSF |
| 4% | chr8 | 42924698; 42924750 | 42924802 | + | ENST00000534420; ENST00000302279; ENST00000533998; ENST00000342116; ENST00000531266; ENST00000525699; ENST00000529687; ENST00000533336 | chr8 | 42925245 | 42925476 | + | TSF |
| 4% | chr20 | 3614958 | 3615036 | + | ENST00000262919 | chr20 | 3615708 | 3616042 | + | TSF |
| 4% | chr7 | 81964567 | 81964451 | − | ENST00000356860; ENST00000356253; ENST00000423588 | chr7 | 81929467 | 81929190 | − | TSF |
| 4% | chr6 | 34386201 | 34386146 | − | ENST00000605528; ENST00000344700; ENST00000326199 | chr6 | 34385704 | 34385695 | − | TSF |
| 4% | chr2 | 176860312; 176860292 | 176860286 | − | ENST00000272748; ENST00000544803; ENST00000392540; ENST00000445472 | chr2 | 176859008 | 176858934 | − | TSF |
| 4% | chr2 | 176860312; 176860292 | 176860286 | − | ENST00000272748; ENST00000544803; ENST00000392540; ENST00000445472 | chr2 | 176859008 | 176858934 | − | TSF |
| 4% | chr1 | 206320201 | 206320319 | + | ENST00000358184; ENST00000361052; ENST00000360218; ENST00000432969 | chr1 | 206324771 | 206325084 | + | TSF |
| 4% | chr1 | 206320201 | 206320319 | + | ENST00000358184; ENST00000361052; ENST00000360218; ENST00000432969 | chr1 | 206324771 | 206325084 | + | TSF |
| 4% | chr18 | 59992586 | 59992660 | + | ENST00000269485; ENST00000586569 | chr18 | 60003547 | 60003575 | + | TSF |
| 4% | chrX | 24091208 | 24091333 | + | ENST00000253039 | chrX | 24091714 | 24091817 | + | TSF |
| 4% | chr12 | 113403549; 113403702 | 113403834 | + | ENST00000228928; ENST00000546973 | chr12 | 113404028 | 113404051 | + | TSF |
| 4% | chr12 | 113403549; 113403702 | 113403834 | + | ENST00000228928; ENST00000546973 | chr12 | 113404028 | 113404051 | + | TSF |
| 4% | chr17 | 79912179 | 79912132 | − | ENST00000409678 | chr17 | 79911834 | 79911647 | − | TSF |

TABLE 57-continued

Transcript fusion for Stomach adenocarcinoma (STAD) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 4% | chr8 | 624047; 623326; 623657 | 623289 | − | ENST00000522706; ENST00000523415; ENST00000262109; ENST00000522893 | chr8 | 622204 | 621954 | − | TSF |
| 4% | chr8 | 624047; 623326; 623657 | 623289 | − | ENST00000522706; ENST00000523415; ENST00000262109; ENST00000522893 | chr8 | 622204 | 621954 | − | TSF |
| 4% | chr8 | 624047; 623326; 623657 | 623289 | − | ENST00000522706; ENST00000523415; ENST00000262109; ENST00000522893 | chr8 | 622204 | 621954 | − | TSF |
| 4% | chr8 | 624047; 623326; 623657 | 623289 | − | ENST00000522706; ENST00000523415; ENST00000262109; ENST00000522893 | chr8 | 622204 | 621954 | − | TSF |
| 4% | chrX | 107320278 | 107320560 | + | ENST00000415430; ENST00000217957 | chrX | 107321756 | 107321847 | + | TSF |
| 4% | chrX | 107320278 | 107320560 | + | ENST00000415430; ENST00000217957 | chrX | 107321756 | 107321847 | + | TSF |
| 4% | chr10 | 90435966 | 90436037 | + | ENST00000394375; ENST00000608620; ENST00000238983; ENST00000355843 | chr10 | 90437871 | 90438023 | + | TSF |
| 4% | chr10 | 90435966 | 90436037 | + | ENST00000394375; ENST00000608620; ENST00000238983; ENST00000355843 | chr10 | 90437871 | 90438023 | + | TSF |
| 4% | chr10 | 90435966 | 90436037 | + | ENST00000394375; ENST00000608620; ENST00000238983; ENST00000355843 | chr10 | 90437871 | 90438023 | + | TSF |
| 4% | chr10 | 90435966 | 90436037 | + | ENST00000394375; ENST00000608620; ENST00000238983; ENST00000355843 | chr10 | 90437871 | 90438023 | + | TSF |
| 4% | chr22 | 36661197; 36661246 | 36661833 | + | ENST00000397278; ENST00000422706; ENST00000426053; ENST00000319136; ENST00000347595; ENST00000397279 | chr22 | 36662881 | 36662970 | + | TSF |
| 4% | chr22 | 36661197; 36661246 | 36661833 | + | ENST00000397278; ENST00000422706; ENST00000426053; ENST00000319136; ENST00000347595; ENST00000397279 | chr22 | 36662881 | 36662970 | + | TSF |
| 4% | chr22 | 36661197; 36661246 | 36661833 | + | ENST00000397278; ENST00000422706; ENST00000426053; ENST00000319136; ENST00000347595; ENST00000397279 | chr22 | 36662881 | 36662970 | + | TSF |
| 4% | chr22 | 36661197; 36661246 | 36661833 | + | ENST00000397278; ENST00000422706; ENST00000426053; ENST00000319136; ENST00000347595; ENST00000397279 | chr22 | 36662881 | 36662970 | + | TSF |
| 4% | chr19 | 53352466; 53352373 | 53352340 | − | ENST00000595646; ENST00000243639; ENST00000597924; ENST00000601847 | chr19 | 53339322 | 53339166 | − | TSF |
| 4% | chr19 | 53352466; 53352373 | 53352340 | − | ENST00000595646; ENST00000243639; ENST00000597924; ENST00000601847 | chr19 | 53339322 | 53339166 | − | TSF |
| 4% | chr17 | 38066177 | 38066009 | − | ENST00000360317; ENST00000394175; ENST00000309481; ENST00000520542; ENST00000394179; ENST00000418519; ENST00000523371; ENST00000524039; ENST00000468820 | chr17 | 38065588 | 38065521 | − | TSF |
| 4% | chr17 | 38066177 | 38066009 | − | ENST00000360317; ENST00000394175; ENST00000309481; ENST00000520542; ENST00000394179; ENST00000418519; ENST00000523371; ENST00000524039; ENST00000468820 | chr17 | 38065588 | 38065521 | − | TSF |
| 4% | chr16 | 72153988; 72154048 | 72153750 | − | ENST00000537465; ENST00000237353; ENST00000355636 | chr16 | 72150929 | 72150229 | − | TSF |
| 4% | chr16 | 72153988; 72154048 | 72153750 | − | ENST00000537465; ENST00000237353; ENST00000355636 | chr16 | 72150929 | 72150229 | − | TSF |
| 4% | chr16 | 72153988; 72154048 | 72153750 | − | ENST00000537465; ENST00000237353; ENST00000355636 | chr16 | 72150929 | 72150229 | − | TSF |
| 4% | chr10 | 48255429 | 48255449 | + | ENST00000357718; ENST00000344416; ENST00000535874; ENST00000456111 | chr10 | 48278725 | 48278896 | + | TSF |
| 4% | chr16 | 50583333 | 50583466 | + | ENST00000268459 | chr16 | 50614862 | 50614981 | + | TSF |
| 4% | chr16 | 50659396 | 50659491 | + | ENST00000268459 | chr16 | 50663933 | 50663990 | + | TSF |
| 4% | chr3 | 32280465 | 32280611 | + | ENST00000458535; ENST00000307526 | chr3 | 32324083 | 32324625 | + | TSF |
| 4% | chr21 | 42540191 | 42540502 | + | ENST00000328735; ENST00000330333; ENST00000347667 | chr21 | 42572645 | 42572848 | + | TSF |
| 4% | chr11 | 22204746 | 22204679 | − | ENST00000374695 | chr1 | 22204032 | 22203987 | − | TSF |
| 4% | chr19 | 15289752 | 15289634 | − | ENST00000263388; ENST00000601011 | chr19 | 15289244 | 15289201 | − | TSF |
| 4% | chr19 | 15289752 | 15289634 | − | ENST00000263388; ENST00000601011 | chr19 | 15289244 | 15289201 | − | TSF |
| 4% | chr7 | 5434226; 5434191 | 5434071 | − | ENST00000399537; ENST00000430969; ENST00000434361; ENST00000399434 | chr7 | 5433863 | 5433797 | − | TSF |
| 4% | chr7 | 5434226; 5434191 | 5434071 | − | ENST00000399537; ENST00000430969; ENST00000434361; ENST00000399434 | chr7 | 5433863 | 5433797 | − | TSF |
| 4% | chr10 | 47173918 | 47173898 | − | ENST00000358140; ENST00000359178; ENST00000545298; ENST00000414655 | chr10 | 47139994 | 47138925 | − | TSF |
| 4% | chr7 | 16900207 | 16900124 | − | ENST00000310398; ENST00000402239; ENST00000414935 | chr7 | 16894536 | 16894260 | − | TSF |
| 4% | chr7 | 16900207 | 16900124 | − | ENST00000310398; ENST00000402239; ENST00000414935 | chr7 | 16894536 | 16894260 | − | TSF |
| 4% | chr1 | 11115983; 11115877 | 11115838 | − | ENST00000376957; ENST00000490101 | chr1 | 11115464 | 11115178 | − | TSF |

TABLE 57-continued

Transcript fusion for Stomach adenocarcinoma (STAD) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 4% | chr1 | 11115983; 11115877 | 11115838 | − | ENST00000376957; ENST00000490101 | chr1 | 11115464 | 15111178 | − | TSF |
| 3% | chr7 | 150065992 | 150066030 | + | ENST00000466559; ENST00000475514; ENST00000488943; ENST00000467980; ENST00000518514; ENST00000522266 | chr7 | 150067849 | 150067901 | + | TSF |
| 3% | chr19 | 49497169 | 49497180 | + | ENST00000595090; ENST00000595811; ENST00000596247; ENST00000221413; ENST00000593570 | chr19 | 49498033 | 49498189 | + | TSF |
| 3% | chr3 | 48716169 | 48715997 | − | ENST00000341520; ENST00000416649; ENST00000294129; ENST00000413374 | chr3 | 48702393 | 48702198 | − | TSF |
| 3% | chr3 | 48716169 | 48715997 | − | ENST00000341520; ENST00000416649; ENST00000294129; ENST00000413374 | chr3 | 48702393 | 48702198 | − | TSF |
| 3% | chr3 | 48716169 | 48715997 | − | ENST00000341520; ENST00000416649; ENST00000294129; ENST00000413374 | chr3 | 48702393 | 48702198 | − | TSF |
| 3% | chr14 | 67878776 | 67878735 | − | ENST00000216446; ENST00000553387 | chr14 | 67864772 | 67864768 | − | TSF |
| 3% | chr20 | 29632611 | 29632721 | + | ENST00000278882; ENST00000358464 | chr20 | 29652086 | 29652324 | + | TSF |
| 3% | chr19 | 42222047 | 42222099 | + | ENST00000398599; ENST00000221992; ENST00000405816 | chr19 | 42233313 | 42233421 | + | TSF |
| 3% | chr19 | 42222047 | 42222099 | + | ENST00000398599; ENST00000221992; ENST00000405816 | chr19 | 42233313 | 42233421 | + | TSF |
| 3% | chr16 | 30783410 | 30783511 | + | ENST00000324685; ENST00000402121; ENST00000563683; ENST00000357890 | chr16 | 30785136 | 30785155 | + | TSF |
| 3% | chr16 | 30783410 | 30783511 | + | ENST00000324685; ENST00000402121; ENST00000563683; ENST00000357890 | chr16 | 30785136 | 30785155 | + | TSF |
| 3% | chr16 | 30783410 | 30783511 | + | ENST00000324685; ENST00000402121; ENST00000563683; ENST00000357890 | chr16 | 30785136 | 30785155 | + | TSF |
| 3% | chr16 | 30783410 | 30783511 | + | ENST00000324685; ENST00000402121; ENST00000563683; ENST00000357890 | chr16 | 30785136 | 30785155 | + | TSF |
| 3% | chr16 | 50642205 | 50642271 | + | ENST00000268459 | chr16 | 50651664 | 50651770 | + | TSF |
| 3% | chr11 | 118888255 | 118888078 | − | ENST00000527673 | chr11 | 118739656 | 118739455 | − | TSF |
| 3% | chr8 | 145001050 | 145000952 | − | ENST00000345136; ENST00000357649; ENST00000354589; ENST00000398774; ENST00000322810; ENST00000354958; ENST00000356346; ENST00000436759; ENST00000527096; ENST00000527303 | chr8 | 144977746 | 144977671 | − | TSF |
| 3% | chr8 | 145001050 | 145000952 | − | ENST00000345136; ENST00000357649; ENST00000354589; ENST00000398774; ENST00000322810; ENST00000354958; ENST00000356346; ENST00000436759; ENST00000527096; ENST00000527303 | chr8 | 144977746 | 144977671 | − | TSF |
| 3% | chr8 | 145001050 | 145000952 | − | ENST00000345136; ENST00000357649; ENST00000354589; ENST00000398774; ENST00000322810; ENST00000354958; ENST00000356346; ENST00000436759; ENST00000527096; ENST00000527303 | chr8 | 144977746 | 144977671 | − | TSF |
| 3% | chr8 | 145001050 | 145000952 | − | ENST00000345136; ENST00000357649; ENST00000354589; ENST00000398774; ENST00000322810; ENST00000354958; ENST00000356346; ENST00000436759; ENST00000527096; ENST00000527303 | chr8 | 144977746 | 144977671 | − | TSF |
| 3% | chr8 | 145001050 | 145000952 | − | ENST00000345136; ENST00000357649; ENST00000354589; ENST00000398774; ENST00000322810; ENST00000354958; ENST00000356346; ENST00000436759; ENST00000527096; ENST00000527303 | chr8 | 144977746 | 144977671 | − | TSF |
| 3% | chr8 | 145001050 | 145000952 | − | ENST00000345136; ENST00000357649; ENST00000354589; ENST00000398774; ENST00000322810; ENST00000354958; ENST00000356346; ENST00000436759; ENST00000527096; ENST00000527303 | chr8 | 144977746 | 144977671 | − | TSF |
| 3% | chr8 | 145001050 | 145000952 | − | ENST00000345136; ENST00000357649; ENST00000354589; ENST00000398774; ENST00000322810; ENST00000354958; ENST00000356346; ENST00000436759; ENST00000527096; ENST00000527303 | chr8 | 144977746 | 144977671 | − | TSF |
| 3% | chr8 | 145001050 | 145000952 | − | ENST00000345136; ENST00000357649; ENST00000354589; ENST00000398774; ENST00000322810; ENST00000354958; ENST00000356346; ENST00000436759; ENST00000527096; ENST00000527303 | chr8 | 144977746 | 144977671 | − | TSF |
| 3% | chr8 | 145001050 | 145000952 | − | ENST00000345136; ENST00000357649; | chr8 | 144977746 | 144977671 | − | TSF |

TABLE 57-continued

Transcript fusion for Stomach adenocarcinoma (STAD) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| | | | | | ENST00000354589; ENST00000398774; ENST00000322810; ENST00000354958; ENST00000356346; ENST00000436759; ENST00000527096; ENST00000527303 | | | | | |
| 3% | chr6 | 30908777 | 30908858 | + | ENST00000462446 | chr6 | 30913176 | 30913422 | + | TSF |
| 3% | chr7 | 55270210 | 55270401 | + | ENST00000455089 | chr7 | 55272949 | 55272949 | + | TSF |
| 3% | chr9 | 133352258 | 133352273 | + | ENST00000352480; ENST00000372394; ENST00000372393 | chr9 | 133421349 | 133421406 | + | TSF |
| 3% | chr1 | 152006276 | 152006124 | − | ENST00000271638 | chr1 | 152005339 | 152005310 | − | TSF |
| 3% | chr14 | 106208559 | 106208462 | − | ENST00000390548; ENST00000390549; ENST00000390542 | chr14 | 106194471 | 106194382 | − | TSF |
| 3% | chr7 | 91771800 | 91771777 | − | ENST00000435873 | chr7 | 91767155 | 91766808 | − | TSF |
| 3% | chr5 | 176830398 | 176830255 | − | ENST00000253496 | chr5 | 176829864 | 176829767 | − | TSF |
| 3% | chr7 | 98741403 | 98741349 | − | ENST00000361368; ENST00000361125 | chr7 | 98680363 | 98679576 | − | TSF |
| 3% | chr14 | 66096210; 66096217 | 66096324 | + | ENST00000360689; ENST00000394586; ENST00000342677; ENST00000557164; ENST00000394585; ENST00000358307 | chr14 | 66099743 | 66101298 | + | TSF |
| 3% | chr14 | 66096210; 66096217 | 66096324 | + | ENST00000360689; ENST00000394586; ENST00000342677; ENST00000557164; ENST00000394585; ENST00000358307 | chr14 | 66099743 | 66101298 | + | TSF |
| 3% | chr14 | 66096210; 66096217 | 66096324 | + | ENST00000360689; ENST00000394586; ENST00000342677; ENST00000557164; ENST00000394585; ENST00000358307 | chr14 | 66099743 | 66101298 | + | TSF |
| 3% | chr10 | 90435966 | 90436037 | + | ENST00000394375; ENST00000608620; ENST00000238983; ENST00000355843 | chr10 | 90437884 | 90438023 | + | TSF |
| 3% | chr10 | 90435966 | 90436037 | + | ENST00000394375; ENST00000608620; ENST00000238983; ENST00000355843 | chr10 | 90437884 | 90438023 | + + | TSF TSF |
| 3% | chr10 | 90435966 | 90436037 | + | ENST00000394375; ENST00000608620; ENST00000238983; ENST00000355843 | chr10 | 90437884 | 90438023 | + | TSF |
| 3% | chr10 | 90435966 | 90436037 | + | ENST00000394375; ENST00000608620; ENST00000238983; ENST00000355843 | chr10 | 90437884 | 90438023 | + | TSF |
| 3% | chr22 | 36661197; 36661246 | 36661580 | + | ENST00000397278; ENST00000422706; ENST00000426053; ENST00000319136; ENST00000347595; ENST00000397279 | chr22 | 36663327 | 36663652 | + | TSF |
| 3% | chr22 | 36661197; 36661246 | 36661580 | + | ENST00000397278; ENST00000422706; ENST00000426053; ENST00000319136; ENST00000347595; ENST00000397279 | chr22 | 36663327 | 36663652 | + | TSF |
| 3% | chr22 | 36661197; 36661246 | 36661580 | + | ENST00000397278; ENST00000422706; ENST00000426053; ENST00000319136; ENST00000347595; ENST00000397279 | chr22 | 36663327 | 36663652 | + | TSF |
| 3% | chr22 | 36661197; 36661246 | 36661580 | + | ENST00000397278; ENST00000422706; ENST00000426053; ENST00000319136; ENST00000347595; ENST00000397279 | chr22 | 36663327 | 36663652 | + | TSF |
| 3% | chr16 | 57115439 | 57115522 | + | ENST00000262510; ENST00000308149; ENST00000539144 | chr16 | 57116257 | 57116272 | + | TSF |
| 3% | chr16 | 57115439 | 57115522 | + | ENST00000262510; ENST00000308149; ENST00000539144 | chr16 | 57116257 | 57116272 | + | TSF |
| 3% | chr1 | 225156461 | 225156576 | + | ENST00000430092; ENST00000400952; ENST00000366849; ENST00000439375 | chr1 | 225157336 | 225158402 | + | TSF |
| 3% | chr1 | 225156461 | 225156576 | + | ENST00000430092; ENST00000400952; ENST00000366849; ENST00000439375 | chr1 | 225157336 | 225158402 | + | TSF |
| 3% | chr5 | 54993786 | 54993674 | − | ENST00000396865; ENST00000539768; ENST00000318672; ENST00000508124; ENST00000511233; ENST00000503891; ENST00000513993; ENST00000505563; ENST00000506624; ENST00000507109 | chr5 | 54993040 | 54992544 | − | TSF |
| 3% | chr17 | 79912179 | 79912132 | − | ENST00000409678 | chr17 | 79911819 | 79911647 | − | TSF |
| 3% | chr11 | 6624732 | 6624634 | − | ENST00000254605; ENST00000534343; ENST00000533907; ENST00000530762 | chr11 | 6614053 | 6614046 | − | TSF |
| 3% | chrX | 119708472 | 119708406 | − | ENST00000404115 | chrX | 119705855 | 119705820 | − | TSF |
| 2% | chr2 | 217366064 | 217366082 | + | ENST00000491306; ENST00000456586 | chr2 | 217393993 | 217394327 | + | TSF |
| 2% | chr2 | 217366064 | 217366082 | + | ENST00000491306; ENST00000456586 | chr2 | 217393993 | 217394327 | + | TSF |
| 2% | chr11 | 61015891; 61015697 | 61016007 | + | ENST00000422676; ENST00000312403; ENST00000451616 | chr11 | 61016877 | 61016985 | + | TSF |
| 2% | chr11 | 61015891; 61015697 | 61016007 | + | ENST00000422676; ENST00000312403; ENST00000451616 | chr11 | 61016877 | 61016985 | + | TSF |
| 2% | chr6 | 84772612 | 84772711 | + | ENST00000257776 | chr6 | 84775517 | 84775723 | + | TSF |
| 2% | chr9 | 100774703 | 100774754 | + | ENST00000339399 | chr9 | 100777715 | 100777715 | + | TSF |
| 2% | chr4 | 39978197 | 39978060 | − | ENST00000303538; ENST00000503396 | chr4 | 39933249 | 39932944 | − | TSF |
| 2% | chr3 | 156262228 | 156262097 | − | ENST00000265044; ENST00000467789; ENST00000476217; ENST00000463503; ENST00000496050 | chr3 | 156246256 | 156246164 | − | TSF |
| 2% | chr3 | 156262228 | 156262097 | − | ENST00000265044; ENST00000467789; ENST00000476217; ENST00000463503; ENST00000496050 | chr3 | 156246256 | 156246164 | − | TSF |
| 2% | chr3 | 156262228 | 156262097 | − | ENST00000265044; ENST00000467789; | chr3 | 156246256 | 156246164 | − | TSF |

TABLE 57-continued

Transcript fusion for Stomach adenocarcinoma (STAD) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| | | | | | ENST00000476217; ENST00000463503; ENST00000496050 | | | | | |
| 2% | chr7 | 74168178 | 74168361 | + | ENST00000324896; ENST00000346152; ENST00000353920; ENST00000416070 | chr7 | 74168612 | 74168748 | + | TSF |
| 2% | chr7 | 74168178 | 74168361 | + | ENST00000324896; ENST00000346152; ENST00000353920; ENST00000416070 | chr7 | 74168612 | 74168748 | + | TSF |
| 2% | chr7 | 74168178 | 74168361 | + | ENST00000324896; ENST00000346152; ENST00000353920; ENST00000416070 | chr7 | 74168612 | 74168748 | + | TSF |
| 2% | chr7 | 74168178 | 74168361 | + | ENST00000324896; ENST00000346152; ENST00000353920; ENST00000416070 | chr7 | 74168612 | 74168748 | + | TSF |
| 2% | chr8 | 63502273 | 63502353 | + | ENST00000523211; ENST00000328472 | chr8 | 63546747 | 63547118 | + | TSF |
| 2% | chr19 | 42265157 | 42265242 | + | ENST00000199764 | chr19 | 42274857 | 42275202 | + | TSF |
| 2% | chr20 | 9382137 | 9382237 | + | ENST00000334005; ENST00000378473; ENST00000278655; ENST00000414679; ENST00000378493; ENST00000378501 | chr20 | 9383648 | 9383757 | + | TSF |
| 2% | chr20 | 62328681 | 62328875 | + | ENST00000369996 | chr20 | 62334477 | 62334522 | + | TSF |
| 2% | chr19 | 42221377; 42221374 | 42221482 | + | ENST00000398599; ENST00000221992; ENST00000405816; ENST00000595113 | chr19 | 42233335 | 42233421 | + | TSF |
| 2% | chr19 | 42221377; 42221374 | 42221482 | + | ENST00000398599; ENST00000221992; ENST00000405816; ENST00000595113 | chr19 | 42233335 | 42233421 | + | TSF |
| 2% | chr19 | 42221377; 42221374 | 42221482 | + | ENST00000398599; ENST00000221992; ENST00000405816; ENST00000595113 | chr19 | 42233335 | 42233421 | + | TSF |
| 2% | chr16 | 50666192 | 50666319 | + | ENST00000268459 | chr16 | 50682755 | 50682972 | + | TSF |
| 2% | chr14 | 24615449 | 24615417 | − | ENST00000216802; ENST00000558273; ENST00000560370 | chr14 | 24615120 | 24615007 | − | TSF |
| 2% | chr2 | 71216946 | 71216879 | − | ENST00000606025; ENST00000272438 | chr2 | 71213852 | 71213417 | − | TSF |
| 2% | chr9 | 130678698 | 130678687 | − | ENST00000335791 | chr9 | 130678527 | 130678449 | − | TSF |
| 2% | chr7 | 74867341 | 74867229 | − | ENST00000426327 | chr7 | 74856485 | 74856184 | − | TSF |
| 2% | chr14 | 106208132 | 106207810 | − | ENST00000390549; ENST00000390542 | chr14 | 106097973 | 106097783 | − | TSF |
| 2% | chr14 | 106208132 | 106207810 | − | ENST00000390549; ENST00000390542 | chr14 | 106097973 | 106097783 | − | TSF |
| 2% | chr20 | 33356389 | 33356267 | − | ENST00000374796; ENST00000359003 | chr20 | 33350617 | 33350460 | − | TSF |
| 2% | chr22 | 42003865 | 42003844 | − | ENST00000263256 | chr22 | 42003633 | 42003499 | − | TSF |
| 2% | chr5 | 149782875 | 149782749 | − | ENST00000518797; ENST00000009530 | chr5 | 149709118 | 149709023 | − | TSF |
| 2% | chr5 | 149782875 | 149782749 | − | ENST00000518797; ENST00000009530 | chr5 | 149709118 | 149709023 | − | TSF |
| 2% | chr15 | 40849571; 40849518 | 40849415 | − | ENST00000560305; ENST00000559153; ENST00000561011; ENST00000559291; ENST00000559911; ENST00000558113; ENST00000358005; ENST00000416810; ENST00000558750; ENST00000558918; ENST00000559103; ENST00000558871 | chr15 | 40813374 | 40812967 | − | TSF |
| 2% | chr15 | 40849571; 40849518 | 40849415 | − | ENST00000560305; ENST00000559153; ENST00000561011; ENST00000559291; ENST00000559911; ENST00000558113; ENST00000358005; ENST00000416810; ENST00000558750; ENST00000558918; ENST00000559103; ENST00000558871 | chr15 | 40813374 | 40812967 | − | TSF |
| 2% | chr15 | 40849571; 40849518 | 40849415 | − | ENST00000560305; ENST00000559153; ENST00000561011; ENST00000559291; ENST00000559911; ENST00000558113; ENST00000358005; ENST00000416810; ENST00000558750; ENST00000558918; ENST00000559103; ENST00000558871 | chr15 | 40813374 | 40812967 | − | TSF |
| 2% | chr4 | 6698620 | 6698734 | + | ENST00000296370 | chr4 | 6720414 | 6720685 | + | TSF |
| 2% | chr11 | 60977314; 60977120 | 60977430 | + | ENST00000325558; ENST00000543349; ENST00000543505; ENST00000543125 | chr11 | 61016877 | 61016985 | + | TSF |
| 2% | chr11 | 60977314; 60977120 | 60977430 | + | ENST00000325558; ENST00000543349; ENST00000543505; ENST00000543125 | chr11 | 61016877 | 61016985 | + | TSF |
| 2% | chr11 | 60977314; 60977120 | 60977430 | + | ENST00000325558; ENST00000543349; ENST00000543505; ENST00000543125 | chr11 | 61016877 | 61016985 | + | TSF |
| 2% | chr7 | 92901947 | 92902045 | + | ENST00000251739; ENST00000305866; ENST00000541136; ENST00000544910; ENST00000458707 | chr7 | 92904706 | 92904974 | + | TSF |
| 2% | chr7 | 92901947 | 92902045 | + | ENST00000251739; ENST00000305866; ENST00000541136; ENST00000544910; ENST00000458707 | chr7 | 92904706 | 92904974 | + | TSF |
| 2% | chr7 | 92901947 | 92902045 | + | ENST00000251739; ENST00000305866; ENST00000541136; ENST00000544910; ENST00000458707 | chr7 | 92904706 | 92904974 | + | TSF |
| 2% | chr7 | 92901947 | 92902045 | + | ENST00000251739; ENST00000305866; ENST00000541136; ENST00000544910; ENST00000458707 | chr7 | 92904706 | 92904974 | + | TSF |
| 2% | chr11 | 60996143; 60995949 | 60996259 | + | ENST00000378149; ENST00000537932 | chr11 | 61016877 | 61016985 | + | TSF |
| 2% | chr11 | 60996143; 60995949 | 60996259 | + | ENST00000378149; ENST00000537932 | chr11 | 61016877 | 61016985 | + | TSF |
| 2% | chr11 | 61015891; | 61016007 | + | ENST00000422676; ENST00000312403; | chr11 | 61016873 | 61016985 | + | TSF |

TABLE 57-continued

Transcript fusion for Stomach adenocarcinoma (STAD) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 2% | chr11 | 61015697 61015891; 61015697 | 61016007 | + | ENST00000451616 ENST00000422676; ENST00000312403; ENST00000451616 | chr11 | 61016873 | 61016985 | + | TSF |
| 2% | chr11 | 60975763 | 60975962 | + | ENST00000325558; ENST00000543349; ENST00000543505 | chr11 | 60977054 | 60977239 | + | TSF |
| 2% | chr11 | 60975763 | 60975962 | + | ENST00000325558; ENST00000543349; ENST00000543505 | chr11 | 60977054 | 60977239 | + | TSF |
| 2% | chr19 | 46498683 | 46498762 | + | ENST00000263284 | chr19 | 46499503 | 46499685 | + | TSF |
| 2% | chr11 | 64088133 | 64088189 | + | ENST00000265462 | chr11 | 64089177 | 64089204 | + | TSF |
| 2% | chr19 | 42223849 | 42223892 | + | ENST00000398599; ENST00000221992; ENST00000405816; ENST00000595403 | chr19 | 42233335 | 42233421 | + | TSF |
| 2% | chr19 | 42223849 | 42223892 | + | ENST00000398599; ENST00000221992; ENST00000405816; ENST00000595403 | chr19 | 42233335 | 42233421 | + | TSF |
| 2% | chr19 | 42223849 | 42223892 | + | ENST00000398599; ENST00000221992; ENST00000405816; ENST00000595403 | chr19 | 42233335 | 42233421 | + | TSF |
| 2% | chr17 | 38451608 | 38451708 | + | ENST00000209728 | chr17 | 38452940 | 38452953 | + | TSF |
| 2% | chrX | 133963256 | 133963312 | + | ENST00000370784; ENST00000370785 | chrX | 133972757 | 133974403 | + | TSF |
| 2% | chr1 | 32696528 | 32696620 | + | ENST00000373586 | chr1 | 32696865 | 32697110 | + | TSF |
| 2% | chr19 | 2151333 | 2151238 | − | ENST00000355272; ENST00000356926; ENST00000350812; ENST00000345016 | chr19 | 2141056 | 2140753 | − | TSF |
| 2% | chr13 | 43566301 | 43566114 | − | ENST00000313640; ENST00000313624; ENST00000398762; ENST00000538562 | chr13 | 43550258 | 43550168 | − | TSF |
| 2% | chr9 | 5164265 | 5164179 | − | ENST00000381641 | chr9 | 4992433 | 4991945 | − | TSF |
| 2% | chr14 | 92251705 | 92251506 | − | ENST00000435962; ENST00000340892; ENST00000360594; ENST00000556018; ENST00000556590 | chr14 | 92250314 | 92250292 | − | TSF |
| 2% | chr14 | 92251705 | 92251506 | − | ENST00000435962; ENST00000340892; ENST00000360594; ENST00000556018; ENST00000556590 | chr14 | 92250314 | 92250292 | − | TSF |
| 2% | chr14 | 92251705 | 92251506 | − | ENST00000435962; ENST00000340892; ENST00000360594; ENST00000556018; ENST00000556590 | chr14 | 92250314 | 92250292 | − | TSF |
| 2% | chr1 | 204183034 | 204183010 | − | ENST00000308302 | chr1 | 204178313 | 204177989 | − | TSF |
| 2% | chr16 | 52580635 | 52580549 | − | ENST00000219746; ENST00000568436 | chr16 | 52507504 | 52507494 | − | TSF |
| 2% | chr2 | 89160434 | 89160398 | − | ENST00000390239 | chr2 | 89129384 | 89129304 | − | TSF |
| 2% | chr2 | 131840219 | 131840150 | − | ENST00000409185; ENST00000389915 | chr2 | 131829827 | 131829686 | − | TSF |
| 2% | chr10 | 128594087 | 128594132 | + | ENST00000280333 | chr10 | 128608404 | 128608409 | + | TSF |
| 2% | chr20 | 3842901 | 3843060 | + | ENST00000416600; ENST00000428216 | chr20 | 3854441 | 3854475 | + | TSF |
| 2% | chr20 | 3842901 | 3843060 | + | ENST00000416600; ENST00000428216 | chr20 | 3854441 | 3854475 | + | TSF |
| 2% | chr3 | 45748376; 45748272 | 45748399 | + | ENST00000455997; ENST00000418611; ENST00000389061; ENST00000445499 | chr3 | 45748934 | 45748953 | + | TSF |
| 2% | chr3 | 45748376; 45748272 | 45748399 | + | ENST00000455997; ENST00000418611; ENST00000389061; ENST00000445499 | chr3 | 45748934 | 45748953 | + | TSF |
| 2% | chr4 | 146617711 | 146617784 | + | ENST00000438731; ENST00000511965 | chr4 | 146620339 | 146620424 | + | TSF |
| 2% | chr4 | 146617711 | 146617784 | + | ENST00000438731; ENST00000511965 | chr4 | 146620339 | 146620424 | + | TSF |
| 2% | chr3 | 50153339 | 50153413 | + | ENST00000347869 | chr3 | 50155909 | 50155909 | + | TSF |
| 2% | chr13 | 52586555 | 52586598 | + | ENST00000523764; ENST00000521508 | chr13 | 52589919 | 52589956 | + | TSF |
| 2% | chr19 | 45323962 | 45324032 | + | ENST00000270233 | chr19 | 45324388 | 45324391 | + | TSF |
| 2% | chr11 | 60975763 | 60975962 | + | ENST00000325558; ENST00000543349; ENST00000543505 | chr11 | 60995883 | 60996068 | + | TSF |
| 2% | chr11 | 60975763 | 60975962 | + | ENST00000325558; ENST00000543349; ENST00000543505 | chr11 | 60995883 | 60996068 | + | TSF |
| 2% | chr1 | 151239649 | 151239815 | + | ENST00000368884; ENST00000368881; ENST00000445776; ENST00000453615 | chr1 | 151245263 | 151245553 | + | TSF |
| 2% | chr1 | 151239649 | 151239815 | + | ENST00000368884; ENST00000368881; ENST00000445776; ENST00000453615 | chr1 | 151245263 | 151245553 | + | TSF |
| 2% | chr1 | 151239649 | 151239815 | + | ENST00000368884; ENST00000368881; ENST00000445776; ENST00000453615 | chr1 | 151245263 | 151245553 | + | TSF |
| 2% | chr1 | 151239649 | 151239815 | + | ENST00000368884; ENST00000368881; ENST00000445776; ENST00000453615 | chr1 | 151245263 | 151245553 | + | TSF |
| 2% | chr19 | 42223849 | 42223957 | + | ENST00000398599; ENST00000221992; ENST00000405816 | chr19 | 42233335 | 42233421 | + | TSF |
| 2% | chr19 | 42223849 | 42223957 | + | ENST00000398599; ENST00000221992; ENST00000405816 | chr19 | 42233335 | 42233421 | + | TSF |
| 2% | chr4 | 57319769 | 57319927 | + | ENST00000514888; ENST00000264221; ENST00000505164; ENST00000399688; ENST00000512576 | chr4 | 57321183 | 57321327 | + | TSF |
| 2% | chr4 | 57319769 | 57319927 | + | ENST00000514888; ENST00000264221; ENST00000505164; ENST00000399688; ENST00000512576 | chr4 | 57321183 | 57321327 | + | TSF |
| 2% | chr4 | 57319769 | 57319927 | + | ENST00000514888; ENST00000264221; ENST00000505164; ENST00000399688; ENST00000512576 | chr4 | 57321183 | 57321327 | + | TSF |
| 2% | chr17 | 80543780; 80544006 | 80544069 | + | ENST00000473637; ENST00000335255; ENST00000575578 | chr17 | 80544168 | 80544444 | + | TSF |
| 2% | chr17 | 80543780; | 80544069 | + | ENST00000473637; ENST00000335255; | chr17 | 80544168 | 80544444 | + | TSF |

TABLE 57-continued

Transcript fusion for Stomach adenocarcinoma (STAD) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|----|----|
|   |   | 80544006 |  |  | ENST00000575578 |  |  |  |  |  |
| 2% | chr7 | 98961166 | 98961256 | + | ENST00000432884; ENST00000262942 | chr7 | 98963096 | 98963255 | + | TSF |
| 2% | chr7 | 98961166 | 98961256 | + | ENST00000432884; ENST00000262942 | chr7 | 98963096 | 98963255 | + | TSF |
| 2% | chr11 | 66949317 | 66949363 | + | ENST00000398645; ENST00000529006 | chr11 | 66953323 | 66953458 | + | TSF |
| 2% | chr11 | 60994592 | 60994791 | + | ENST00000378149; ENST00000422676 | chr11 | 60995883 | 60996068 | + | TSF |
| 2% | chr11 | 16769644 | 16769704 | + | ENST00000228136; ENST00000524439; ENST00000422258; ENST00000528634 | chr11 | 16771716 | 16772764 | + | TSF |
| 2% | chr11 | 16769644 | 16769704 | + | ENST00000228136; ENST00000524439; ENST00000422258; ENST00000528634 | chr11 | 16771716 | 16772764 | + | TSF |
| 2% | chr11 | 16769644 | 16769704 | + | ENST00000228136; ENST00000524439; ENST00000422258; ENST00000528634 | chr11 | 16771716 | 16772764 | + | TSF |
| 2% | chr14 | 54903155 | 54903087 | − | ENST00000395573; ENST00000216416; ENST00000557659; ENST00000557690; ENST00000556113 | chr14 | 54854962 | 54854914 | − | TSF |
| 2% | chr7 | 157903607 | 157903521 | − | ENST00000409483; ENST00000389416; ENST00000389418; ENST00000404321 | chr7 | 157893548 | 157892972 | − | TSF |
| 2% | chr7 | 157903607 | 157903521 | − | ENST00000409483; ENST00000389416; ENST00000389418; ENST00000404321 | chr7 | 157893548 | 157892972 | − | TSF |
| 2% | chr7 | 157903607 | 157903521 | − | ENST00000409483; ENST00000389416; ENST00000389418; ENST00000404321 | chr7 | 157893548 | 157892972 | − | TSF |
| 2% | chr7 | 157903607 | 157903521 | − | ENST00000409483; ENST00000389416; ENST00000389418; ENST00000404321 | chr7 | 157893548 | 157892972 | − | TSF |
| 2% | chr16 | 15813165 | 15813077 | − | ENST00000396324; ENST00000452625; ENST00000576790; ENST00000300036 | chr16 | 15797551 | 15797467 | − | TSF |
| 2% | chr16 | 15813165 | 15813077 | − | ENST00000396324; ENST00000452625; ENST00000576790; ENST00000300036 | chr16 | 15797551 | 15797467 | − | TSF |
| 2% | chr19 | 46088022 | 46087881 | − | ENST00000323060; ENST00000263275 | chr19 | 46085924 | 46085806 | − | TSF |
| 2% | chr1 | 160264383 | 160264318 | − | ENST00000368069; ENST00000241704 | chr1 | 160259468 | 160259379 | − | TSF |
| 2% | chr1 | 160264383 | 160264318 | − | ENST00000368069; ENST00000241704 | chr1 | 160259468 | 160259379 | − | TSF |
| 2% | chr8 | 28707790 | 28707730 | − | ENST00000523303; ENST00000521022; ENST00000416984; ENST00000521777; ENST00000522363; ENST00000523436; ENST00000518510; ENST00000524081; ENST00000520184 | chr8 | 28705226 | 28705209 | − | TSF |
| 2% | chr8 | 28707790 | 28707730 | − | ENST00000523303; ENST00000521022; ENST00000416984; ENST00000521777; ENST00000522363; ENST00000523436; ENST00000518510; ENST00000524081; ENST00000520184 | chr8 | 28705226 | 28705209 | − | TSF |
| 2% | chr8 | 28707790 | 28707730 | − | ENST00000523303; ENST00000521022; ENST00000416984; ENST00000521777; ENST00000522363; ENST00000523436; ENST00000518510; ENST00000524081; ENST00000520184 | chr8 | 28705226 | 28705209 | − | TSF |
| 2% | chr8 | 28707790 | 28707730 | − | ENST00000523303; ENST00000521022; ENST00000416984; ENST00000521777; ENST00000522363; ENST00000523436; ENST00000518510; ENST00000524081; ENST00000520184 | chr8 | 28705226 | 28705209 | − | TSF |
| 2% | chr6 | 105771643 | 105771540 | − | ENST00000369110; ENST00000448705 | chr6 | 105764464 | 105763345 | − | TSF |
| 2% | chr1 | 156721221 | 156721135 | − | ENST00000357325; ENST00000537739 | chr1 | 156716225 | 156716218 | − | TSF |
| 2% | chr14 | 106235896 | 106235574 | − | ENST00000390551 | chr14 | 106216701 | 106216511 | − | TSF |
| 2% | chrX | 41598709 | 41598637 | − | ENST00000421587; ENST00000318588; ENST00000361962; ENST00000378163; ENST00000378158; ENST00000378166; ENST00000442742; ENST00000378154 | chrX | 41557348 | 41557057 | − | TSF |
| 2% | chr6 | 2116114 | 2116005 | − | ENST00000530927; ENST00000380815 | chr6 | 2081017 | 2075510 | − | TSF |
| 2% | chr6 | 2116114 | 2116005 | − | ENST00000530927; ENST00000380815 | chr6 | 2081017 | 2075510 | − | TSF |
| 2% | chr13 | 111315865 | 111315798 | − | ENST00000257347; ENST00000487253; ENST00000537743 | chr13 | 111312615 | 111311877 | − | TSF |
| 2% | chr13 | 111315865 | 111315798 | − | ENST00000257347; ENST00000487253; ENST00000537743 | chr13 | 111312615 | 111311877 | − | TSF |
| 2% | chr13 | 111315865 | 111315798 | − | ENST00000257347; ENST00000487253; ENST00000537743 | chr13 | 111312615 | 111311877 | − | TSF |
| 2% | chr17 | 79912179 | 79912132 | − | ENST00000409678 | chr17 | 79911788 | 79911647 | − | TSF |
| 2% | chr19 | 39294191 | 39294162 | − | ENST00000307751; ENST00000600070 | chr19 | 39289106 | 39287788 | − | TSF |
| 2% | chr19 | 39294191 | 39294162 | − | ENST00000307751; ENST00000600070 | chr19 | 39289106 | 39287788 | − | TSF |
| 2% | chr17 | 48266371 | 48266269 | − | ENST00000225964 | chr17 | 48238174 | 48237883 | − | TSF |

TABLE 58

Transcript fusion for Stomach adenocarcinoma (STAD) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 60% | chr4 | 39699858 | 39699922 | + | chr4 | 39739040 | 39739133 | + | ENST00000261427; ENST00000510934; ENST00000295963; ENST00000445950 | TAF |
| 60% | chr4 | 39699858 | 39699922 | + | chr4 | 39739040 | 39739133 | + | ENST00000261427; ENST00000510934; ENST00000295963; ENST00000445950 | TAF |
| 60% | chr4 | 39699858 | 39699922 | + | chr4 | 39739040 | 39739133 | + | ENST00000261427; ENST00000510934; ENST00000295963; ENST00000445950 | TAF |
| 60% | chr4 | 39699858 | 39699922 | + | chr4 | 39739040 | 39739133 | + | ENST00000261427; ENST00000510934; ENST00000295963; ENST00000445950 | TAF |
| 55% | chr19 | 56187371 | 56187420 | + | chr19 | 56189893 | 56190221 | + | ENST00000411543 | TAF |
| 53% | chr17 | 75318693 | 75318752 | + | chr17 | 75398141 | 75398484; 75398785; 75398497; 75398565 | + | ENST00000589070; ENST00000427177; ENST00000591198; ENST00000329047; ENST00000590294; ENST00000591934; ENST00000423034; ENST00000589140 | TAF |
| 53% | chr17 | 75318693 | 75318752 | + | chr17 | 75398141 | 75398484; 75398785; 75398497; 75398565 | + | ENST00000589070; ENST00000427177; ENST00000591198; ENST00000329047; ENST00000590294; ENST00000591934; ENST00000423034; ENST00000589140 | TAF |
| 53% | chr17 | 75318693 | 75318752 | + | chr17 | 75398141 | 75398484; 75398785; 75398497; 75398565 | + | ENST00000589070; ENST00000427177; ENST00000591198; ENST00000329047; ENST00000590294; ENST00000591934; ENST00000423034; ENST00000589140 | TAF |
| 53% | chr17 | 75318693 | 75318752 | + | chr17 | 75398141 | 75398484; 75398785; 75398497; 75398565 | + | ENST00000589070; ENST00000427177; ENST00000591198; ENST00000329047; ENST00000590294; ENST00000591934; ENST00000423034; ENST00000589140 | TAF |
| 48% | chr17 | 74261446 | 74261484 | + | chr17 | 74261988 | 74262050 | + | ENST00000327490 | TAF |
| 47% | chr21 | 42597177 | 42597622 | + | chr21 | 42598193 | 42598281 | + | ENST00000328735; ENST00000330333; ENST00000347667 | TAF |
| 47% | chr21 | 42597177 | 42597622 | + | chr21 | 42598193 | 42598281 | + | ENST00000328735; ENST00000330333; ENST00000347667 | TAF |
| 47% | chr21 | 42597177 | 42597622 | + | chr21 | 42598193 | 42598281 | + | ENST00000328735; ENST00000330333; ENST00000347667 | TAF |
| 45% | chr5 | 10732874 | 10732658 | − | chr5 | 10683683 | 10683641 | − | ENST00000230895 | TAF |
| 42% | chr7 | 116364854 | 116364901 | + | chr7 | 116371722 | 116371913 | + | ENST00000397752; ENST00000318493; ENST00000436117 | TAF |
| 42% | chr7 | 116364854 | 116364901 | + | chr7 | 116371722 | 116371913 | + | ENST00000397752; ENST00000318493; ENST00000436117 | TAF |
| 42% | chr7 | 116364854 | 116364901 | + | chr7 | 116371722 | 116371913 | + | ENST00000397752; ENST00000318493; ENST00000436117 | TAF |
| 38% | chr3 | 128359904 | 128359849 | − | chr3 | 128356948 | 128356642 | − | ENST00000296255 | TAF |
| 37% | chr3 | 47700203 | 47700048 | − | chr3 | 47680270 | 47680215 | − | ENST00000254480 | TAF |
| 36% | chr11 | 93468219 | 93468129 | − | chr11 | 93467826 | 93467791; 93467814 | − | ENST00000393259; ENST00000527169 | TAF |
| 36% | chr11 | 93468219 | 93468129 | − | chr11 | 93467826 | 93467791; 93467814 | − | ENST00000393259; ENST00000527169 | TAF |
| 34% | chr12 | 123873690 | 123873729 | + | chr12 | 123873980 | 123874101 | + | ENST00000330479; ENST00000402868 | TSF |
| 34% | chr4 | 39585332 | 39585284 | − | chr4 | 39459881 | 39459814 | − | ENST00000295955; ENST00000449470; ENST00000508595; ENST00000503040; ENST00000504470 | TSF |
| 34% | chr4 | 39585332 | 39585284 | − | chr4 | 39459881 | 39459814 | − | ENST00000295955; ENST00000449470; ENST00000508595; ENST00000503040; ENST00000504470 | TSF |
| 34% | chr4 | 39585332 | 39585284 | − | chr4 | 39459881 | 39459814 | − | ENST00000295955; ENST00000449470; ENST00000508595; ENST00000503040; ENST00000504470 | TSF |
| 33% | chr22 | 37419605 | 37419606 | + | chr22 | 37420233 | 37420851 | + | ENST00000397129 | TAF |
| 28% | chr9 | 100872455 | 100872351 | − | chr9 | 100872266 | 100872171 | − | ENST00000375098; ENST00000341469; ENST00000342043 | TAF |
| 27% | chr13 | 43628887 | 43629679 | + | chr13 | 43639822 | 43639873 | + | ENST00000379221 | TAF |
| 27% | chr7 | 56018506 | 56018522 | + | chr7 | 56020872 | 56021011 | + | ENST00000426595 | TSF |
| 26% | chr3 | 185411133 | 185410965 | − | chr3 | 185410550 | 185410487 | − | ENST00000382199; ENST00000421047; ENST00000457616; ENST00000346192 | TAF |
| 26% | chr3 | 185411133 | 185410965 | − | chr3 | 185410550 | 185410487 | − | ENST00000382199; ENST00000421047; ENST00000457616; ENST00000346192 | TAF |
| 25% | chr19 | 1600051 | 1599987 | − | chr19 | 1599559 | 1599439 | − | ENST00000585937; ENST00000591899; ENST00000589880; ENST00000585671 | TAF |
| 23% | chr2 | 24544896 | 24544683 | − | chr2 | 24538093 | 24538001 | − | ENST00000361999; ENST00000355123; ENST00000406921; ENST00000412011 | TAF |
| 23% | chr2 | 24544896 | 24544683 | − | chr2 | 24538093 | 24538001 | − | ENST00000361999; ENST00000355123; ENST00000406921; ENST00000412011 | TAF |
| 23% | chr2 | 24544896 | 24544683 | − | chr2 | 24538093 | 24538001 | − | ENST00000361999; ENST00000355123; ENST00000406921; ENST00000412011 | TAF |
| 23% | chr2 | 24544896 | 24544683 | − | chr2 | 24538093 | 24538001 | − | ENST00000361999; ENST00000355123; ENST00000406921; ENST00000412011 | TAF |
| 23% | chr13 | 98628730 | 98628756 | + | chr13 | 98628947 | 98629040; 98629046 | + | ENST00000460070; ENST00000481455; ENST00000261574; ENST00000493281; | TAF |

TABLE 58-continued

Transcript fusion for Stomach adenocarcinoma (STAD) Coordinates of the fusion sequences for which the donor is the TE.

| 1 | 2' | 3' | 4' | 5' | 6' | 7' | 8' | 9' | 10' | 11' |
|---|----|----|----|----|----|----|----|----|-----|-----|
| | 23% | chr13 | 98628730 | 98628756 | + | chr13 | 98628947 | 98629040; 98629046 | + | ENST00000490369; ENST00000463157; ENST00000489058; ENST00000481689; ENST00000480611; ENST00000485433; ENST00000496368; ENST00000421861 ENST00000460070; ENST00000481455; ENST00000261574; ENST00000493281; | TAF |
| | 23% | chr13 | 98628730 | 98628756 | + | chr13 | 98628947 | 98629040; 98629046 | + | ENST00000490369; ENST00000463157; ENST00000489058; ENST00000481689; ENST00000480611; ENST00000485433; ENST00000496368; ENST00000421861 ENST00000460070; ENST00000481455; ENST00000261574; ENST00000493281; | TAF |
| | 23% | chr13 | 98628730 | 98628756 | + | chr13 | 98628947 | 98629040; 98629046 | + | ENST00000490369; ENST00000463157; ENST00000489058; ENST00000481689; ENST00000480611; ENST00000485433; ENST00000496368; ENST00000421861 ENST00000460070; ENST00000481455; ENST00000261574; ENST00000493281; ENST00000490369; ENST00000463157; ENST00000489058; ENST00000481689; ENST00000480611; ENST00000485433; ENST00000496368; ENST00000421861 | TAF |
| | 23% | chr13 | 98628730 | 98628756 | + | chr13 | 98628947 | 98629040; 98629046 | + | ENST00000460070; ENST00000481455; ENST00000261574; ENST00000493281; ENST00000490369; ENST00000463157; ENST00000489058; ENST00000481689; ENST00000480611; ENST00000485433; ENST00000496368; ENST00000421861 | TAF |
| | 23% | chr13 | 98628730 | 98628756 | + | chr13 | 98628947 | 98629040; 98629046 | + | ENST00000460070; ENST00000481455; ENST00000261574; ENST00000493281; ENST00000490369; ENST00000463157; ENST00000489058; ENST00000481689; ENST00000480611; ENST00000485433; ENST00000496368; ENST00000421861 | TAF |
| | 23% | chr13 | 98628730 | 98628756 | + | chr13 | 98628947 | 98629040; 98629046 | + | ENST00000460070; ENST00000481455; ENST00000261574; ENST00000493281; ENST00000490369; ENST00000463157; ENST00000489058; ENST00000481689; ENST00000480611; ENST00000485433; ENST00000496368; ENST00000421861 | TAF |
| | 23% | chr13 | 98628730 | 98628756 | + | chr13 | 98628947 | 98629040; 98629046 | + | ENST00000460070; ENST00000481455; ENST00000261574; ENST00000493281; ENST00000490369; ENST00000463157; ENST00000489058; ENST00000481689; ENST00000480611; ENST00000485433; ENST00000496368; ENST00000421861 | TAF |
| | 23% | chr13 | 98628730 | 98628756 | + | chr13 | 98628947 | 98629040; 98629046 | + | ENST00000460070; ENST00000481455; ENST00000261574; ENST00000493281; ENST00000490369; ENST00000463157; ENST00000489058; ENST00000481689; ENST00000480611; ENST00000485433; ENST00000496368; ENST00000421861 | TAF |
| | 23% | chr13 | 98628730 | 98628756 | + | chr13 | 98628947 | 98629040; 98629046 | + | ENST00000460070; ENST00000481455; ENST00000261574; ENST00000493281; ENST00000490369; ENST00000463157; ENST00000489058; ENST00000481689; ENST00000480611; ENST00000485433; ENST00000496368; ENST00000421861 | TAF |
| | 23% | chr13 | 98628730 | 98628756 | + | chr13 | 98628947 | 98629040; 98629046 | + | ENST00000460070; ENST00000481455; ENST00000261574; ENST00000493281; ENST00000490369; ENST00000463157; ENST00000489058; ENST00000481689; ENST00000480611; ENST00000485433; ENST00000496368; ENST00000421861 | TAF |
| | 23% | chr13 | 98628730 | 98628756 | + | chr13 | 98628947 | 98629040; 98629046 | + | ENST00000460070; ENST00000481455; ENST00000261574; ENST00000493281; ENST00000490369; ENST00000463157; ENST00000489058; ENST00000481689; ENST00000480611; ENST00000485433; ENST00000496368; ENST00000421861 | TAF |
| | 22% | chr10 | 5826921 | 5825287 | − | chr10 | 5815904 | 5815805 | − | ENST00000380191; ENST00000447751; ENST00000380132; ENST00000380181; ENST00000456041 | TAF |
| | 22% | chr10 | 5826921 | 5825287 | − | chr10 | 5815904 | 5815805 | − | ENST00000380191; ENST00000447751; ENST00000380132; ENST00000380181; ENST00000456041 | TAF |

TABLE 58-continued

Transcript fusion for Stomach adenocarcinoma (STAD) Coordinates of the fusion sequences for which the donor is the TE.

| 1 | 2' | 3' | 4' | 5' | 6' | 7' | 8' | 9' | 10' | 11' |
|---|----|----|----|----|----|----|----|----|-----|-----|
| 22% | chr10 | 5826921 | 5825287 | − | chr10 | 5815904 | 5815805 | − | ENST00000380191; ENST00000447751; ENST00000380132; ENST00000380181; ENST00000456041 | TAF |
| 22% | chr10 | 89682344 | 89682384 | + | chr10 | 89685270 | 89685314 | + | ENST00000371953 | TSF |
| 21% | chr5 | 147210961 | 147210946 | − | chr5 | 147209193 | 147209162 | − | ENST00000296695; ENST00000510027 | TAF |
| 21% | chr5 | 147210961 | 147210946 | − | chr5 | 147209193 | 147209162 | − | ENST00000296695; ENST00000510027 | TAF |
| 20% | chr19 | 16267516 | 16267566 | + | chr19 | 16268020 | 16268208; 16268205; 16268448; 16268139 | + | ENST00000253680; ENST00000397372; ENST00000593154; ENST00000588246; ENST00000593031 | TAF |
| 20% | chr19 | 16267516 | 16267566 | + | chr19 | 16268020 | 16268208; 16268205; 16268448; 16268139 | + | ENST00000253680; ENST00000397372; ENST00000593154; ENST00000588246; ENST00000593031 | TAF |
| 20% | chr19 | 16267516 | 16267566 | + | chr19 | 16268020 | 16268208; 16268205; 16268448; 16268139 | + | ENST00000253680; ENST00000397372; ENST00000593154; ENST00000588246; ENST00000593031 | TAF |
| 20% | chr19 | 16267516 | 16267566 | + | chr19 | 16268020 | 16268208; 16268205; 16268448; 16268139 | + | ENST00000253680; ENST00000397372; ENST00000593154; ENST00000588246; ENST00000593031 | TAF |
| 20% | chr13 | 43659219 | 43659268 | + | chr13 | 43659904 | 43659974 | + | ENST00000379221 | TAF |
| 20% | chr5 | 147206892 | 147206839 | + | chr5 | 147204269 | 147204224 | − | ENST00000296695 | TAF |
| 19% | chr12 | 6602868 | 6602840 | − | chr12 | 6602138 | 6602028 | − | ENST00000229238 | TAF |
| 18% | chr7 | 66386440 | 66386448 | + | chr7 | 66409963 | 66410248; 66410147; 46610019; 66410221; 66410085 | + | ENST00000341567; ENST00000607045; ENST00000433271; ENST00000413593; ENST00000424964; ENST00000418375 | TSF |
| 18% | chr7 | 66386440 | 66386448 | + | chr7 | 66409963 | 66410248; 66410147; 46610019; 66410221; 66410085 | + | ENST00000341567; ENST00000607045; ENST00000433271; ENST00000413593; ENST00000424964; ENST00000418375 | TSF |
| 18% | chr7 | 66386440 | 66386448 | + | chr7 | 66409963 | 66410248; 66410147; 46610019; 66410221; 66410085 | + | ENST00000341567; ENST00000607045; ENST00000433271; ENST00000413593; ENST00000424964; ENST00000418375 | TSF |
| 18% | chr7 | 66386440 | 66386448 | + | chr7 | 66409963 | 66410248; 66410147; 46610019; 66410221; 66410085 | + | ENST00000341567; ENST00000607045; ENST00000433271; ENST00000413593; ENST00000424964; ENST00000418375 | TSF |
| 18% | chr7 | 66386440 | 66386448 | + | chr7 | 66409963 | 66410248; 66410147; 46610019; 66410221; 66410085 | + | ENST00000341567; ENST00000607045; ENST00000433271; ENST00000413593; ENST00000424964; ENST00000418375 | TSF |
| 18% | chr7 | 66386440 | 66386448 | + | chr7 | 66409963 | 66410248; 66410147; 46610019; 66410221; 66410085 | + | ENST00000341567; ENST00000607045; ENST00000433271; ENST00000413593; ENST00000424964; ENST00000418375 | TSF |
| 17% | chr5 | 179238653 | 179238682 | + | chr5 | 179249989 | 179250053 | + | ENST00000389805; ENST00000504627; ENST00000510187 | TAF |
| 17% | chr5 | 179238653 | 179238682 | + | chr5 | 179249989 | 179250053 | + | ENST00000389805; ENST00000504627; ENST00000510187 | TAF |
| 17% | chr5 | 179238653 | 179238682 | + | chr5 | 179249989 | 179250053 | + | ENST00000389805; ENST00000504627; ENST00000510187 | TAF |
| 17% | chr20 | 35844460 | 35844528 | + | chr20 | 35852281 | 35852372 | + | ENST00000237530; ENST00000373622 | TAF |
| 17% | chr20 | 35844460 | 35844528 | + | chr20 | 35852281 | 35852372 | + | ENST00000237530; ENST00000373622 | TAF |
| 17% | chr4 | 38696010 | 38696173 | + | chr4 | 38696367 | 38696527 | + | ENST00000261438 | TAF |
| 17% | chr22 | 45064651 | 45064685 | + | chr22 | 45098372 | 45098488 | + | ENST00000403581; ENST00000336985; ENST00000403696; ENST00000431834; ENST00000361473; ENST00000352766; ENST00000517296 | TAF |
| 17% | chr22 | 45064651 | 45064685 | + | chr22 | 45098372 | 45098488 | + | ENST00000403581; ENST00000336985; ENST00000403696; ENST00000431834; ENST00000361473; ENST00000352766; ENST00000517296 | TAF |
| 17% | chr22 | 45064651 | 45064685 | + | chr22 | 45098372 | 45098488 | + | ENST00000403581; ENST00000336985; ENST00000403696; ENST00000431834; ENST00000361473; ENST00000352766; ENST00000517296 | TAF |

TABLE 58-continued

Transcript fusion for Stomach adenocarcinoma (STAD) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 17% | chr22 | 45064651 | 45064685 | + | chr22 | 45098372 | 45098488 | + | ENST00000403581; ENST00000336985; ENST00000403696; ENST00000431834; ENST00000361473; ENST00000352766; ENST00000517296 | TAF |
| 17% | chr22 | 45064651 | 45064685 | + | chr22 | 45098372 | 45098488 | + | ENST00000403581; ENST00000336985; ENST00000403696; ENST00000431834; ENST00000361473; ENST00000352766; ENST00000517296 | TAF |
| 17% | chr10 | 74501505 | 74501603 | + | chr10 | 74594117 | 74594186; 74594190 | + | ENST00000373053; ENST00000357157; ENST00000536019; ENST00000604152 | TSF |
| 17% | chr10 | 74501505 | 74501603 | + | chr10 | 74594117 | 74594186; 74594190 | + | ENST00000373053; ENST00000357157; ENST00000536019; ENST00000604152 | TSF |
| 17% | chr10 | 74501505 | 74501603 | + | chr10 | 74594117 | 74594186; 74594190 | + | ENST00000373053; ENST00000357157; ENST00000536019; ENST00000604152 | TSF |
| 17% | chr4 | 6592594 | 6592648 | + | chr4 | 6594900 | 6595077; 6595011 | + | ENST00002285599; ENST00000504248; ENST00000505907 | TSF |
| 17% | chr4 | 6592594 | 6592648 | + | chr4 | 6594900 | 6595077; 6595011 | + | ENST00002285599; ENST00000504248; ENST00000505907 | TSF |
| 17% | chr4 | 6592594 | 6592648 | + | chr4 | 6594900 | 6595077; 6595011 | + | ENST00002285599; ENST00000504248; ENST00000505907 | TSF |
| 16% | chr9 | 6248332 | 6248555 | + | chr9 | 6250474 | 6250599 | + | ENST00000456383; ENST00000381434 | TAF |
| 16% | chr9 | 6248332 | 6248555 | + | chr9 | 6250474 | 6250599 | + | ENST00000456383; ENST00000381434 | TAF |
| 16% | chr9 | 135665394 | 135665131 | − | chr9 | 135602921 | 135602841 | − | ENST00000298545 | TAF |
| 16% | chr19 | 49121994 | 49121817 | − | chr19 | 49121134 | 49121048 | − | ENST00000549920; ENST00000547897; ENST00000084795; ENST00000550645; ENST00000549370; ENST00000549273 | TAF |
| 16% | chr19 | 49121994 | 49121817 | − | chr19 | 49121134 | 49121048 | − | ENST00000549920; ENST00000547897; ENST00000084795; ENST00000550645; ENST00000549370; ENST00000549273 | TAF |
| 16% | chr19 | 49121994 | 49121817 | − | chr19 | 49121134 | 49121048 | − | ENST00000549920; ENST00000547897; ENST00000084795; ENST00000550645; ENST00000549370; ENST00000549273 | TAF |
| 16% | chr19 | 49121994 | 49121817 | − | chr19 | 49121134 | 49121048 | − | ENST00000549920; ENST00000547897; ENST00000084795; ENST00000550645; ENST00000549370; ENST00000549273 | TAF |
| 16% | chr19 | 49121994 | 49121817 | − | chr19 | 49121134 | 49121048 | − | ENST00000549920; ENST00000547897; ENST00000084795; ENST00000550645; ENST00000549370; ENST00000549273 | TAF |
| 16% | chr14 | 65406849 | 65406835 | − | chr14 | 65406556 | 65406206 | − | ENST00000389614; ENST00000557049 | TAF |
| 16% | chr1 | 6380703 | 6380649 | − | chr1 | 6378638 | 6378552 | − | ENST00000608083; ENST00000377842; ENST00000377845; ENST00000377855; ENST00000377860; ENST00000418124; ENST00000545482; ENST00000361521; ENST00000473466; ENST00000541130 | TAF |
| 16% | chr1 | 6380703 | 6380649 | − | chr1 | 6378638 | 6378552 | − | ENST00000608083; ENST00000377842; ENST00000377845; ENST00000377855; ENST00000377860; ENST00000418124; ENST00000545482; ENST00000361521; ENST00000473466; ENST00000541130 | TAF |
| 16% | chr1 | 6380703 | 6380649 | − | chr1 | 6378638 | 6378552 | − | ENST00000608083; ENST00000377842; ENST00000377845; ENST00000377855; ENST00000377860; ENST00000418124; ENST00000545482; ENST00000361521; ENST00000473466; ENST00000541130 | TAF |
| 16% | chr1 | 6380703 | 6380649 | − | chr1 | 6378638 | 6378552 | − | ENST00000608083; ENST00000377842; ENST00000377845; ENST00000377855; ENST00000377860; ENST00000418124; ENST00000545482; ENST00000361521; ENST00000473466; ENST00000541130 | TAF |
| 16% | chr1 | 6380703 | 6380649 | − | chr1 | 6378638 | 6378552 | − | ENST00000608083; ENST00000377842; ENST00000377845; ENST00000377855; ENST00000377860; ENST00000418124; ENST00000545482; ENST00000361521; ENST00000473466; ENST00000541130 | TAF |
| 16% | chr16 | 2991578 | 29915910 | + | chr16 | 29916173 | 29916286 | + | ENST00000563177; ENST00000483405; ENST00000308748; ENST00000414952; ENST00000566693 | TAF |
| 16% | chr16 | 2991578 | 29915910 | + | chr16 | 29916173 | 29916286 | + | ENST00000563177; ENST00000483405; ENST00000308748; ENST00000414952; ENST00000566693 | TAF |
| 16% | chr15 | 66170740 | 66170790 | + | chr15 | 66172009 | 66172089; 66172017 | + | ENST00000564910; ENST00000261890; ENST00000569896; ENST00000567671 | TSF |
| 16% | chr15 | 66170740 | 66170790 | + | chr15 | 66172009 | 66172089; 66172017 | + | ENST00000564910; ENST00000261890; ENST00000569896; ENST00000567671 | TSF |
| 16% | chr15 | 66170740 | 66170790 | + | chr15 | 66172009 | 66172089; 66172017 | + | ENST00000564910; ENST00000261890; ENST00000569896; ENST00000567671 | TSF |

TABLE 58-continued

Transcript fusion for Stomach adenocarcinoma (STAD) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 15% | chr16 | 603045 | 603077 | + | chr16 | 603343 | 603516 | + | ENST00000219611 | TAF |
| 15% | chr16 | 603045 | 603138 | + | chr16 | 603343 | 603516 | + | ENST00000219611 | TAF |
| 15% | chr15 | 43889497 | 43889601 | + | chr15 | 43890391 | 43890525 | + | ENST00000300283; ENST00000441322 | TAF |
| 15% | chr22 | 21972574 | 21972670 | + | chr22 | 21975804 | 21975958 | + | ENST00000458578; ENST00000342192; ENST00000545681 | TSF |
| 14% | chr17 | 30771499 | 30771536 | + | chr17 | 30773963 | 30774064 | + | ENST00000261712; ENST00000457654; ENST00000579451 | TAF |
| 14% | chr17 | 30771499 | 30771536 | + | chr17 | 30773963 | 30774064 | + | ENST00000261712; ENST00000457654; ENST00000579451 | TAF |
| 14% | chr13 | 43628887 | 43629679 | + | chr13 | 43643066 | 43643139 | + | ENST00000379221 | TAF |
| 14% | chr7 | 150730019 | 150730148 | + | chr7 | 150730692 | 150730929; 150731004; 150730700 | + | ENST00000461373; ENST00000358849; ENST00000489192; ENST00000297504; ENST00000356058; ENST00000498578; ENST00000477719; ENST00000477092 | TAF |
| 14% | chr7 | 150730019 | 150730148 | + | chr7 | 150730692 | 150730929; 150731004; 150730700 | + | ENST00000461373; ENST00000358849; ENST00000489192; ENST00000297504; ENST00000356058; ENST00000498578; ENST00000477719; ENST00000477092 | TAF |
| 14% | chr7 | 150730019 | 150730148 | + | chr7 | 150730692 | 150730929; 150731004; 150730700 | + | ENST00000461373; ENST00000358849; ENST00000489192; ENST00000297504; ENST00000356058; ENST00000498578; ENST00000477719; ENST00000477092 | TAF |
| 14% | chr7 | 150730019 | 150730148 | + | chr7 | 150730692 | 150730929; 150731004; 150730700 | + | ENST00000461373; ENST00000358849; ENST00000489192; ENST00000297504; ENST00000356058; ENST00000498578; ENST00000477719; ENST00000477092 | TAF |
| 14% | chr7 | 150730019 | 150730148 | + | chr7 | 150730692 | 150730929; 150731004; 150730700 | + | ENST00000461373; ENST00000358849; ENST00000489192; ENST00000297504; ENST00000356058; ENST00000498578; ENST00000477719; ENST00000477092 | TAF |
| 14% | chr7 | 150730019 | 150730148 | + | chr7 | 150730692 | 150730929; 150731004; 150730700 | + | ENST00000461373; ENST00000358849; ENST00000489192; ENST00000297504; ENST00000356058; ENST00000498578; ENST00000477719; ENST00000477092 | TAF |
| 14% | chr7 | 150730019 | 150730148 | + | chr7 | 150730692 | 150730929; 150731004; 150730700 | + | ENST00000461373; ENST00000358849; ENST00000489192; ENST00000297504; ENST00000356058; ENST00000498578; ENST00000477719; ENST00000477092 | TAF |
| 14% | chr10 | 126455800 | 12645579 | − | chr10 | 126454177 | 126453961 | − | ENST00000494792; ENST00000368836 | TAF |
| 14% | chr10 | 126455800 | 12645579 | − | chr10 | 126454177 | 126453961 | − | ENST00000494792; ENST00000368836 | TAF |
| 14% | chr8 | 143751981 | 143751986 | + | chr8 | 143762745 | 143762852; 143762884 | + | ENST00000301258; ENST00000513264 | TAF |
| 14% | chr8 | 143751981 | 143751986 | + | chr8 | 143762745 | 143762852; 143762884 | + | ENST00000301258; ENST00000513264 | TAF |
| 14% | chr17 | 78344149 | 78344187 | + | chr17 | 78345674 | 78345785 | + | ENST00000508628; ENST00000582970; ENST00000336301 | TSF |
| 14% | chr4 | 39933437 | 39933081 | − | chr4 | 39929784 | 39929581 | − | ENST00000303538; ENST00000503396 | TSF |
| 14% | chr4 | 39933437 | 39933081 | − | chr4 | 39929784 | 39929581 | − | ENST00000303538; ENST00000503396 | TSF |
| 14% | chr5 | 64050585 | 64050405 | − | chr5 | 64050189 | 64050142 | − | ENST00000513458 | TSF |
| 13% | chr19 | 42217251 | 42217314 | + | chr19 | 42218890 | 42219168 | + | ENST00000398599; ENST00000221992; ENST00000405816; ENST00000595113 | TAF |
| 13% | chr19 | 42217251 | 42217314 | + | chr19 | 42218890 | 42219168 | + | ENST00000398599; ENST00000221992; ENST00000405816; ENST00000595113 | TAF |
| 13% | chr19 | 42217251 | 42217314 | + | chr19 | 42218890 | 42219168 | + | ENST00000398599; ENST00000221992; ENST00000405816; ENST00000595113 | TAF |
| 13% | chr4 | 73969917 | 73969720 | − | chr4 | 73968264 | 73968093; 73968180 | − | ENST00000358602; ENST00000558247; ENST00000509867; ENST00000330838; ENST00000561029 | TAF |
| 13% | chr4 | 73969917 | 73969720 | − | chr4 | 73968264 | 73968093; 73968180 | − | ENST00000358602; ENST00000558247; ENST00000509867; ENST00000330838; ENST00000561029 | TAF |
| 13% | chr13 | 41835911 | 41835827 | − | chr13 | 41835051 | 41834629 | − | ENST00000430347 | TAF |
| 13% | chr3 | 69286305 | 69286248 | − | chr3 | 69273841 | 69273758; 69273834 | − | ENST00000398540; ENST00000542259; ENST00000493880; ENST00000473029; ENST00000460709 | TAF |
| 13% | chr3 | 69286305 | 69286248 | − | chr3 | 69273841 | 69273758; 69273834 | − | ENST00000398540; ENST00000542259; ENST00000493880; ENST00000473029; ENST00000460709 | TAF |
| 13% | chr3 | 69286305 | 69286248 | − | chr3 | 69273841 | 69273758; 69273834 | − | ENST00000398540; ENST00000542259; ENST00000493880; ENST00000473029; ENST00000460709 | TAF |
| 13% | chr3 | 69286305 | 69286248 | − | chr3 | 69273841 | 69273758; 69273834 | − | ENST00000398540; ENST00000542259; ENST00000493880; ENST00000473029; ENST00000460709 | TAF |
| 13% | chr1 | 44446234 | 44446286 | + | chr1 | 44446781 | 44447145 | + | ENST00000309519 | TSF |
| 13% | chr10 | 90437871 | 90437988 | + | chr10 | 90438202 | 90438438 | + | ENST00000394375; ENST00000608620; | TSF |

TABLE 58-continued

Transcript fusion for Stomach adenocarcinoma (STAD) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 12% | chr9 | 130924283 | 130924301 | + | chr9 | 130925722 | 130925894 | + | ENST00000238983; ENST00000355843 ENST00000372994 | TAF |
| 12% | chr2 | 201253013 | 201253278 | + | chr2 | 201253946 | 201254006 | + | ENST00000409755; ENST00000409151 | TAF |
| 12% | chr12 | 64687157 | 64687061 | − | chr12 | 64679840 | 64679734 | − | ENST00000543942; ENST00000333722 | TAF |
| 12% | chr14 | 65408081 | 65408080 | − | chr14 | 65406556 | 65406206 | − | ENST00000389614; ENST00000557049 | TAF |
| 12% | chr15 | 43989318 | 43989422 | + | chr15 | 43990212 | 43990346 | + | ENST00000434505; ENST00000413453 | TAF |
| 12% | chr19 | 42217251 | 42217314 | + | chr19 | 42223849 | 42224127; 42223947 | + | ENST00000398599; ENST00000221992; ENST00000405816; ENST00000595403 | TAF |
| 12% | chr19 | 42217251 | 42217314 | + | chr19 | 42223849 | 42224127; 42223947 | + | ENST00000398599; ENST00000221992; ENST00000405816; ENST00000595403 | TAF |
| 12% | chr19 | 55559415 | 55559414 | − | chr19 | 55558856 | 55558755 | − | ENST00000415061; ENST00000396247 | TAF |
| 11% | chr21 | 47410358 | 47410419 | + | chr21 | 47410687 | 47410740 | + | ENST00000361866 | TAF |
| 11% | chr5 | 175826144 | 175825958 | − | chr5 | 175825048 | 175824931; 175824945 | − | ENST00000310418; ENST00000345807; ENST00000508425 | TAF |
| 11% | chr5 | 175826144 | 175825958 | − | chr5 | 175825048 | 175824931; 175824945 | − | ENST00000310418; ENST00000345807; ENST00000508425 | TAF |
| 11% | chr5 | 175826144 | 175825958 | − | chr5 | 175825048 | 175824931; 175824945 | − | ENST00000310418; ENST00000345807; ENST00000508425 | TAF |
| 11% | chr20 | 19851935 | 19851939 | + | chr20 | 19870210 | 19870302 | + | ENST00000255006 | TAF |
| 11% | chr12 | 21011867 | 21011909 | + | chr12 | 21013951 | 21014072 | + | ENST00000540853; ENST00000261196; ENST00000381545; ENST00000540229; ENST00000553473 | TAF |
| 11% | chr12 | 21011867 | 21011909 | + | chr12 | 21013951 | 21014072 | + | ENST00000540853; ENST00000261196; ENST00000381545; ENST00000540229; ENST00000553473 | TAF |
| 11% | chr12 | 21011867 | 21011909 | + | chr12 | 21013951 | 21014072 | + | ENST00000540853; ENST00000261196; ENST00000381545; ENST00000540229; ENST00000553473 | TAF |
| 11% | chr2 | 201277501 | 201277593 | + | chr2 | 201281102 | 201281151 | + | ENST00000439084; ENST00000409718; ENST00000358677; ENST00000409988; ENST00000439395; ENST00000451764; ENST00000360760; ENST00000423749; ENST00000457757; ENST00000453663; ENST00000409140; ENST00000409397; ENST00000409755; ENST00000409151; ENST00000421573; ENST00000449647; ENST00000438761 | TAF |
| 11% | chr2 | 201277501 | 201277593 | + | chr2 | 201281102 | 201281151 | + | ENST00000439084; ENST00000409718; ENST00000358677; ENST00000409988; ENST00000439395; ENST00000451764; ENST00000360760; ENST00000423749; ENST00000457757; ENST00000453663; ENST00000409140; ENST00000409397; ENST00000409755; ENST00000409151; ENST00000421573; ENST00000449647; ENST00000438761 | TAF |
| 11% | chr2 | 201277501 | 201277593 | + | chr2 | 201281102 | 201281151 | + | ENST00000439084; ENST00000409718; ENST00000358677; ENST00000409988; ENST00000439395; ENST00000451764; ENST00000360760; ENST00000423749; ENST00000457757; ENST00000453663; ENST00000409140; ENST00000409397; ENST00000409755; ENST00000409151; ENST00000421573; ENST00000449647; ENST00000438761 | TAF |
| 11% | chr2 | 201277501 | 201277593 | + | chr2 | 201281102 | 201281151 | + | ENST00000439084; ENST00000409718; ENST00000358677; ENST00000409988; ENST00000439395; ENST00000451764; ENST00000360760; ENST00000423749; ENST00000457757; ENST00000453663; ENST00000409140; ENST00000409397; ENST00000409755; ENST00000409151; ENST00000421573; ENST00000449647; ENST00000438761 | TAF |
| 11% | chr2 | 201277501 | 201277593 | + | chr2 | 201281102 | 201281151 | + | ENST00000439084; ENST00000409718; ENST00000358677; ENST00000409988; ENST00000439395; ENST00000451764; | TAF |

TABLE 58-continued

Transcript fusion for Stomach adenocarcinoma (STAD) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| | | | | | | | | | ENST00000360760; ENST00000423749; ENST00000457757; ENST00000453663; ENST00000409140; ENST00000409397; ENST00000409755; ENST00000409151; ENST00000421573; ENST00000449647; ENST00000438761 | |
| 11% | chr2 | 201277501 | 201277593 | + | chr2 | 201281102 | 201281151 | + | ENST00000439084; ENST00000409718; ENST00000358677; ENST00000409988; ENST00000439395; ENST00000451764; ENST00000360760; ENST00000423749; ENST00000457757; ENST00000453663; ENST00000409140; ENST00000409397; ENST00000409755; ENST00000409151; ENST00000421573; ENST00000449647; ENST00000438761 | TAF |
| 11% | chr2 | 201277501 | 201277593 | + | chr2 | 201281102 | 201281151 | + | ENST00000439084; ENST00000409718; ENST00000358677; ENST00000409988; ENST00000439395; ENST00000451764; ENST00000360760; ENST00000423749; ENST00000457757; ENST00000453663; ENST00000409140; ENST00000409397; ENST00000409755; ENST00000409151; ENST00000421573; ENST00000449647; ENST00000438761 | TAF |
| 11% | chr2 | 201277501 | 201277593 | + | chr2 | 201281102 | 201281151 | + | ENST00000439084; ENST00000409718; ENST00000358677; ENST00000409988; ENST00000439395; ENST00000451764; ENST00000360760; ENST00000423749; ENST00000457757; ENST00000453663; ENST00000409140; ENST00000409397; ENST00000409755; ENST00000409151; ENST00000421573; ENST00000449647; ENST00000438761 | TAF |
| 11% | chr2 | 201277501 | 201277593 | + | chr2 | 201281102 | 201281151 | + | ENST00000439084; ENST00000409718; ENST00000358677; ENST00000409988; ENST00000439395; ENST00000451764; ENST00000360760; ENST00000423749; ENST00000457757; ENST00000453663; ENST00000409140; ENST00000409397; ENST00000409755; ENST00000409151; ENST00000421573; ENST00000449647; ENST00000438761 | TAF |
| 11% | chr2 | 201277501 | 201277593 | + | chr2 | 201281102 | 201281151 | + | ENST00000439084; ENST00000409718; ENST00000358677; ENST00000409988; ENST00000439395; ENST00000451764; ENST00000360760; ENST00000423749; ENST00000457757; ENST00000453663; ENST00000409140; ENST00000409397; ENST00000409755; ENST00000409151; ENST00000421573; ENST00000449647; ENST00000438761 | TAF |
| 11% | chr3 | 146238022 | 146237953 | − | chr3 | 146234954 | 146234793; 146234876; 146234936; 146234945 | − | ENST00000342435; ENST00000487389; ENST00000448787; ENST00000483300; ENST00000462666; ENST00000486631; ENST00000472349 | TAF |
| 11% | chr3 | 146238022 | 146237953 | − | chr3 | 146234954 | 146234793; 146234876; 146234936; 146234945 | − | ENST00000342435; ENST00000487389; ENST00000448787; ENST00000483300; ENST00000462666; ENST00000486631; ENST00000472349 | TAF |
| 11% | chr3 | 146238022 | 146237953 | − | chr3 | 146234954 | 146234793; 146234876; 146234936; 146234945 | − | ENST00000342435; ENST00000487389; ENST00000448787; ENST00000483300; ENST00000462666; ENST00000486631; ENST00000472349 | TAF |
| 11% | chr3 | 146238022 | 146237953 | − | chr3 | 146234954 | 146234793; 146234876; 146234936; 146234945 | − | ENST00000342435; ENST00000487389; ENST00000448787; ENST00000483300; ENST00000462666; ENST00000486631; ENST00000472349 | TAF |
| 11% | chr3 | 146238022 | 146237953 | − | chr3 | 146234954 | 146234793; 146234876; 146234936; 146234945 | − | ENST00000342435; ENST00000487389; ENST00000448787; ENST00000483300; ENST00000462666; ENST00000486631; ENST00000472349 | TAF |
| 11% | chr17 | 79911953 | 79911734 | − | chr17 | 79911143 | 79910837 | − | ENST00000409678 | TAF |
| 11% | chr14 | 105172936 | 105173038 | + | chr14 | 105173247 | 105173388 | + | ENST00000330634; ENST00000392634 | TSF |
| 11% | chr14 | 105172936 | 105173038 | + | chr14 | 105173247 | 105173388 | + | ENST00000330634; ENST00000392634 | TSF |
| 10% | chr7 | 100850556 | 100850506 | − | chr7 | 100850185 | 100850060 | − | ENST00000454310; ENST00000223127 | TSF |
| 9% | chr20 | 45337040 | 45337192 | + | chr20 | 45353680 | 45354963 | + | ENST00000359271 | TSF |

TABLE 58-continued

Transcript fusion for Stomach adenocarcinoma (STAD) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 9% | chrX | 107293989 | 107294242 | + | chrX | 107301268 | 107301431 | + | ENST00000415430; ENST00000217957; ENST00000458383 | TSF |
| 9% | chrX | 107293989 | 107294242 | + | chrX | 107301268 | 107301431 | + | ENST00000415430; ENST00000217957; ENST00000458383 | TSF |
| 9% | chrX | 107293989 | 107294242 | + | chrX | 107301268 | 107301431 | + | ENST00000415430; ENST00000217957; ENST00000458383 | TSF |
| 9% | chr1 | 19672366 | 19672295 | − | chr1 | 19671746 | 19671681 | − | ENST00000401084; ENST00000264203; ENST00000375144; ENST00000375142; ENST00000433834; ENST00000264202; ENST00000413711 | TSF |
| 9% | chr1 | 19672366 | 19672295 | − | chr1 | 19671746 | 19671681 | − | ENST00000401084; ENST00000264203; ENST00000375144; ENST00000375142; ENST00000433834; ENST00000264202; ENST00000413711 | TSF |
| 9% | chr1 | 19672366 | 19672295 | − | chr1 | 19671746 | 19671681 | − | ENST00000401084; ENST00000264203; ENST00000375144; ENST00000375142; ENST00000433834; ENST00000264202; ENST00000413711 | TSF |
| 9% | chr1 | 19672366 | 19672295 | − | chr1 | 19671746 | 19671681 | − | ENST00000401084; ENST00000264203; ENST00000375144; ENST00000375142; ENST00000433834; ENST00000264202; ENST00000413711 | TSF |
| 9% | chr3 | 132014279 | 132014543 | + | chr3 | 132047111 | 132047206 | + | ENST00000336375; ENST00000495911; ENST00000475741; ENST00000351273 | TSF |
| 9% | chr3 | 132014279 | 132014543 | + | chr3 | 132047111 | 132047206 | + | ENST00000336375; ENST00000495911; ENST00000475741; ENST00000351273 | TSF |
| 9% | chr3 | 132014279 | 132014543 | + | chr3 | 132047111 | 132047206 | + | ENST00000336375; ENST00000495911; ENST00000475741; ENST00000351273 | TSF |
| 9% | chr3 | 132014279 | 132014543 | + | chr3 | 132047111 | 132047206 | + | ENST00000336375; ENST00000495911; ENST00000475741; ENST00000351273 | TSF |
| 9% | chr7 | 7559044 | 7558760 | − | chr7 | 7557468 | 7557427 | − | ENST00000399429; ENST00000444268 | TSF |
| 9% | chr7 | 7559044 | 7558760 | − | chr7 | 7557468 | 7557427 | − | ENST00000399429; ENST00000444268 | TSF |
| 8% | chr17 | 65894489 | 65894534 | + | chr17 | 65899905 | 65900034 | + | ENST00000544778; ENST00000321892; ENST00000335221; ENST00000306378; ENST00000424123 | TSF |
| 8% | chr17 | 65894489 | 65894534 | + | chr17 | 65899905 | 65900034 | + | ENST00000544778; ENST00000321892; ENST00000335221; ENST00000306378; ENST00000424123 | TSF |
| 8% | chr17 | 65894489 | 65894534 | + | chr17 | 65899905 | 65900034 | + | ENST00000544778; ENST00000321892; ENST00000335221; ENST00000306378; ENST00000424123 | TSF |
| 8% | chrX | 47057962 | 47058027 | + | chrX | 47058202 | 47058318 | + | ENST00000377351; ENST00000412206; ENST00000427561; ENST00000442035; ENST00000457753; ENST00000335972; ENST00000451702 | TSF |
| 8% | chrX | 47057962 | 47058027 | + | chrX | 47058202 | 47058318 | + | ENST00000377351; ENST00000412206; ENST00000427561; ENST00000442035; ENST00000457753; ENST00000335972; ENST00000451702 | TSF |
| 8% | chrX | 47057962 | 47058027 | + | chrX | 47058202 | 47058318 | + | ENST00000377351; ENST00000412206; ENST00000427561; ENST00000442035; ENST00000457753; ENST00000335972; ENST00000451702 | TSF |
| 8% | chrX | 47057962 | 47058027 | + | chrX | 47058202 | 47058318 | + | ENST00000377351; ENST00000412206; ENST00000427561; ENST00000442035; ENST00000457753; ENST00000335972; ENST00000451702 | TSF |
| 8% | chrX | 47057962 | 47058027 | + | chrX | 47058202 | 47058318 | + | ENST00000377351; ENST00000412206; ENST00000427561; ENST00000442035; ENST00000457753; ENST00000335972; ENST00000451702 | TSF |
| 8% | chrX | 47057962 | 47058027 | + | chrX | 47058202 | 47058318 | + | ENST00000377351; ENST00000412206; ENST00000427561; ENST00000442035; ENST00000457753; ENST00000335972; ENST00000451702 | TSF |
| 8% | chr1 | 156716197 | 156716133 | − | chr1 | 156715165 | 156715089 | − | ENST00000357325; ENST00000537739; ENST00000368209; ENST00000368206 | TSF |
| 8% | chr11 | 59608573 | 59608450 | − | chr11 | 59604824 | 59604647 | − | ENST00000257248; ENST00000541311 | TSF |
| 8% | chr2 | 232340741 | 232340940 | + | chr2 | 232577177 | 232577226 | + | ENST00000409321; ENST00000409115; ENST00000341369; ENST00000409683; ENST00000410064; ENST00000412128 | TSF |
| 8% | chr17 | 75338773 | 75338959 | + | chr17 | 75398141 | 75398484; 75398785; 75398497; 75398565 | + | ENST00000589070; ENST00000427177; ENST00000591198; ENST00000329047; ENST00000590294; ENST00000591934; ENST00000423034; ENST00000589140 | TSF |
| 8% | chr17 | 75338773 | 75338959 | + | chr17 | 75398141 | 75398484; | + | ENST00000589070; ENST00000427177; | TSF |

TABLE 58-continued

Transcript fusion for Stomach adenocarcinoma (STAD) Coordinates of the fusion sequences for which the donor is the TE.

| 1 | 2' | 3' | 4' | 5' | 6' | 7' | 8' | 9' | 10' | 11' |
|---|----|----|----|----|----|----|----|----|-----|-----|
| 8% | chr17 | 75338773 | 75338959 | + | chr17 | 75398141 | 75398785; 75398497; 75398565 75398484; 75398785; 75398497; 75398565 | + | ENST00000591198; ENST00000329047; ENST00000590294; ENST00000591934; ENST00000423034; ENST00000589140 ENST00000589070; ENST00000427177; ENST00000591198; ENST00000329047; ENST00000590294; ENST00000591934; ENST00000423034; ENST00000589140 | TSF |
| 8% | chr17 | 75338773 | 75338959 | + | chr17 | 75398141 | 75398484; 75398785; 75398497; 75398565 | + | ENST00000589070; ENST00000427177; ENST00000591198; ENST00000329047; ENST00000590294; ENST00000591934; ENST00000423034; ENST00000589140 | TSF |
| 8% | chr11 | 61196480 | 61196370 | − | chr11 | 61189080 | 61188862 | − | ENST00000340437; ENST00000394888; ENST00000439958; ENST00000448745; ENST00000477890; ENST00000539952; ENST00000535222; ENST00000544990; ENST00000544585; ENST00000413232; ENST00000537162; ENST00000543545; ENST00000541963; ENST00000536548; ENST00000450000; ENST00000449811; ENST00000413184; ENST00000536145 | TSF |
| 8% | chr11 | 61196480 | 61196370 | − | chr11 | 61189080 | 61188862 | − | ENST00000340437; ENST00000394888; ENST00000439958; ENST00000448745; ENST00000477890; ENST00000539952; ENST00000535222; ENST00000544990; ENST00000544585; ENST00000413232; ENST00000537162; ENST00000543545; ENST00000541963; ENST00000536548; ENST00000450000; ENST00000449811; ENST00000413184; ENST00000536145 | TSF |
| 8% | chr11 | 61196480 | 61196370 | − | chr11 | 61189080 | 61188862 | − | ENST00000340437; ENST00000394888; ENST00000439958; ENST00000448745; ENST00000477890; ENST00000539952; ENST00000535222; ENST00000544990; ENST00000544585; ENST00000413232; ENST00000537162; ENST00000543545; ENST00000541963; ENST00000536548; ENST00000450000; ENST00000449811; ENST00000413184; ENST00000536145 | TSF |
| 8% | chr11 | 61196480 | 61196370 | − | chr11 | 61189080 | 61188862 | − | ENST00000340437; ENST00000394888; ENST00000439958; ENST00000448745; ENST00000477890; ENST00000539952; ENST00000535222; ENST00000544990; ENST00000544585; ENST00000413232; ENST00000537162; ENST00000543545; ENST00000541963; ENST00000536548; ENST00000450000; ENST00000449811; ENST00000413184; ENST00000536145 | TSF |
| 8% | chr11 | 61196480 | 61196370 | − | chr11 | 61189080 | 61188862 | − | ENST00000340437; ENST00000394888; ENST00000439958; ENST00000448745; ENST00000477890; ENST00000539952; ENST00000535222; ENST00000544990; ENST00000544585; ENST00000413232; ENST00000537162; ENST00000543545; ENST00000541963; ENST00000536548; ENST00000450000; ENST00000449811; ENST00000413184; ENST00000536145 | TSF |
| 8% | chr11 | 61196480 | 61196370 | − | chr11 | 61189080 | 61188862 | − | ENST00000340437; ENST00000394888; ENST00000439958; ENST00000448745; ENST00000477890; ENST00000539952; ENST00000535222; ENST00000544990; ENST00000544585; ENST00000413232; ENST00000537162; ENST00000543545; ENST00000541963; ENST00000536548; ENST00000450000; ENST00000449811; ENST00000413184; ENST00000536145 | TSF |
| 8% | chr11 | 61196480 | 61196370 | − | chr11 | 61189080 | 61188862 | − | ENST00000340437; ENST00000394888; ENST00000439958; ENST00000448745; | TSF |

TABLE 58-continued

Transcript fusion for Stomach adenocarcinoma (STAD) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| | | | | | | | | | ENST00000477890; ENST00000539952; ENST00000535222; ENST00000544990; ENST00000544585; ENST00000413232; ENST00000537162; ENST00000543545; ENST00000541963; ENST00000536548; ENST00000450000; ENST00000449811; ENST00000413184; ENST00000536145 | |
| | 8% | chr11 | 61196480 | 61196370 | − | chr11 | 61189080 | 61188862 | − | ENST00000340437; ENST00000394888; ENST00000439958; ENST00000448745; ENST00000477890; ENST00000539952; ENST00000535222; ENST00000544990; ENST00000544585; ENST00000413232; ENST00000537162; ENST00000543545; ENST00000541963; ENST00000536548; ENST00000450000; ENST00000449811; ENST00000413184; ENST00000536145 | TSF |
| | 8% | chr11 | 61196480 | 61196370 | − | chr11 | 61189080 | 61188862 | − | ENST00000340437; ENST00000394888; ENST00000439958; ENST00000448745; ENST00000477890; ENST00000539952; ENST00000535222; ENST00000544990; ENST00000544585; ENST00000413232; ENST00000537162; ENST00000543545; ENST00000541963; ENST00000536548; ENST00000450000; ENST00000449811; ENST00000413184; ENST00000536145 | TSF |
| | 8% | chr11 | 61196480 | 61196370 | − | chr11 | 61189080 | 61188862 | − | ENST00000340437; ENST00000394888; ENST00000439958; ENST00000448745; ENST00000477890; ENST00000539952; ENST00000535222; ENST00000544990; ENST00000544585; ENST00000413232; ENST00000537162; ENST00000543545; ENST00000541963; ENST00000536548; ENST00000450000; ENST00000449811; ENST00000413184; ENST00000536145 | TSF |
| | 8% | chr11 | 61196480 | 61196370 | − | chr11 | 61189080 | 61188862 | − | ENST00000340437; ENST00000394888; ENST00000439958; ENST00000448745; ENST00000477890; ENST00000539952; ENST00000535222; ENST00000544990; ENST00000544585; ENST00000413232; ENST00000537162; ENST00000543545; ENST00000541963; ENST00000536548; ENST00000450000; ENST00000449811; ENST00000413184; ENST00000536145 | TSF |
| | 8% | chr11 | 61196480 | 61196370 | − | chr11 | 61189080 | 61188862 | − | ENST00000340437; ENST00000394888; ENST00000439958; ENST00000448745; ENST00000477890; ENST00000539952; ENST00000535222; ENST00000544990; ENST00000544585; ENST00000413232; ENST00000537162; ENST00000543545; ENST00000541963; ENST00000536548; ENST00000450000; ENST00000449811; ENST00000413184; ENST00000536145 | TSF |
| | 8% | chr11 | 61196480 | 61196370 | − | chr11 | 61189080 | 61188862 | − | ENST00000340437; ENST00000394888; ENST00000439958; ENST00000448745; ENST00000477890; ENST00000539952; ENST00000535222; ENST00000544990; ENST00000544585; ENST00000413232; ENST00000537162; ENST00000543545; ENST00000541963; ENST00000536548; ENST00000450000; ENST00000449811; ENST00000413184; ENST00000536145 | TSF |
| | 8% | chr11 | 61196480 | 61196370 | − | chr11 | 61189080 | 61188862 | − | ENST00000340437; ENST00000394888; ENST00000439958; ENST00000448745; ENST00000477890; ENST00000539952; ENST00000535222; ENST00000544990; ENST00000544585; ENST00000413232; ENST00000537162; ENST00000543545; ENST00000541963; ENST00000536548; ENST00000450000; ENST00000449811; ENST00000413184; ENST00000536145 | TSF |
| | 7% | chr19 | 2141057 | 2140989 | − | chr19 | 2138713 | 2138618 | − | ENST00000355272; ENST00000356926; ENST00000350812; ENST00000345016 | TSF |
| | 7% | chr19 | 2141057 | 2140989 | − | chr19 | 2138713 | 2138618 | − | ENST00000355272; ENST00000356926; ENST00000350812; ENST00000345016 | TSF |
| | 7% | chr19 | 2141057 | 2140989 | − | chr19 | 2138713 | 2138618 | − | ENST00000355272; ENST00000356926; ENST00000350812; ENST00000345016 | TSF |

TABLE 58-continued

Transcript fusion for Stomach adenocarcinoma (STAD) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 7% | chr19 | 2141057 | 2140989 | – | chr19 | 2138713 | 2138618 | – | ENST00000355272; ENST00000356926; ENST00000350812; ENST00000345016 | TSF |
| 7% | chr9 | 101730308 | 101730438 | + | chr9 | 101747847 | 101748394 | + | ENST0000375001 | TSF |
| 7% | chr17 | 75313396 | 75313709 | + | chr17 | 75398141 | 75398484; 75398785; 75398497; 75398565 | + | ENST00000589070; ENST00000427177; ENST00000591198; ENST00000329047; ENST00000590294; ENST00000591934; ENST00000423034; ENST00000589140 | TSF |
| 7% | chr17 | 75313396 | 75313709 | + | chr17 | 75398141 | 75398484; 75398785; 75398497; 75398565 | + | ENST00000589070; ENST00000427177; ENST00000591198; ENST00000329047; ENST00000590294; ENST00000591934; ENST00000423034; ENST00000589140 | TSF |
| 7% | chr17 | 75313396 | 75313709 | + | chr17 | 75398141 | 75398484; 75398785; 75398497; 75398565 | + | ENST00000589070; ENST00000427177; ENST00000591198; ENST00000329047; ENST00000590294; ENST00000591934; ENST00000423034; ENST00000589140 | TSF |
| 7% | chr17 | 75313396 | 75313709 | + | chr17 | 75398141 | 75398484; 75398785; 75398497; 75398565 | + | ENST00000589070; ENST00000427177; ENST00000591198; ENST00000329047; ENST00000590294; ENST00000591934; ENST00000423034; ENST00000589140 | TSF |
| 7% | chr7 | 100877200 | 100877154 | – | chr7 | 100876195 | 100876114 | – | ENST00000308344; ENST00000401528; ENST00000414035; ENST00000412417 | TSF |
| 7% | chr7 | 100877200 | 100877154 | – | chr7 | 100876195 | 100876114 | – | ENST00000308344; ENST00000401528; ENST00000414035; ENST00000412417 | TSF |
| 7% | chr7 | 100877200 | 100877154 | – | chr7 | 100876195 | 100876114 | – | ENST00000308344; ENST00000401528; ENST00000414035; ENST00000412417 | TSF |
| 7% | chr12 | 6602868 | 6602754 | – | chr12 | 6602138 | 6602028 | – | ENST00000229238 | TSF |
| 7% | chr20 | 48264330 | 48264298 | – | chr20 | 48263615 | 48263502 | – | ENST00000371711 | TSF |
| 7% | chr5 | 59968470 | 59968185 | – | chr5 | 59943360 | 59943225 | – | ENST00000265036; ENST00000453022; ENST00000545085 | TSF |
| 7% | chr5 | 59968470 | 59968185 | – | chr5 | 59943360 | 59943225 | – | ENST00000265036; ENST00000453022; ENST00000545085 | TSF |
| 6% | chr5 | 175697409 | 175697523 | + | chr5 | 175716657 | 175717958 | + | ENST00000443967; ENST00000429602 | TSF |
| 6% | chr5 | 175697409 | 175697523 | + | chr5 | 175716657 | 175717958 | + | ENST00000443967; ENST00000429602 | TSF |
| 6% | chr11 | 46321227 | 46321229 | + | chr11 | 46321486 | 46321714 | + | ENST00000529193; ENST00000288400 | TSF |
| 6% | chr21 | 34902064 | 34901873 | – | chr21 | 34901243 | 34901156 | – | ENST00000381815; ENST00000381831; ENST00000381839; ENST00000424203; ENST00000361093 | TSF |
| 6% | chr21 | 34902064 | 34901873 | – | chr21 | 34901243 | 34901156 | – | ENST00000381815; ENST00000381831; ENST00000381839; ENST00000424203; ENST00000361093 | TSF |
| 6% | chr21 | 34902064 | 34901873 | – | chr21 | 34901243 | 34901156 | – | ENST00000381815; ENST00000381831; ENST00000381839; ENST00000424203; ENST00000361093 | TSF |
| 6% | chr19 | 17384225 | 17384260 | + | chr19 | 17384713 | 17384833; 17384754; 17384789 | + | ENST00000598188; ENST00000594247; ENST00000359435; ENST00000596542; ENST00000599474; ENST00000599057; ENST00000447614; ENST00000601043; ENST00000596335; ENST00000601436; ENST00000601938; ENST00000602066; ENST00000598567 | TSF |
| 6% | chr19 | 17384225 | 17384260 | + | chr19 | 17384713 | 17384833; 17384754; 17384789 | + | ENST00000598188; ENST00000594247; ENST00000359435; ENST00000596542; ENST00000599474; ENST00000599057; ENST00000447614; ENST00000601043; ENST00000596335; ENST00000601436; ENST00000601938; ENST00000602066; ENST00000598567 | TSF |
| 6% | chr19 | 17384225 | 17384260 | + | chr19 | 17384713 | 17384833; 17384754; 17384789 | + | ENST00000598188; ENST00000594247; ENST00000359435; ENST00000596542; ENST00000599474; ENST00000599057; ENST00000447614; ENST00000601043; ENST00000596335; ENST00000601436; ENST00000601938; ENST00000602066; ENST00000598567 | TSF |
| 6% | chr19 | 17384225 | 17384260 | + | chr19 | 17384713 | 17384833; 17384754; 17384789 | + | ENST00000598188; ENST00000594247; ENST00000359435; ENST00000596542; ENST00000599474; ENST00000599057; ENST00000447614; ENST00000601043; ENST00000596335; ENST00000601436; ENST00000601938; ENST00000602066; ENST00000598567 | TSF |
| 6% | chr19 | 17384225 | 17384260 | + | chr19 | 17384713 | 17384833; 17384754; 17384789 | + | ENST00000598188; ENST00000594247; ENST00000359435; ENST00000596542; ENST00000599474; ENST00000599057; ENST00000447614; ENST00000601043; ENST00000596335; ENST00000601436; | TSF |

TABLE 58-continued

Transcript fusion for Stomach adenocarcinoma (STAD) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 6% | chr19 | 17384225 | 17384260 | + | chr19 | 17384713 | 17384833; 17384754; 17384789 | + | ENST00000601938; ENST00000602066; ENST00000598567 ENST00000598188; ENST00000594247; ENST00000359435; ENST00000596542; ENST00000599474; ENST00000599057; ENST00000447614; ENST00000601043; ENST00000596335; ENST00000601436; ENST00000601938; ENST00000602066; ENST00000598567 | TSF |
| 6% | chr19 | 17384225 | 17384260 | + | chr19 | 17384713 | 17384833; 17384754; 17384789 | + | ENST00000598188; ENST00000594247; ENST00000359435; ENST00000596542; ENST00000599474; ENST00000599057; ENST00000447614; ENST00000601043; ENST00000596335; ENST00000601436; ENST00000601938; ENST00000602066; ENST00000598567 | TSF |
| 6% | chr19 | 17384225 | 17384260 | + | chr19 | 17384713 | 17384833; 17384754; 17384789 | + | ENST00000598188; ENST00000594247; ENST00000359435; ENST00000596542; ENST00000599474; ENST00000599057; ENST00000447614; ENST00000601043; ENST00000596335; ENST00000601436; ENST00000601938; ENST00000602066; ENST00000598567 | TSF |
| 6% | chr19 | 17384225 | 17384260 | + | chr19 | 17384713 | 17384833; 17384754; 17384789 | + | ENST00000598188; ENST00000594247; ENST00000359435; ENST00000596542; ENST00000599474; ENST00000599057; ENST00000447614; ENST00000601043; ENST00000596335; ENST00000601436; ENST00000601938; ENST00000602066; ENST00000598567 | TSF |
| 6% | chr19 | 17384225 | 17384260 | + | chr19 | 17384713 | 17384833; 17384754; 17384789 | + | ENST00000598188; ENST00000594247; ENST00000359435; ENST00000596542; ENST00000599474; ENST00000599057; ENST00000447614; ENST00000601043; ENST00000596335; ENST00000601436; ENST00000601938; ENST00000602066; ENST00000598567 | TSF |
| 6% | chr19 | 17384225 | 17384260 | + | chr19 | 17384713 | 17384833; 17384754; 17384789 | + | ENST00000598188; ENST00000594247; ENST00000359435; ENST00000596542; ENST00000599474; ENST00000599057; ENST00000447614; ENST00000601043; ENST00000596335; ENST00000601436; ENST00000601938; ENST00000602066; ENST00000598567 | TSF |
| 6% | chr2 | 232340741 | 232340940 | + | chr2 | 232576646 | 232576693 | + | ENST00000409321; ENST00000409115; ENST00000341369; ENST00000409683; ENST00000410064; ENST00000412128 | TSF |
| 6% | chr2 | 232340741 | 232340940 | + | chr2 | 232576646 | 232576693 | + | ENST00000409321; ENST00000409115; ENST00000341369; ENST00000409683; ENST00000410064; ENST00000412128 | TSF |
| 6% | chr1 | 6366296 | 6365480 | − | chr1 | 6355040 | 6354924 | − | ENST00000608083; ENST00000377842; ENST00000377845; ENST00000377855; ENST00000377860; ENST00000418124; ENST00000545482; ENST00000361521; ENST00000473466 | TSF |
| 6% | chr1 | 6366296 | 6365480 | − | chr1 | 6355040 | 6354924 | − | ENST00000608083; ENST00000377842; ENST00000377845; ENST00000377855; ENST00000377860; ENST00000418124; ENST00000545482; ENST00000361521; ENST00000473466 | TSF |
| 6% | chr1 | 6366296 | 6365480 | − | chr1 | 6355040 | 6354924 | − | ENST00000608083; ENST00000377842; ENST00000377845; ENST00000377855; ENST00000377860; ENST00000418124; ENST00000545482; ENST00000361521; ENST00000473466 | TSF |
| 6% | chr1 | 6366296 | 6365480 | − | chr1 | 6355040 | 6354924 | − | ENST00000608083; ENST00000377842; ENST00000377845; ENST00000377855; ENST00000377860; ENST00000418124; ENST00000545482; ENST00000361521; ENST00000473466 | TSF |
| 6% | chr19 | 45365391 | 45365456 | + | chr19 | 45368528 | 45368917 | + | ENST00000252485; ENST00000252483 | TSF |
| 6% | chr19 | 45365391 | 45365456 | + | Ichr19 | 45368528 | 45368917 | + | ENST00000252485; ENST00000252483 | TSF |
| 6% | chr22 | 37963762 | 37963951 | + | chr22 | 37964115 | 37964827 | + | ENST00000249014 | TSF |
| 6% | chr12 | 50813695 | 50814670 | + | chr12 | 50821545 | 50821692 | + | ENST00000293618; ENST00000429001; ENST00000548174; ENST00000398473; ENST00000522085; ENST00000551886; | TSF |

TABLE 58-continued

Transcript fusion for Stomach adenocarcinoma (STAD) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 6% | chr12 | 50813695 | 50814670 | + | chr12 | 50821545 | 50821692 | + | ENST00000347328 ENST00000293618; ENST00000429001; ENST00000548174; ENST00000398473; ENST00000522085; ENST00000551886; | TSF |
| 6% | chr12 | 50813695 | 50814670 | + | chr12 | 50821545 | 50821692 | + | ENST00000347328 ENST00000293618; ENST00000429001; ENST00000548174; ENST00000398473; ENST00000522085; ENST00000551886; | TSF |
| 6% | chr12 | 50813695 | 50814670 | + | chr12 | 50821545 | 50821692 | + | ENST00000347328 ENST00000293618; ENST00000429001; ENST00000548174; ENST00000398473; ENST00000522085; ENST00000551886; | TSF |
| 6% | chr12 | 50813695 | 50814670 | + | chr12 | 50821545 | 50821692 | + | ENST00000347328 ENST00000293618; ENST00000429001; ENST00000548174; ENST00000398473; ENST00000522085; ENST00000551886; | TSF |
| 6% | chr12 | 50813695 | 50814670 | + | chr12 | 50821545 | 50821692 | + | ENST00000347328 ENST00000293618; ENST00000429001; ENST00000548174; ENST00000398473; ENST00000522085; ENST00000551886; | TSF |
| 6% | chr12 | 50813695 | 50814670 | + | chr12 | 50821545 | 50821692 | + | ENST00000347328 ENST00000293618; ENST00000429001; ENST00000548174; ENST00000398473; ENST00000522085; ENST00000551886; | TSF |
| 6% | chr16 | 16100474 | 16100650 | + | chr16 | 16101673 | 16101849 | + | ENST00000399410; ENST00000345148; ENST00000346370; ENST00000349029; ENST00000351154; ENST00000399408 | TSF |
| 6% | chr16 | 16100474 | 16100650 | + | chr16 | 16101673 | 16101849 | + | ENST00000399410; ENST00000345148; ENST00000346370; ENST00000349029; ENST00000351154; ENST00000399408 | TSF |
| 6% | chr16 | 16100474 | 16100650 | + | chr16 | 16101673 | 16101849 | + | ENST00000399410; ENST00000345148; ENST00000346370; ENST00000349029; ENST00000351154; ENST00000399408 | TSF |
| 6% | chr16 | 16100474 | 16100650 | + | chr16 | 16101673 | 16101849 | + | ENST00000399410; ENST00000345148; ENST00000346370; ENST00000349029; ENST00000351154; ENST00000399408 | TSF |
| 6% | chr16 | 16100474 | 16100650 | + | chr16 | 16101673 | 16101849 | + | ENST00000399410; ENST00000345148; ENST00000346370; ENST00000349029; ENST00000351154; ENST00000399408 | TSF |
| 6% | chr16 | 16100474 | 16100650 | + | chr16 | 16101673 | 16101849 | + | ENST00000399410; ENST00000345148; ENST00000346370; ENST00000349029; ENST00000351154; ENST00000399408 | TSF |
| 6% | chr12 | 133288092 | 133288275 | + | chr12 | 133291444 | 133291498; 133291622 | + | ENST00000537262; ENST00000545677; ENST00000317555; ENST00000498926 | TSF |
| 6% | chr12 | 133288092 | 133288275 | + | chr12 | 133291444 | 133291498; 133291622 | + | ENST00000537262; ENST00000545677; ENST00000317555; ENST00000498926 | TSF |
| 6% | chr12 | 133288092 | 133288275 | + | chr12 | 133291444 | 133291498; 133291622 | + | ENST00000537262; ENST00000545677; ENST00000317555; ENST00000498926 | TSF |
| 6% | chr12 | 133288092 | 133288275 | + | chr12 | 133291444 | 133291498; 133291622 | + | ENST00000537262; ENST00000545677; ENST00000317555; ENST00000498926 | TSF |
| 6% | chr11 | 14589824 | 14589773 | − | chr11 | 14540587 | 14540543 | − | ENST00000419365; ENST00000555531; ENST00000396394; ENST00000396393; ENST00000418988 | TSF |
| 6% | chr11 | 14589824 | 14589773 | − | chr11 | 14540587 | 14540543 | − | ENST00000419365; ENST00000555531; ENST00000396394; ENST00000396393; ENST00000418988 | TSF |
| 5% | chr14 | 93063213 | 93063281 | + | chr14 | 93081752 | 93081824 | + | ENST00000216487 | TSF |
| 5% | chr4 | 124087242 | 124087575 | + | chr4 | 124177171 | 124177335 | + | ENST00000274008 | TSF |
| 5% | chr7 | 5433736 | 5433673 | − | chr7 | 5430259 | 5430116; 5429988 | − | ENST00000399537; ENST00000430969; ENST00000434361; ENST00000399434 | TSF |
| 5% | chr7 | 5433736 | 5433673 | − | chr7 | 5430259 | 5430116; 5429988 | − | ENST00000399537; ENST00000430969; ENST00000434361; ENST00000399434 | TSF |
| 5% | chr7 | 5433736 | 5433673 | − | chr7 | 5430259 | 5430116; 5429988 | − | ENST00000399537; ENST00000430969; ENST00000434361; ENST00000399434 | TSF |
| 5% | chr7 | 5433736 | 5433673 | − | chr7 | 5430259 | 5430116; 5429988 | − | ENST00000399537; ENST00000430969; ENST00000434361; ENST00000399434 | TSF |
| 5% | chr10 | 74623670 | 74624174 | + | chr10 | 74628461 | 74628621; 74628570 | + | ENST00000373053; ENST00000536019; ENST00000604152 | TSF |
| 5% | chr10 | 74623670 | 74624174 | + | chr10 | 74628461 | 74628621; 74628570 | + | ENST00000373053; ENST00000536019; ENST00000604152 | TSF |
| 5% | chr7 | 56020443 | 56020541 | + | chr7 | 56020872 | 56021011 | + | ENST00000426595 | TSF |
| 5% | chr1 | 33270876 | 33270146 | − | chr1 | 33263444 | 33263364 | − | ENST00000373477 | TSF |
| 5% | chr3 | 100461912 | 100462018 | + | chr3 | 100463677 | 100463775 | + | ENST00000418917; ENST00000490574; ENST00000240851; ENST00000476228 | TSF |
| 5% | chr1 | 233789624 | 233790730 | + | chr1 | 233802341 | 233802736 | + | ENST00000366621; ENST00000366620; | TSF |

TABLE 58-continued

Transcript fusion for Stomach adenocarcinoma (STAD) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 5% | chr1 | 233789624 | 233790730 | + | chr1 | 233802341 | 233802736 | + | ENST00000446915 ENST00000366621; ENST00000366620; ENST00000446915 | |
| 5% | chr16 | 56972194 | 56972244 | + | chr16 | 56973149 | 56973271 | + | ENST00000439977; ENST00000300302; ENST00000379792; ENST00000569429; ENST00000563343; ENST00000568358 | TSF |
| 5% | chr16 | 56972194 | 56972244 | + | chr16 | 56973149 | 56973271 | + | ENST00000439977; ENST00000300302; ENST00000379792; ENST00000569429; ENST00000563343; ENST00000568358 | TSF |
| 5% | chr16 | 56972194 | 56972244 | + | chr16 | 56973149 | 56973271 | + | ENST00000439977; ENST00000300302; ENST00000379792; ENST00000569429; ENST00000563343; ENST00000568358 | TSF |
| 5% | chr16 | 56972194 | 56972244 | + | chr16 | 56973149 | 56973271 | + | ENST00000439977; ENST00000300302; ENST00000379792; ENST00000569429; ENST00000563343; ENST00000568358 | TSF |
| 5% | chr19 | 1114930 | 1114676 | − | chr19 | 1114421 | 1114230 | − | ENST00000361757; ENST00000587024; ENST00000438103 | TSF |
| 5% | chr16 | 23606905 | 23606750 | − | chr16 | 23598640 | 23598518 | − | ENST00000007516; ENST00000570319 | TSF |
| 4% | chr10 | 101420120 | 101420239 | + | chr10 | 101421203 | 101421385 | + | ENST00000370489 | TSF |
| 4% | chr17 | 37898260 | 37898291 | + | chr17 | 37898505 | 37898709 | + | ENST00000445327 | TSF |
| 4% | chr12 | 52353922 | 52353971 | + | chr12 | 52369049 | 52369288 | + | ENST00000257963; ENST00000541224; ENST00000426655; ENST00000415850 | TSF |
| 4% | chr12 | 52353922 | 52353971 | + | chr12 | 52369049 | 52369288 | + | ENST00000257963; ENST00000541224; ENST00000426655; ENST00000415850 | TSF |
| 4% | chr12 | 52353922 | 52353971 | + | chr12 | 52369049 | 52369288 | + | ENST00000257963; ENST00000541224; ENST00000426655; ENST00000415850 | TSF |
| 4% | chr12 | 52353922 | 52353971 | + | chr12 | 52369049 | 52369288 | + | ENST00000257963; ENST00000541224; ENST00000426655; ENST00000415850 | TSF |
| 4% | chr5 | 59983652 | 59983552 | − | chr5 | 59983054 | 59982789 | − | ENST00000265036; ENST00000453022 | TSF |
| 4% | chr5 | 59983652 | 59983552 | − | chr5 | 59983054 | 59982789 | − | ENST00000265036; ENST00000453022 | TSF |
| 4% | chr1 | 201354798 | 201354740 | − | chr1 | 201353963 | 201353920 | − | ENST00000503578; ENST00000391967; ENST00000367313 | TSF |
| 4% | chr1 | 201354798 | 201354740 | − | chr1 | 201353963 | 201353920 | − | ENST00000503578; ENST00000391967; ENST00000367313 | TSF |
| 4% | chr1 | 172134550 | 172134843 | + | chr1 | 172222713 | 172222822; 172222718 | + | ENST00000358155; ENST00000355305; ENST00000367731; ENST00000520906; ENST00000523513 | TSF |
| 4% | chr1 | 172134550 | 172134843 | + | chr1 | 172222713 | 172222822; 172222718 | + | ENST00000358155; ENST00000355305; ENST00000367731; ENST00000520906; ENST00000523513 | TSF |
| 4% | chr1 | 172134550 | 172134843 | + | chr1 | 172222713 | 172222822; 172222718 | + | ENST00000358155; ENST00000355305; ENST00000367731; ENST00000520906; ENST00000523513 | TSF |
| 4% | chr1 | 172134550 | 172134843 | + | chr1 | 172222713 | 172222822; 172222718 | + | ENST00000358155; ENST00000355305; ENST00000367731; ENST00000520906; ENST00000523513 | TSF |
| 4% | chr2 | 232340741 | 232340940 | + | chr2 | 232576621 | 232576693 | + | ENST00000409321; ENST00000409115; ENST00000341369; ENST00000409683; ENST00000410064; ENST00000412128 | TSF |
| 4% | chr2 | 232340741 | 232340940 | + | chr2 | 232576621 | 232576693 | + | ENST00000409321; ENST00000409115; ENST00000341369; ENST00000409683; ENST00000410064; ENST00000412128 | TSF |
| 4% | chr10 | 35744377 | 35744391 | + | chr10 | 35772332 | 35772406 | + | ENST00000374704 | TSF |
| 4% | chr17 | 42149044 | 42149179 | + | chr17 | 42151528 | 42151634; 42151597 | + | ENST00000269097; ENST00000591696 | TSF |
| 4% | chr17 | 42149044 | 42149179 | + | chr17 | 42151528 | 42151634; 42151597 | + | ENST00000269097; ENST00000591696 | TSF |
| 4% | chr7 | 33006587 | 33006627 | + | chr7 | 33014229 | 33014374 | + | ENST00000242209; ENST00000538336 | TSF |
| 4% | chr16 | 58758969 | 58758792 | − | chr16 | 58757806 | 58757650 | − | ENST00000245206; ENST00000434819 | TSF |
| 4% | chr16 | 58758969 | 58758792 | − | chr16 | 58757806 | 58757650 | − | ENST00000245206; ENST00000434819 | TSF |
| 4% | chr14 | 51360331 | 51362440 | + | chr14 | 51368547 | 51368629 | + | ENST00000337334; ENST00000353130; ENST00000395752 | TSF |
| 4% | chr17 | 37902588 | 37902638 | + | chr17 | 37903004 | 37903150 | + | ENST00000309156; ENST00000394211; ENST00000445327; ENST00000394209 | TSF |
| 4% | chr12 | 50810162 | 50810217 | + | chr12 | 50821545 | 50821692 | + | ENST00000293618; ENST00000429001; ENST00000548174; ENST00000398473; ENST00000522085; ENST00000551886; ENST00000347328 | TSF |
| 4% | chr12 | 50810162 | 50810217 | + | chr12 | 50821545 | 50821692 | + | ENST00000293618; ENST00000429001; ENST00000548174; ENST00000398473; ENST00000522085; ENST00000551886; ENST00000347328 | TSF |
| 4% | chr12 | 50810162 | 50810217 | + | chr12 | 50821545 | 50821692 | + | ENST00000293618; ENST00000429001; ENST00000548174; ENST00000398473; ENST00000522085; ENST00000551886; ENST00000347328 | TSF |

TABLE 58-continued

Transcript fusion for Stomach adenocarcinoma (STAD) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 4% | chr12 | 50810162 | 50810217 | + | chr12 | 50821545 | 50821692 | + | ENST00000293618; ENST00000429001; ENST00000548174; ENST00000398473; ENST00000522085; ENST00000551886; ENST00000347328 | TSF |
| 4% | chr12 | 50810162 | 50810217 | + | chr12 | 50821545 | 50821692 | + | ENST00000293618; ENST00000429001; ENST00000548174; ENST00000398473; ENST00000522085; ENST00000551886; ENST00000347328 | TSF |
| 4% | chr12 | 50810162 | 50810217 | + | chr12 | 50821545 | 50821692 | + | ENST00000293618; ENST00000429001; ENST00000548174; ENST00000398473; ENST00000522085; ENST00000551886; ENST00000347328 | TSF |
| 4% | chr12 | 50810162 | 50810217 | + | chr12 | 50821545 | 50821692 | + | ENST00000293618; ENST00000429001; ENST00000548174; ENST00000398473; ENST00000522085; ENST00000551886; ENST00000347328 | TSF |
| 4% | chr20 | 34710617 | 34710669 | + | chr20 | 34761806 | 34761876 | + | ENST00000406771; ENST00000452261; ENST00000447825; ENST00000427533; ENST00000338074; ENST00000373941 | TSF |
| 4% | chr20 | 34710617 | 34710669 | + | chr20 | 34761806 | 34761876 | + | ENST00000406771; ENST00000452261; ENST00000447825; ENST00000427533; ENST00000338074; ENST00000373941 | TSF |
| 4% | chr20 | 34710617 | 34710669 | + | chr20 | 34761806 | 34761876 | + | ENST00000406771; ENST00000452261; ENST00000447825; ENST00000427533; ENST00000338074; ENST00000373941 | TSF |
| 4% | chr20 | 34710617 | 34710669 | + | chr20 | 34761806 | 34761876 | + | ENST00000406771; ENST00000452261; ENST00000447825; ENST00000427533; ENST00000338074; ENST00000373941 | TSF |
| 4% | chr20 | 34710617 | 34710669 | + | chr20 | 34761806 | 34761876 | + | ENST00000406771; ENST00000452261; ENST00000447825; ENST00000427533; ENST00000338074; ENST00000373941 | TSF |
| 4% | chr20 | 34710617 | 34710669 | + | chr20 | 34761806 | 34761876 | + | ENST00000406771; ENST00000452261; ENST00000447825; ENST00000427533; ENST00000338074; ENST00000373941 | TSF |
| 4% | chr7 | 100878007 | 100877907 | − | chr7 | 100877723 | 100877559 | − | ENST00000308344; ENST00000401528; ENST00000433833 | TSF |
| 4% | chr7 | 100878007 | 100877907 | − | chr7 | 100877723 | 100877559 | − | ENST00000308344; ENST00000401528; ENST00000433833 | TSF |
| 4% | chr11 | 14589824 | 14589820 | − | chr11 | 14540587 | 14540543 | − | ENST00000419365; ENST00000555531; ENST00000396394; ENST00000396393; ENST00000418988 | TSF |
| 4% | chr11 | 14589824 | 14589820 | − | chr11 | 14540587 | 14540543 | − | ENST00000419365; ENST00000555531; ENST00000396394; ENST00000396393; ENST00000418988 | TSF |
| 4% | chr6 | 17994733 | 17994671 | − | chr6 | 17987375 | 17987285 | − | ENST00000378814; ENST00000259711; ENST00000378843; ENST00000378826; ENST00000378816; ENST00000502704 | TSF |
| 4% | chr6 | 17994733 | 17994671 | − | chr6 | 17987375 | 17987285 | − | ENST00000378814; ENST00000259711; ENST00000378843; ENST00000378826; ENST00000378816; ENST00000502704 | TSF |
| 4% | chr6 | 17994733 | 17994671 | − | chr6 | 17987375 | 17987285 | − | ENST00000378814; ENST00000259711; ENST00000378843; ENST00000378826; ENST00000378816; ENST00000502704 | TSF |
| 4% | chr6 | 17994733 | 17994671 | − | chr6 | 17987375 | 17987285 | − | ENST00000378814; ENST00000259711; ENST00000378843; ENST00000378826; ENST00000378816; ENST00000502704 | TSF |
| 4% | chr6 | 17994733 | 17994671 | − | chr6 | 17987375 | 17987285 | − | ENST00000378814; ENST00000259711; ENST00000378843; ENST00000378826; ENST00000378816; ENST00000502704 | TSF |
| 4% | chr6 | 17994733 | 17994671 | − | chr6 | 17987375 | 17987285 | − | ENST00000378814; ENST00000259711; ENST00000378843; ENST00000378826; ENST00000378816; ENST00000502704 | TSF |
| 4% | chr4 | 83774285 | 83774211 | − | chr4 | 83772757 | 83772584; 83772667 | − | ENST00000348405; ENST00000513858; ENST00000395310; ENST00000443462; ENST00000509142; ENST00000311785; ENST00000326950; ENST00000432794; ENST00000448323; ENST00000505472; ENST00000500777; ENST00000508502; ENST00000355196; ENST00000264405; ENST00000505984; ENST00000508479; ENST00000507828; ENST00000512664 | TSF |
| 4% | chr4 | 83774285 | 83774211 | − | chr4 | 83772757 | 83772584; 83772667 | − | ENST00000348405; ENST00000513858; ENST00000395310; ENST00000443462; ENST00000509142; ENST00000311785; ENST00000326950; ENST00000432794; ENST00000448323; ENST00000505472; | TSF |

TABLE 58-continued

Transcript fusion for Stomach adenocarcinoma (STAD) Coordinates of the fusion sequences for which the donor is the TE.

| 1 | 2' | 3' | 4' | 5' | 6' | 7' | 8' | 9' | 10' | 11' |
|---|----|----|----|----|----|----|----|----|-----|-----|
| 4% | chr4 | 83774285 | 83774211 | − | chr4 | 83772757 | 83772584; 83772667 | − | ENST00000500777; ENST00000508502; ENST00000355196; ENST00000264405; ENST00000505984; ENST00000508479; ENST00000507828; ENST00000512664 ENST00000348405; ENST00000513858; ENST00000395310; ENST00000443462; ENST00000509142; ENST00000311785; ENST00000326950; ENST00000432794; ENST00000448323; ENST00000505472; | TSF |
| 4% | chr4 | 83774285 | 83774211 | − | chr4 | 83772757 | 83772584; 83772667 | − | ENST00000500777; ENST00000508502; ENST00000355196; ENST00000264405; ENST00000505984; ENST00000508479; ENST00000507828; ENST00000512664 ENST00000348405; ENST00000513858; ENST00000395310; ENST00000443462; ENST00000509142; ENST00000311785; ENST00000326950; ENST00000432794; ENST00000448323; ENST00000505472; | TSF |
| 4% | chr4 | 83774285 | 83774211 | − | chr4 | 83772757 | 83772584; 83772667 | − | ENST00000500777; ENST00000508502; ENST00000355196; ENST00000264405; ENST00000505984; ENST00000508479; ENST00000507828; ENST00000512664 ENST00000348405; ENST00000513858; ENST00000395310; ENST00000443462; ENST00000509142; ENST00000311785; ENST00000326950; ENST00000432794; ENST00000448323; ENST00000505472; | TSF |
| 4% | chr4 | 83774285 | 83774211 | − | chr4 | 83772757 | 83772584; 83772667 | − | ENST00000500777; ENST00000508502; ENST00000355196; ENST00000264405; ENST00000505984; ENST00000508479; ENST00000507828; ENST00000512664 ENST00000348405; ENST00000513858; ENST00000395310; ENST00000443462; ENST00000509142; ENST00000311785; ENST00000326950; ENST00000432794; ENST00000448323; ENST00000505472; | TSF |
| 4% | chr4 | 83774285 | 83774211 | − | chr4 | 83772757 | 83772584; 83772667 | − | ENST00000500777; ENST00000508502; ENST00000355196; ENST00000264405; ENST00000505984; ENST00000508479; ENST00000507828; ENST00000512664 ENST00000348405; ENST00000513858; ENST00000395310; ENST00000443462; ENST00000509142; ENST00000311785; ENST00000326950; ENST00000432794; ENST00000448323; ENST00000505472; | TSF |
| 4% | chr4 | 83774285 | 83774211 | − | chr4 | 83772757 | 83772584; 83772667 | − | ENST00000500777; ENST00000508502; ENST00000355196; ENST00000264405; ENST00000505984; ENST00000508479; ENST00000507828; ENST00000512664 ENST00000348405; ENST00000513858; ENST00000395310; ENST00000443462; ENST00000509142; ENST00000311785; ENST00000326950; ENST00000432794; ENST00000448323; ENST00000505472; | TSF |
| 4% | chr17 | 18967449 | 18967302 | − | chr17 | 18881199 | 18880897 | − | ENST00000388995; ENST00000585154; ENST00000345041; ENST00000580115 | TSF |
| 4% | chr17 | 18967449 | 18967302 | − | chr17 | 18881199 | 18880897 | − | ENST00000388995; ENST00000585154; ENST00000345041; ENST00000580115 | |
| 4% | chr10 | 134665322 | 134665102 | − | chr10 | 134664809 | 134664621 | − | ENST00000368586; ENST00000263170 | TSF |
| 4% | chr7 | 100854761 | 10085471 | − | chr7 | 100853923 | 100853813; 100853876 | − | ENST00000454310; ENST00000223127; ENST00000421736 | TSF |
| 4% | chr7 | 100854761 | 10085471 | − | chr7 | 100853923 | 100853813; 100853876 | − | ENST00000454310; ENST00000223127; ENST00000421736 | TSF |
| 4% | chr7 | 100854761 | 10085471 | − | chr7 | 100853923 | 100853813; 100853876 | − | ENST00000454310; ENST00000223127; ENST00000421736 | TSF |
| 4% | chr16 | 67063021 | 67063052 | + | chr16 | 67063630 | 67063716 | + | ENST00000290858; ENST00000564034; ENST00000412916; ENST00000565389 | TSF |
| 4% | chr16 | 67063021 | 67063052 | + | chr16 | 67063630 | 67063716 | + | ENST00000290858; ENST00000564034; ENST00000412916; ENST00000565389 | TSF |
| 4% | chr16 | 67063021 | 67063052 | + | chr16 | 67063630 | 67063716 | + | ENST00000290858; ENST00000564034; ENST00000412916; ENST00000565389 | TSF |
| 4% | chr16 | 67063021 | 67063052 | + | chr16 | 67063630 | 67063716 | + | ENST00000290858; ENST00000564034; | TSF |

TABLE 58-continued

Transcript fusion for Stomach adenocarcinoma (STAD) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 4% | chr12 | 53835137 | 53835233 | + | chr12 | 53836479 | 53836517 | + | ENST00000412916; ENST00000565389 ENST00000547368 | TSF |
| 4% | chr4 | 1708983 | 1709026 | + | chr4 | 1957892 | 1957915 | + | ENST00000508803; ENST00000382892; ENST00000382891; ENST00000382895; ENST00000514329; ENST00000382888 | TSF |
| 4% | chr4 | 1708983 | 1709026 | + | chr4 | 1957892 | 1957915 | + | ENST00000508803; ENST00000382892; ENST00000382891; ENST00000382895; ENST00000514329; ENST00000382888 | TSF |
| 4% | chr3 | 137719364 | 137719364 | + | chr3 | 137742500 | 137742664 | + | ENST00000343735; ENST00000183605; ENST00000479660 | TSF |
| 4% | chr3 | 137719364 | 137719364 | + | chr3 | 137742500 | 137742664 | + | ENST00000343735; ENST00000183605; ENST00000479660 | TSF |
| 4% | chr19 | 39131233 | 39131283 | + | chr19 | 39191240 | 39191354; 39191344 | + | ENST00000252699; ENST00000424234; ENST00000589528 | TSF |
| 4% | chr19 | 39131233 | 39131283 | + | chr19 | 39191240 | 39191354; 39191344 | + | ENST00000252699; ENST00000424234; ENST00000589528 | TSF |
| 4% | chr19 | 39131233 | 39131283 | + | chr19 | 39191240 | 39191354; 39191344 | + | ENST00000252699; ENST00000424234; ENST00000589528 | TSF |
| 4% | chr20 | 33351314 | 33350530 | − | chr20 | 33346736 | 33346608 | − | ENST00000374796; ENST00000359003 | TSF |
| 4% | chrX | 76851229 | 76851182 | − | chrX | 76849319 | 76849166 | − | ENST00000373344; ENST00000395603 | TSF |
| 3% | chr2 | 171572610 | 171572614 | + | chr2 | 171572769 | 171573914 | + | ENST00000375281 | TSF |
| 3% | chr16 | 14942551 | 14942561 | + | chr16 | 14942756 | 14942828 | + | ENST00000287667 | TSF |
| 3% | chr6 | 124669760 | 124669850 | + | chr6 | 124676413 | 124676493 | + | ENST00000368416; ENST00000368417; ENST00000546092; ENST00000545433 | TSF |
| 3% | chr6 | 124669760 | 124669850 | + | chr6 | 124676413 | 124676493 | + | ENST00000368416; ENST00000368417; ENST00000546092; ENST00000545433 | TSF |
| 3% | chr6 | 124669760 | 124669850 | + | chr6 | 124676413 | 124676493 | + | ENST00000368416; ENST00000368417; ENST00000546092; ENST00000545433 | TSF |
| 3% | chr6 | 124669760 | 124669850 | + | chr6 | 124676413 | 124676493 | + | ENST00000368416; ENST00000368417; ENST00000546092; ENST00000545433 | TSF |
| 3% | chr16 | 16341038 | 16341057 | + | chr16 | 16341252 | 16341324; 16341266 | + | ENST00000399336; ENST00000263012; ENST00000538468; ENST00000575225 | TSF |
| 3% | chr16 | 16341038 | 16341057 | + | chr16 | 16341252 | 16341324; 16341266 | + | ENST00000399336; ENST00000263012; ENST00000538468; ENST00000575225 | TSF |
| 3% | chr16 | 16341038 | 16341057 | + | chr16 | 16341252 | 16341324; 16341266 | + | ENST00000399336; ENST00000263012; ENST00000538468; ENST00000575225 | TSF |
| 3% | chr1 | 78389766 | 78390023 | + | chr1 | 78390873 | 78390914 | + | ENST00000401035; ENST00000330010; ENST00000334785; ENST00000342754 | TSF |
| 3% | chr1 | 78389766 | 78390023 | + | chr1 | 78390873 | 78390914 | + | ENST00000401035; ENST00000330010; ENST00000334785; ENST00000342754 | TSF |
| 3% | chr1 | 78389766 | 78390023 | + | chr1 | 78390873 | 78390914 | + | ENST00000401035; ENST00000330010; ENST00000334785; ENST00000342754 | TSF |
| 3% | chr17 | 39974832 | 39974893 | + | chr17 | 39975462 | 39975651 | + | ENST00000321562 | TSF |
| 3% | chr1 | 200882539 | 200882562 | + | chr1 | 200882665 | 200882757 | + | ENST00000367342; ENST00000413687 | TSF |
| 3% | chr9 | 130732697 | 130732597 | − | chr9 | 130716204 | 130716084 | − | ENST00000373095 | TSF |
| 3% | chr2 | 232340741 | 232340940 | + | chr2 | 232576658 | 232576693 | + | ENST00000409321; ENST00000409115; ENST00000341369; ENST00000409683; ENST00000410064; ENST00000412128 | TSF |
| 3% | chr2 | 232340741 | 232340940 | + | chr2 | 232576658 | 232576693 | + | ENST00000409321; ENST00000409115; ENST00000341369; ENST00000409683; ENST00000410064; ENST00000412128 | TSF |
| 3% | chr13 | 43628887 | 43629679 | + | chr13 | 43681314 | 43681384 | + | ENST00000379221 | TSF |
| 3% | chr2 | 85534293 | 85534401 | + | chr2 | 85534765 | 85534840 | + | ENST00000282111 | TSF |
| 3% | chr1 | 165854440 | 165854616 | + | chr1 | 165859441 | 165859600 | + | ENST00000367879; ENST00000372212 | TSF |
| 3% | chr1 | 165854440 | 165854616 | + | chr1 | 165859441 | 165859600 | + | ENST00000367879; ENST00000372212 | TSF |
| 3% | chr20 | 34710617 | 34710669 | + | chr20 | 34763473 | 34763637 | + | ENST00000406771; ENST00000452261; ENST00000447825; ENST00000373946; ENST00000338074; ENST00000373941 | TSF |
| 3% | chr20 | 34710617 | 34710669 | + | chr20 | 34763473 | 34763637 | + | ENST00000406771; ENST00000452261; ENST00000447825; ENST00000373946; ENST00000338074; ENST00000373941 | TSF |
| 3% | chr20 | 34710617 | 34710669 | + | chr20 | 34763473 | 34763637 | + | ENST00000406771; ENST00000452261; ENST00000447825; ENST00000373946; ENST00000338074; ENST00000373941 | TSF |
| 3% | chr20 | 34710617 | 34710669 | + | chr20 | 34763473 | 34763637 | + | ENST00000406771; ENST00000452261; ENST00000447825; ENST00000373946; ENST00000338074; ENST00000373941 | TSF |
| 3% | chr20 | 34710617 | 34710669 | + | chr20 | 34763473 | 34763637 | + | ENST00000406771; ENST00000452261; ENST00000447825; ENST00000373946; ENST00000338074; ENST00000373941 | TSF |
| 3% | chr20 | 34710617 | 34710669 | + | chr20 | 34763473 | 34763637 | + | ENST00000406771; ENST00000452261; ENST00000447825; ENST00000373946; ENST00000338074; ENST00000373941 | TSF |
| 3% | chr21 | 40180090 | 40180187 | + | chr21 | 40181959 | 40182030 | + | ENST00000360214; ENST00000360938; ENST00000432278; ENST00000456966 | TSF |
| 3% | chr21 | 40180090 | 40180187 | + | chr21 | 40181959 | 40182030 | + | ENST00000360214; ENST00000360938; | TSF |

TABLE 58-continued

Transcript fusion for Stomach adenocarcinoma (STAD) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 3% | chr21 | 40180090 | 40180187 | + | chr21 | 40181959 | 40182030 | + | ENST00000432278; ENST00000456966 ENST00000360214; ENST00000360938; ENST00000432278; ENST00000456966 | TSF |
| 3% | chrX | 53664297 | 53664254 | − | chrX | 53661250 | 53661188 | − | ENST00000342160; ENST00000262854; ENST00000218328 | TSF |
| 3% | chrX | 53664297 | 53664254 | − | chrX | 53661250 | 53661188 | − | ENST00000342160; ENST00000262854; ENST00000218328 | TSF |
| 3% | chr17 | 27441253 | 27441216 | − | chr17 | 27441115 | 27441029 | − | ENST00000354329; ENST00000533112; ENST00000531253; ENST00000527372 | TSF |
| 3% | chr17 | 27441253 | 27441216 | − | chr17 | 27441115 | 27441029 | − | ENST00000354329; ENST00000533112; ENST00000531253; ENST00000527372 | TSF |
| 3% | chr17 | 27441253 | 27441216 | − | chr17 | 27441115 | 27441029 | − | ENST00000354329; ENST00000533112; ENST00000531253; ENST00000527372 | TSF |
| 3% | chr17 | 43485811 | 43485601 | − | chr17 | 43483449 | 43483042; 43483213 | − | ENST00000532038; ENST00000428638; ENST00000442348; ENST00000532891; ENST00000528677 | TSF |
| 3% | chr17 | 43485811 | 43485601 | − | chr17 | 43483449 | 43483042; 43483213 | − | ENST00000532038; ENST00000428638; ENST00000442348; ENST00000532891; ENST00000528677 | TSF |
| 3% | chr17 | 43485811 | 43485601 | − | chr17 | 43483449 | 43483042; 43483213 | − | ENST00000532038; ENST00000428638; ENST00000442348; ENST00000532891; ENST00000528677 | TSF |
| 3% | chr17 | 43485811 | 43485601 | − | chr17 | 43483449 | 43483042; 43483213 | − | ENST00000532038; ENST00000428638; ENST00000442348; ENST00000532891; ENST00000528677 | TSF |
| 3% | chr13 | 95233957 | 95233815 | − | chr13 | 95233443 | 95233345 | − | ENST00000261296 | TSF |
| 3% | chr17 | 1005272 | 1005174 | − | chr17 | 1003975 | 1003877 | − | ENST00000302538; ENST00000544583; ENST00000574437; ENST00000291107; ENST00000574139; ENST00000570525; ENST00000574266 | TSF |
| 3% | chr17 | 1005272 | 1005174 | − | chr17 | 1003975 | 1003877 | − | ENST00000302538; ENST00000544583; ENST00000574437; ENST00000291107; ENST00000574139; ENST00000570525; ENST00000574266 | TSF |
| 3% | chr17 | 1005272 | 1005174 | − | chr17 | 1003975 | 1003877 | − | ENST00000302538; ENST00000544583; ENST00000574437; ENST00000291107; ENST00000574139; ENST00000570525; ENST00000574266 | TSF |
| 3% | chr17 | 1005272 | 1005174 | − | chr17 | 1003975 | 1003877 | − | ENST00000302538; ENST00000544583; ENST00000574437; ENST00000291107; ENST00000574139; ENST00000570525; ENST00000574266 | TSF |
| 3% | chr9 | 131902050 | 131902148 | + | chr9 | 131904724 | 131904831; 131905179 | + | ENST00000358994; ENST00000393370; ENST00000337738; ENST00000348141; ENST00000452489; ENST00000357197; ENST00000347048; ENST00000355007; ENST00000417728; ENST00000411917; ENST00000423100; ENST00000524946; ENST00000436883; ENST00000414510; ENST00000432124; ENST00000435305; ENST00000419582; ENST00000432651; ENST00000435132; ENST00000434095 | TSF |
| 3% | chr9 | 131902050 | 131902148 | + | chr9 | 131904724 | 131904831; 131905179 | + | ENST00000358994; ENST00000393370; ENST00000337738; ENST00000348141; ENST00000452489; ENST00000357197; ENST00000347048; ENST00000355007; ENST00000417728; ENST00000411917; ENST00000423100; ENST00000524946; ENST00000436883; ENST00000414510; ENST00000432124; ENST00000435305; ENST00000419582; ENST00000432651; ENST00000435132; ENST00000434095 | TSF |
| 3% | chr9 | 131902050 | 131902148 | + | chr9 | 131904724 | 131904831; 131905179 | + | ENST00000358994; ENST00000393370; ENST00000337738; ENST00000348141; ENST00000452489; ENST00000357197; ENST00000347048; ENST00000355007; ENST00000417728; ENST00000411917; ENST00000423100; ENST00000524946; ENST00000436883; ENST00000414510; ENST00000432124; ENST00000435305; ENST00000419582; ENST00000432651; ENST00000435132; ENST00000434095 | TSF |
| 3% | chr9 | 131902050 | 131902148 | + | chr9 | 131904724 | 131904831; 131905179 | + | ENST00000358994; ENST00000393370; ENST00000337738; ENST00000348141; ENST00000452489; ENST00000357197; ENST00000347048; ENST00000355007; | TSF |

TABLE 58-continued

Transcript fusion for Stomach adenocarcinoma (STAD) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 3% | chr9 | 131902050 | 131902148 | + | chr9 | 131904724 | 131904831; 131905179 | + | ENST00000417728; ENST00000411917; ENST00000423100; ENST00000524946; ENST00000436883; ENST00000414510; ENST00000432124; ENST00000435305; ENST00000419582; ENST00000432651; ENST00000435132; ENST00000434095 ENST00000358994; ENST00000393370; ENST00000337738; ENST00000348141; ENST00000452489; ENST00000357197; ENST00000347048; ENST00000355007; ENST00000417728; ENST00000411917; ENST00000423100; ENST00000524946; ENST00000436883; ENST00000414510; ENST00000432124; ENST00000435305; ENST00000419582; ENST00000432651; ENST00000435132; ENST00000434095 | TSF |
| 3% | chr1 | 109695285 | 109695471 | + | chr1 | 109704516 | 109704636 | + | ENST00000533147; ENST00000531664; ENST00000534476; ENST00000526264; ENST00000369939; ENST00000457623; ENST00000529753 | TSF |
| 3% | chr1 | 109695285 | 109695471 | + | chr1 | 109704516 | 109704636 | + | ENST00000533147; ENST00000531664; ENST00000534476; ENST00000526264; ENST00000369939; ENST00000457623; ENST00000529753 | TSF |
| 3% | chr1 | 109695285 | 109695471 | + | chr1 | 109704516 | 109704636 | + | ENST00000533147; ENST00000531664; ENST00000534476; ENST00000526264; ENST00000369939; ENST00000457623; ENST00000529753 | TSF |
| 3% | chr1 | 109695285 | 109695471 | + | chr1 | 109704516 | 109704636 | + | ENST00000533147; ENST00000531664; ENST00000534476; ENST00000526264; ENST00000369939; ENST00000457623; ENST00000529753 | TSF |
| 3% | chr1 | 109695285 | 109695471 | + | chr1 | 109704516 | 109704636 | + | ENST00000533147; ENST00000531664; ENST00000534476; ENST00000526264; ENST00000369939; ENST00000457623; ENST00000529753 | TSF |
| 3% | chr1 | 109695285 | 109695471 | + | chr1 | 109704516 | 109704636 | + | ENST00000533147; ENST00000531664; ENST00000534476; ENST00000526264; ENST00000369939; ENST00000457623; ENST00000529753 | TSF |
| 3% | chr10 | 74643151 | 74643529 | + | chr10 | 74644024 | 74644140 | + | ENST00000373053; ENST00000357157; ENST00000536019 | TSF |
| 3% | chr5 | 179238653 | 179238682 | + | chr5 | 179250858 | 179251087; 179251057 | + | ENST00000376929; ENST00000514093; ENST00000422245; ENST00000389805; ENST00000504627; ENST00000402874; ENST00000510187; ENST00000360718 | TSF |
| 3% | chr5 | 179238653 | 179238682 | + | chr5 | 179250858 | 179251087; 179251057 | + | ENST00000376929; ENST00000514093; ENST00000422245; ENST00000389805; ENST00000504627; ENST00000402874; ENST00000510187; ENST00000360718 | TSF |
| 3% | chr5 | 179238653 | 179238682 | + | chr5 | 179250858 | 179251087; 179251057 | + | ENST00000376929; ENST00000514093; ENST00000422245; ENST00000389805; ENST00000504627; ENST00000402874; ENST00000510187; ENST00000360718 | TSF |
| 3% | chr5 | 179238653 | 179238682 | + | chr5 | 179250858 | 179251087; 179251057 | + | ENST00000376929; ENST00000514093; ENST00000422245; ENST00000389805; ENST00000504627; ENST00000402874; ENST00000510187; ENST00000360718 | TSF |
| 3% | chr5 | 179238653 | 179238682 | + | chr5 | 179250858 | 179251087; 179251057 | + | ENST00000376929; ENST00000514093; ENST00000422245; ENST00000389805; ENST00000504627; ENST00000402874; ENST00000510187; ENST00000360718 | TSF |
| 3% | chr2 | 232340741 | 232340940 | + | chr2 | 232576651 | 232576693 | + | ENST00000409321; ENST00000409115; ENST00000341369; ENST00000409683; ENST00000410064; ENST00000412128 | TSF |
| 3% | chr2 | 232340741 | 232340940 | + | chr2 | 232576651 | 232576693 | + | ENST00000409321; ENST00000409115; ENST00000341369; ENST00000409683; ENST00000410064; ENST00000412128 | TSF |
| 3% | chr7 | 56020443 | 56020509 | + | chr7 | 56020872 | 56021011 | + | ENST0000426595 | TSF |
| 3% | chr16 | 50663697 | 50663964 | + | chr16 | 50664097 | 50664244 | + | ENST00000268459 | TSF |
| 3% | chr16 | 28836248 | 28836298 | + | chr16 | 28836687 | 28836723 | + | ENST00000340394; ENST00000325215; ENST00000336783; ENST00000382686; | TSF |

TABLE 58-continued

Transcript fusion for Stomach adenocarcinoma (STAD) Coordinates of the fusion sequences for which the donor is the TE.

| 1 | 2' | 3' | 4' | 5' | 6' | 7' | 8' | 9' | 10' | 11' |
|---|----|----|----|----|----|----|----|----|----|----|
| 3% | chr16 | 28836248 | 28836298 | + | chr16 | 28836687 | 28836723 | + | ENST00000395547; ENST00000564304; ENST00000570200; ENST00000568266 ENST00000340394; ENST00000325215; ENST00000336783; ENST00000382686; | TSF |
| 3% | chr16 | 28836248 | 28836298 | + | chr16 | 28836687 | 28836723 | + | ENST00000395547; ENST00000564304; ENST00000570200; ENST00000568266 ENST00000340394; ENST00000325215; ENST00000336783; ENST00000382686; | TSF |
| 3% | chr16 | 28836248 | 28836298 | + | chr16 | 28836687 | 28836723 | + | ENST00000395547; ENST00000564304; ENST00000570200; ENST00000568266 ENST00000340394; ENST00000325215; ENST00000336783; ENST00000382686; | TSF |
| 3% | chr16 | 28836248 | 28836298 | + | chr16 | 28836687 | 28836723 | + | ENST00000395547; ENST00000564304; ENST00000570200; ENST00000568266 ENST00000340394; ENST00000325215; ENST00000336783; ENST00000382686; | TSF |
| 3% | chr16 | 28836248 | 28836298 | + | chr16 | 28836687 | 28836723 | + | ENST00000395547; ENST00000564304; ENST00000570200; ENST00000568266 ENST00000340394; ENST00000325215; ENST00000336783; ENST00000382686; | TSF |
| 3% | chr16 | 28836248 | 28836298 | + | chr16 | 28836687 | 28836723 | + | ENST00000395547; ENST00000564304; ENST00000570200; ENST00000568266 ENST00000340394; ENST00000325215; ENST00000336783; ENST00000382686; | TSF |
| 3% | chr16 | 28836248 | 28836298 | + | chr16 | 28836687 | 28836723 | + | ENST00000395547; ENST00000564304; ENST00000570200; ENST00000568266 ENST00000340394; ENST00000325215; ENST00000336783; ENST00000382686; | TSF |
| 3% | chr7 | 23722338 | 23722381 | + | chr7 | 23724118 | 23724291 | + | ENST00000409192; ENST00000344962; ENST00000429719; ENST00000446234 | TSF |
| 3% | chr7 | 23722338 | 23722381 | + | chr7 | 23724118 | 23724291 | + | ENST00000409192; ENST00000344962; ENST00000429719; ENST00000446234 | TSF |
| 3% | chr7 | 23722338 | 23722381 | + | chr7 | 23724118 | 23724291 | + | ENST00000409192; ENST00000344962; ENST00000429719; ENST00000446234 | TSF |
| 3% | chr7 | 23722338 | 23722381 | + | chr7 | 23724118 | 23724291 | + | ENST00000409192; ENST00000344962; ENST00000429719; ENST00000446234 | TSF |
| 3% | chr17 | 39976225 | 39976301 | + | chr17 | 39976521 | 39976713 | + | ENST00000321562; ENST00000455106; ENST00000544340 | TSF |
| 3% | chr15 | 44600951 | 44601046 | + | chr15 | 44615163 | 44615217 | + | ENST00000557945; ENST00000299957; ENST00000345795; ENST00000360824 | TSF |
| 3% | chr15 | 44600951 | 44601046 | + | chr15 | 44615163 | 44615217 | + | ENST00000557945; ENST00000299957; ENST00000345795; ENST00000360824 | TSF |
| 3% | chr15 | 44600951 | 44601046 | + | chr15 | 44615163 | 44615217 | + | ENST00000557945; ENST00000299957; ENST00000345795; ENST00000360824 | TSF |
| 3% | chr11 | 46390474 | 46390524 | + | chr11 | 46391044 | 46391100; 46391047 | + | ENST00000343674; ENST00000532868; ENST00000395574; ENST00000527911; ENST00000533376; ENST00000456247; ENST00000421244; ENST00000318201; ENST00000454345; ENST00000524448 | TSF |
| 3% | chr11 | 46390474 | 46390524 | + | chr11 | 46391044 | 46391100; 46391047 | + | ENST00000343674; ENST00000532868; ENST00000395574; ENST00000527911; ENST00000533376; ENST00000456247; ENST00000421244; ENST00000318201; ENST00000454345; ENST00000524448 | TSF |
| 3% | chr11 | 46390474 | 46390524 | + | chr11 | 46391044 | 46391100; 46391047 | + | ENST00000343674; ENST00000532868; ENST00000395574; ENST00000527911; ENST00000533376; ENST00000456247; ENST00000421244; ENST00000318201; ENST00000454345; ENST00000524448 | TSF |
| 3% | chr11 | 46390474 | 46390524 | + | chr11 | 46391044 | 46391100; 46391047 | + | ENST00000343674; ENST00000532868; ENST00000395574; ENST00000527911; ENST00000533376; ENST00000456247; ENST00000421244; ENST00000318201; ENST00000454345; ENST00000524448 | TSF |
| 3% | chr11 | 46390474 | 46390524 | + | chr11 | 46391044 | 46391100; 46391047 | + | ENST00000343674; ENST00000532868; ENST00000395574; ENST00000527911; ENST00000533376; ENST00000456247; ENST00000421244; ENST00000318201; ENST00000454345; ENST00000524448 | TSF |
| 3% | chr22 | 38166164 | 38166230 | + | chr22 | 38167657 | 38167743 | + | ENST00000406386; ENST00000403663 | TSF |
| 3% | chr12 | 117498589 | 117498567 | − | chr12 | 117494691 | 117494611 | − | ENST00000470612; ENST00000335209; ENST00000392545; ENST00000462502 | TSF |
| 3% | chr12 | 117498589 | 117498567 | − | chr12 | 117494691 | 117494611 | − | ENST00000470612; ENST00000335209; ENST00000392545; ENST00000462502 | TSF |

TABLE 58-continued

Transcript fusion for Stomach adenocarcinoma (STAD) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 3% | chr12 | 117498589 | 117498567 | − | chr12 | 117494691 | 117494611 | − | ENST00000470612; ENST00000335209; ENST00000392545; ENST00000462502 | TSF |
| 3% | chr16 | 21060024 | 21059927 | − | chr16 | 21053525 | 21053349 | − | ENST00000261383; ENST00000415178 | TSF |
| 3% | chr16 | 21060024 | 21059927 | − | chr16 | 21053525 | 21053349 | − | ENST00000261383; ENST00000415178 | TSF |
| 3% | chr17 | 38639751 | 38639593 | − | chr17 | 38638668 | 38638576 | − | ENST00000254051 | TSF |
| 3% | chr1 | 8924664 | 8924519 | − | chr1 | 8924151 | 8923950 | − | ENST00000234590 | TSF |
| 3% | chr7 | 22858195 | 22858099 | − | chr7 | 22857667 | 22857619 | − | ENST00000358435; ENST00000405021; ENST00000372879 | TSF TSF |
| 3% | chr17 | 17735107 | 17735071 | − | chr17 | 17723835 | 17723404 | − | ENST00000338854; ENST00000355815; ENST00000261646; ENST00000435530; ENST00000423161 | TSF |
| 3% | chr17 | 17735107 | 17735071 | − | chr17 | 17723835 | 17723404 | − | ENST00000338854; ENST00000355815; ENST00000261646; ENST00000435530; ENST00000423161 | TSF |
| 3% | chr17 | 17735107 | 17735071 | − | chr17 | 17723835 | 17723404 | − | ENST00000338854; ENST00000355815; ENST00000261646; ENST00000435530; ENST00000423161 | TSF |
| 3% | chr17 | 17735107 | 17735071 | − | chr17 | 17723835 | 17723404 | − | ENST00000338854; ENST00000355815; ENST00000261646; ENST00000435530; ENST00000423161 | TSF |
| 3% | chr7 | 97938760 | 97938714 | − | chr7 | 97937208 | 97937001 | − | ENST00000005260 | TSF |
| 3% | chr2 | 150044073 | 150044093 | + | chr2 | 150061767 | 150061918 | + | ENST00000409642; ENST00000409876; ENST00000409029; ENST00000442722; ENST00000280115 | TSF |
| 3% | chr2 | 150044073 | 150044093 | + | chr2 | 150061767 | 150061918 | + | ENST00000409642; ENST00000409876; ENST00000409029; ENST00000442722; ENST00000280115 | TSF |
| 3% | chr16 | 66461229 | 66461334 | + | chr16 | 66503505 | 66503768 | + | ENST00000536005 | TSF |
| 3% | chr2 | 101567739 | 101568117 | + | chr2 | 101580425 | 101580638 | + | ENST00000335681; ENST00000542504 | TSF |
| 3% | chr13 | 43670805 | 43671144 | + | chr13 | 43681314 | 43681384 | + | ENST00000379221 | TSF |
| 3% | chr7 | 56018506 | 56018522 | + | chr7 | 56022602 | 56022871; 56022865 | + | ENST00000426595; ENST00000285298; ENST00000443449 | TSF |
| 3% | chr7 | 56018506 | 56018522 | + | chr7 | 56022602 | 56022871; 56022865 | + | ENST00000426595; ENST00000285298; ENST00000443449 | TSF |
| 3% | chr1 | 15562769 | 15563257 | + | chr1 | 15578267 | 15578373 | + | ENST00000433640 | TSF |
| 3% | chr3 | 47772073 | 47772030 | − | chr3 | 47770584 | 47770515 | − | ENST00000254480 | TSF |
| 3% | chr17 | 70713894 | 70713885 | − | chr17 | 70645407 | 70645309 | − | ENST00000255559; ENST00000542342; ENST00000582769 | TSF |
| 3% | chr17 | 70713894 | 70713885 | − | chr17 | 70645407 | 70645309 | − | ENST00000255559; ENST00000542342; ENST00000582769 | TSF |
| 3% | chr11 | 93468219 | 93468129 | − | chr11 | 93466563 | 93466528 | − | ENST00000393259 | TSF |
| 3% | chr20 | 56265149 | 56265035 | − | chr20 | 56234753 | 56234599 | − | ENST00000341744; ENST00000347215; ENST00000414037; ENST00000395819 | TSF |
| 3% | chr20 | 56265149 | 56265035 | − | chr20 | 56234753 | 56234599 | − | ENST00000341744; ENST00000347215; ENST00000414037; ENST00000395819 | TSF |
| 3% | chr20 | 56265149 | 56265035 | − | chr20 | 56234753 | 56234599 | − | ENST00000341744; ENST00000347215; ENST00000414037; ENST00000395819 | TSF |
| 3% | chrX | 134954053 | 134953756 | − | chrX | 134932924 | 134932815 | − | ENST00000487941; ENST00000434966; ENST00000494421 | TSF |
| 3% | chr17 | 42400590 | 42400540 | − | chr17 | 42400220 | 42400176 | − | ENST00000225308; ENST00000377095; ENST00000590194; ENST00000590194; ENST00000588049; ENST00000586633; ENST00000592857; ENST00000585523 | TSF |
| 3% | chr17 | 42400590 | 42400540 | − | chr17 | 42400220 | 42400176 | − | ENST00000225308; ENST00000377095; ENST00000590194; ENST00000590194; ENST00000588049; ENST00000586633; ENST00000592857; ENST00000585523 | TSF |
| 3% | chr17 | 42400590 | 42400540 | − | chr17 | 42400220 | 42400176 | − | ENST00000225308; ENST00000377095; ENST00000590194; ENST00000590194; ENST00000588049; ENST00000586633; ENST00000592857; ENST00000585523 | TSF |
| 3% | chr17 | 42400590 | 42400540 | − | chr17 | 42400220 | 42400176 | − | ENST00000225308; ENST00000377095; ENST00000590194; ENST00000590194; ENST00000588049; ENST00000586633; ENST00000592857; ENST00000585523 | TSF |
| 3% | chr17 | 42400590 | 42400540 | − | chr17 | 42400220 | 42400176 | − | ENST00000225308; ENST00000377095; ENST00000590194; ENST00000590194; ENST00000588049; ENST00000586633; ENST00000592857; ENST00000585523 | TSF |
| 3% | chr17 | 42400590 | 42400540 | − | chr17 | 42400220 | 42400176 | − | ENST00000225308; ENST00000377095; ENST00000590194; ENST00000590194; ENST00000588049; ENST00000586633; ENST00000592857; ENST00000585523 | TSF |
| 3% | chrX | 134954053 | 134953756 | − | chrX | 134950187 | 134950078 | − | ENST00000420087; ENST00000463085; ENST00000370724; ENST00000491480 | TSF |
| 3% | chrX | 134954053 | 134953756 | − | chrX | 134950187 | 134950078 | − | ENST00000420087; ENST00000463085; | TSF |

TABLE 58-continued

Transcript fusion for Stomach adenocarcinoma (STAD) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 3% | chr22 | 22899971 | 22899965 | − | chr22 | 22893511 | 22893189; 22893185; 22893481; 22893274 | − | ENST00000370724; ENST00000491480 ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |
| 3% | chr22 | 22899971 | 22899965 | − | chr22 | 22893511 | 22893189; 22893185; 22893481; 22893274 | − | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |
| 3% | chr22 | 22899971 | 22899965 | − | chr22 | 22893511 | 22893189; 22893185; 22893481; 22893274 | − | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |
| 3% | chr22 | 22899971 | 22899965 | − | chr22 | 22893511 | 22893189; 22893185; 22893481; 22893274 | − | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |
| 3% | chr22 | 22899971 | 22899965 | − | chr22 | 22893511 | 22893189; 22893185; 22893481; 22893274 | − | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |
| 3% | chr22 | 22899971 | 22899965 | − | chr22 | 22893511 | 22893189; 22893185; 22893481; 22893274 | − | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |
| 3% | chrX | 134936794 | 134936497 | − | chrX | 134932924 | 134932815 | − | ENST00000487941; ENST00000434966; ENST00000494421 | TSF |
| 2% | chr7 | 2403615 | 2403665 | + | chr7 | 2404007 | 2404164; 2404031 | + | ENST00000431643; ENST00000360876; ENST00000413917; ENST00000397011 | TSF |
| 2% | chr7 | 2403615 | 2403665 | + | chr7 | 2404007 | 2404164; 2404031 | + | ENST00000431643; ENST00000360876; ENST00000413917; ENST00000397011 | TSF |
| 2% | chr7 | 2403615 | 2403665 | + | chr7 | 2404007 | 2404164; 2404031 | + | ENST00000431643; ENST00000360876; ENST00000413917; ENST00000397011 | TSF |
| 2% | chr20 | 44442461 | 44442685 | + | chr20 | 44443023 | 44443109 | + | ENST00000356455; ENST00000405520; ENST00000335046; ENST00000372568 | TSF |
| 2% | chr20 | 44442461 | 44442685 | + | chr20 | 44443023 | 44443109 | + | ENST00000356455; ENST00000405520; ENST00000335046; ENST00000372568 | TSF |
| 2% | chr21 | 42597177 | 42597622 | + | chr21 | 42598199 | 42598281 | + | ENST00000328735; ENST00000330333; ENST00000347667 | TSF |
| 2% | chr21 | 42597177 | 42597622 | + | chr21 | 42598199 | 42598281 | + | ENST00000328735; ENST00000330333; ENST00000347667 | TSF |
| 2% | chr21 | 42597177 | 42597622 | + | chr21 | 42598199 | 42598281 | + | ENST00000328735; ENST00000330333; ENST00000347667 | TSF |
| 2% | chr17 | 7479605 | 7479718 | + | chr17 | 7479842 | 7480008; 7480010; 7479924 | + | ENST00000582169; ENST00000293831; ENST00000585024; ENST00000583802; ENST00000581544; ENST00000577269; ENST00000584784; ENST00000582746; ENST00000584860; ENST00000581384 | TSF |
| 2% | chr17 | 7479605 | 7479718 | + | chr17 | 7479842 | 7480008; 7480010; 7479924 | + | ENST00000582169; ENST00000293831; ENST00000585024; ENST00000583802; ENST00000581544; ENST00000577269; ENST00000584784; ENST00000582746; ENST00000584860; ENST00000581384 | TSF |
| 2% | chr17 | 7479605 | 7479718 | + | chr17 | 7479842 | 7480008; 7480010; 7479924 | + | ENST00000582169; ENST00000293831; ENST00000585024; ENST00000583802; ENST00000581544; ENST00000577269; ENST00000584784; ENST00000582746; ENST00000584860; ENST00000581384 | TSF |
| 2% | chr17 | 7479605 | 7479718 | + | chr17 | 7479842 | 7480008; 7480010; 7479924 | + | ENST00000582169; ENST00000293831; ENST00000585024; ENST00000583802; ENST00000581544; ENST00000577269; ENST00000584784; ENST00000582746; ENST00000584860; ENST00000581384 | TSF |
| 2% | chr17 | 7479605 | 7479718 | + | chr17 | 7479842 | 7480008; | + | ENST00000582169; ENST00000293831; | TSF |

TABLE 58-continued

Transcript fusion for Stomach adenocarcinoma (STAD) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| | | | | | | | 7480010; 7479924 | | ENST00000585024; ENST00000583802; ENST00000581544; ENST00000577269; ENST00000584784; ENST00000582746; ENST00000584860; ENST00000581384 | |
| 2% | chr17 | 7479605 | 7479718 | + | chr17 | 7479842 | 7480008; 7480010; 7479924 | + | ENST00000582169; ENST00000293831; ENST00000585024; ENST00000583802; ENST00000581544; ENST00000577269; ENST00000584784; ENST00000582746; ENST00000584860; ENST00000581384 | TSF |
| 2% | chr17 | 7479605 | 7479718 | + | chr17 | 7479842 | 7480008; 7480010; 7479924 | + | ENST00000582169; ENST00000293831; ENST00000585024; ENST00000583802; ENST00000581544; ENST00000577269; ENST00000584784; ENST00000582746; ENST00000584860; ENST00000581384 | TSF |
| 2% | chr17 | 7479605 | 7479718 | + | chr17 | 7479842 | 7480008; 7480010; 7479924 | + | ENST00000582169; ENST00000293831; ENST00000585024; ENST00000583802; ENST00000581544; ENST00000577269; ENST00000584784; ENST00000582746; ENST00000584860; ENST00000581384 | TSF |
| 2% | chr17 | 7479605 | 7479718 | + | chr17 | 7479842 | 7480008; 7480010; 7479924 | + | ENST00000582169; ENST00000293831; ENST00000585024; ENST00000583802; ENST00000581544; ENST00000577269; ENST00000584784; ENST00000582746; ENST00000584860; ENST00000581384 | TSF |
| 2% | chr17 | 7479605 | 7479718 | + | chr17 | 7479842 | 7480008; 7480010; 7479924 | + | ENST00000582169; ENST00000293831; ENST00000585024; ENST00000583802; ENST00000581544; ENST00000577269; ENST00000584784; ENST00000582746; ENST00000584860; ENST00000581384 | TSF |
| 2% | chr3 | 39374892 | 39374955 | + | chr3 | 39453486 | 39453552; 39453550 | + | ENST00000301821; ENST00000458478; ENST00000443003 | TSF |
| 2% | chr3 | 39374892 | 39374955 | + | chr3 | 39453486 | 39453552; 39453550 | + | ENST00000301821; ENST00000458478; ENST00000443003 | TSF |
| 2% | chr1 | 206326596 | 206326721 | + | chr1 | 206327474 | 206327596 | + | ENST00000358184; ENST00000361052; ENST00000360218; ENST00000432969 | TSF |
| 2% | chr1 | 206326596 | 206326721 | + | chr1 | 206327474 | 206327596 | + | ENST00000358184; ENST00000361052; ENST00000360218; ENST00000432969 | TSF |
| 2% | chr20 | 60878087 | 60878105 | + | chr20 | 60878775 | 60878837 | + | ENST00000253003 | TSF |
| 2% | chr11 | 66953459 | 66954052 | + | chr11 | 66974981 | 66975159 | + | ENST00000398645; ENST00000529006 | TSF |
| 2% | chr11 | 66953459 | 66954052 | + | chr11 | 66974981 | 66975159 | + | ENST00000398645; ENST00000529006 | TSF |
| 2% | chr2 | 242276229 | 242276279 | + | chr2 | 242276797 | 242276931; 242276900; 242276863; 242276848 | + | ENST00000391973; ENST00000428282; ENST00000360051; ENST00000391971; ENST00000401990; ENST00000407971; ENST00000436795; ENST00000411484; ENST00000402092; ENST00000443492; ENST00000437066; ENST00000449239; ENST00000457874 | TSF |
| 2% | chr2 | 242276229 | 242276279 | + | chr2 | 242276797 | 242276931; 242276900; 242276863; 242276848 | + | ENST00000391973; ENST00000428282; ENST00000360051; ENST00000391971; ENST00000401990; ENST00000407971; ENST00000436795; ENST00000411484; ENST00000402092; ENST00000443492; ENST00000437066; ENST00000449239; ENST00000457874 | TSF |
| 2% | chr2 | 242276229 | 242276279 | + | chr2 | 242276797 | 242276931; 242276900; 242276863; 242276848 | + | ENST00000391973; ENST00000428282; ENST00000360051; ENST00000391971; ENST00000401990; ENST00000407971; ENST00000436795; ENST00000411484; ENST00000402092; ENST00000443492; ENST00000437066; ENST00000449239; ENST00000457874 | TSF |
| 2% | chr2 | 242276229 | 242276279 | + | chr2 | 242276797 | 242276931; 242276900; 242276863; 242276848 | + | ENST00000391973; ENST00000428282; ENST00000360051; ENST00000391971; ENST00000401990; ENST00000407971; ENST00000436795; ENST00000411484; ENST00000402092; ENST00000443492; ENST00000437066; ENST00000449239; ENST00000457874 | TSF |
| 2% | chr2 | 242276229 | 242276279 | + | chr2 | 242276797 | 242276931; 242276900; 242276863; 242276848 | + | ENST00000391973; ENST00000428282; ENST00000360051; ENST00000391971; ENST00000401990; ENST00000407971; ENST00000436795; ENST00000411484; ENST00000402092; ENST00000443492; ENST00000437066; ENST00000449239; ENST00000457874 | TSF |
| 2% | chr2 | 242276229 | 242276279 | + | chr2 | 242276797 | 242276931; | + | ENST00000391973; ENST00000428282; | TSF |

TABLE 58-continued

Transcript fusion for Stomach adenocarcinoma (STAD) Coordinates of the fusion sequences for which the donor is the TE.

| 1 | 2' | 3' | 4' | 5' | 6' | 7' | 8' | 9' | 10' | 11' |
|---|----|----|----|----|----|----|----|----|-----|-----|
|   |    |    |    |    |    |    | 242276900; 242276863; 242276848 |    | ENST00000360051; ENST00000391971; ENST00000401990; ENST00000407971; ENST00000436795; ENST00000411484; ENST00000402092; ENST00000443492; ENST00000437066; ENST00000449239; ENST00000457874 |  |
| 2% | chr2 | 242276229 | 242276279 | + | chr2 | 242276797 | 242276931; 242276900; 242276863; 242276848 | + | ENST00000391973; ENST00000428282; ENST00000360051; ENST00000391971; ENST00000401990; ENST00000407971; ENST00000436795; ENST00000411484; ENST00000402092; ENST00000443492; ENST00000437066; ENST00000449239; ENST00000457874 | TSF |
| 2% | chr2 | 242276229 | 242276279 | + | chr2 | 242276797 | 242276931; 242276900; 242276863; 242276848 | + | ENST00000391973; ENST00000428282; ENST00000360051; ENST00000391971; ENST00000401990; ENST00000407971; ENST00000436795; ENST00000411484; ENST00000402092; ENST00000443492; ENST00000437066; ENST00000449239; ENST00000457874 | TSF |
| 2% | chr2 | 189844524 | 189844751 | + | chr2 | 189849486 | 189849688 | + | ENST00000304636; ENST00000317840 | TSF |
| 2% | chr2 | 189844524 | 189844751 | + | chr2 | 189849486 | 189849688 | + | ENST00000304636; ENST00000317840 | TSF |
| 2% | chr6 | 30913142 | 30913271 | + | chr6 | 30916324 | 30920276 | + | ENST00000462446 | TSF |
| 2% | chr17 | 37897992 | 37898081 | + | chr17 | 37898505 | 37898709 | + | ENST00000445327 | TSF |
| 2% | chr1 | 1562829 | 1562875 | + | chr1 | 1563053 | 1563209 | + | ENST00000520777; ENST00000357210; ENST00000360522; ENST00000378710; ENST00000355826; ENST00000518681; ENST00000505820; ENST00000487053; ENST00000378712; ENST00000504599; ENST00000378708; ENST00000514234 | TSF |
| 2% | chr1 | 1562829 | 1562875 | + | chr1 | 1563053 | 1563209 | + | ENST00000520777; ENST00000357210; ENST00000360522; ENST00000378710; ENST00000355826; ENST00000518681; ENST00000505820; ENST00000487053; ENST00000378712; ENST00000504599; ENST00000378708; ENST00000514234 | TSF |
| 2% | chr1 | 1562829 | 1562875 | + | chr1 | 1563053 | 1563209 | + | ENST00000520777; ENST00000357210; ENST00000360522; ENST00000378710; ENST00000355826; ENST00000518681; ENST00000505820; ENST00000487053; ENST00000378712; ENST00000504599; ENST00000378708; ENST00000514234 | TSF |
| 2% | chr8 | 9629642 | 9629933 | + | chr8 | 9634160 | 9634246 | + | ENST00000310430; ENST00000518281 | TSF |
| 2% | chr4 | 2041574 | 2041819 | + | chr4 | 2044463 | 2044551 | + | ENST00000382878; ENST00000409248; ENST00000409860 | TSF |
| 2% | chr14 | 106174427 | 106174466 | + | chr14 | 106173770 | 106173505 | − | ENST00000390547 | TSF |
| 2% | chr1 | 31218846 | 31218765 | − | chr1 | 31215396 | 31215303 | − | ENST00000294507 | TSF |
| 2% | chr11 | 118917082 | 118917078 | − | chr11 | 118916543 | 118916493 | − | ENST00000404233; ENST00000529972; ENST00000525859 | TSF |
| 2% | chr11 | 118917082 | 118917078 | − | chr11 | 118916543 | 118916493 | − | ENST00000404233; ENST00000529972; ENST00000525859 | TSF |
| 2% | chr11 | 118917082 | 118917078 | − | chr11 | 118916543 | 118916493 | − | ENST00000404233; ENST00000529972; ENST00000525859 | TSF |
| 2% | chr3 | 128352356 | 128352306 | − | chr3 | 128351000 | 128350791 | − | ENST00000296255; ENST00000497289 | TSF |
| 2% | chr1 | 52343673 | 52343655 | − | chr1 | 52306186 | 52305898 | − | ENST00000352171; ENST00000354831 | TSF |
| 2% | chr1 | 52343673 | 52343655 | − | chr1 | 52306186 | 52305898 | − | ENST00000352171; ENST00000354831 | TSF |
| 2% | chrX | 134971303 | 134971006 | − | chrX | 134950187 | 134950078 | − | ENST00000420087; ENST00000463085; ENST00000370724; ENST00000491480 | TSF |
| 2% | chrX | 134971303 | 134971006 | − | chrX | 134950187 | 134950078 | − | ENST00000420087; ENST00000463085; ENST00000370724; ENST00000491480 | TSF |
| 2% | chr19 | 47347459 | 47347409 | − | chr19 | 47342835 | 47342722 | − | ENST00000352203; ENST00000601498; ENST00000599990; ENST00000593442; ENST00000263270; ENST00000597020 | TSF |
| 2% | chr15 | 93592614 | 93592599 | − | chr15 | 93588935 | 93588228; 93588877 | − | ENST00000425933; ENST00000543599; ENST00000329082; ENST00000542321; ENST00000538818; ENST00000557301; ENST00000557420; ENST00000556658 | TSF |
| 2% | chr15 | 93592614 | 93592599 | − | chr15 | 93588935 | 93588228; 93588877 | − | ENST00000425933; ENST00000543599; ENST00000329082; ENST00000542321; ENST00000538818; ENST00000557301; ENST00000557420; ENST00000556658 | TSF |
| 2% | chr12 | 14670381 | 14670239 | − | chr12 | 14664645 | 14664445 | − | ENST00000240617 | TSF |
| 2% | chr17 | 19015949 | 19015802 | − | chr17 | 18881199 | 18880897 | − | ENST00000388995; ENST00000585154; ENST00000345041; ENST00000580115 | TSF |
| 2% | chr17 | 19015949 | 19015802 | − | chr17 | 18881199 | 18880897 | − | ENST00000388995; ENST00000585154; ENST00000345041; ENST00000580115 | TSF |

TABLE 58-continued

Transcript fusion for Stomach adenocarcinoma (STAD) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 2% | chrX | 134971303 | 134971006 | − | chrX | 134967437 | 134967328 | − | ENST00000491002; ENST00000448053; ENST00000472834 | TSF |
| 2% | chr16 | 74833301 | 74833256 | − | chr16 | 74774013 | 74773921 | − | ENST00000219368; ENST00000567683; ENST00000569949 | TSF |
| 2% | chr16 | 74833301 | 74833256 | − | chr16 | 74774013 | 74773921 | − | ENST00000219368; ENST00000567683; ENST00000569949 | TSF |
| 2% | chr16 | 74833301 | 74833256 | − | chr16 | 74774013 | 74773921 | − | ENST00000219368; ENST00000567683; ENST00000569949 | TSF |
| 2% | chr9 | 130921922 | 130922014 | + | chr9 | 130925722 | 130925894 | + | ENST00000372994 | TSF |
| 2% | chr6 | 37326936 | 37327118 | + | chr6 | 37328222 | 37328350 | + | ENST00000373479; ENST00000229866; ENST00000394443; ENST00000469316; ENST00000469731 | TSF |
| 2% | chr6 | 37326936 | 37327118 | + | chr6 | 37328222 | 37328350 | + | ENST00000373479; ENST00000229866; ENST00000394443; ENST00000469316; ENST00000469731 | TSF |
| 2% | chr6 | 37326936 | 37327118 | + | chr6 | 37328222 | 37328350 | + | ENST00000373479; ENST00000229866; ENST00000394443; ENST00000469316; ENST00000469731 | TSF |
| 2% | chr6 | 37326936 | 37327118 | + | chr6 | 37328222 | 37328350 | + | ENST00000373479; ENST00000229866; ENST00000394443; ENST00000469316; ENST00000469731 | TSF |
| 2% | chr6 | 109426948 | 109427293 | + | chr6 | 109466422 | 109466584 | + | ENST00000523787 | TSF |
| 2% | chr19 | 45365700 | 45365943 | + | chr19 | 45368528 | 45368917 | + | ENST00000252485; ENST00000252483 | TSF |
| 2% | chr19 | 45365700 | 45365943 | + | chr19 | 45368528 | 45368917 | + | ENST00000252485; ENST00000252483 | TSF |
| 2% | chr6 | 31941780 | 31941829 | + | chr6 | 31946680 | 31946775; 31946787; 31946759 | + | ENST00000375331; ENST00000375333; ENST00000483801; ENST00000519179 | TSF |
| 2% | chr6 | 31941780 | 31941829 | + | chr6 | 31946680 | 31946775; 31946787; 31946759 | + | ENST00000375331; ENST00000375333; ENST00000483801; ENST00000519179 | TSF |
| 2% | chr6 | 31941780 | 31941829 | + | chr6 | 31946680 | 31946775; 31946787; 31946759 | + | ENST00000375331; ENST00000375333; ENST00000483801; ENST00000519179 | TSF |
| 2% | chr1 | 32605303 | 32605465 | + | chr1 | 32620189 | 32620322 | + | ENST00000373625; ENST00000471599; ENST00000545542 | TSF |
| 2% | chr1 | 32605303 | 32605465 | + | chr1 | 32620189 | 32620322 | + | ENST00000373625; ENST00000471599; ENST00000545542 | TSF |
| 2% | chr2 | 27666464 | 27666532 | + | chr2 | 27666816 | 27666923 | + | ENST00000543753; ENST00000288873; ENST00000407293; ENST00000452499 | TSF |
| 2% | chr3 | 184083167 | 184083362 | + | chr3 | 184084505 | 184084588 | + | ENST00000456318; ENST00000438240; ENST00000455712; ENST00000452961; ENST00000296223; ENST00000429568 | TSF |
| 2% | chr3 | 184083167 | 184083362 | + | chr3 | 184084505 | 184084588 | + | ENST00000456318; ENST00000438240; ENST00000455712; ENST00000452961; ENST00000296223; ENST00000429568 | TSF |
| 2% | chr3 | 184083167 | 184083362 | + | chr3 | 184084505 | 184084588 | + | ENST00000456318; ENST00000438240; ENST00000455712; ENST00000452961; ENST00000296223; ENST00000429568 | TSF |
| 2% | chrX | 69366031 | 69366077 | + | chrX | 69366483 | 69366678 | + | ENST00000342206; ENST00000356413 | TSF |
| 2% | chr1 | 1562829 | 1562926 | + | chr1 | 1563053 | 1563209 | + | ENST00000520777; ENST00000357210; ENST00000360522; ENST00000378710; ENST00000355826; ENST00000518681; ENST00000505820; ENST00000487053; ENST00000378712; ENST00000504599; ENST00000378708; ENST00000514234 | TSF |
| 2% | chr1 | 1562829 | 1562926 | + | chr1 | 1563053 | 1563209 | + | ENST00000520777; ENST00000357210; ENST00000360522; ENST00000378710; ENST00000355826; ENST00000518681; ENST00000505820; ENST00000487053; ENST00000378712; ENST00000504599; ENST00000378708; ENST00000514234 | TSF |
| 2% | chr1 | 1562829 | 1562926 | + | chr1 | 1563053 | 1563209 | + | ENST00000520777; ENST00000357210; ENST00000360522; ENST00000378710; ENST00000355826; ENST00000518681; ENST00000505820; ENST00000487053; ENST00000378712; ENST00000504599; ENST00000378708; ENST00000514234 | TSF |
| 2% | chr2 | 211417526 | 211417732 | + | chr2 | 211421443 | 211421583 | + | ENST00000523702; ENST00000430249 | TSF |
| 2% | chr2 | 211417526 | 211417732 | + | chr2 | 211421443 | 211421583 | + | ENST00000523702; ENST00000430249 | TSF |
| 2% | chr17 | 78263107 | 78263365 | + | chr17 | 78263458 | 78263636 | + | ENST00000508628; ENST00000456466; ENST00000582970; ENST00000319921 | TSF |
| 2% | chr17 | 78263107 | 78263365 | + | chr17 | 78263458 | 78263636 | + | ENST00000508628; ENST00000456466; ENST00000582970; ENST00000319921 | TSF |
| 2% | chr17 | 78263107 | 78263365 | + | chr17 | 78263458 | 78263636 | + | ENST00000508628; ENST00000456466; ENST00000582970; ENST00000319921 | TSF |
| 2% | chr15 | 44051756 | 44051953 | + | chr15 | 44053622 | 44053729 | + | ENST00000300289; ENST00000538521 | TSF |

TABLE 58-continued

Transcript fusion for Stomach adenocarcinoma (STAD) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 2% | chr2 | 171572610 | 171572610 | + | chr2 | 171572769 | 171573914 | + | ENST00000375281 | TSF |
| 2% | chr2 | 28191829 | 28192099 | + | chr2 | 28210860 | 28210954 | + | ENST00000436924; ENST00000344773; ENST00000379624; ENST00000342045; ENST00000361704; ENST00000379632; ENST00000379629; ENST00000604932 | TSF |
| 2% | chr2 | 28191829 | 28192099 | + | chr2 | 28210860 | 28210954 | + | ENST00000436924; ENST00000344773; ENST00000379624; ENST00000342045; ENST00000361704; ENST00000379632; ENST00000379629; ENST00000604932 | TSF |
| 2% | chr2 | 28191829 | 28192099 | + | chr2 | 28210860 | 28210954 | + | ENST00000436924; ENST00000344773; ENST00000379624; ENST00000342045; ENST00000361704; ENST00000379632; ENST00000379629; ENST00000604932 | TSF |
| 2% | chr2 | 28191829 | 28192099 | + | chr2 | 28210860 | 28210954 | + | ENST00000436924; ENST00000344773; ENST00000379624; ENST00000342045; ENST00000361704; ENST00000379632; ENST00000379629; ENST00000604932 | TSF |
| 2% | chr2 | 28191829 | 28192099 | + | chr2 | 28210860 | 28210954 | + | ENST00000436924; ENST00000344773; ENST00000379624; ENST00000342045; ENST00000361704; ENST00000379632; ENST00000379629; ENST00000604932 | TSF |
| 2% | chr2 | 28191829 | 28192099 | + | chr2 | 28210860 | 28210954 | + | ENST00000436924; ENST00000344773; ENST00000379624; ENST00000342045; ENST00000361704; ENST00000379632; ENST00000379629; ENST00000604932 | TSF |
| 2% | chr9 | 101724297 | 101724399 | + | chr9 | 101747847 | 101748394 | + | ENST00000375001 | TSF |
| 2% | chr15 | 74004214 | 74004264 | + | chr15 | 74005275 | 74005297 | + | ENST00000318443; ENST00000537340; ENST00000318424; ENST00000564751; ENST00000561176; ENST00000559073 | TSF |
| 2% | chrX | 17044209 | 17044386 | + | chrX | 17047649 | 17047746 | + | ENST00000357277; ENST00000303843; ENST00000380064 | TSF |
| 2% | chrX | 17044209 | 17044386 | + | chrX | 17047649 | 17047746 | + | ENST00000357277; ENST00000303843; ENST00000380064 | TSF |
| 2% | chr12 | 49659927 | 49660025 | + | chr12 | 49663248 | 49663470; 49663252 | + | ENST00000541364; ENST00000552125; ENST00000301072; ENST00000549183 | TSF |
| 2% | chr12 | 49659927 | 49660025 | + | chr12 | 49663248 | 49663470; 49663252 | + | ENST00000541364; ENST00000552125; ENST00000301072; ENST00000549183 | TSF |
| 2% | chr12 | 49659927 | 49660025 | + | chr12 | 49663248 | 49663470; 49663252 | + | ENST00000541364; ENST00000552125; ENST00000301072; ENST00000549183 | TSF |
| 2% | chr5 | 151074528 | 151074519 | − | chr5 | 151046027 | 151045922; 151045934 | − | ENST00000231061; ENST00000538026 | TSF |
| 2% | chr5 | 151074528 | 151074519 | − | chr5 | 151046027 | 151045922; 151045934 | − | ENST00000231061; ENST00000538026 | TSF |
| 2% | chr19 | 46395476 | 46395428 | − | chr19 | 46394581 | 46393881 | − | ENST00000322217 | TSF |
| 2% | chr3 | 45180920 | 45180844 | − | chr3 | 45160113 | 45159904 | − | ENST00000296129; ENST00000425231 | TSF |
| 2% | chr3 | 45180920 | 45180844 | − | chr3 | 45160113 | 45159904 | − | ENST00000296129; ENST00000425231 | TSF |
| 2% | chr8 | 74859521 | 74859471 | − | chr8 | 74859055 | 74858865; 74858935 | − | ENST00000518127; ENST00000520210; ENST00000520242; ENST00000519487; ENST00000284811; ENST00000522337; ENST00000523815; ENST00000519082 | TSF |
| 2% | chr8 | 74859521 | 74859471 | − | chr8 | 74859055 | 74858865; 74858935 | − | ENST00000518127; ENST00000520210; ENST00000520242; ENST00000519487; ENST00000284811; ENST00000522337; ENST00000523815; ENST00000519082 | TSF |
| 2% | chr4 | 873272 | 873014 | − | chr4 | 871597 | 871403 | − | ENST00000314167; ENST00000511163 | TSF |
| 2% | chr7 | 99257824 | 99257739 | − | chr7 | 99247855 | 99247696 | − | ENST00000222982; ENST00000343703 | TSF |
| 2% | chr17 | 30185561 | 30185499 | − | chr17 | 30183884 | 30183818 | − | ENST00000302362; ENST00000378634; ENST00000496655 | TSF |
| 2% | chr17 | 30185561 | 30185499 | − | chr17 | 30183884 | 30183818 | − | ENST00000302362; ENST00000378634; ENST00000496655 | TSF |
| 2% | chr19 | 36397290 | 36397240 | − | chr19 | 36395536 | 36395471 | − | ENST00000424586; ENST00000585901; ENST00000544690; ENST00000262629; ENST00000589517 | TSF |
| 2% | chr1 | 89663545 | 89663461 | − | chr1 | 89662987 | 89662793 | − | ENST00000355754 | TSF |
| 2% | chr2 | 38983894 | 38983253 | − | chr2 | 38977336 | 38977156 | − | ENST00000313117; ENST00000425778; ENST00000425941; ENST00000446327; ENST00000409276; ENST00000431066; ENST00000443213 | TSF |
| 2% | chr2 | 38983894 | 38983253 | − | chr2 | 38977336 | 38977156 | − | ENST00000313117; ENST00000425778; ENST00000425941; ENST00000446327; ENST00000409276; ENST00000431066; ENST00000443213 | TSF |
| 2% | chr2 | 38983894 | 38983253 | − | chr2 | 38977336 | 38977156 | − | ENST00000313117; ENST00000425778; ENST00000425941; ENST00000446327; ENST00000409276; ENST00000431066; ENST00000443213 | TSF |

TABLE 58-continued

Transcript fusion for Stomach adenocarcinoma (STAD) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 2% | chr2 | 38983894 | 38983253 | − | chr2 | 38977336 | 38977156 | − | ENST00000313117; ENST00000425778; ENST00000425941; ENST00000446327; ENST00000409276; ENST00000431066; ENST00000443213 | TSF |
| 2% | chr2 | 38983894 | 38983253 | − | chr2 | 38977336 | 38977156 | − | ENST00000313117; ENST00000425778; ENST00000425941; ENST00000446327; ENST00000409276; ENST00000431066; ENST00000443213 | TSF |
| 2% | chr14 | 92270099 | 92270000 | − | chr14 | 92268765 | 92268598 | − | ENST00000435962; ENST00000340892; ENST00000360594; ENST00000556018 | TSF |
| 2% | chr14 | 92270099 | 92270000 | − | chr14 | 92268765 | 92268598 | − | ENST00000435962; ENST00000340892; ENST00000360594; ENST00000556018 | TSF |
| 2% | chr2 | 27667813 | 27667765 | − | chr2 | 27667388 | 27667299 | − | ENST00000260570 | TSF |
| 2% | chr4 | 39699858 | 39699922 | + | chr4 | 39747372 | 39747430 | + | ENST00000261427; ENST00000510934; ENST00000295963; ENST00000445950 | TSF |
| 2% | chr4 | 39699858 | 39699922 | + | chr4 | 39747372 | 39747430 | + | ENST00000261427; ENST00000510934; ENST00000295963; ENST00000445950 | TSF |
| 2% | chr4 | 39699858 | 39699922 | + | chr4 | 39747372 | 39747430 | + | ENST00000261427; ENST00000510934; ENST00000295963; ENST00000445950 | TSF |
| 2% | chr4 | 39699858 | 39699922 | + | chr4 | 39747372 | 39747430 | + | ENST00000261427; ENST00000510934; ENST00000295963; ENST00000445950 | TSF |
| 2% | chr3 | 184639788 | 184640271 | + | chr3 | 184642650 | 184642769 | + | ENST00000287546; ENST00000437079; ENST00000436792; ENST00000446204 | TSF |
| 2% | chr7 | 6423751 | 6423803 | + | chr7 | 6426843 | 6426914 | + | ENST00000348035; ENST00000356142 | TSF |
| 2% | chr7 | 6423751 | 6423803 | + | chr7 | 6426843 | 6426914 | + | ENST00000348035; ENST00000356142 | TSF |
| 2% | chr19 | 16267516 | 16267584 | + | chr19 | 16268020 | 16268208; 16268205; 16268448; 16268139 | + | ENST00000253680; ENST00000397372; ENST00000593154; ENST00000588246; ENST00000593031 | TSF |
| 2% | chr19 | 16267516 | 16267584 | + | chr19 | 16268020 | 16268208; 16268205; 16268448; 16268139 | + | ENST00000253680; ENST00000397372; ENST00000593154; ENST00000588246; ENST00000593031 | TSF |
| 2% | chr19 | 16267516 | 16267584 | + | chr19 | 16268020 | 16268208; 16268205; 16268448; 16268139 | + | ENST00000253680; ENST00000397372; ENST00000593154; ENST00000588246; ENST00000593031 | TSF |
| 2% | chr19 | 16267516 | 16267584 | + | chr19 | 16268020 | 16268208; 16268205; 16268448; 16268139 | + | ENST00000253680; ENST00000397372; ENST00000593154; ENST00000588246; ENST00000593031 | TSF |
| 2% | chr17 | 66244121 | 66244199 | + | chr17 | 66244785 | 66244846 | + | ENST00000584837 | TSF |
| 2% | chr22 | 24967426 | 24967475 | + | chr22 | 24967884 | 24967945 | + | ENST00000215829; ENST00000404603 | TSF |
| 2% | chr2 | 219298180 | 219298229 | + | chr2 | 219299249 | 219299428 | + | ENST00000248444; ENST00000392114; ENST00000419986 | TSF |
| 2% | chr2 | 219298180 | 219298229 | + | chr2 | 219299249 | 219299428 | + | ENST00000248444; ENST00000392114; ENST00000419986 | TSF |
| 2% | chr22 | 45098289 | 45098289 | + | chr22 | 45098372 | 45098488 | + | ENST00000403581; ENST00000336985; ENST00000403696; ENST00000431834; ENST00000361473; ENST00000352766; ENST00000517296 | TSF |
| 2% | chr22 | 45098289 | 45098289 | + | chr22 | 45098372 | 45098488 | + | ENST00000403581; ENST00000336985; ENST00000403696; ENST00000431834; ENST00000361473; ENST00000352766; ENST00000517296 | TSF |
| 2% | chr22 | 45098289 | 45098289 | + | chr22 | 45098372 | 45098488 | + | ENST00000403581; ENST00000336985; ENST00000403696; ENST00000431834; ENST00000361473; ENST00000352766; ENST00000517296 | TSF |
| 2% | chr22 | 45098289 | 45098289 | + | chr22 | 45098372 | 45098488 | + | ENST00000403581; ENST00000336985; ENST00000403696; ENST00000431834; ENST00000361473; ENST00000352766; ENST00000517296 | TSF |
| 2% | chr22 | 45098289 | 45098289 | + | chr22 | 45098372 | 45098488 | + | ENST00000403581; ENST00000336985; ENST00000403696; ENST00000431834; ENST00000361473; ENST00000352766; ENST00000517296 | TSF |
| 2% | chr8 | 71625721 | 71625811 | + | chr8 | 71646031 | 71646659 | + | ENST00000408926; ENST00000520030 | TSF |
| 2% | chr7 | 156960055 | 156960055 | + | chr7 | 156961742 | 156961816 | + | ENST00000348165 | TSF |
| 2% | chr9 | 130921922 | 130922117 | + | chr9 | 130925722 | 130925894 | + | ENST00000372994 | TSF |
| 2% | chr20 | 61437613 | 61437613 | + | chr20 | 61438889 | 61438957 | + | ENST00000290291 | TSF |
| 2% | chr1 | 236326774 | 236327054 | + | chr1 | 236332006 | 236332055 | + | ENST00000366592; ENST00000454895 | TSF |
| 2% | chr1 | 236326774 | 236327054 | + | chr1 | 236332006 | 236332055 | + | ENST00000366592; ENST00000454895 | TSF |
| 2% | chr5 | 66046112 | 66046208 | + | chr5 | 66055537 | 66055690 | + | ENST00000404260; ENST00000403625; ENST00000406374; ENST00000406039 | TSF |
| 2% | chr5 | 66046112 | 66046208 | + | chr5 | 66055537 | 66055690 | + | ENST00000404260; ENST00000403625; | TSF |

TABLE 58-continued

Transcript fusion for Stomach adenocarcinoma (STAD) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 2% | chr5 | 66046112 | 66046208 | + | chr5 | 66055537 | 66055690 | + | ENST00000406374; ENST00000406039 ENST00000404260; ENST00000403625; ENST00000406374; ENST00000406039 | TSF |
| 2% | chr5 | 66046112 | 66046208 | + | chr5 | 66055537 | 66055690 | + | ENST00000404260; ENST00000403625; ENST00000406374; ENST00000406039 | TSF |
| 2% | chr7 | 134212336 | 134212386 | + | chr7 | 134215479 | 134215562 | + | ENST00000359579 | TSF |
| 2% | chr4 | 56227367 | 56227417 | + | chr4 | 56235999 | 56236258 | + | ENST00000264228; ENST00000505210 | TSF |
| 2% | chr1 | 23397020 | 23397118 | + | chr1 | 23397718 | 23397852 | + | ENST00000356634; ENST00000400181; ENST00000542151 | TSF |
| 2% | chr19 | 39144921 | 39144970 | + | chr19 | 39191240 | 39191354; 39191344 | + | ENST00000252699; ENST00000424234; ENST00000589528 | TSF |
| 2% | chr19 | 39144921 | 39144970 | + | chr19 | 39191240 | 39191354; 39191344 | + | ENST00000252699; ENST00000424234; ENST00000589528 | TSF |
| 2% | chr19 | 39144921 | 39144970 | + | chr19 | 39191240 | 39191354; 39191344 | + | ENST00000252699; ENST00000424234; ENST00000589528 | TSF |
| 2% | chr7 | 55464873 | 55464924 | + | chr7 | 55466116 | 55466323 | + | ENST00000254770 | TSF |
| 2% | chr21 | 42609094 | 42609191 | + | chr21 | 42609440 | 42609656 | + | ENST00000328735; ENST00000330333; ENST00000347667 | TSF |
| 2% | chr21 | 42609094 | 42609191 | + | chr21 | 42609440 | 42609656 | + | ENST00000328735; ENST00000330333; ENST00000347667 | TSF |
| 2% | chr21 | 42609094 | 42609191 | + | chr21 | 42609440 | 42609656 | + | ENST00000328735; ENST00000330333; ENST00000347667 | TSF |
| 2% | chr2 | 232340741 | 232340940 | + | chr2 | 232576105 | 232576119; 232576129 | + | ENST00000448874; ENST00000409321; ENST00000409115; ENST00000341369; ENST00000409683; ENST00000410064; ENST00000412128 | TSF |
| 2% | chr2 | 232340741 | 232340940 | + | chr2 | 232576105 | 232576119; 232576129 | + | ENST00000448874; ENST00000409321; ENST00000409115; ENST00000341369; ENST00000409683; ENST00000410064; ENST00000412128 | TSF |
| 2% | chr2 | 232340741 | 232340940 | + | chr2 | 232576105 | 232576119; 232576129 | + | ENST00000448874; ENST00000409321; ENST00000409115; ENST00000341369; ENST00000409683; ENST00000410064; ENST00000412128 | TSF |
| 2% | chr2 | 232340741 | 232340940 | + | chr2 | 232576105 | 232576119; 232576129 | + | ENST00000448874; ENST00000409321; ENST00000409115; ENST00000341369; ENST00000409683; ENST00000410064; ENST00000412128 | TSF |
| 2% | chrX | 134971303 | 134971006 | − | chrX | 134932924 | 134932815 | − | ENST00000487941; ENST00000434966; ENST00000494421 | TSF |
| 2% | chr5 | 39217816 | 39217739 | − | chr5 | 39203089 | 39201928 | − | ENST00000540520 | TSF |
| 2% | chr14 | 106258982 | 106258725 | − | chr14 | 106209234 | 106209114 | − | ENST00000390548; ENST00000390549; ENST00000390542 | TSF |
| 2% | chr14 | 106258982 | 106258725 | − | chr14 | 106209234 | 106209114 | − | ENST00000390548; ENST00000390549; ENST00000390542 | TSF |
| 2% | chr14 | 106258982 | 106258725 | − | chr14 | 106209234 | 106209114 | − | ENST00000390548; ENST00000390549; ENST00000390542 | TSF |
| 2% | chr5 | 179234950 | 179234884 | − | chr5 | 179228969 | 179228784 | − | ENST00000337755; ENST00000292591; ENST00000520918; ENST00000523329 | TSF |
| 2% | chr5 | 179234950 | 179234884 | − | chr5 | 179228969 | 179228784 | − | ENST00000337755; ENST00000292591; ENST00000520918; ENST00000523329 | TSF |
| 2% | chr5 | 179234950 | 179234884 | − | chr5 | 179228969 | 179228784 | − | ENST00000337755; ENST00000292591; ENST00000520918; ENST00000523329 | TSF |
| 2% | chr6 | 137536317 | 137536205 | − | chr6 | 137528214 | 137528100 | − | ENST00000367739; ENST00000543628; ENST00000458076; ENST00000367735; ENST00000414770 | TSF |
| 2% | chr6 | 137536317 | 137536205 | − | chr6 | 137528214 | 137528100 | − | ENST00000367739; ENST00000543628; ENST00000458076; ENST00000367735; ENST00000414770 | TSF |
| 2% | chr6 | 137536317 | 137536205 | − | chr6 | 137528214 | 137528100 | − | ENST00000367739; ENST00000543628; ENST00000458076; ENST00000367735; ENST00000414770 | TSF |
| 2% | chr6 | 137536317 | 137536205 | − | chr6 | 137528214 | 137528100 | − | ENST00000367739; ENST00000543628; ENST00000458076; ENST00000367735; ENST00000414770 | TSF |
| 2% | chr11 | 15114123 | 15112973 | − | chr6 | 32497961 | 32497902 | − | ENST00000374975 | TSF |
| 2% | chr20 | 32693720 | 32693709 | − | chr20 | 32693351 | 32693174 | − | ENST00000374980 | TSF |
| 2% | chr5 | 145541009 | 145540727 | − | chr5 | 145540049 | 145539937 | − | ENST00000394434; ENST00000545646; ENST00000274562; ENST00000510191 | TSF |
| 2% | chr1 | 48839622 | 48839346 | − | chr1 | 48825442 | 48825258 | − | ENST00000371847; ENST00000371843; ENST00000396199; ENST00000371841 | TSF |
| 2% | chr1 | 48839622 | 48839346 | − | chr1 | 48825442 | 48825258 | − | ENST00000371847; ENST00000371843; ENST00000396199; ENST00000371841 | TSF |
| 2% | chr1 | 48839622 | 48839346 | − | chr1 | 48825442 | 48825258 | − | ENST00000371847; ENST00000371843; ENST00000396199; ENST00000371841 | TSF |
| 2% | chr14 | 106258982 | 106258725 | − | chr14 | 106237569 | 106237449 | − | ENST00000390551 | TSF |

TABLE 58-continued

Transcript fusion for Stomach adenocarcinoma (STAD) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 2% | chr19 | 48889673 | 48889623 | − | chr19 | 48887655 | 48887487; 48887496 | − | ENST00000330720; ENST00000597017; ENST00000600980 | TSF |
| 2% | chr19 | 48889673 | 48889623 | − | chr19 | 48887655 | 48887487; 48887496 | − | ENST00000330720; ENST00000597017; ENST00000600980 | TSF |
| 2% | chr7 | 48039730 | 48039725 | − | chr7 | 48035743 | 48035628 | − | ENST00000453071; ENST00000297325; ENST00000412371; ENST00000412142; ENST00000395572; ENST00000453192; ENST00000438771 | TSF |
| 2% | chr7 | 48039730 | 48039725 | − | chr7 | 48035743 | 48035628 | − | ENST00000453071; ENST00000297325; ENST00000412371; ENST00000412142; ENST00000395572; ENST00000453192; ENST00000438771 | TSF |
| 2% | chr7 | 48039730 | 48039725 | − | chr7 | 48035743 | 48035628 | − | ENST00000453071; ENST00000297325; ENST00000412371; ENST00000412142; ENST00000395572; ENST00000453192; ENST00000438771 | TSF |
| 2% | chr17 | 38649720 | 38649640 | − | chr17 | 38645221 | 38644798 | − | ENST00000254051 | TSF |
| 2% | chr19 | 39309918 | 39309912 | − | chr19 | 39308215 | 39308091; 39308111 | − | ENST00000221418; ENST00000601778; ENST00000595470; ENST00000594769; ENST00000602021 | TSF |
| 2% | chr19 | 39309918 | 39309912 | − | chr19 | 39308215 | 39308091; 39308111 | − | ENST00000221418; ENST00000601778; ENST00000595470; ENST00000594769; ENST00000602021 | TSF |
| 2% | chr19 | 39309918 | 39309912 | − | chr19 | 39308215 | 39308091; 39308111 | − | ENST00000221418; ENST00000601778; ENST00000595470; ENST00000594769; ENST00000602021 | TSF |
| 2% | chr19 | 39309918 | 39309912 | − | chr19 | 39308215 | 39308091; 39308111 | − | ENST00000221418; ENST00000601778; ENST00000595470; ENST00000594769; ENST00000602021 | TSF |
| 2% | chr6 | 31660537 | 31660355 | − | chr6 | 31659695 | 31659581 | − | ENST00000395952; ENST00000440843 | TSF |
| 2% | chr22 | 21355965 | 21355835 | − | chr22 | 21355700 | 21355545 | − | ENST00000215742; ENST00000399133 | TSF |
| 2% | chr8 | 3040579 | 3040513 | − | chr8 | 3038736 | 3038632 | − | ENST00000335551; ENST00000400186; ENST00000602723; ENST00000520002; ENST00000602557; ENST00000537824; ENST00000542608; ENST00000539096 | TSF |
| 2% | chr8 | 3040579 | 3040513 | − | chr8 | 3038736 | 3038632 | − | ENST00000335551; ENST00000400186; ENST00000602723; ENST00000520002; ENST00000602557; ENST00000537824; ENST00000542608; ENST00000539096 | TSF |
| 2% | chr8 | 3040579 | 3040513 | − | chr8 | 3038736 | 3038632 | − | ENST00000335551; ENST00000400186; ENST00000602723; ENST00000520002; ENST00000602557; ENST00000537824; ENST00000542608; ENST00000539096 | TSF |
| 2% | chr8 | 3040579 | 3040513 | − | chr8 | 3038736 | 3038632 | − | ENST00000335551; ENST00000400186; ENST00000602723; ENST00000520002; ENST00000602557; ENST00000537824; ENST00000542608; ENST00000539096 | TSF |
| 2% | chr17 | 37886362 | 37886333 | − | chr17 | 37886014 | 37885938; 37885851 | − | ENST00000394231; ENST00000577810 | TSF |
| 2% | chr17 | 37886362 | 37886333 | − | chr17 | 37886014 | 37885938; 37885851 | − | ENST00000394231; ENST00000577810 | TSF |
| 2% | chr1 | 109479016 | 109478866 | − | chr1 | 109477564 | 109477292 | − | ENST00000369968; ENST00000369969; ENST00000356970; ENST00000369971; ENST00000415331; ENST00000369970; ENST00000302500; ENST00000348264 | TSF |
| 2% | chr5 | 10728215 | 10728097 | − | chr5 | 10683683 | 10683641 | − | ENST00000230895 | TSF |
| 2% | chr8 | 101933557 | 101933272 | − | chr8 | 101932980 | 101932921; 101932944 | − | ENST00000395957; ENST00000395958; ENST00000457309; ENST00000395956; ENST00000353245; ENST00000523848; ENST00000522542; ENST00000521309; ENST00000522819; ENST00000395953; ENST00000395948; ENST00000395951; ENST00000419477; ENST00000521607 | TSF |
| 2% | chr8 | 101933557 | 101933272 | − | chr8 | 101932980 | 101932921; 101932944 | − | ENST00000395957; ENST00000395958; ENST00000457309; ENST00000395956; ENST00000353245; ENST00000523848; ENST00000522542; ENST00000521309; ENST00000522819; ENST00000395953; ENST00000395948; ENST00000395951; ENST00000419477; ENST00000521607 | TSF |
| 2% | chr14 | 50053298 | 50053490 | + | chr14 | 50166790 | 50166875 | + | ENST00000555704 | TSF |
| 2% | chr2 | 242276229 | 242276234 | + | chr2 | 242276797 | 242276931; 242276900; 242276863; 242276848 | + | ENST00000391973; ENST00000428282; ENST00000360051; ENST00000391971; ENST00000401990; ENST00000407971; ENST00000436795; ENST00000411484; ENST00000402092; ENST00000443492; | TSF |

TABLE 58-continued

Transcript fusion for Stomach adenocarcinoma (STAD) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 2% | chr2 | 242276229 | 242276234 | + | chr2 | 242276797 | 242276931; 242276900; 242276863; 242276848 | + | ENST00000391973; ENST00000428282; ENST00000360051; ENST00000391971; ENST00000401990; ENST00000407971; ENST00000436795; ENST00000411484; ENST00000402092; ENST00000443492; ENST00000437066; ENST00000449239; ENST00000457874 | TSF |
| 2% | chr2 | 242276229 | 242276234 | + | chr2 | 242276797 | 242276931; 242276900; 242276863; 242276848 | + | ENST00000391973; ENST00000428282; ENST00000360051; ENST00000391971; ENST00000401990; ENST00000407971; ENST00000436795; ENST00000411484; ENST00000402092; ENST00000443492; ENST00000437066; ENST00000449239; ENST00000457874 | TSF |
| 2% | chr2 | 242276229 | 242276234 | + | chr2 | 242276797 | 242276931; 242276900; 242276863; 242276848 | + | ENST00000391973; ENST00000428282; ENST00000360051; ENST00000391971; ENST00000401990; ENST00000407971; ENST00000436795; ENST00000411484; ENST00000402092; ENST00000443492; ENST00000437066; ENST00000449239; ENST00000457874 | TSF |
| 2% | chr2 | 242276229 | 242276234 | + | chr2 | 242276797 | 242276931; 242276900; 242276863; 242276848 | + | ENST00000391973; ENST00000428282; ENST00000360051; ENST00000391971; ENST00000401990; ENST00000407971; ENST00000436795; ENST00000411484; ENST00000402092; ENST00000443492; ENST00000437066; ENST00000449239; ENST00000457874 | TSF |
| 2% | chr2 | 242276229 | 242276234 | + | chr2 | 242276797 | 242276931; 242276900; 242276863; 242276848 | + | ENST00000391973; ENST00000428282; ENST00000360051; ENST00000391971; ENST00000401990; ENST00000407971; ENST00000436795; ENST00000411484; ENST00000402092; ENST00000443492; ENST00000437066; ENST00000449239; ENST00000457874 | TSF |
| 2% | chr2 | 242276229 | 242276234 | + | chr2 | 242276797 | 242276931; 242276900; 242276863; 242276848 | + | ENST00000391973; ENST00000428282; ENST00000360051; ENST00000391971; ENST00000401990; ENST00000407971; ENST00000436795; ENST00000411484; ENST00000402092; ENST00000443492; ENST00000437066; ENST00000449239; ENST00000457874 | TSF |
| 2% | chr2 | 242276229 | 242276234 | + | chr2 | 242276797 | 242276931; 242276900; 242276863; 242276848 | + | ENST00000391973; ENST00000428282; ENST00000360051; ENST00000391971; ENST00000401990; ENST00000407971; ENST00000436795; ENST00000411484; ENST00000402092; ENST00000443492; ENST00000437066; ENST00000449239; ENST00000457874 | TSF |
| 2% | chr3 | 9476647 | 9476785 | + | chr3 | 9477412 | 9477509; 9477590 | + | ENST00000450326; ENST00000402198; ENST00000402466; ENST00000406341; ENST00000407969; ENST00000442373; ENST00000302463 | TSF |
| 2% | chr3 | 9476647 | 9476785 | + | chr3 | 9477412 | 9477509; 9477590 | + | ENST00000450326; ENST00000402198; ENST00000402466; ENST00000406341; ENST00000407969; ENST00000442373; ENST00000302463 | TSF |
| 2% | chr3 | 9476647 | 9476785 | + | chr3 | 9477412 | 9477509; 9477590 | + | ENST00000450326; ENST00000402198; ENST00000402466; ENST00000406341; ENST00000407969; ENST00000442373; ENST00000302463 | TSF |
| 2% | chr3 | 9476647 | 9476785 | + | chr3 | 9477412 | 9477509; 9477590 | + | ENST00000450326; ENST00000402198; ENST00000402466; ENST00000406341; ENST00000407969; ENST00000442373; ENST00000302463 | TSF |
| 2% | chr7 | 55477082 | 55477474 | + | chr7 | 55479600 | 55479782 | + | ENST00000254770 | TSF |
| 2% | chr16 | 2525097 | 2525171 | + | chr16 | 2569219 | 2569384; 2569402 | + | ENST00000564543; ENST00000330398; ENST00000568562 | TSF |
| 2% | chr16 | 2525097 | 2525171 | + | chr16 | 2569219 | 2569384; 2569402 | + | ENST00000564543; ENST00000330398; ENST00000568562 | TSF |
| 2% | chr3 | 170075519 | 170075551 | + | chr3 | 170099032 | 170099129 | + | ENST00000259119; ENST00000426052; ENST00000413427; ENST00000458537; ENST00000470571 | TSF |
| 2% | chr3 | 170075519 | 170075551 | + | chr3 | 170099032 | 170099129 | + | ENST00000259119; ENST00000426052; | TSF |

TABLE 58-continued

Transcript fusion for Stomach adenocarcinoma (STAD) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 2% | chr3 | 170075519 | 170075551 | + | chr3 | 170099032 | 170099129 | + | ENST00000413427; ENST00000458537; ENST00000470571 ENST00000259119; ENST00000426052; ENST00000413427; ENST00000458537; ENST00000470571 | TSF |
| 2% | chr7 | 99779289 | 99779427 | + | chr7 | 99779713 | 99779815 | + | ENST00000426455; ENST00000394018; ENST00000416412; ENST00000317296; ENST00000422690; ENST00000439782 | TSF |
| 2% | chr7 | 99779289 | 99779427 | + | chr7 | 99779713 | 99779815 | + | ENST00000426455; ENST00000394018; ENST00000416412; ENST00000317296; ENST00000422690; ENST00000439782 | TSF |
| 2% | chr7 | 99779289 | 99779427 | + | chr7 | 99779713 | 99779815 | + | ENST00000426455; ENST00000394018; ENST00000416412; ENST00000317296; ENST00000422690; ENST00000439782 | TSF |
| 2% | chr7 | 99779289 | 99779427 | + | chr7 | 99779713 | 99779815 | + | ENST00000426455; ENST00000394018; ENST00000416412; ENST00000317296; ENST00000422690; ENST00000439782 | TSF |
| 2% | chr7 | 99779289 | 99779427 | + | chr7 | 99779713 | 99779815 | + | ENST00000426455; ENST00000394018; ENST00000416412; ENST00000317296; ENST00000422690; ENST00000439782 | TSF |
| 2% | chr8 | 21954408 | 21954458 | + | chr8 | 21955027 | 21955131 | + | ENST00000450006; ENST00000289921 | TSF |
| 2% | chr2 | 232340741 | 232340940 | + | chr2 | 232576649 | 232576693 | + | ENST00000409321; ENST00000409115; ENST00000341369; ENST00000409683; ENST00000410064; ENST00000412128 | TSF |
| 2% | chr2 | 232340741 | 232340940 | + | chr2 | 232576649 | 232576693 | + | ENST00000409321; ENST00000409115; ENST00000341369; ENST00000409683; ENST00000410064; ENST00000412128 | TSF |
| 2% | chr16 | 2205826 | 2205859 | + | chr16 | 2215880 | 2215937 | + | ENST00000326181; ENST00000564067; ENST00000567645 | TSF |
| 2% | chr16 | 2205826 | 2205859 | + | chr16 | 2215880 | 2215937 | + | ENST00000326181; ENST00000564067; ENST00000567645 | TSF |
| 2% | chr16 | 2205826 | 2205859 | + | chr16 | 2215880 | 2215937 | + | ENST00000326181; ENST00000564067; ENST00000567645 | TSF |
| 2% | chr20 | 3776424 | 3776526 | + | chr20 | 3779059 | 3779110 | + | ENST00000344256; ENST00000379598; ENST00000245960; ENST00000439880; ENST00000340833 | TSF |
| 2% | chr20 | 3776424 | 3776526 | + | chr20 | 3779059 | 3779110 | + | ENST00000344256; ENST00000379598; ENST00000245960; ENST00000439880; ENST00000340833 | TSF |
| 2% | chr20 | 3776424 | 3776526 | + | chr20 | 3779059 | 3779110 | + | ENST00000344256; ENST00000379598; ENST00000245960; ENST00000439880; ENST00000340833 | TSF |
| 2% | chr7 | 66414193 | 66414197 | + | chr7 | 66415939 | 66416122 | + | ENST00000341567 | TSF |
| 2% | chr20 | 25146273 | 25146366 | + | chr20 | 25249765 | 25249843 | + | ENST00000216962 | TSF |
| 2% | chrX | 134883429 | 134883726 | + | chrX | 134887292 | 134887401 | + | ENST00000370734; ENST00000485366; ENST00000443882 | TSF |
| 2% | chr12 | 4757939 | 4757967 | + | chr12 | 4763458 | 4763628 | + | ENST00000266544; ENST00000535050 | TSF |
| 2% | chr12 | 4757939 | 4757967 | + | chr12 | 4763458 | 4763628 | + | ENST00000266544; ENST00000535050 | TSF |
| 2% | chr7 | 73816114 | 73816214 | + | chr7 | 73818167 | 73818178 | + | ENST00000361545; ENST00000223398; ENST00000395060; ENST00000487447 | TSF |
| 2% | chr2 | 26309164 | 26309786 | + | chr2 | 26321531 | 26321591 | + | ENST00000264710 | TSF |
| 2% | chr20 | 44501760 | 44501827 | + | chr20 | 44520650 | 44520666 | + | ENST00000606788; ENST00000372484; ENST00000354880; ENST00000191018; ENST00000607482; ENST00000372459 | TSF |
| 2% | chr20 | 44501760 | 44501827 | + | chr20 | 44520650 | 44520666 | + | ENST00000606788; ENST00000372484; ENST00000354880; ENST00000191018; ENST00000607482; ENST00000372459 | TSF |
| 2% | chr20 | 44501760 | 44501827 | + | chr20 | 44520650 | 44520666 | + | ENST00000606788; ENST00000372484; ENST00000354880; ENST00000191018; ENST00000607482; ENST00000372459 | TSF |
| 2% | chr20 | 44501760 | 44501827 | + | chr20 | 44520650 | 44520666 | + | ENST00000606788; ENST00000372484; ENST00000354880; ENST00000191018; ENST00000607482; ENST00000372459 | TSF |
| 2% | chr3 | 170097741 | 170097776 | + | chr3 | 170099032 | 170099129 | + | ENST00000259119; ENST00000426052; ENST00000413427; ENST00000458537; ENST00000470571 | TSF |
| 2% | chr3 | 170097741 | 170097776 | + | chr3 | 170099032 | 170099129 | + | ENST00000259119; ENST00000426052; ENST00000413427; ENST00000458537; ENST00000470571 | TSF |
| 2% | chr3 | 170097741 | 170097776 | + | chr3 | 170099032 | 170099129 | + | ENST00000259119; ENST00000426052; ENST00000413427; ENST00000458537; ENST00000470571 | TSF |
| 2% | chr15 | 89717587 | 89717675 | + | chr15 | 89719043 | 89719226 | + | ENST00000352732; ENST00000565973; ENST00000355100 | TSF |
| 2% | chr16 | 28838911 | 28839140 | + | chr16 | 28840722 | 28840813 | + | ENST00000340394; ENST00000325215; ENST00000336783; ENST00000382686; | TSF |

TABLE 58-continued

Transcript fusion for Stomach adenocarcinoma (STAD) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 2% | chr16 | 28838911 | 28839140 | + | chr16 | 28840722 | 28840813 | + | ENST00000395547; ENST00000564304; ENST00000570200; ENST00000568266 ENST00000340394; ENST00000325215; ENST00000336783; ENST00000382686; | TSF |
| 2% | chr16 | 28838911 | 28839140 | + | chr16 | 28840722 | 28840813 | + | ENST00000395547; ENST00000564304; ENST00000570200; ENST00000568266 ENST00000340394; ENST00000325215; ENST00000336783; ENST00000382686; | TSF |
| 2% | chr16 | 28838911 | 28839140 | + | chr16 | 28840722 | 28840813 | + | ENST00000395547; ENST00000564304; ENST00000570200; ENST00000568266 ENST00000340394; ENST00000325215; ENST00000336783; ENST00000382686; | TSF |
| 2% | chr16 | 28838911 | 28839140 | + | chr16 | 28840722 | 28840813 | + | ENST00000395547; ENST00000564304; ENST00000570200; ENST00000568266 ENST00000340394; ENST00000325215; ENST00000336783; ENST00000382686; | TSF |
| 2% | chr16 | 28838911 | 28839140 | + | chr16 | 28840722 | 28840813 | + | ENST00000395547; ENST00000564304; ENST00000570200; ENST00000568266 ENST00000340394; ENST00000325215; ENST00000336783; ENST00000382686; | TSF |
| 2% | chr16 | 28838911 | 28839140 | + | chr16 | 28840722 | 28840813 | + | ENST00000395547; ENST00000564304; ENST00000570200; ENST00000568266 ENST00000340394; ENST00000325215; ENST00000336783; ENST00000382686; | TSF |
| 2% | chr16 | 28838911 | 28839140 | + | chr16 | 28840722 | 28840813 | + | ENST00000395547; ENST00000564304; ENST00000570200; ENST00000568266 ENST00000340394; ENST00000325215; ENST00000336783; ENST00000382686; | TSF |
| 2% | chr11 | 67803205 | 67803255 | + | chr11 | 67803929 | 67804060; 67803981 | + | ENST00000313468; ENST00000528492; ENST00000526339 | TSF |
| 2% | chr11 | 67803205 | 67803255 | + | chr11 | 67803929 | 67804060; 67803981 | + | ENST00000313468; ENST00000528492; ENST00000526339 | TSF |
| 2% | chr12 | 123873690 | 123873729 | + | chr12 | 123873984 | 123874101 | + | ENST00000330479; ENST00000402868 | TSF |
| 2% | chr12 | 133142351 | 133142413 | + | chr12 | 133144067 | 133144112 | + | ENST00000434748; ENST00000261673 | TSF |
| 2% | chr12 | 50813695 | 50814670 | + | chr12 | 50821548 | 50821692 | + | ENST00000293618; ENST00000429001; ENST00000548174; ENST00000398473; ENST00000522085; ENST00000518444; ENST00000551886; ENST00000347328; ENST00000550260 | TSF |
| 2% | chr12 | 50813695 | 50814670 | + | chr12 | 50821548 | 50821692 | + | ENST00000293618; ENST00000429001; ENST00000548174; ENST00000398473; ENST00000522085; ENST00000518444; ENST00000551886; ENST00000347328; ENST00000550260 | TSF |
| 2% | chr12 | 50813695 | 50814670 | + | chr12 | 50821548 | 50821692 | + | ENST00000293618; ENST00000429001; ENST00000548174; ENST00000398473; ENST00000522085; ENST00000518444; ENST00000551886; ENST00000347328; ENST00000550260 | TSF |
| 2% | chr12 | 50813695 | 50814670 | + | chr12 | 50821548 | 50821692 | + | ENST00000293618; ENST00000429001; ENST00000548174; ENST00000398473; ENST00000522085; ENST00000518444; ENST00000551886; ENST00000347328; ENST00000550260 | TSF |
| 2% | chr12 | 50813695 | 50814670 | + | chr12 | 50821548 | 50821692 | + | ENST00000293618; ENST00000429001; ENST00000548174; ENST00000398473; ENST00000522085; ENST00000518444; ENST00000551886; ENST00000347328; ENST00000550260 | TSF |
| 2% | chr12 | 50813695 | 50814670 | + | chr12 | 50821548 | 50821692 | + | ENST00000293618; ENST00000429001; ENST00000548174; ENST00000398473; ENST00000522085; ENST00000518444; ENST00000551886; ENST00000347328; ENST00000550260 | TSF |
| 2% | chr12 | 50813695 | 50814670 | + | chr12 | 50821548 | 50821692 | + | ENST00000293618; ENST00000429001; ENST00000548174; ENST00000398473; ENST00000522085; ENST00000518444; ENST00000551886; ENST00000347328; ENST00000550260 | TSF |
| 2% | chr12 | 50813695 | 50814670 | + | chr12 | 50821548 | 50821692 | + | ENST00000293618; ENST00000429001; ENST00000548174; ENST00000398473; ENST00000522085; ENST00000518444; ENST00000551886; ENST00000347328; ENST00000550260 | TSF |

TABLE 58-continued

Transcript fusion for Stomach adenocarcinoma (STAD) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 2% | chr8 | 128749913 | 128749923 | + | chr8 | 128750494 | 128751265 | + | ENST00000377970 | TSF |
| 2% | chr19 | 50391349 | 50391391 | + | chr19 | 50391488 | 50391574 | + | ENST00000221543; ENST00000535102 | TSF |
| 2% | chr7 | 30847611 | 30847863 | + | chr7 | 30868295 | 30868353 | + | ENST00000265299 | TSF |
| 2% | chr20 | 389765 | 390021 | + | chr20 | 390525 | 390669 | + | ENST00000411647; ENST00000382214; ENST00000356286; ENST00000415942; ENST00000475269 | TSF |
| 2% | chr20 | 389765 | 390021 | + | chr20 | 390525 | 390669 | + | ENST00000411647; ENST00000382214; ENST00000356286; ENST00000415942; ENST00000475269 | TSF |
| 2% | chr20 | 389765 | 390021 | + | chr20 | 390525 | 390669 | + | ENST00000411647; ENST00000382214; ENST00000356286; ENST00000415942; ENST00000475269 | TSF |
| 2% | chr20 | 389765 | 390021 | + | chr20 | 390525 | 390669 | + | ENST00000411647; ENST00000382214; ENST00000356286; ENST00000415942; ENST00000475269 | TSF |
| 2% | chr20 | 389765 | 390021 | + | chr20 | 390525 | 390669 | + | ENST00000411647; ENST00000382214; ENST00000356286; ENST00000415942; ENST00000475269 | TSF |
| 2% | chr1 | 222838237 | 222838358 | + | chr1 | 222838651 | 222838961 | + | ENST00000344922; ENST00000344441; ENST00000340535 | TSF |
| 2% | chr19 | 36405278 | 36405224 | − | chr19 | 36398166 | 36398120 | − | ENST00000585901; ENST00000544690; ENST00000262629 | TSF |
| 2% | chr1 | 154581117 | 154581067 | − | chr1 | 154575102 | 154573517 | − | ENST00000292205; ENST00000368474; ENST00000529168 | TSF |
| 2% | chr1 | 154581117 | 154581067 | − | chr1 | 154575102 | 154573517 | − | ENST00000292205; ENST00000368474; ENST00000529168 | TSF |
| 2% | chr6 | 32547977 | 32547972 | − | chr6 | 32546881 | 32546868 | − | ENST00000360004 | TSF |
| 2% | chr2 | 163165782 | 163165417 | − | chr2 | 163163365 | 163163219 | − | ENST00000263642 | TSF |
| 2% | chr3 | 128721625 | 128721589 | − | chr3 | 128706672 | 128706459 | − | ENST00000511438; ENST00000265068; ENST00000515659 | TSF |
| 2% | chr3 | 128721625 | 128721589 | − | chr3 | 128706672 | 128706459 | − | ENST00000511438; ENST00000265068; ENST00000515659 | TSF |
| 2% | chr13 | 45925262 | 45925234 | − | chr13 | 45914303 | 45914129 | − | ENST00000379056; ENST00000530705; ENST00000379060; ENST00000379055; ENST00000309246; ENST00000527226 | TSF |
| 2% | chr13 | 45925262 | 45925234 | − | chr13 | 45914303 | 45914129 | − | ENST00000379056; ENST00000530705; ENST00000379060; ENST00000379055; ENST00000309246; ENST00000527226 | TSF |
| 2% | chr13 | 45925262 | 45925234 | − | chr13 | 45914303 | 45914129 | − | ENST00000379056; ENST00000530705; ENST00000379060; ENST00000379055; ENST00000309246; ENST00000527226 | TSF |
| 2% | chr9 | 130715295 | 130715152 | − | chr9 | 130712818 | 130712702 | − | ENST00000373095 | TSF |
| 2% | chr15 | 40187476 | 40186733 | − | chr15 | 40099459 | 40099207 | − | ENST00000561100; ENST00000543580 | TSF |
| 2% | chr17 | 5014630 | 5014371 | − | chr17 | 5013063 | 5012689; 5012527 | − | ENST00000575898; ENST00000250076; ENST00000416429 | TSF |
| 2% | chr17 | 5014630 | 5014371 | − | chr17 | 5013063 | 5012689; 5012527 | − | ENST00000575898; ENST00000250076; ENST00000416429 | TSF |
| 2% | chr17 | 5014630 | 5014371 | − | chr17 | 5013063 | 5012689; 5012527 | − | ENST00000575898; ENST00000250076; ENST00000416429 | TSF |
| 2% | chrX | 48708290 | 48708228 | − | chrX | 48690751 | 48690279 | − | ENST00000218230 | TSF |
| 2% | chrX | 53579130 | 53578958 | − | chrX | 53578441 | 53578227 | − | ENST00000427052; ENST00000342160; ENST00000262854 | TSF |
| 2% | chr4 | 83752701 | 83752626 | − | chr4 | 83752128 | 83752090 | − | ENST00000503937; ENST00000432794 | TSF |
| 2% | chr2 | 31719227 | 31719225 | − | chr2 | 31628830 | 31628773 | − | ENST00000379416 | TSF |
| 2% | chr18 | 47213717 | 47213643 | − | chr18 | 47017800 | 47017775 | − | ENST00000584895; ENST00000577910; ENST00000579408; ENST00000579248; ENST00000580261; ENST00000418495; ENST00000580210; ENST00000583637; ENST00000578532; ENST00000583036; ENST00000580387; ENST00000578528 | TSF |
| 2% | chr18 | 47213717 | 47213643 | − | chr18 | 47017800 | 47017775 | − | ENST00000584895; ENST00000577910; ENST00000579408; ENST00000579248; ENST00000580261; ENST00000418495; ENST00000580210; ENST00000583637; ENST00000578532; ENST00000583036; ENST00000580387; ENST00000578528 | TSF |
| 2% | chr18 | 47213717 | 47213643 | − | chr18 | 47017800 | 47017775 | − | ENST00000584895; ENST00000577910; ENST00000579408; ENST00000579248; ENST00000580261; ENST00000418495; ENST00000580210; ENST00000583637; ENST00000578532; ENST00000583036; ENST00000580387; ENST00000578528 | TSF |
| 2% | chr18 | 47213717 | 47213643 | − | chr18 | 47017800 | 47017775 | − | ENST00000584895; ENST00000577910; ENST00000579408; ENST00000579248; ENST00000580261; ENST00000418495; ENST00000580210; ENST00000583637; | TSF |

TABLE 58-continued

Transcript fusion for Stomach adenocarcinoma (STAD) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 2% | chr18 | 47213717 | 47213643 | − | chr18 | 47017800 | 47017775 | − | ENST00000578532; ENST00000583036; ENST00000580387; ENST00000578528 ENST00000584895; ENST00000577910; ENST00000579408; ENST00000579248; ENST00000580261; ENST00000418495; ENST00000580210; ENST00000583637; | TSF |
| 2% | chr18 | 47213717 | 47213643 | − | chr18 | 47017800 | 47017775 | − | ENST00000578532; ENST00000583036; ENST00000580387; ENST00000578528 ENST00000584895; ENST00000577910; ENST00000579408; ENST00000579248; ENST00000580261; ENST00000418495; ENST00000580210; ENST00000583637; | TSF |
| 2% | chr18 | 47213717 | 47213643 | − | chr18 | 47017800 | 47017775 | − | ENST00000578532; ENST00000583036; ENST00000580387; ENST00000578528 ENST00000584895; ENST00000577910; ENST00000579408; ENST00000579248; ENST00000580261; ENST00000418495; ENST00000580210; ENST00000583637; ENST00000578532; ENST00000583036; ENST00000580387; ENST00000578528 | TSF |
| 2% | chr8 | 63949410 | 63948932 | − | chr8 | 63948329 | 63948215 | − | ENST00000260118 | TSF |
| 2% | chr7 | 102212392 | 102212170 | − | chr7 | 102210371 | 102210282 | − | ENST00000489144; ENST00000379340; ENST00000486319; ENST00000508848; ENST00000513506; ENST00000514917; ENST00000507355; ENST00000608621; ENST00000511313; ENST00000513438 | TSF |
| 2% | chr7 | 102212392 | 102212170 | − | chr7 | 102210371 | 102210282 | − | ENST00000489144; ENST00000379340; ENST00000486319; ENST00000508848; ENST00000513506; ENST00000514917; ENST00000507355; ENST00000608621; ENST00000511313; ENST00000513438 | TSF |
| 2% | chr7 | 102212392 | 102212170 | − | chr7 | 102210371 | 102210282 | − | ENST00000489144; ENST00000379340; ENST00000486319; ENST00000508848; ENST00000513506; ENST00000514917; ENST00000507355; ENST00000608621; ENST00000511313; ENST00000513438 | TSF |
| 2% | chr7 | 102212392 | 102212170 | − | chr7 | 102210371 | 102210282 | − | ENST00000489144; ENST00000379340; ENST00000486319; ENST00000508848; ENST00000513506; ENST00000514917; ENST00000507355; ENST00000608621; ENST00000511313; ENST00000513438 | TSF |
| 2% | chr7 | 102212392 | 102212170 | − | chr7 | 102210371 | 102210282 | − | ENST00000489144; ENST00000379340; ENST00000486319; ENST00000508848; ENST00000513506; ENST00000514917; ENST00000507355; ENST00000608621; ENST00000511313; ENST00000513438 | TSF |
| 2% | chr7 | 102212392 | 102212170 | − | chr7 | 102210371 | 102210282 | − | ENST00000489144; ENST00000379340; ENST00000486319; ENST00000508848; ENST00000513506; ENST00000514917; ENST00000507355; ENST00000608621; ENST00000511313; ENST00000513438 | TSF |
| 2% | chr7 | 102212392 | 102212170 | − | chr7 | 102210371 | 102210282 | − | ENST00000489144; ENST00000379340; ENST00000486319; ENST00000508848; ENST00000513506; ENST00000514917; ENST00000507355; ENST00000608621; ENST00000511313; ENST00000513438 | TSF |
| 2% | chr6 | 32552703 | 32552631 | − | chr6 | 32549391 | 32549334 | − | ENST00000360004 | TSF |
| 2% | chr18 | 71747213 | 47213601 | − | chr18 | 47017800 | 47017775 | − | ENST00000584895; ENST00000577910; ENST00000579408; ENST00000579248; ENST00000580261; ENST00000418495; ENST00000580210; ENST00000583637; ENST00000578532; ENST00000583036; ENST00000580387; ENST00000578528 | TSF |
| 2% | chr18 | 71747213 | 47213601 | − | chr18 | 47017800 | 47017775 | − | ENST00000584895; ENST00000577910; ENST00000579408; ENST00000579248; ENST00000580261; ENST00000418495; ENST00000580210; ENST00000583637; ENST00000578532; ENST00000583036; ENST00000580387; ENST00000578528 | TSF |
| 2% | chr18 | 71747213 | 47213601 | − | chr18 | 47017800 | 47017775 | − | ENST00000584895; ENST00000577910; ENST00000579408; ENST00000579248; | TSF |

TABLE 58-continued

Transcript fusion for Stomach adenocarcinoma (STAD) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 2% | chr18 | 71747213 | 47213601 | – | chr18 | 47017800 | 47017775 | – | ENST00000580261; ENST00000418495; ENST00000580210; ENST00000583637; ENST00000578532; ENST00000583036; ENST00000580387; ENST00000578528 ENST00000584895; ENST00000577910; ENST00000579408; ENST00000579248; | TSF |
| 2% | chr18 | 71747213 | 47213601 | – | chr18 | 47017800 | 47017775 | – | ENST00000580261; ENST00000418495; ENST00000580210; ENST00000583637; ENST00000578532; ENST00000583036; ENST00000580387; ENST00000578528 ENST00000584895; ENST00000577910; ENST00000579408; ENST00000579248; | TSF |
| 2% | chr18 | 71747213 | 47213601 | – | chr18 | 47017800 | 47017775 | – | ENST00000580261; ENST00000418495; ENST00000580210; ENST00000583637; ENST00000578532; ENST00000583036; ENST00000580387; ENST00000578528 ENST00000584895; ENST00000577910; ENST00000579408; ENST00000579248; | TSF |
| 2% | chr18 | 71747213 | 47213601 | – | chr18 | 47017800 | 47017775 | – | ENST00000580261; ENST00000418495; ENST00000580210; ENST00000583637; ENST00000578532; ENST00000583036; ENST00000580387; ENST00000578528 ENST00000584895; ENST00000577910; ENST00000579408; ENST00000579248; | TSF |
| 2% | chr22 | 38620420 | 38620354 | – | chr22 | 38617717 | 38617476 | – | ENST00000361906; ENST00000361684 | TSF |
| 2% | chr22 | 22141039 | 22140985 | – | chr22 | 22127271 | 22127162 | – | ENST00000215832; ENST00000398822; ENST00000544786 | TSF |
| 2% | chr6 | 161637963 | 161637691 | – | chr6 | 161587449 | 161587280; 161587148 | – | ENST00000320285; ENST00000366908; ENST00000436279; ENST00000366905 | TSF |
| 2% | chr6 | 161637963 | 161637691 | – | chr6 | 161587449 | 161587280; 161587148 | – | ENST00000320285; ENST00000366908; ENST00000436279; ENST00000366905 | TSF |
| 2% | chr6 | 161637963 | 161637691 | – | chr6 | 161587449 | 161587280; 161587148 | – | ENST00000320285; ENST00000366908; ENST00000436279; ENST00000366905 | TSF |
| 2% | chr12 | 50285408 | 50285280 | – | chr12 | 50284897 | 50284847; 50284860 | – | ENST00000320634; ENST00000550890; ENST00000550195; ENST00000552669; ENST00000552863; ENST00000550635; ENST00000547871 | TSF |
| 2% | chr12 | 50285408 | 50285280 | – | chr12 | 50284897 | 50284847; 50284860 | – | ENST00000320634; ENST00000550890; ENST00000550195; ENST00000552669; ENST00000552863; ENST00000550635; ENST00000547871 | TSF |
| 2% | chr12 | 50285408 | 50285280 | – | chr12 | 50284897 | 50284847; 50284860 | – | ENST00000320634; ENST00000550890; ENST00000550195; ENST00000552669; ENST00000552863; ENST00000550635; ENST00000547871 | TSF |
| 2% | chr12 | 50285408 | 50285280 | – | chr12 | 50284897 | 50284847; 50284860 | – | ENST00000320634; ENST00000550890; ENST00000550195; ENST00000552669; ENST00000552863; ENST00000550635; ENST00000547871 | TSF |
| 2% | chr12 | 50285408 | 50285280 | – | chr12 | 50284897 | 50284847; 50284860 | – | ENST00000320634; ENST00000550890; ENST00000550195; ENST00000552669; ENST00000552863; ENST00000550635; ENST00000547871 | TSF |
| 2% | chr12 | 50285408 | 50285280 | – | chr12 | 50284897 | 50284847; 50284860 | – | ENST00000320634; ENST00000550890; ENST00000550195; ENST00000552669; ENST00000552863; ENST00000550635; ENST00000547871 | TSF |
| 2% | chr4 | 83764590 | 83764450 | – | chr4 | 83763634 | 83763293; 83763338 | – | ENST00000503937; ENST00000348405; ENST00000395310; ENST00000443462; ENST00000326950; ENST00000432794; ENST00000448323; ENST00000505472; ENST00000508502; ENST00000355196; ENST00000264405; ENST00000505984 | TSF |
| 2% | chr4 | 83764590 | 83764450 | – | chr4 | 83763634 | 83763293; 83763338 | – | ENST00000503937; ENST00000348405; ENST00000395310; ENST00000443462; ENST00000326950; ENST00000432794; ENST00000448323; ENST00000505472; ENST00000508502; ENST00000355196; ENST00000264405; ENST00000505984 | TSF |
| 2% | chr4 | 83764590 | 83764450 | – | chr4 | 83763634 | 83763293; 83763338 | – | ENST00000503937; ENST00000348405; ENST00000395310; ENST00000443462; ENST00000326950; ENST00000432794; | TSF |

TABLE 58-continued

Transcript fusion for Stomach adenocarcinoma (STAD) Coordinates of the fusion sequences for which the donor is the TE.

| 1 | 2' | 3' | 4' | 5' | 6' | 7' | 8' | 9' | 10' | 11' |
|---|----|----|----|----|----|----|----|----|-----|-----|
|   |    |    |    |    |    |    |    |    | ENST00000448323; ENST00000505472; ENST00000508502; ENST00000355196; ENST00000264405; ENST00000505984 | |

TABLE 59

Transcript fusion for Testicular Germ Cell Tumors (TGCT) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|----|----|
| 68% | chr5 | 54993786 | 54993674 | − | ENST00000396865; ENST00000539768; ENST00000318672; ENST00000508124; ENST00000511233; ENST00000503891; ENST00000513993; ENST00000505563; ENST00000506624; ENST00000507109 | chr5 | 54993040 | 54992544 | − | TSF |
| 64% | chr10 | 70432652 | 70432802 | + | ENST00000373644 | chr10 | 70433158 | 70433321 | + | TSF |
| 52% | chr15 | 58957396 | 58957296 | − | ENST00000260408 | chr15 | 58947615 | 58947395 | − | TAF |
| 51% | chr12 | 71509738 | 71509630 | − | ENST00000549357 | chr12 | 71504233 | 71503634 | − | TAF |
| 49% | chr12 | 32369181 | 32369393 | + | ENST00000548411; ENST00000281474; ENST00000395758 | chr12 | 32375738 | 32375900 | + | TSF |
| 47% | chr20 | 29632611 | 29632721 | + | ENST00000278882; ENST00000358464 | chr20 | 29652086 | 29652324 | + | TSF |
| 38% | chr19 | 35514331 | 35514451 | + | ENST00000599564; ENST00000317991; ENST00000504615; ENST00000411896 | chr19 | 35514601 | 35514631 | + | TAF |
| 38% | chr19 | 35514331 | 35514451 | + | ENST00000599564; ENST00000317991; ENST00000504615; ENST00000411896 | chr19 | 35514601 | 35514631 | + | TAF |
| 38% | chr19 | 35514331 | 35514451 | + | ENST00000599564; ENST00000317991; ENST00000504615; ENST00000411896 | chr19 | 35514601 | 35514631 | + | TAF |
| 38% | chr19 | 35514331 | 35514451 | + | ENST00000599564; ENST00000317991; ENST00000504615; ENST00000411896 | chr19 | 35514601 | 35514631 | + | TAF |
| 33% | chr2 | 47690170 | 47690293 | + | ENST00000233146; ENST00000543555; ENST00000406134 | chr2 | 47691419 | 47691669 | + | TSF |
| 33% | chr2 | 47690170 | 47690293 | + | ENST00000233146; ENST00000543555; ENST00000406134 | chr2 | 47691419 | 47691669 | + | TSF |
| 32% | chr9 | 125054028 | 125054119 | + | ENST00000297908; ENST00000344641; ENST00000373723; ENST00000373729; ENST00000394315 | chr9 | 125068067 | 125068171 | + | TSF |
| 32% | chr9 | 125054028 | 125054119 | + | ENST00000297908; ENST00000344641; ENST00000373723; ENST00000373729; ENST00000394315 | chr9 | 125068067 | 125068171 | + | TSF |
| 32% | chr9 | 125054028 | 125054119 | + | ENST00000297908; ENST00000344641; ENST00000373723; ENST00000373729; ENST00000394315 | chr9 | 125068067 | 125068171 | + | TSF |
| 30% | chr2 | 175809671 | 175809616 | − | ENST00000409900; ENST00000409156 | chr2 | 175805622 | 175805109 | − | TAF |
| 29% | chr5 | 82554349 | 82554496 | + | ENST00000282268; ENST00000338635; ENST00000396027; ENST00000511817 | chr5 | 82606608 | 82606935 | + | TAF |
| 29% | chr7 | 81964567 | 81964451 | − | ENST00000356860; ENST00000356253; ENST00000423588 | chr7 | 81929467 | 81929190 | − | TSF |
| 28% | chr2 | 42924916 | 42924974 | + | ENST00000405592; ENST00000406652; ENST00000407270; ENST00000454356; ENST00000406911; ENST00000409019; ENST00000405094 | chr2 | 42925555 | 42925601 | + | TAF |
| 28% | chr2 | 42924916 | 42924974 | + | ENST00000405592; ENST00000406652; ENST00000407270; ENST00000454356; ENST00000406911; ENST00000409019; ENST00000405094 | chr2 | 42925555 | 42925601 | + | TAF |
| 27% | chr2 | 128260448 | 128260391 | − | ENST00000295321; ENST00000455721 | chr2 | 128258799 | 128257878 | − | TAF |
| 27% | chr2 | 128260448 | 128260391 | − | ENST00000295321; ENST00000455721 | chr2 | 128258799 | 128257878 | − | TAF |
| 27% | chr7 | 64254947 | 64254949 | + | ENST00000307355; ENST00000494380; ENST00000440155; ENST00000440598 | chr7 | 64257358 | 64257449 | + | TAF |
| 27% | chr1 | 32696528 | 32696620 | + | ENST00000373586 | chr1 | 32696861 | 32697110 | + | TAF |
| 27% | chr7 | 27582719 | 27582586 | − | ENST00000265395; ENST00000425715 | chr7 | 27581374 | 27579272 | − | TAF |
| 27% | chr7 | 27582719 | 27582586 | − | ENST00000265395; ENST00000425715 | chr7 | 27581374 | 27579272 | − | TAF |
| 27% | chr1 | 11115983; 11115877 | 11115838 | − | ENST00000376957; ENST00000490101 | chr1 | 11115464 | 11115178 | − | TSF |
| 27% | chr1 | 11115983; 11115877 | 11115838 | − | ENST00000376957; ENST00000490101 | chr1 | 11115464 | 11115178 | − | TSF |
| 26% | chr20 | 35842163 | 35842268 | + | ENST00000237530; ENST00000373622 | chr20 | 35844460 | 35844765 | + | TAF |
| 26% | chr20 | 35842163 | 35842268 | + | ENST00000237530; ENST00000373622 | chr20 | 35844460 | 35844765 | + | TAF |
| 26% | chr9 | 17143286 | 17143374 | + | ENST00000380647; ENST00000262360; ENST00000425824; ENST00000380641 | chr9 | 17166816 | 17167136 | + | TSF |
| 23% | chrX | 119708472 | 119708406 | − | ENST00000404115 | chrX | 119705855 | 119705820 | − | TSF |
| 21% | chrX | 64743587; 64743497 | 64743440 | − | ENST00000374807; ENST00000374811; ENST00000374804; ENST00000469091 | chrX | 64742373 | 64741630 | − | TAF |

TABLE 59-continued

Transcript fusion for Testicular Germ Cell Tumors (TGCT) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 21% | chrX | 64743587; 64743497 | 64743440 | − | ENST00000374807; ENST00000374811; ENST00000374804; ENST00000469091 | chrX | 64742373 | 64741630 | − | TAF |
| 21% | chrX | 64743587; 64743497 | 64743440 | − | ENST00000374807; ENST00000374811; ENST00000374804; ENST00000469091 | chrX | 64742373 | 64741630 | − | TAF |
| 21% | chrX | 64743587; 64743497 | 64743440 | − | ENST00000374807; ENST00000374811; ENST00000374804; ENST00000469091 | chrX | 64742373 | 64741630 | − | TAF |
| 20% | chr22 | 24323139 | 24323226 | + | ENST00000215780; ENST00000402588 | chr22 | 24324557 | 24324632 | + | TAF |
| 20% | chr5 | 74984990 | 74984837 | − | ENST00000428202; ENST00000514838; ENST00000380475; ENST00000510798; ENST00000446329 | chr5 | 74983153 | 74982863 | − | TAF |
| 20% | chr5 | 74984990 | 74984837 | − | ENST00000428202; ENST00000514838; ENST00000380475; ENST00000510798; ENST00000446329 | chr5 | 74983153 | 74982863 | − | TAF |
| 20% | chr5 | 74984990 | 74984837 | − | ENST00000428202; ENST00000514838; ENST00000380475; ENST00000510798; ENST00000446329 | chr5 | 74983153 | 74982863 | − | TAF |
| 20% | chr5 | 74984990 | 74984837 | − | ENST00000428202; ENST00000514838; ENST00000380475; ENST00000510798; ENST00000446329 | chr5 | 74983153 | 74982863 | − | TAF |
| 19% | chr8 | 73921122 | 73921440 | + | ENST00000276603; ENST00000276602; ENST00000518874 | chr8 | 73925091 | 73925180 | + | TSF |
| 19% | chr1 | 225156461 | 225156576 | + | ENST00000430092; ENST00000400952; ENST00000366849; ENST00000439375 | chr1 | 225157336 | 225158402 | + | TSF |
| 19% | chr1 | 225156461 | 225156576 | + | ENST00000430092; ENST00000400952; ENST00000366849; ENST00000439375 | chr1 | 225157336 | 225158402 | + | TSF |
| 18% | chr19 | 37618030 | 37619808 | + | ENST00000337995 | chr19 | 37621046 | 37621237 | + | TAF |
| 17% | chr19 | 13869914; 13869931; 13869925 | 13870086 | + | ENST00000586600; ENST00000221554; ENST00000586666; ENST00000588809; ENST00000585844 | chr19 | 13872305 | 13872412 | + | TAF |
| 17% | chr19 | 13869914; 13869931; 13869925 | 13870086 | + | ENST00000586600; ENST00000221554; ENST00000586666; ENST00000588809; ENST00000585844 | chr19 | 13872305 | 13872412 | + | TAF |
| 17% | chr19 | 13869914; 13869931; 13869925 | 13870086 | + | ENST00000586600; ENST00000221554; ENST00000586666; ENST00000588809; ENST00000585844 | chr19 | 13872305 | 13872412 | + | TAF |
| 17% | chr19 | 13869914; 13869931; 13869925 | 13870086 | + | ENST00000586600; ENST00000221554; ENST00000586666; ENST00000588809; ENST00000585844 | chr19 | 13872305 | 13872412 | + | TAF |
| 17% | chr16 | 81142298 | 81142167 | − | ENST00000533478; ENST00000525539 | chr16 | 81141929 | 81141855 | − | TAF |
| 17% | chr16 | 81142298 | 81142167 | − | ENST00000533478; ENST00000525539 | chr16 | 81141929 | 81141855 | − | TAF |
| 17% | chr4 | 57319769 | 57319927 | + | ENST00000514888; ENST00000264221; ENST00000505164; ENST00000399688; ENST00000512576 | chr4 | 57321183 | 57321327 | + | TSF |
| 17% | chr4 | 57319769 | 57319927 | + | ENST00000514888; ENST00000264221; ENST00000505164; ENST00000399688; ENST00000512576 | chr4 | 57321183 | 57321327 | + | TSF |
| 17% | chr4 | 57319769 | 57319927 | + | ENST00000514888; ENST00000264221; ENST00000505164; ENST00000399688; ENST00000512576 | chr4 | 57321183 | 57321327 | + | TSF |
| 17% | chr4 | 99325628 | 99325753 | + | ENST00000514888; ENST00000264221; ENST00000505164; ENST00000399688; ENST00000512576 | chr1 | 99330014 | 99330389 | + | TSF |
| 17% | chr4 | 99325628 | 99325753 | + | ENST00000514888; ENST00000264221; ENST00000505164; ENST00000399688; ENST00000512576 | chr4 | 99330014 | 99330389 | + | TSF |
| 17% | chr4 | 99325628 | 99325753 | + | ENST00000514888; ENST00000264221; ENST00000505164; ENST00000399688; ENST00000512576 | chr4 | 99330014 | 99330389 | + | TSF |
| 17% | chr4 | 99325628 | 99325753 | + | ENST00000514888; ENST00000264221; ENST00000505164; ENST00000399688; ENST00000512576 | chr4 | 99330014 | 99330389 | + | TSF |
| 17% | chr4 | 99325628 | 99325753 | + | ENST00000514888; ENST00000264221; ENST00000505164; ENST00000399688; ENST00000512576 | chr4 | 99330014 | 99330389 | + | TSF |
| 17% | chr4 | 99325628 | 99325753 | + | ENST00000514888; ENST00000264221; ENST00000505164; ENST00000399688; ENST00000512576 | chr4 | 99330014 | 99330389 | + | TSF |
| 17% | chr7 | 140080190 | 140080082 | − | ENST00000514888; ENST00000264221; ENST00000505164; ENST00000399688; ENST00000512576 | chr7 | 140075454 | 140075361 | − | TSF |
| 16% | chr15 | 71144671 | 71144566 | − | ENST00000559140 | chr15 | 71144059 | 71143957 | − | TAF |
| 16% | chr12 | 102547647 | 102547754 | + | ENST00000327680; ENST00000378128; ENST00000541394; ENST00000358383; ENST00000392911; ENST00000412715; ENST00000417507; ENST00000457614 | chr12 | 102548605 | 102548938 | + | TSF |
| 16% | chr12 | 102547647 | 102547754 | + | ENST00000327680; ENST00000378128; ENST00000541394; ENST00000358383; ENST00000392911; ENST00000412715; ENST00000417507; ENST00000457614 | chr12 | 102548605 | 102548938 | + | TSF |

TABLE 59-continued

Transcript fusion for Testicular Germ Cell Tumors (TGCT) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|----|----|
| 16% | chr12 | 102547647 | 102547754 | + | ENST00000327680; ENST00000378128; ENST00000541394; ENST00000358383; ENST00000392911; ENST00000412715; ENST00000417507; ENST00000457614 | chr12 | 102548605 | 102548938 | + | TSF |
| 16% | chr12 | 102547647 | 102547754 | + | ENST00000327680; ENST00000378128; ENST00000541394; ENST00000358383; ENST00000392911; ENST00000412715; ENST00000417507; ENST00000457614 | chr12 | 102548605 | 102548938 | + | TSF |
| 16% | chr12 | 102547647 | 102547754 | + | ENST00000327680; ENST00000378128; ENST00000541394; ENST00000358383; ENST00000392911; ENST00000412715; ENST00000417507; ENST00000457614 | chr12 | 102548605 | 102548938 | + | TSF |
| 15% | chr2 | 71607643 | 71607695 | + | ENST00000377802; ENST00000355812; ENST00000264447; ENST00000409544 | chr2 | 71620524 | 71622486 | + | TAF |
| 15% | chr12 | 6943089 | 6943213 | + | ENST00000251761; ENST00000396725; ENST00000606935 | chr12 | 6943989 | 6944119 | + | TAF |
| 15% | chr12 | 6943089 | 6943213 | + | ENST00000251761; ENST00000396725; ENST00000606935 | chr12 | 6943989 | 6944119 | + | TAF |
| 15% | chr12 | 6943089 | 6943213 | + | ENST00000251761; ENST00000396725; ENST00000606935 | chr12 | 6943989 | 6944119 | + | TAF |
| 15% | chr17 | 4908150 | 4908295 | + | ENST00000320785 | chr17 | 4908583 | 4909022 | + | TAF |
| 15% | chr16 | 4409386 | 4409297 | − | ENST00000572467; ENST00000251166; ENST00000539968; ENST00000537233; ENST00000574025; ENST00000576637 | chr16 | 4409070 | 4408945 | − | TAF |
| 15% | chr16 | 4409386 | 4409297 | − | ENST00000572467; ENST00000251166; ENST00000539968; ENST00000537233; ENST00000574025; ENST00000576637 | chr16 | 4409070 | 4408945 | − | TAF |
| 15% | chr16 | 4409386 | 4409297 | − | ENST00000572467; ENST00000251166; ENST00000539968; ENST00000537233; ENST00000574025; ENST00000576637 | chr16 | 4409070 | 4408945 | − | TAF |
| 15% | chr16 | 4409386 | 4409297 | − | ENST00000572467; ENST00000251166; ENST00000539968; ENST00000537233; ENST00000574025; ENST00000576637 | chr16 | 4409070 | 4408945 | − | TAF |
| 15% | chr16 | 4409386 | 4409297 | − | ENST00000572467; ENST00000251166; ENST00000539968; ENST00000537233; ENST00000574025; ENST00000576637 | chr16 | 4409070 | 4408945 | − | TAF |
| 15% | chr9 | 15506635 | 15506559 | − | ENST00000380738; ENST00000380733; ENST00000380715; ENST00000380716; ENST00000397519 | chr9 | 15492223 | 15492056 | − | TAF |
| 15% | chr9 | 96030909 | 96031028 | + | ENST00000427277; ENST00000297954; ENST00000349097; ENST00000395477; ENST00000432730; ENST00000411624; ENST00000448251 | chr9 | 96040344 | 96040994 | + | TSF |
| 15% | chr9 | 96030909 | 96031028 | + | ENST00000427277; ENST00000297954; ENST00000349097; ENST00000395477; ENST00000432730; ENST00000411624; ENST00000448251 | chr9 | 96040344 | 96040994 | + | TSF |
| 15% | chr9 | 96030909 | 96031028 | + | ENST00000427277; ENST00000297954; ENST00000349097; ENST00000395477; ENST00000432730; ENST00000411624; ENST00000448251 | chr9 | 96040344 | 96040994 | + | TSF |
| 15% | chr9 | 96030909 | 96031028 | + | ENST00000427277; ENST00000297954; ENST00000349097; ENST00000395477; ENST00000432730; ENST00000411624; ENST00000448251 | chr9 | 96040344 | 96040994 | + | TSF |
| 15% | chr9 | 96030909 | 96031028 | + | ENST00000427277; ENST00000297954; ENST00000349097; ENST00000395477; ENST00000432730; ENST00000411624; ENST00000448251 | chr9 | 96040344 | 96040994 | + | TSF |
| 15% | chr8 | 139890559 | 139889993 | − | ENST00000303045; ENST00000435777 | chr8 | 139875196 | 139875126 | − | TSF |
| 15% | chr3 | 137906397; 137906427 | 137906441 | + | ENST00000469044; ENST00000461600; ENST00000461822; ENST00000470821; ENST00000471709; ENST00000393058; ENST00000538260; ENST00000463485 | chr3 | 137907243 | 137907252 | + | TSF |
| 15% | chr3 | 137906397; 137906427 | 137906441 | + | ENST00000469044; ENST00000461600; ENST00000461822; ENST00000470821; ENST00000471709; ENST00000393058; ENST00000538260; ENST00000463485 | chr3 | 137907243 | 137907252 | + | TSF |
| 15% | chr3 | 48716169 | 48715997 | − | ENST00000341520; ENST00000416649; ENST00000294129; ENST00000413374 | chr3 | 48702393 | 48702198 | − | TSF |
| 15% | chr3 | 48716169 | 48715997 | − | ENST00000341520; ENST00000416649; ENST00000294129; ENST00000413374 | chr3 | 48702393 | 48702198 | − | TSF |
| 15% | chr3 | 48716169 | 48715997 | − | ENST00000341520; ENST00000416649; ENST00000294129; ENST00000413374 | chr3 | 48702393 | 48702198 | − | TSF |
| 15% | chr8 | 139626163 | 139626110 | − | ENST00000303045; ENST00000435777 | chr8 | 139623600 | 139623460 | − | TSF |
| 15% | chr8 | 139626163 | 139626110 | − | ENST00000303045; ENST00000435777 | chr8 | 139623600 | 139623460 | − | TSF |

TABLE 59-continued

Transcript fusion for Testicular Germ Cell Tumors (TGCT) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 14% | chr1 | 147438786 | 147438895 | + | ENST00000314163 | chr1 | 147440564 | 147440653 | + | TAF |
| 14% | chr3 | 196230044 | 196229744 | − | ENST00000318037; ENST00000437070 | chr3 | 196223342 | 196223041 | − | TAF |
| 14% | chr16 | 2825557; 2825626 | 2825452 | − | ENST00000262306; ENST00000409906; ENST00000409477; ENST00000494946 | chr16 | 2823834 | 2823809 | − | TAF |
| 14% | chr16 | 2825557; 2825626 | 2825452 | − | ENST00000262306; ENST00000409906; ENST00000409477; ENST00000494946 | chr16 | 2823834 | 2823809 | − | TAF |
| 14% | chr16 | 2825557; 2825626 | 2825452 | − | ENST00000262306; ENST00000409906; ENST00000409477; ENST00000494946 | chr16 | 2823834 | 2823809 | − | TAF |
| 13% | chr6 | 41606488 | 41606563 | + | ENST00000432027; ENST00000419164; ENST00000373051; ENST00000441667; ENST00000230321; ENST00000373050; ENST00000446650; ENST00000435476 | chr6 | 41607515 | 41607595 | + | TAF |
| 13% | chr10 | 15151838 | 15151701 | − | ENST00000378165; ENST00000378150; ENST00000540259; ENST00000535341 | chr10 | 15148697 | 15148684 | − | TAF |
| 13% | chr10 | 15151838 | 15151701 | − | ENST00000378165; ENST00000378150; ENST00000540259; ENST00000535341 | chr10 | 15148697 | 15148684 | − | TAF |
| 13% | chr10 | 15151838 | 15151701 | − | ENST00000378165; ENST00000378150; ENST00000540259; ENST00000535341 | chr10 | 15148697 | 15148684 | − | TAF |
| 13% | chr10 | 15151838 | 15151701 | − | ENST00000378165; ENST00000378150; ENST00000540259; ENST00000535341 | chr10 | 15148697 | 15148684 | − | TAF |
| 13% | chr1 | 41463066 | 41463198 | + | ENST00000372621; ENST00000541520; ENST00000372616 | chr1 | 41465502 | 41465535 | + | TAF |
| 13% | chr1 | 41463066 | 41463198 | + | ENST00000372621; ENST00000541520; ENST00000372616 | chr1 | 41465502 | 41465535 | + | TAF |
| 13% | chr6 | 35314915 | 35314927 | + | ENST00000448077 | chr6 | 35351354 | 35351915 | + | TAF |
| 13% | chr6 | 151742456 | 151742380 | − | ENST00000336451; ENST00000367303; ENST00000444024 | chr6 | 151739714 | 151739579 | − | TSF |
| 13% | chr6 | 151742456 | 151742380 | − | ENST00000336451; ENST00000367303; ENST00000444024 | chr6 | 151739714 | 151739579 | − | TSF |
| 13% | chr6 | 151742456 | 151742380 | − | ENST00000336451; ENST00000367303; ENST00000444024 | chr6 | 151739714 | 151739579 | − | TSF |
| 13% | chr4 | 146617711 | 146617784 | + | ENST00000438731; ENST00000511965 | chr4 | 146620339 | 146620424 | + | TSF |
| 13% | chr4 | 146617711 | 146617784 | + | ENST00000438731; ENST00000511965 | chr4 | 146620339 | 146620424 | + | TSF |
| 12% | chr15 | 34826374 | 34826255 | − | ENST00000342314; ENST00000267731 | chr15 | 34679464 | 34679458 | − | TAF |
| 12% | chr2 | 172725333; 172725194 | 172725191 | − | ENST00000422440; ENST00000263812; ENST00000392592; ENST00000426896; ENST00000475360 | chr2 | 172723793 | 172722363 | − | TSF |
| 12% | chr2 | 172725333; 172725194 | 172725191 | − | ENST00000422440; ENST00000263812; ENST00000392592; ENST00000426896; ENST00000475360 | chr2 | 172723793 | 172722363 | − | TSF |
| 12% | chr2 | 172725333; 172725194 | 172725191 | − | ENST00000422440; ENST00000263812; ENST00000392592; ENST00000426896; ENST00000475360 | chr2 | 172723793 | 172722363 | − | TSF |
| 11% | chr12 | 64833024 | 64833095 | + | ENST00000332707 | chr12 | 64833417 | 64833459 | + | TAF |
| 11% | chr2 | 211342488 | 211342490 | + | ENST00000523702; ENST00000430249 | chr2 | 211384275 | 211384452 | + | TAF |
| 11% | chr12 | 57060050 | 57059988 | − | ENST00000262033; ENST00000414274; ENST00000436399; ENST00000456859 | chr12 | 57059571 | 57059432 | − | TAF |
| 11% | chr12 | 57060050 | 57059988 | − | ENST00000262033; ENST00000414274; ENST00000436399; ENST00000456859 | chr12 | 57059571 | 57059432 | − | TAF |
| 11% | chr12 | 57060050 | 57059988 | − | ENST00000262033; ENST00000414274; ENST00000436399; ENST00000456859 | chr12 | 57059571 | 57059432 | − | TAF |
| 11% | chr12 | 57060050 | 57059988 | − | ENST00000262033; ENST00000414274; ENST00000436399; ENST00000456859 | chr12 | 57059571 | 57059432 | − | TAF |
| 11% | chr1 | 244855181; 244855186 | 244855322 | + | ENST00000302550; ENST00000263831 | chr1 | 244863163 | 244863387 | + | TAF |
| 11% | chr1 | 244855181; 244855186 | 244855322 | + | ENST00000302550; ENST00000263831 | chr1 | 244863163 | 244863387 | + | TAF |
| 11% | chr14 | 51355542 | 51355621 | + | ENST00000337334; ENST00000353130; ENST00000395752 | chr14 | 51359931 | 51360328 | + | TAF |
| 11% | chr14 | 51355542 | 51355621 | + | ENST00000337334; ENST00000353130; ENST00000395752 | chr14 | 51359931 | 51360328 | + | TAF |
| 11% | chr14 | 51355542 | 51355621 | + | ENST00000337334; ENST00000353130; ENST00000395752 | chr14 | 51359931 | 51360328 | + | TAF |
| 11% | chr2 | 242275390; 242275258 | 242275513 | + | ENST00000391973; ENST00000428282; ENST00000360051; ENST00000407017; ENST00000391971; ENST00000401990; ENST00000407971; ENST00000436795; ENST00000411484; ENST00000402092; ENST00000443492; ENST00000437066; ENST00000449239; ENST00000457874 | chr2 | 242276200 | 242276228 | + | TAF |
| 11% | chr2 | 242275390; 242275258 | 242275513 | + | ENST00000391973; ENST00000428282; ENST00000360051; ENST00000407017; ENST00000391971; ENST00000401990; ENST00000407971; ENST00000436795; ENST00000411484; ENST00000402092; ENST00000443492; ENST00000437066; | chr2 | 242276200 | 242276228 | + | TAF |

TABLE 59-continued

Transcript fusion for Testicular Germ Cell Tumors (TGCT) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 11% | chr2 | 242275390; 242275258 | 242275513 | + | ENST00000449239; ENST00000457874 ENST00000391973; ENST00000428282; ENST00000360051; ENST00000407017; ENST00000391971; ENST00000401990; ENST00000407971; ENST00000436795; ENST00000411484; ENST00000402092; ENST00000443492; ENST00000437066; | chr2 | 242276200 | 242276228 | + | TAF |
| 11% | chr2 | 242275390; 242275258 | 242275513 | + | ENST00000449239; ENST00000457874 ENST00000391973; ENST00000428282; ENST00000360051; ENST00000407017; ENST00000391971; ENST00000401990; ENST00000407971; ENST00000436795; ENST00000411484; ENST00000402092; ENST00000443492; ENST00000437066; | chr2 | 242276200 | 242276228 | + | TAF |
| 11% | chr2 | 242275390; 242275258 | 242275513 | + | ENST00000449239; ENST00000457874 ENST00000391973; ENST00000428282; ENST00000360051; ENST00000407017; ENST00000391971; ENST00000401990; ENST00000407971; ENST00000436795; ENST00000411484; ENST00000402092; ENST00000443492; ENST00000437066; | chr2 | 242276200 | 242276228 | + | TAF |
| 11% | chr22 | 46136249 | 46136418 | + | ENST00000381061; ENST00000252934; ENST00000435026; ENST00000451241 | chr22 | 46194492 | 46194955 | + | TAF |
| 11% | chr22 | 46136249 | 46136418 | + | ENST00000381061; ENST00000252934; ENST00000435026; ENST00000451241 | chr22 | 46194492 | 46194955 | + | TAF |
| 11% | chr22 | 46136249 | 46136418 | + | ENST00000381061; ENST00000252934; ENST00000435026; ENST00000451241 | chr22 | 46194492 | 46194955 | + | TAF |
| 11% | chr22 | 46136249 | 46136418 | + | ENST00000381061; ENST00000252934; ENST00000435026; ENST00000451241 | chr22 | 46194492 | 46194955 | + | TAF |
| 11% | chr15 | 89011139 | 89011255 | + | ENST00000560708; ENST00000325844; ENST00000353598 | chr15 | 89011993 | 89012264 | + | TAF |
| 11% | chr1 | 24463799 | 24463621 | − | ENST00000270800 | chr1 | 24461426 | 24461370 | − | TAF |
| 11% | chr1 | 32560385 | 32560572 | + | ENST00000336294; ENST00000373634; ENST00000427288 | chr1 | 32561261 | 32561358 | + | TSF |
| 11% | chr1 | 32560385 | 32560572 | + | ENST00000336294; ENST00000373634; ENST00000427288 | chr1 | 32561261 | 32561358 | + | TSF |
| 11% | chr1 | 32560385 | 32560572 | + | ENST00000336294; ENST00000373634; ENST00000427288 | chr1 | 32561261 | 32561358 | + | TSF |
| 11% | chr3 | 54157540 | 54157621 | + | ENST00000415676; ENST00000288197; ENST00000474759 | chr3 | 54326852 | 54327228 | + | TSF |
| 11% | chr7 | 77212872; 77212944 | 77212967 | + | ENST00000248594; ENST00000433369; ENST00000415482; ENST00000418110; ENST00000522115; ENST00000440186; ENST00000447995 | chr7 | 77213910 | 77213912 | + | TSF |
| 11% | chr7 | 77212872; 77212944 | 77212967 | + | ENST00000248594; ENST00000433369; ENST00000415482; ENST00000418110; ENST00000522115; ENST00000440186; ENST00000447995 | chr7 | 77213910 | 77213912 | + | TSF |
| 11% | chr7 | 77212872; 77212944 | 77212967 | + | ENST00000248594; ENST00000433369; ENST00000415482; ENST00000418110; ENST00000522115; ENST00000440186; ENST00000447995 | chr7 | 77213910 | 77213912 | + | TSF |
| 11% | chr15 | 65114590 | 65114465 | − | ENST00000268043; ENST00000333425; ENST00000559239 | chr15 | 65114331 | 65114239 | − | TSF |
| 10% | chr7 | 45649978 | 45650096 | + | ENST00000432715; ENST00000297323 | chr7 | 45652520 | 45652533 | + | TSF |
| 10% | chr7 | 45649978 | 45650096 | + | ENST00000432715; ENST00000297323 | chr7 | 45652520 | 45652533 | + | TSF |
| 10% | chr12 | 4874545 | 4874712 | + | ENST00000252318; ENST00000542998; ENST00000535354 | chr12 | 4884414 | 4884790 | + | TSF |
| 10% | chr12 | 4874545 | 4874712 | + | ENST00000252318; ENST00000542998; ENST00000535354 | chr12 | 4884414 | 4884790 | + | TSF |
| 10% | chr12 | 4874545 | 4874712 | + | ENST00000252318; ENST00000542998; ENST00000535354 | chr12 | 4884414 | 4884790 | + | TSF |
| 10% | chr1 | 33272212 | 33272083 | − | ENST00000373477 | chr1 | 33270484 | 33269340 | − | TSF |
| 9% | chr14 | 66096210; 66096217 | 66096324 | + | ENST00000360689; ENST00000394586; ENST00000342677; ENST00000557164; ENST00000394585; ENST00000358307 | chr14 | 66099743 | 66101298 | + | TSF |
| 9% | chr14 | 66096210; 66096217 | 66096324 | + | ENST00000360689; ENST00000394586; ENST00000342677; ENST00000557164; ENST00000394585; ENST00000358307 | chr14 | 66099743 | 66101298 | + | TSF |
| 9% | chr14 | 66096210; 66096217 | 66096324 | + | ENST00000360689; ENST00000394586; ENST00000342677; ENST00000557164; ENST00000394585; ENST00000358307 | chr14 | 66099743 | 66101298 | + | TSF |
| 9% | chr12 | 56742407 | 56742313 | − | ENST00000314128; ENST00000557235 | chr12 | 56740986 | 56740975 | − | TSF |
| 9% | chr12 | 56742407 | 56742313 | − | ENST00000314128; ENST00000557235 | chr12 | 56740986 | 56740975 | − | TSF |
| 9% | chr20 | 30060816 | 30060759 | − | ENST00000317676 | chr20 | 30059856 | 30059283 | − | TSF |

TABLE 59-continued

Transcript fusion for Testicular Germ Cell Tumors (TGCT) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 9% | chr14 | 76662221 | 76662315 | + | ENST00000312858; ENST00000261530; ENST00000554799; ENST00000553588 | chr14 | 76666223 | 76666696 | + | TSF |
| 9% | chr14 | 76662221 | 76662315 | + | ENST00000312858; ENST00000261530; ENST00000554799; ENST00000553588 | chr14 | 76666223 | 76666696 | + | TSF |
| 9% | chr14 | 76662221 | 76662315 | + | ENST00000312858; ENST00000261530; ENST00000554799; ENST00000553588 | chr14 | 76666223 | 76666696 | + | TSF |
| 9% | chrX | 133963256 | 133963312 | + | ENST00000370784; ENST00000370785 | chrX | 133972757 | 133974403 | + | TSF |
| 9% | chr19 | 53357525 | 53357511 | − | ENST00000595646; ENST00000243639; ENST00000597924; ENST00000602144 | chr19 | 53258356 | 53258315 | − | TSF |
| 9% | chr19 | 53321211 | 53321197 | − | ENST00000457749; ENST00000596559; ENST00000594602 | chr19 | 53258356 | 53258315 | − | TSF |
| 8% | chr1 | 72163822 | 72163691 | − | ENST00000357731; ENST00000306821 | chr1 | 72145446 | 72144785 | − | TSF |
| 8% | chr1 | 72163822 | 72163691 | − | ENST00000357731; ENST00000306821 | chr1 | 72145446 | 72144785 | − | TSF |
| 8% | chr20 | 40102157 | 40101962 | − | ENST00000373233 | chr20 | 40101067 | 40101036 | − | TSF |
| 8% | chr6 | 151738534 | 151738414 | − | ENST00000336451; ENST00000367303 | chr6 | 151732046 | 151731858 | − | TSF |
| 8% | chr6 | 151738534 | 151738414 | − | ENST00000336451; ENST00000367303 | chr6 | 151732046 | 151731858 | − | TSF |
| 7% | chr7 | 73459552 | 73459623 | + | ENST00000445912; ENST00000252034; ENST00000358929; ENST00000320492; ENST00000438906; ENST00000414324; ENST00000380562; ENST00000380575; ENST00000380584; ENST00000458204; ENST00000357036; ENST00000429192; ENST00000380576; ENST00000320399 | chr7 | 73460337 | 73460377 | + | TSF |
| 7% | chr7 | 73459552 | 73459623 | + | ENST00000445912; ENST00000252034; ENST00000358929; ENST00000320492; ENST00000438906; ENST00000414324; ENST00000380562; ENST00000380575; ENST00000380584; ENST00000458204; ENST00000357036; ENST00000429192; ENST00000380576; ENST00000320399 | chr7 | 73460337 | 73460377 | + | TSF |
| 7% | chr7 | 73459552 | 73459623 | + | ENST00000445912; ENST00000252034; ENST00000358929; ENST00000320492; ENST00000438906; ENST00000414324; ENST00000380562; ENST00000380575; ENST00000380584; ENST00000458204; ENST00000357036; ENST00000429192; ENST00000380576; ENST00000320399 | chr7 | 73460337 | 73460377 | + | TSF |
| 7% | chr7 | 73459552 | 73459623 | + | ENST00000445912; ENST00000252034; ENST00000358929; ENST00000320492; ENST00000438906; ENST00000414324; ENST00000380562; ENST00000380575; ENST00000380584; ENST00000458204; ENST00000357036; ENST00000429192; ENST00000380576; ENST00000320399 | chr7 | 73460337 | 73460377 | + | TSF |
| 7% | chr7 | 73459552 | 73459623 | + | ENST00000445912; ENST00000252034; ENST00000358929; ENST00000320492; ENST00000438906; ENST00000414324; ENST00000380562; ENST00000380575; ENST00000380584; ENST00000458204; ENST00000357036; ENST00000429192; ENST00000380576; ENST00000320399 | chr7 | 73460337 | 73460377 | + | TSF |
| 7% | chr17 | 15443875 | 15443747 | − | ENST00000519970; ENST00000584811; ENST00000438826; ENST00000428082; ENST00000518321 | chr17 | 15435156 | 15434353 | − | TSF |
| 7% | chr17 | 15443875 | 15443747 | − | ENST00000519970; ENST00000584811; ENST00000438826; ENST00000428082; ENST00000518321 | chr17 | 15435156 | 15434353 | − | TSF |
| 7% | chr17 | 15443875 | 15443747 | − | ENST00000519970; ENST00000584811; ENST00000438826; ENST00000428082; ENST00000518321 | chr17 | 15435156 | 15434353 | − | TSF |
| 7% | chr1 | 63955889 | 63955754 | − | ENST00000371092; ENST00000271002; ENST00000489099; ENST00000283568 | chr1 | 63952444 | 63951983 | − | TSF |
| 7% | chr1 | 63955889 | 63955754 | − | ENST00000371092; ENST00000271002; ENST00000489099; ENST00000283568 | chr1 | 63952444 | 63951983 | − | TSF |
| 7% | chr19 | 3869015; 3869013 | 3868963 | − | ENST00000262961; ENST00000438164; ENST00000587212; ENST00000586578; ENST00000439086 | chr19 | 3855694 | 3855445 | − | TSF |
| 7% | chr19 | 3869015; 3869013 | 3868963 | − | ENST00000262961; ENST00000438164; ENST00000587212; ENST00000586578; ENST00000439086 | chr19 | 3855694 | 3855445 | − | TSF |
| 7% | chr5 | 79498872 | 79498705 | − | ENST00000507668; ENST00000509193; ENST00000512972; ENST00000512721 | chr5 | 79481724 | 79481327 | − | TSF |
| 7% | chr11 | 76944217 | 76944070 | − | ENST00000315938; ENST00000376217 | chr11 | 76940716 | 76940641 | − | TSF |
| 7% | chr1 | 207857217 | 207857302 | + | ENST00000508064; ENST00000294997 | chr1 | 207860136 | 207860394 | + | TSF |
| 7% | chr1 | 207857217 | 207857302 | + | ENST00000508064; ENST00000294997 | chr1 | 207860136 | 207860394 | + | TSF |
| 7% | chr1 | 212209233 | 212209284 | + | ENST00000366991; ENST00000542077 | chr1 | 212211973 | 212212067 | + | TSF |

TABLE 59-continued

Transcript fusion for Testicular Germ Cell Tumors (TGCT) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 7% | chr20 | 29978286 | 29978226 | − | ENST00000339144; ENST00000376321; ENST00000376315 | chr20 | 29976162 | 29976126 | − | TSF |
| 7% | chr16 | 81142298 | 81142167 | − | ENST00000533478; ENST00000525539 | chr16 | 81139177 | 81139155 | − | TSF |
| 7% | chr16 | 81142298 | 81142167 | − | ENST00000533478; ENST00000525539 | chr16 | 81139177 | 81139155 | − | TSF |
| 6% | chr16 | 88873689 | 88873890 | + | ENST00000301019 | chr16 | 88875475 | 88875490 | + | TSF |
| 6% | chr17 | 58329803 | 58329742 | − | ENST00000300896; ENST00000592339; ENST00000590133; ENST00000589335; ENST00000393003 | chr17 | 58323153 | 58323061 | − | TSF |
| 6% | chr17 | 58329803 | 58329742 | − | ENST00000300896; ENST00000592339; ENST00000590133; ENST00000589335; ENST00000393003 | chr17 | 58323153 | 58323061 | − | TSF |
| 6% | chr17 | 58329803 | 58329742 | − | ENST00000300896; ENST00000592339; ENST00000590133; ENST00000589335; ENST00000393003 | chr17 | 58323153 | 58323061 | − | TSF |
| 6% | chr17 | 58329803 | 58329742 | − | ENST00000300896; ENST00000592339; ENST00000590133; ENST00000589335; ENST00000393003 | chr17 | 58323153 | 58323061 | − | TSF |
| 5% | chr7 | 26192119 | 26192688 | + | ENST00000056233 | chr7 | 26210356 | 26210396 | + | TSF |
| 5% | chr22 | 39448079 | 39448358 | + | ENST00000308521 | chr22 | 39449757 | 39450008 | + | TSF |
| 5% | chr19 | 55178148; 55178145 | 55178200 | + | ENST00000391736; ENST00000270452; ENST00000430952; ENST00000391734; ENST00000391733; ENST00000434286 | chr19 | 55178294 | 55178458 | + | TSF |
| 5% | chr19 | 55178148; 55178145 | 55178200 | + | ENST00000391736; ENST00000270452; ENST00000430952; ENST00000391734; ENST00000391733; ENST00000434286 | chr19 | 55178294 | 55178458 | + | TSF |
| 5% | chr19 | 55178148; 55178145 | 55178200 | + | ENST00000391736; ENST00000270452; ENST00000430952; ENST00000391734; ENST00000391733; ENST00000434286 | chr19 | 55178294 | 55178458 | + | TSF |
| 5% | chr5 | 140044498 | 140044686 | + | ENST00000358337; ENST00000506393 | chr5 | 140046629 | 140046654 | + | TSF |
| 5% | chr5 | 128864213 | 128864370 | + | ENST00000274487 | chr5 | 128868409 | 128868509 | + | TSF |
| 5% | chr15 | 43705532; 43705526; 43705484 | 43705317 | − | ENST00000263801; ENST00000382039; ENST00000382044; ENST00000450115; ENST00000434595 | chr15 | 43702724 | 43702621 | − | TSF |
| 5% | chr15 | 43705532; 43705526; 43705484 | 43705317 | − | ENST00000263801; ENST00000382039; ENST00000382044; ENST00000450115; ENST00000434595 | chr15 | 43702724 | 43702621 | − | TSF |
| 5% | chr15 | 43705532; 43705526; 43705484 | 43705317 | − | ENST00000263801; ENST00000382039; ENST00000382044; ENST00000450115; ENST00000434595 | chr15 | 43702724 | 43702621 | − | TSF |
| 5% | chr15 | 43705532; 43705526; 43705484 | 43705317 | − | ENST00000263801; ENST00000382039; ENST00000382044; ENST00000450115; ENST00000434595 | chr15 | 43702724 | 43702621 | − | TSF |
| 5% | chr15 | 43705532; 43705526; 43705484 | 43705317 | − | ENST00000263801; ENST00000382039; ENST00000382044; ENST00000450115; ENST00000434595 | chr15 | 43702724 | 43702621 | − | TSF |
| 5% | chr13 | 53307494; 53307473 | 53307354 | − | ENST00000448904; ENST00000377962; ENST00000431550 | chr13 | 53304269 | 53303967 | − | TSF |
| 5% | chr13 | 53307494; 53307473 | 53307354 | − | ENST00000448904; ENST00000377962; ENST00000431550 | chr13 | 53304269 | 53303967 | − | TSF F |
| 5% | chr3 | 185414451 | 185414400 | − | ENST00000382199; ENST00000421047; ENST00000457616; ENST00000346192 | chr3 | 185411016 | 185410789 | − | TSF |
| 5% | chr3 | 185414451 | 185414400 | − | ENST00000382199; ENST00000421047; ENST00000457616; ENST00000346192 | chr3 | 185411016 | 185410789 | − | TSF |
| 5% | chr20 | 3614958 | 3615036 | + | ENST00000262919 | chr20 | 3615708 | 3616042 | + | TSF |
| 5% | chr22 | 48885405 | 48885516 | + | ENST00000402357; ENST00000336769 | chr22 | 48915770 | 48916108 | + | TSF |
| 5% | chr16 | 29497154 | 29495055 | − | ENST00000354563 | chr16 | 29392982 | 29392973 | − | TSF |
| 5% | chr16 | 69418613; 69418553; 69418599 | 69418483 | − | ENST00000254942; ENST00000603068; ENST00000566750; ENST00000569542; ENST00000566257; ENST00000567296; ENST00000567841 | chr16 | 69413560 | 69413452 | − | TSF |
| 5% | chr16 | 69418613; 69418553; 69418599 | 69418483 | − | ENST00000254942; ENST00000603068; ENST00000566750; ENST00000569542; ENST00000566257; ENST00000567296; ENST00000567841 | chr16 | 69413560 | 69413452 | − | TSF |
| 5% | chr16 | 69418613; 69418553; 69418599 | 69418483 | − | ENST00000254942; ENST00000603068; ENST00000566750; ENST00000569542; ENST00000566257; ENST00000567296; ENST00000567841 | chr16 | 69413560 | 69413452 | − | TSF |
| 5% | chr16 | 69418613; 69418553; 69418599 | 69418483 | − | ENST00000254942; ENST00000603068; ENST00000566750; ENST00000569542; ENST00000566257; ENST00000567296; ENST00000567841 | chr16 | 69413560 | 69413452 | − | TSF |
| 5% | chr16 | 69418613; 69418553; 69418599 | 69418483 | − | ENST00000254942; ENST00000603068; ENST00000566750; ENST00000569542; ENST00000566257; ENST00000567296; ENST00000567841 | chr16 | 69413560 | 69413452 | − | TSF |

TABLE 59-continued

Transcript fusion for Testicular Germ Cell Tumors (TGCT) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 5% | chr16 | 69418613; 69418553; 69418599 | 69418483 | − | ENST00000254942; ENST00000603068; ENST00000566750; ENST00000569542; ENST00000566257; ENST00000567296; ENST00000567841 | chr16 | 69413560 | 69413452 | − | TSF |
| 5% | chr14 | 55615191 | 55615113 | − | ENST00000247191 | chr14 | 55613267 | 55613026 | − | TSF |
| 5% | chr7 | 74867341 | 74867229 | − | ENST00000426327 | chr7 | 74856485 | 74856184 | − | TSF |
| 5% | chr17 | 15449230 | 15449099 | − | ENST00000522212; ENST00000519970; ENST00000225576; ENST00000581273; ENST00000584811; ENST00000438826; ENST00000428082; ENST00000518321; ENST00000419890 | chr17 | 15435156 | 15434353 | − | TSF |
| 5% | chr17 | 15449230 | 15449099 | − | ENST00000522212; ENST00000519970; ENST00000225576; ENST00000581273; ENST00000584811; ENST00000438826; ENST00000428082; ENST00000518321; ENST00000419890 | chr17 | 15435156 | 15434353 | − | TSF |
| 5% | chr17 | 15449230 | 15449099 | − | ENST00000522212; ENST00000519970; ENST00000225576; ENST00000581273; ENST00000584811; ENST00000438826; ENST00000428082; ENST00000518321; ENST00000419890 | chr17 | 15435156 | 15434353 | − | TSF |
| 5% | chr17 | 15449230 | 15449099 | − | ENST00000522212; ENST00000519970; ENST00000225576; ENST00000581273; ENST00000584811; ENST00000438826; ENST00000428082; ENST00000518321; ENST00000419890 | chr17 | 15435156 | 15434353 | − | TSF |
| 5% | chr8 | 55013499 | 55013468 | − | ENST00000316963; ENST00000343231; ENST00000518546; ENST00000522007; ENST00000521898 | chr8 | 54994583 | 54994275 | − | TSF |
| 4% | chr9 | 78547295 | 78547399 | + | ENST00000545128; ENST00000376767; ENST00000376752 | chr9 | 78565414 | 78565806 | + | TSF |
| 4% | chr16 | 88873689 | 88873890 | + | ENST00000301019 | chr16 | 88875489 | 88875490 | + | TSF |
| 4% | chr8 | 71619168 | 71619388 | + | ENST00000408926; ENST00000520030 | chr8 | 71625661 | 71625673 | + | TSF |
| 4% | chr9 | 128510829; 128510854 | 128510902 | + | ENST00000342287; ENST00000373487; ENST00000373489; ENST00000373492; ENST00000373482; ENST00000491787; ENST00000447726 | chr9 | 128572989 | 128573209 | + | TSF |
| 4% | chr9 | 128510829; 128510854 | 128510902 | + | ENST00000342287; ENST00000373487; ENST00000373489; ENST00000373492; ENST00000373482; ENST00000491787; ENST00000447726 | chr9 | 128572989 | 128573209 | + | TSF |
| 4% | chr11 | 60701014 | 60701216 | + | ENST00000453848; ENST00000005286; ENST00000536409 | chr11 | 60701443 | 60701575 | + | TSF |
| 4% | chr11 | 60701014 | 60701216 | + | ENST00000453848; ENST00000005286; ENST00000536409 | chr11 | 60701443 | 60701575 | + | TSF |
| 4% | chr11 | 60701014 | 60701216 | + | ENST00000453848; ENST00000005286; ENST00000536409 | chr11 | 60701443 | 60701575 | + | TSF |
| 4% | chr7 | 74157788 | 74157859 | + | ENST00000324896; ENST00000346152; ENST00000353920; ENST00000416070 | chr7 | 74158483 | 74158600 | + | TSF |
| 4% | chr7 | 74157788 | 74157859 | + | ENST00000324896; ENST00000346152; ENST00000353920; ENST00000416070 | chr7 | 74158483 | 74158600 | + | TSF |
| 4% | chr7 | 74157788 | 74157859 | + | ENST00000324896; ENST00000346152; ENST00000353920; ENST00000416070 | chr7 | 74158483 | 74158600 | + | TSF |
| 4% | chr7 | 74157788 | 74157859 | + | ENST00000324896; ENST00000346152; ENST00000353920; ENST00000416070 | chr7 | 74158483 | 74158600 | + | TSF |
| 4% | chr12 | 71509738 | 71509630 | − | ENST00000549357 | chr12 | 71507025 | 71506982 | − | TSF |
| 4% | chr10 | 99229480 | 99229403 | − | ENST00000438925; ENST00000370782; ENST00000327238; ENST00000355839; ENST00000434392; ENST00000437002 | chr10 | 99229305 | 99229286 | − | TSF |
| 4% | chr10 | 99229480 | 99229403 | − | ENST00000438925; ENST00000370782; ENST00000327238; ENST00000355839; ENST00000434392; ENST00000437002 | chr10 | 99229305 | 99229286 | − | TSF |
| 4% | chr10 | 99229480 | 99229403 | − | ENST00000438925; ENST00000370782; ENST00000327238; ENST00000355839; ENST00000434392; ENST00000437002 | chr10 | 99229305 | 99229286 | − | TSF |
| 4% | chr10 | 99229480 | 99229403 | − | ENST00000438925; ENST00000370782; ENST00000327238; ENST00000355839; ENST00000434392; ENST00000437002 | chr10 | 99229305 | 99229286 | − | TSF |
| 4% | chr1 | 154794660; 154794654 | 154794565 | − | ENST00000271915; ENST00000361147; ENST00000358505 | chr1 | 154761737 | 154761457 | − | TSF |
| 4% | chr1 | 154794660; 154794654 | 154794565 | − | ENST00000271915; ENST00000361147; ENST00000358505 | chr1 | 154761737 | 154761457 | − | TSF |
| 4% | chr1 | 154794660; 154794654 | 154794565 | − | ENST00000271915; ENST00000361147; ENST00000358505 | chr1 | 154761737 | 154761457 | − | TSF |
| 4% | chr13 | 42457627 | 42457523 | − | ENST00000379310; ENST00000281496 | chr13 | 42456370 | 42455523 | − | TSF |
| 4% | chr7 | 619014 | 618893 | − | ENST00000544935; ENST00000537384 | chr7 | 618449 | 618307 | − | TSF |

TABLE 59-continued

Transcript fusion for Testicular Germ Cell Tumors (TGCT) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 4% | chr7 | 619014 | 618893 | − | ENST00000406797; ENST00000403562; ENST00000360274; ENST00000400758; ENST00000430040 ENST00000544935; ENST00000537384;chr7 ENST00000406797; ENST00000403562; ENST00000360274; ENST00000400758; ENST00000430040 | 618449 | 618307 | − | TSF |
| 4% | chr16 | 397025 | 396148 | − | ENST00000262320; ENST00000354866 chr16 | 369976 | 369697 | − | TSF |
| 4% | chr20 | 50803610; 50803604 | 50803371 | − | ENST00000371518; ENST00000361387;chr20 ENST00000346617; ENST00000371515; ENST00000216923 | 50801861 | 50801561 | − | TSF |
| 4% | chr20 | 50803610; 50803604 | 50803371 | − | ENST00000371518; ENST00000361387;chr20 ENST00000346617; ENST00000371515; ENST00000216923 | 50801861 | 50801561 | − | TSF |

TABLE 60

Transcript fusion for Testicular Germ Cell Tumors (TGCT) Coordinates of the fusion sequences for which the donor is the TE.

| 1' | 2' | 3' | 4' | 5' | 6' | 7' | 8' | 9' | 10' | 11' |
|---|---|---|---|---|---|---|---|---|---|---|
| 77% | chr14 | 51360331 | 51362440 | + | chr14 | 51368547 | 51368629 | + | ENST00000337334; ENST00000353130; ENST00000395752 | TSF |
| 68% | chr10 | 70433076 | 70433244 | + | chr10 | 70441156 | 70441245 | + | ENST00000373644 | TSF |
| 60% | chr18 | 51273 | 49727 | − | chr18 | 49237 | 49129 | − | ENST00000308911 | TSF |
| 59% | chr12 | 6602868 | 6602840 | − | chr12 | 6602138 | 6602028 | − | ENST00000229238 | TAF |
| 56% | chr22 | 29117574 | 29117506 | − | chr22 | 29115473 | 29115383; 29115458 | − | ENST00000348295; ENST00000382566; ENST00000382578; ENST00000404276; ENST00000328354; ENST00000405598; ENST00000382580; ENST00000433728; ENST00000448511; ENST00000402731; ENST00000403642; ENST00000439200 | TSF |
| 56% | chr22 | 29117574 | 29117506 | − | chr22 | 29115473 | 29115383; 29115458 | − | ENST00000348295; ENST00000382566; ENST00000382578; ENST00000404276; ENST00000328354; ENST00000405598; ENST00000382580; ENST00000433728; ENST00000448511; ENST00000402731; ENST00000403642; ENST00000439200 | TSF |
| 56% | chr22 | 29117574 | 29117506 | − | chr22 | 29115473 | 29115383; 29115458 | − | ENST00000348295; ENST00000382566; ENST00000382578; ENST00000404276; ENST00000328354; ENST00000405598; ENST00000382580; ENST00000433728; ENST00000448511; ENST00000402731; ENST00000403642; ENST00000439200 | TSF |
| 56% | chr22 | 29117574 | 29117506 | − | chr22 | 29115473 | 29115383; 29115458 | − | ENST00000348295; ENST00000382566; ENST00000382578; ENST00000404276; ENST00000328354; ENST00000405598; ENST00000382580; ENST00000433728; ENST00000448511; ENST00000402731; ENST00000403642; ENST00000439200 | TSF |
| 56% | chr22 | 29117574 | 29117506 | − | chr22 | 29115473 | 29115383; 29115458 | − | ENST00000348295; ENST00000382566; ENST00000382578; ENST00000404276; ENST00000328354; ENST00000405598; ENST00000382580; ENST00000433728; ENST00000448511; ENST00000402731; ENST00000403642; ENST00000439200 | TSF |
| 56% | chr16 | 23606905 | 23606750 | − | chr16 | 23598640 | 23598518 | − | ENST00000007516; ENST00000570319 | TSF |
| 53% | chr17 | 80440912 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |
| 53% | chr17 | 80440912 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |
| 53% | chr17 | 80440912 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |
| 53% | chr17 | 80440912 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |

TABLE 60-continued

Transcript fusion for Testicular Germ Cell Tumors (TGCT) Coordinates of the fusion sequences for which the donor is the TE.

| 1' | 2' | 3' | 4' | 5' | 6' | 7' | 8' | 9' | 10' | 11' |
|---|---|---|---|---|---|---|---|---|---|---|
| 53% | chrX | 793481 | 48793462 | – | chrX | 48792291 | 48792227 | – | ENST00000396743; ENST00000455452; ENST00000156084; ENST00000376488; ENST00000428668 | TAF |
| 53% | chrX | 793481 | 48793462 | – | chrX | 48792291 | 48792227 | – | ENST00000396743; ENST00000455452; ENST00000156084; ENST00000376488; ENST00000428668 | TAF |
| 52% | chrX | 2291342 | 2291084 | – | chr | 2209644 | 2209543 | – | ENST00000334651; ENST00000412516; ENST00000444280 | TAF |
| 52% | chrX | 2291342 | 2291084 | – | chr | 2209644 | 2209543 | – | ENST00000334651; ENST00000412516; ENST00000444280 | TAF |
| 52% | chrX | 2291342 | 2291084 | – | chr | 2209644 | 2209543 | – | ENST00000334651; ENST00000412516; ENST00000444280 | TAF |
| 52% | chrX | 2291342 | 2291084 | – | chr | 2209644 | 2209543 | – | ENST00000334651; ENST00000412516; ENST00000444280 | TAF |
| 52% | chrX | 2291342 | 2291084 | – | chr | 2209644 | 2209543 | – | ENST00000334651; ENST00000412516; ENST00000444280 | TAF |
| 52% | chrX | 2291342 | 2291084 | – | chr | 2209644 | 2209543 | – | ENST00000334651; ENST00000412516; ENST00000444280 | TAF |
| 52% | chrX | 2291342 | 2291084 | – | chr | 2209644 | 2209543 | – | ENST00000334651; ENST00000412516; ENST00000444280 | TAF |
| 52% | chrX | 2291342 | 2291084 | – | chr | 2209644 | 2209543 | – | ENST00000334651; ENST00000412516; ENST00000444280 | TAF |
| 51% | chr19 | 39110121 | 39110170 | + | chr19 | 39110977 | 39111075 | + | ENST00000248342; ENST00000588934; ENST00000545173; ENST00000586513; ENST00000592558 | TAF |
| 51% | chr19 | 39110121 | 39110170 | + | chr19 | 39110977 | 39111075 | + | ENST00000248342; ENST00000588934; ENST00000545173; ENST00000586513; ENST00000592558 | TAF |
| 51% | chr19 | 39110121 | 39110170 | + | chr19 | 39110977 | 39111075 | + | ENST00000248342; ENST00000588934; ENST00000545173; ENST00000586513; ENST00000592558 | TAF |
| 51% | chr19 | 39110121 | 39110170 | + | chr19 | 39110977 | 39111075 | + | ENST00000248342; ENST00000588934; ENST00000545173; ENST00000586513; ENST00000592558 | TAF |
| 51% | chr19 | 39110121 | 39110170 | + | chr19 | 39110977 | 39111075 | + | ENST00000248342; ENST00000588934; ENST00000545173; ENST00000586513; ENST00000592558 | TAF |
| 45% | chr19 | 49121994 | 49121817 | – | chr19 | 49121134 | 49121048 | – | ENST00000549920; ENST00000547897; ENST00000084795; ENST00000550645; ENST00000549370; ENST00000549273 | TAF |
| 45% | chr19 | 49121994 | 49121817 | – | chr19 | 49121134 | 49121048 | – | ENST00000549920; ENST00000547897; ENST00000084795; ENST00000550645; ENST00000549370; ENST00000549273 | TAF |
| 45% | chr19 | 49121994 | 49121817 | – | chr19 | 49121134 | 49121048 | – | ENST00000549920; ENST00000547897; ENST00000084795; ENST00000550645; ENST00000549370; ENST00000549273 | TAF |
| 45% | chr19 | 49121994 | 49121817 | – | chr19 | 49121134 | 49121048 | – | ENST00000549920; ENST00000547897; ENST00000084795; ENST00000550645; ENST00000549370; ENST00000549273 | TAF |
| 45% | chr19 | 49121994 | 49121817 | – | chr19 | 49121134 | 49121048 | – | ENST00000549920; ENST00000547897; ENST00000084795; ENST00000550645; ENST00000549370; ENST00000549273 | TAF |
| 43% | chr20 | 30060256 | 30059518 | – | chr20 | 30053466 | 30053309 | – | ENST00000317676 | TAF |
| 42% | chrX | 71397824 | 71398498 | + | chrX | 71406311 | 71406384 | + | ENST00000218432; ENST00000423432; ENST00000373669; ENST00000496835; ENST00000439980; ENST00000446576 | TAF |
| 42% | chrX | 71397824 | 71398498 | + | chrX | 71406311 | 71406384 | + | ENST00000218432; ENST00000423432; ENST00000373669; ENST00000496835; ENST00000439980; ENST00000446576 | TAF |
| 42% | chrX | 71397824 | 71398498 | + | chrX | 71406311 | 71406384 | + | ENST00000218432; ENST00000423432; ENST00000373669; ENST00000496835; ENST00000439980; ENST00000446576 | TAF |
| 42% | chrX | 71397824 | 71398498 | + | chrX | 71406311 | 71406384 | + | ENST00000218432; ENST00000423432; ENST00000373669; ENST00000496835; ENST00000439980; ENST00000446576 | TAF |
| 41% | chr11 | 93468219 | 93468129 | – | chr11 | 93467826 | 93467791; 93467814 | – | ENST00000393259; ENST00000527169 | TAF |
| 41% | chr11 | 93468219 | 93468129 | – | chr11 | 93467826 | 93467791; 93467814 | – | ENST00000393259; ENST00000527169 | TAF |
| 41% | chr3 | 185411133 | 185410965 | – | chr3 | 185410550 | 185410487 | – | ENST00000382199; ENST00000421047; ENST00000457616; ENST00000346192 | TAF |
| 41% | chr3 | 185411133 | 185410965 | – | chr3 | 185410550 | 185410487 | – | ENST00000382199; ENST00000421047; ENST00000457616; ENST00000346192 | TAF |
| 41% | chr1 | 1422590 | 1422685 | + | chr1 | 1423243 | 1423294 | + | ENST00000308647 | TSF |
| 39% | chr2 | 38983894 | 38983253 | – | chr2 | 38977336 | 38977156 | – | ENST00000313117; ENST00000425778; ENST00000425941; ENST00000446327; | TSF |

TABLE 60-continued

Transcript fusion for Testicular Germ Cell Tumors (TGCT) Coordinates of the fusion sequences for which the donor is the TE.

| 1' | 2' | 3' | 4' | 5' 6' | 7' | 8' | 9' 10' | 11' |
|---|---|---|---|---|---|---|---|---|
| 39% | chr2 | 38983894 | 38983253 | − chr2 | 38977336 | 38977156 | − | ENST00000409276; ENST00000431066; ENST00000443213 ENST00000313117; ENST00000425778;TSF ENST00000425941; ENST00000446327; |
| 39% | chr2 | 38983894 | 38983253 | − chr2 | 38977336 | 38977156 | − | ENST00000409276; ENST00000431066; ENST00000443213 ENST00000313117; ENST00000425778;TSF ENST00000425941; ENST00000446327; |
| 39% | chr2 | 38983894 | 38983253 | − chr2 | 38977336 | 38977156 | − | ENST00000409276; ENST00000431066; ENST00000443213 ENST00000313117; ENST00000425778;TSF ENST00000425941; ENST00000446327; |
| 39% | chr2 | 38983894 | 38983253 | − chr2 | 38977336 | 38977156 | − | ENST00000409276; ENST00000431066; ENST00000443213 ENST00000313117; ENST00000425778;TSF ENST00000425941; ENST00000446327; |
| 37% | chr7 | 150730019 | 150730148 | + chr7 | 150730692 | 150730929; 150731004; 150730700 | + | ENST00000461373; ENST00000358849;TAF ENST00000489192; ENST00000297504; ENST00000356058; ENST00000498578; ENST00000477719; ENST00000477092 |
| 37% | chr7 | 150730019 | 150730148 | + chr7 | 150730692 | 150730929; 150731004; 150730700 | + | ENST00000461373; ENST00000358849;TAF ENST00000489192; ENST00000297504; ENST00000356058; ENST00000498578; ENST00000477719; ENST00000477092 |
| 37% | chr7 | 150730019 | 150730148 | + chr7 | 150730692 | 150730929; 150731004; 150730700 | + | ENST00000461373; ENST00000358849;TAF ENST00000489192; ENST00000297504; ENST00000356058; ENST00000498578; ENST00000477719; ENST00000477092 |
| 37% | chr7 | 150730019 | 150730148 | + chr7 | 150730692 | 150730929; 150731004; 150730700 | + | ENST00000461373; ENST00000358849;TAF ENST00000489192; ENST00000297504; ENST00000356058; ENST00000498578; ENST00000477719; ENST00000477092 |
| 37% | chr7 | 150730019 | 150730148 | + chr7 | 150730692 | 150730929; 150731004; 150730700 | + | ENST00000461373; ENST00000358849;TAF ENST00000489192; ENST00000297504; ENST00000356058; ENST00000498578; ENST00000477719; ENST00000477092 |
| 37% | chr7 | 150730019 | 150730148 | + chr7 | 150730692 | 150730929; 150731004; 150730700 | + | ENST00000461373; ENST00000358849;TAF ENST00000489192; ENST00000297504; ENST00000356058; ENST00000498578; ENST00000477719; ENST00000477092 |
| 36% | chr7 | 74158449 | 74158566 | + chr7 | 74159097 | 74159280 | + | ENST00000324896; ENST00000346152;TAF ENST00000353920; ENST00000416070 |
| 35% | chr7 | 48039730 | 48039725 | − chr7 | 48035743 | 48035628 | − | ENST00000453071; ENST00000297325;TSF ENST00000412371; ENST00000412142; ENST00000395572; ENST00000453192; ENST00000438771 |
| 35% | chr7 | 48039730 | 48039725 | − chr7 | 48035743 | 48035628 | − | ENST00000453071; ENST00000297325;TSF ENST00000412371; ENST00000412142; ENST00000395572; ENST00000453192; ENST00000438771 |
| 35% | chr7 | 48039730 | 48039725 | − chr7 | 48035743 | 48035628 | − | ENST00000453071; ENST00000297325;TSF ENST00000412371; ENST00000412142; ENST00000395572; ENST00000453192; ENST00000438771 |
| 34% | chr7 | 73098299 | 73098330 | + chr7 | 73100966 | 73101061 | + | ENST00000265758; ENST00000432522;TAF ENST00000421744; ENST00000428163; ENST00000423166; ENST00000423497 |
| 34% | chr7 | 73098299 | 73098330 | + chr7 | 73100966 | 73101061 | + | ENST00000265758; ENST00000432522;TAF ENST00000421744; ENST00000428163; ENST00000423166; ENST00000423497 |
| 34% | chr7 | 73098299 | 73098330 | + chr7 | 73100966 | 73101061 | + | ENST00000265758; ENST00000432522;TAF ENST00000421744; ENST00000428163; ENST00000423166; ENST00000423497 |
| 34% | chr7 | 73098299 | 73098330 | + chr7 | 73100966 | 73101061 | + | ENST00000265758; ENST00000432522;TAF ENST00000421744; ENST00000428163; ENST00000423166; ENST00000423497 |
| 34% | chr7 | 73098299 | 73098330 | + chr7 | 73100966 | 73101061 | + | ENST00000265758; ENST00000432522;TAF ENST00000421744; ENST00000428163; ENST00000423166; ENST00000423497 |
| 34% | chr2 | 175806110 | 175805544 | − chr2 | 175783293 | 175783262 | − | ENST00000409900; ENST00000409156 TAF |

TABLE 60-continued

Transcript fusion for Testicular Germ Cell Tumors (TGCT) Coordinates of the fusion sequences for which the donor is the TE.

| 1' | 2' | 3' | 4' | 5' | 6' | 7' | 8' | 9' | 10' | 11' |
|---|---|---|---|---|---|---|---|---|---|---|
| 34% | chr2 | 175806110 | 175805544 | − | chr2 | 175783293 | 175783262 | − | ENST00000409900; ENST00000409156 | TAF |
| 34% | chr15 | 40187476 | 40186733 | − | chr15 | 40099459 | 40099207 | − | ENST00000561100; ENST00000543580 | TSF |
| 33% | chr12 | 122430912 | 122431615 | + | chr12 | 122437622 | 122437850 | + | ENST00000288912 | TAF |
| 33% | chr7 | 21979898 | 21979880 | − | chr7 | 21956512 | 21956372 | − | ENST00000406877; ENST00000373934 | TAF |
| 33% | chr7 | 21979898 | 21979880 | − | chr7 | 21956512 | 21956372 | − | ENST00000406877; ENST00000373934 | TAF |
| 32% | chr17 | 79214190 | 79214239 | + | chr17 | 79214787 | 79214816; 79214953 | + | ENST00000431388; ENST00000576002 | TAF |
| 32% | chr17 | 79214190 | 79214239 | + | chr17 | 79214787 | 79214816; 79214953 | + | ENST00000431388; ENST00000576002 | TAF |
| 32% | chr5 | 176950016 | 176949956 | − | chr5 | 176949072 | 176948976 | − | ENST00000514747; ENST00000329540; ENST00000443375; ENST00000524677 | TAF |
| 31% | chr19 | 54631006 | 54631115 | + | chr19 | 54631448 | 54631575 | + | ENST00000321030; ENST00000419967 | TAF |
| 31% | chr19 | 54631006 | 54631115 | + | chr19 | 54631448 | 54631575 | + | ENST00000321030; ENST00000419967 | TAF |
| 31% | chr12 | 6602868 | 6602754 | − | chr12 | 6602138 | 6602028 | − | ENST00000229238 | TSF |
| 31% | chr1 | 53346099 | 53346501 | + | chr1 | 53347143 | 53347337 | + | ENST00000371532; ENST00000371528 | TSF |
| 31% | chr3 | 48252382 | 48252880 | + | chr3 | 48265844 | 48265951 | + | ENST00000296435; ENST00000576243 | TSF |
| 29% | chr2 | 38983894 | 38983132 | − | chr2 | 38977336 | 38977156 | − | ENST00000313117; ENST00000425778; ENST00000425941; ENST00000446327; ENST00000409276; ENST00000431066; ENST00000443213 | TAF |
| 29% | chr2 | 38983894 | 38983132 | − | chr2 | 38977336 | 38977156 | − | ENST00000313117; ENST00000425778; ENST00000425941; ENST00000446327; ENST00000409276; ENST00000431066; ENST00000443213 | TAF |
| 29% | chr2 | 38983894 | 38983132 | − | chr2 | 38977336 | 38977156 | − | ENST00000313117; ENST00000425778; ENST00000425941; ENST00000446327; ENST00000409276; ENST00000431066; ENST00000443213 | TAF |
| 29% | chr2 | 38983894 | 38983132 | − | chr2 | 38977336 | 38977156 | − | ENST00000313117; ENST00000425778; ENST00000425941; ENST00000446327; ENST00000409276; ENST00000431066; ENST00000443213 | TAF |
| 29% | chr2 | 38983894 | 38983132 | − | chr2 | 38977336 | 38977156 | − | ENST00000313117; ENST00000425778; ENST00000425941; ENST00000446327; ENST00000409276; ENST00000431066; ENST00000443213 | TAF |
| 29% | chr1 | 52322378 | 52322114 | − | chr1 | 52306186 | 52305898 | − | ENST00000352171; ENST00000354831 | TSF |
| 29% | chr1 | 52322378 | 52322114 | − | chr1 | 52306186 | 52305898 | − | ENST00000352171; ENST00000354831 | TSF |
| 29% | chr19 | 39347374 | 39346206 | − | chr19 | 39338074 | 39337956 | − | ENST00000221419; ENST00000601449; ENST00000600233; ENST00000601813 | TSF |
| 29% | chr19 | 39347374 | 39346206 | − | chr19 | 39338074 | 39337956 | − | ENST00000221419; ENST00000601449; ENST00000600233; ENST00000601813 | TSF |
| 29% | chr19 | 39347374 | 39346206 | − | chr19 | 39338074 | 39337956 | − | ENST00000221419; ENST00000601449; ENST00000600233; ENST00000601813 | TSF |
| 29% | chr17 | 3367100 | 3366820 | − | chr17 | 3366061 | 3366001; 3366037 | − | ENST00000397168; ENST00000572969; ENST00000355380; ENST00000575375; ENST00000573128; ENST00000541913; ENST00000268981; ENST00000574051; ENST00000572582; ENST00000574457 | TSF |
| 29% | chr17 | 3367100 | 3366820 | − | chr17 | 3366061 | 3366001; 3366037 | − | ENST00000397168; ENST00000572969; ENST00000355380; ENST00000575375; ENST00000573128; ENST00000541913; ENST00000268981; ENST00000574051; ENST00000572582; ENST00000574457 | TSF |
| 29% | chr17 | 3367100 | 3366820 | − | chr17 | 3366061 | 3366001; 3366037 | − | ENST00000397168; ENST00000572969; ENST00000355380; ENST00000575375; ENST00000573128; ENST00000541913; ENST00000268981; ENST00000574051; ENST00000572582; ENST00000574457 | TSF |
| 29% | chr17 | 3367100 | 3366820 | − | chr17 | 3366061 | 3366001; 3366037 | − | ENST00000397168; ENST00000572969; ENST00000355380; ENST00000575375; ENST00000573128; ENST00000541913; ENST00000268981; ENST00000574051; ENST00000572582; ENST00000574457 | TSF |
| 29% | chr17 | 3367100 | 3366820 | − | chr17 | 3366061 | 3366001; 3366037 | − | ENST00000397168; ENST00000572969; ENST00000355380; ENST00000575375; ENST00000573128; ENST00000541913; ENST00000268981; ENST00000574051; ENST00000572582; ENST00000574457 | TSF |
| 28% | chr7 | 23675523 | 23676342 | + | chr7 | 23682550 | 23682734; 23682643 | + | ENST00000307471; ENST00000409765; ENST00000448353; ENST00000410069 | TSF |
| 28% | chr7 | 23675523 | 23676342 | + | chr7 | 23682550 | 23682734; 23682643 | + | ENST00000307471; ENST00000409765; ENST00000448353; ENST00000410069 | TSF |
| 28% | chr19 | 39347374 | 39346430 | − | chr19 | 39338074 | 39337956 | − | ENST00000221419; ENST00000601449; ENST00000600233; ENST00000601813 | TSF |
| 28% | chr19 | 39347374 | 39346430 | − | chr19 | 39338074 | 39337956 | − | ENST00000221419; ENST00000601449; | TSF |

TABLE 60-continued

Transcript fusion for Testicular Germ Cell Tumors (TGCT) Coordinates of the fusion sequences for which the donor is the TE.

| 1' | 2' | 3' | 4' | 5' | 6' | 7' | 8' | 9' | 10' | 11' |
|---|---|---|---|---|---|---|---|---|---|---|
| 28% | chr19 | 39347374 | 39346430 | − | chr19 | 39338074 | 39337956 | − | ENST00000600233; ENST00000601813 ENST00000221419; ENST00000601449; | TSF |
| 26% | chr20 | 18495298 | 18495446 | + | chr20 | 18496294 | 18496380 | + | ENST00000450074; ENST00000262544; ENST00000336714; ENST00000377475; ENST00000377465 | TSF |
| 26% | chr20 | 18495298 | 18495446 | + | chr20 | 18496294 | 18496380 | + | ENST00000450074; ENST00000262544; ENST00000336714; ENST00000377475; ENST00000377465 | TSF |
| 25% | chr12 | 54862718 | 54862609 | − | chr12 | 54858951 | 54858851 | − | ENST00000546931; ENST00000552397; ENST00000305879 | TSF |
| 25% | chr12 | 54862718 | 54862609 | − | chr12 | 54858951 | 54858851 | − | ENST00000546931; ENST00000552397; ENST00000305879 | TSF |
| 25% | chr3 | 195593372 | 195593261 | − | chr3 | 195591058 | 195591052 | − | ENST00000416152; ENST00000381916; ENST00000333602; ENST00000428187; ENST00000392400 | TSF |
| 24% | chr4 | 39469818 | 39470047 | + | chr4 | 39471639 | 39471784 | + | ENST00000340169; ENST00000261434; ENST00000513731; ENST00000381846 | TAF |
| 24% | chr4 | 39469818 | 39470047 | + | chr4 | 39471639 | 39471784 | + | ENST00000340169; ENST00000261434; ENST00000513731; ENST00000381846 | TAF |
| 24% | chr11 | 64508144 | 64507840 | − | chr11 | 64507635 | 64507485 | − | ENST00000377494; ENST00000394432; ENST00000377497; ENST00000354024; ENST00000431822 | TAF |
| 24% | chr11 | 64508144 | 64507840 | − | chr11 | 64507635 | 64507485 | − | ENST00000377494; ENST00000394432; ENST00000377497; ENST00000354024; ENST00000431822 | TAF |
| 24% | chr11 | 64508144 | 64507840 | − | chr11 | 64507635 | 64507485 | − | ENST00000377494; ENST00000394432; ENST00000377497; ENST00000354024; ENST00000431822 | TAF |
| 24% | chr20 | 42342728 | 42342751 | + | chr20 | 42343774 | 42343923 | + | ENST00000396863; ENST00000217026 | TSF |
| 24% | chr19 | 22699420 | 22699248 | − | chr19 | 22697432 | 22697166 | − | ENST00000593802 | TSF |
| 23% | chr16 | 19723118 | 19723116 | − | chr16 | 19722762 | 19722694 | − | ENST00000219837 | TAF |
| 23% | chr3 | 10112843 | 10113019 | + | chr3 | 10114555 | 10114665 | + | ENST00000287647; ENST00000383806; ENST00000383807; ENST00000419585; ENST00000421731 | TSF |
| 23% | chr3 | 10112843 | 10113019 | + | chr3 | 10114555 | 10114665 | + | ENST00000287647; ENST00000383806; ENST00000383807; ENST00000419585; ENST00000421731 | TSF |
| 23% | chr3 | 10112843 | 10113019 | + | chr3 | 10114555 | 10114665 | + | ENST00000287647; ENST00000383806; ENST00000383807; ENST00000419585; ENST00000421731 | TSF |
| 23% | chr12 | 21426370 | 21426215 | − | chr12 | 21422701 | 21422482 | − | ENST00000307378; ENST00000452078; ENST00000458504; ENST00000537524 | TSF |
| 23% | chr21 | 27478957 | 27478879 | − | chr21 | 27462388 | 27462259 | − | ENST00000346798; ENST00000354192; ENST00000348990; ENST00000357903; ENST00000358918; ENST00000359726; ENST00000448388; ENST00000440126; ENST00000439274 | TSF |
| 23% | chr21 | 27478957 | 27478879 | − | chr21 | 27462388 | 27462259 | − | ENST00000346798; ENST00000354192; ENST00000348990; ENST00000357903; ENST00000358918; ENST00000359726; ENST00000448388; ENST00000440126; ENST00000439274 | TSF |
| 23% | chr21 | 27478957 | 27478879 | − | chr21 | 27462388 | 27462259 | − | ENST00000346798; ENST00000354192; ENST00000348990; ENST00000357903; ENST00000358918; ENST00000359726; ENST00000448388; ENST00000440126; ENST00000439274 | TSF |
| 23% | chr21 | 27478957 | 27478879 | − | chr21 | 27462388 | 27462259 | − | ENST00000346798; ENST00000354192; ENST00000348990; ENST00000357903; ENST00000358918; ENST00000359726; ENST00000448388; ENST00000440126; ENST00000439274 | TSF |
| 23% | chr21 | 27478957 | 27478879 | − | chr21 | 27462388 | 27462259 | − | ENST00000346798; ENST00000354192; ENST00000348990; ENST00000357903; ENST00000358918; ENST00000359726; ENST00000448388; ENST00000440126; ENST00000439274 | TSF |
| 23% | chr20 | 30014070 | 30014925 | + | chr20 | 30037832 | 30037977 | + | ENST00000376309 | TSF |
| 23% | chr14 | 51360331 | 51360476 | + | chr14 | 51368547 | 51368629 | + | ENST00000337334; ENST00000353130; ENST00000395752 | TSF |
| 23% | chr19 | 55501071 | 55501120 | + | chr19 | 55501390 | 55501560; 55501464 | + | ENST00000543010; ENST00000391721; ENST00000339757; ENST00000448584; ENST00000537859; ENST00000427260; ENST00000538819; ENST00000263437; ENST00000543277 | TSF |

TABLE 60-continued

Transcript fusion for Testicular Germ Cell Tumors (TGCT) Coordinates of the fusion sequences for which the donor is the TE.

| 1' | 2' | 3' | 4' | 5' | 6' | 7' | 8' | 9' | 10' | 11' |
|---|---|---|---|---|---|---|---|---|---|---|
| 23% | chr19 | 55501071 | 55501120 | + | chr19 | 55501390 | 55501560; 55501464 | + | ENST00000543010; ENST00000391721; ENST00000339757; ENST00000448584; ENST00000537859; ENST00000427260; ENST00000538819; ENST00000263437; ENST00000543277 | TSF |
| 23% | chr21 | 27462714 | 27462572 | − | chr21 | 27462388 | 27462259 | − | ENST00000543010; ENST00000391721; ENST00000339757; ENST00000448584; ENST00000537859; ENST00000427260; ENST00000538819; ENST00000263437; ENST00000543277 | TSF |
| 23% | chr21 | 27462714 | 27462572 | − | chr21 | 27462388 | 27462259 | − | ENST00000543010; ENST00000391721; ENST00000339757; ENST00000448584; ENST00000537859; ENST00000427260; ENST00000538819; ENST00000263437; ENST00000543277 | TSF |
| 23% | chr21 | 27462714 | 27462572 | − | chr21 | 27462388 | 27462259 | − | ENST00000543010; ENST00000391721; ENST00000339757; ENST00000448584; ENST00000537859; ENST00000427260; ENST00000538819; ENST00000263437; ENST00000543277 | TSF |
| 23% | chr21 | 27462714 | 27462572 | − | chr21 | 27462388 | 27462259 | − | ENST00000543010; ENST00000391721; ENST00000339757; ENST00000448584; ENST00000537859; ENST00000427260; ENST00000538819; ENST00000263437; ENST00000543277 | TSF |
| 23% | chr21 | 27462714 | 27462572 | − | chr21 | 27462388 | 27462259 | − | ENST00000543010; ENST00000391721; ENST00000339757; ENST00000448584; ENST00000537859; ENST00000427260; ENST00000538819; ENST00000263437; ENST00000543277 | TSF |
| 23% | chr5 | 141373148 | 141373145 | − | chr5 | 141371485 | 141371430 | | ENST00000513454 | TSF |
| 23% | chr14 | 55484360 | 55484310 | − | chr14 | 55480314 | 55480203 | − | ENST00000360586; ENST00000455555 | TSF |
| 23% | chr14 | 55484360 | 55484310 | − | chr14 | 55480314 | 55480203 | − | ENST00000360586; ENST00000455555 | TSF |
| 22% | chr1 | 169819657 | 169819707 | + | chr1 | 169820958 | 169821077 | + | ENST00000359326; ENST00000286031 | TSF |
| 22% | chr8 | 3040579 | 3040513 | − | chr8 | 3038736 | 3038632 | − | ENST00000335551; ENST00000400186; ENST00000602723; ENST00000520002; ENST00000602557; ENST00000537824; ENST00000542608; ENST00000539096 | TSF |
| 22% | chr8 | 3040579 | 3040513 | − | chr8 | 3038736 | 3038632 | − | ENST00000335551; ENST00000400186; ENST00000602723; ENST00000520002; ENST00000602557; ENST00000537824; ENST00000542608; ENST00000539096 | TSF |
| 22% | chr8 | 3040579 | 3040513 | − | chr8 | 3038736 | 3038632 | − | ENST00000335551; ENST00000400186; ENST00000602723; ENST00000520002; ENST00000602557; ENST00000537824; ENST00000542608; ENST00000539096 | TSF |
| 22% | chr8 | 3040579 | 3040513 | − | chr8 | 3038736 | 3038632 | − | ENST00000335551; ENST00000400186; ENST00000602723; ENST00000520002; ENST00000602557; ENST00000537824; ENST00000542608; ENST00000539096 | TSF |
| 22% | chr3 | 122500000 | 122499597 | − | chr3 | 122496753 | 122496568 | − | ENST00000383659; ENST00000306103 | TSF |
| 22% | chr3 | 122500000 | 122499597 | − | chr3 | 122496753 | 122496568 | − | ENST00000383659; ENST00000306103 | TSF |
| 21% | chr19 | 39958795 | 39959001 | + | chr19 | 39959396 | 39959501 | + | ENST00000599117; ENST00000402194; ENST00000432763; ENST00000359191; ENST00000598725 | TAF |
| 21% | chr8 | 104389530 | 104389551 | + | chr8 | 104390255 | 104390471 | + | ENST00000330295; ENST00000520337 | TAF |
| 21% | chr6 | 24710791 | 24710723 | − | chr6 | 24709139 | 24709005 | − | ENST00000378119; ENST00000540769; ENST00000378102 | TAF |
| 21% | chr22 | 22899971 | 22899965 | − | chr22 | 22893511 | 22893189; 22893185; 22893481; 22893274 | − | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |
| 21% | chr22 | 22899971 | 22899965 | − | chr22 | 22893511 | 22893189; 22893185; 22893481; 22893274 | − | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |
| 21% | chr22 | 22899971 | 22899965 | − | chr22 | 22893511 | 22893189; 22893185; 22893481; 22893274 | − | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |

TABLE 60-continued

Transcript fusion for Testicular Germ Cell Tumors (TGCT) Coordinates of the fusion sequences for which the donor is the TE.

| 1' | 2' | 3' | 4' | 5' | 6' | 7' | 8' | 9' | 10' | 11' |
|---|---|---|---|---|---|---|---|---|---|---|
| 21% | chr22 | 22899971 | 22899965 | − | chr22 | 22893511 | 22893189; 22893185; 22893481; 22893274 | − | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |
| 21% | chr22 | 22899971 | 22899965 | − | chr22 | 22893511 | 22893189; 22893185; 22893481; 22893274 | − | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |
| 21% | chr22 | 22899971 | 22899965 | − | chr22 | 22893511 | 22893189; 22893185; 22893481; 22893274 | − | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |
| 21% | chr22 | 22899971 | 22899965 | − | chr22 | 22893511 | 22893189; 22893185; 22893481; 22893274 | − | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |
| 21% | chr1 | 6366296 | 6365480 | − | chr1 | 6355040 | 6354924 | − | ENST00000608083; ENST00000377842; ENST00000377845; ENST00000377855; ENST00000377860; ENST00000418124; ENST00000545482; ENST00000361521; ENST00000473466 | TSF |
| 21% | chr1 | 6366296 | 6365480 | − | chr1 | 6355040 | 6354924 | − | ENST00000608083; ENST00000377842; ENST00000377845; ENST00000377855; ENST00000377860; ENST00000418124; ENST00000545482; ENST00000361521; ENST00000473466 | TSF |
| 21% | chr1 | 6366296 | 6365480 | − | chr1 | 6355040 | 6354924 | − | ENST00000608083; ENST00000377842; ENST00000377845; ENST00000377855; ENST00000377860; ENST00000418124; ENST00000545482; ENST00000361521; ENST00000473466 | TSF |
| 21% | chr1 | 6366296 | 6365480 | − | chr1 | 6355040 | 6354924 | − | ENST00000608083; ENST00000377842; ENST00000377845; ENST00000377855; ENST00000377860; ENST00000418124; ENST00000545482; ENST00000361521; ENST00000473466 | TSF |
| 21% | chr12 | 7846135 | 7846037 | − | chr12 | 7843300 | 7842474 | − | ENST00000329913 | TSF |
| 21% | chr6 | 111494644 | 111494728 | + | chr6 | 111498415 | 111498868; 111498889 | + | ENST00000368851; ENST00000439288; ENST00000419619 | TSF |
| 21% | chr6 | 111494644 | 111494728 | + | chr6 | 111498415 | 111498868; 111498889 | + | ENST00000368851; ENST00000439288; ENST00000419619 | TSF |
| 21% | chr6 | 111494644 | 111494728 | + | chr6 | 111498415 | 111498868; 111498889 | + | ENST00000368851; ENST00000439288; ENST00000419619 | TSF |
| 21% | chr1 | 156307574 | 156307468 | − | chr1 | 156305679 | 156305618 | − | ENST00000295688; ENST00000368259; ENST00000413555; ENST00000496684; ENST00000446905; ENST00000478640; ENST00000415548 | TSF |
| 21% | chr1 | 156307574 | 156307468 | − | chr1 | 156305679 | 156305618 | − | ENST00000295688; ENST00000368259; ENST00000413555; ENST00000496684; ENST00000446905; ENST00000478640; ENST00000415548 | TSF |
| 21% | chr1 | 156307574 | 156307468 | − | chr1 | 156305679 | 156305618 | − | ENST00000295688; ENST00000368259; ENST00000413555; ENST00000496684; ENST00000446905; ENST00000478640; ENST00000415548 | TSF |
| 21% | chr1 | 156307574 | 156307468 | − | chr1 | 156305679 | 156305618 | − | ENST00000295688; ENST00000368259; ENST00000413555; ENST00000496684; ENST00000446905; ENST00000478640; ENST00000415548 | TSF |
| 21% | chr1 | 156307574 | 156307468 | − | chr1 | 156305679 | 156305618 | − | ENST00000295688; ENST00000368259; ENST00000413555; ENST00000496684; ENST00000446905; ENST00000478640; ENST00000415548 | TSF |
| 21% | chr1 | 156307574 | 156307468 | − | chr1 | 156305679 | 156305618 | − | ENST00000295688; ENST00000368259; | TSF |

TABLE 60-continued

Transcript fusion for Testicular Germ Cell Tumors (TGCT) Coordinates of the fusion sequences for which the donor is the TE.

| 1' | 2' | 3' | 4' | 5' 6' | 7' | 8' | 9' 10' | 11' |
|---|---|---|---|---|---|---|---|---|
| | | | | | | | | ENST00000413555; ENST00000496684; ENST00000446905; ENST00000478640; ENST00000415548 |
| 20% | chr12 | 57899758 | 57899899 | + chr12 | 157905481 | 57905651 | + | ENST00000537638; ENST00000262027;TAF ENST00000315473 |
| 20% | chr12 | 57899758 | 57899899 | + chr12 | 157905481 | 57905651 | + | ENST00000537638; ENST00000262027;TAF ENST00000315473 |
| 20% | chr12 | 57899758 | 57899899 | + chr12 | 157905481 | 57905651 | + | ENST00000537638; ENST00000262027;TAF ENST00000315473 |
| 20% | chr16 | 89607673 | 89607792 | + chr16 | 89611056 | 89611180 | + | ENST00000268704; ENST00000569820 TAF |
| 20% | chr16 | 89607673 | 89607792 | + chr16 | 89611056 | 89611180 | + | ENST00000268704; ENST00000569820 TAF |
| 20% | chr2 | 234174801 | 234174805 | + chr2 | 234178648 | 234178713 | + | ENST00000347464; ENST00000392017;TAF ENST00000444735; ENST00000373525; ENST00000419681; ENST00000417017; ENST00000392020; ENST00000392018 |
| 20% | chr2 | 234174801 | 234174805 | + chr2 | 234178648 | 234178713 | + | ENST00000347464; ENST00000392017;TAF ENST00000444735; ENST00000373525; ENST00000419681; ENST00000417017; ENST00000392020; ENST00000392018 |
| 20% | chr2 | 234174801 | 234174805 | + chr2 | 234178648 | 234178713 | + | ENST00000347464; ENST00000392017;TAF ENST00000444735; ENST00000373525; ENST00000419681; ENST00000417017; ENST00000392020; ENST00000392018 |
| 20% | chr2 | 234174801 | 234174805 | + chr2 | 234178648 | 234178713 | + | ENST00000347464; ENST00000392017;TAF ENST00000444735; ENST00000373525; ENST00000419681; ENST00000417017; ENST00000392020; ENST00000392018 |
| 20% | chr2 | 234174801 | 234174805 | + chr2 | 234178648 | 234178713 | + | ENST00000347464; ENST00000392017;TAF ENST00000444735; ENST00000373525; ENST00000419681; ENST00000417017; ENST00000392020; ENST00000392018 |
| 20% | chr2 | 234174801 | 234174805 | + chr2 | 234178648 | 234178713 | + | ENST00000347464; ENST00000392017;TAF ENST00000444735; ENST00000373525; ENST00000419681; ENST00000417017; ENST00000392020; ENST00000392018 |
| 20% | chr1 | 113646274 | 113646407 | + chr1 | 113650216 | 113650379 | + | ENST00000361127 TAF |
| 19% | chrX | 2178048 | 2177670 | − chrX | 2161271 | 2161064; 2161103 | − | ENST00000334651; ENST00000412516 TAF |
| 19% | chrX | 2178048 | 2177670 | − chrX | 2161271 | 2161064; 2161103 | − | ENST00000334651; ENST00000412516 TAF |
| 19% | chr9 | 114402184 | 114403068 | + chr9 | 114405137 | 114405208 | + | ENST00000463589; ENST00000447096 TSF |
| 19% | chrX | 71397824 | 71398615 | + chrX | 71406311 | 71406384 | + | ENST00000218432; ENST00000423432;TSF ENST00000373669; ENST00000496835; ENST00000439980; ENST00000446576 |
| 19% | chrX | 71397824 | 71398615 | + chrX | 71406311 | 71406384 | + | ENST00000218432; ENST00000423432;TSF ENST00000373669; ENST00000496835; ENST00000439980; ENST00000446576 |
| 19% | chrX | 71397824 | 71398615 | + chrX | 71406311 | 71406384 | + | ENST00000218432; ENST00000423432;TSF ENST00000373669; ENST00000496835; ENST00000439980; ENST00000446576 |
| 19% | chrX | 71397824 | 71398615 | + chrX | 71406311 | 71406384 | + | ENST00000218432; ENST00000423432;TSF ENST00000373669; ENST00000496835; ENST00000439980; ENST00000446576 |
| 19% | chr12 | 52353922 | 52353971 | + chr12 | 52369049 | 52369288 | + | ENST00000257963; ENST00000541224;TSF ENST00000426655; ENST00000415850 |
| 19% | chr12 | 52353922 | 52353971 | + chr12 | 52369049 | 52369288 | + | ENST00000257963; ENST00000541224;TSF ENST00000426655; ENST00000415850 |
| 19% | chr12 | 52353922 | 52353971 | + chr12 | 52369049 | 52369288 | + | ENST00000257963; ENST00000541224;TSF ENST00000426655; ENST00000415850 |
| 19% | chr12 | 52353922 | 52353971 | + chr12 | 52369049 | 52369288 | + | ENST00000257963; ENST00000541224;TSF ENST00000426655; ENST00000415850 |
| 19% | chr1 | 6366296 | 6365564 | − chr1 | 6355040 | 6354924 | − | ENST00000608083; ENST00000377842;TSF ENST00000377845; ENST00000377855; ENST00000377860; ENST00000418124; ENST00000545482; ENST00000361521; ENST00000473466 |
| 19% | chr1 | 6366296 | 6365564 | − chr1 | 6355040 | 6354924 | − | ENST00000608083; ENST00000377842;TSF ENST00000377845; ENST00000377855; ENST00000377860; ENST00000418124; ENST00000545482; ENST00000361521; ENST00000473466 |
| 19% | chr1 | 6366296 | 6365564 | − chr1 | 6355040 | 6354924 | − | ENST00000608083; ENST00000377842;TSF |

TABLE 60-continued

Transcript fusion for Testicular Germ Cell Tumors (TGCT) Coordinates of the fusion sequences for which the donor is the TE.

| 1' | 2' | 3' | 4' | 5' | 6' | 7' | 8' | 9' | 10' | 11' |
|---|---|---|---|---|---|---|---|---|---|---|
| 19% | chr1 | 6366296 | 6365564 | − | chr1 | 6355040 | 6354924 | − | ENST00000377845; ENST00000377855; ENST00000377860; ENST00000418124; ENST00000545482; ENST00000361521; ENST00000473466 ENST00000608083; ENST00000377842; ENST00000377845; ENST00000377855; ENST00000377860; ENST00000418124; ENST00000545482; ENST00000361521; ENST00000473466 | TSF |
| 19% | chr11 | 76935376 | 76935283 | − | chr11 | 76928359 | 76928322; 76928345 | − | ENST00000315938; ENST00000376217 | TSF |
| 19% | chr11 | 76935376 | 76935283 | − | chr11 | 76928359 | 76928322; 76928345 | − | ENST00000315938; ENST00000376217 | TSF |
| 17% | chr9 | 131002678 | 131002811 | + | chr9 | 131004511 | 131004624 | + | ENST00000475805; ENST00000341179; ENST00000372923; ENST00000393594; ENST00000486160 | TAF |
| 17% | chr9 | 131002678 | 131002811 | + | chr9 | 131004511 | 131004624 | + | ENST00000475805; ENST00000341179; ENST00000372923; ENST00000393594; ENST00000486160 | TAF |
| 17% | chr17 | 62480131 | 62480081 | − | chr17 | 62479116 | 62479036 | − | ENST00000539111; ENST00000581355 | TAF |
| 17% | chr17 | 62480131 | 62480081 | − | chr17 | 62479116 | 62479036 | − | ENST00000539111; ENST00000581355 | TAF |
| 17% | chr19 | 15502944 | 15502761 | − | chr19 | 15491423 | 15491328 | − | ENST00000397410; ENST00000595465 | TAF |
| 17% | chr12 | 110610148 | 110610836 | + | chr12 | 110618227 | 110618376 | + | ENST00000552912; ENST00000242591; ENST00000550156 | TAF |
| 17% | chr12 | 110610148 | 110610836 | + | chr12 | 110618227 | 110618376 | + | ENST00000552912; ENST00000242591; ENST00000550156 | TAF |
| 17% | chr 12 | 102411559 | 102411198 | − | chr12 | 102406970 | 102406886 | − | ENST00000240079; ENST00000545679; ENST00000542923 | TAF |
| 17% | chr14 | 51360331 | 51362421 | + | chr14 | 51368547 | 51368629 | + | ENST00000337334; ENST00000353130; ENST00000395752 | TSF |
| 17% | chr20 | 30060256 | 30059441 | − | chr20 | 30053466 | 30053309 | − | ENST00000317676 | TSF |
| 16% | chr19 | 49458157 | 49458182 | + | chr19 | 49458944 | 49459090; 49459035 | + | ENST00000539787; ENST00000345358; ENST00000391871; ENST00000515540; ENST00000356483; ENST00000415969; ENST00000293288 | TAF |
| 16% | chr19 | 49458157 | 49458182 | + | chr19 | 49458944 | 49459090; 49459035 | + | ENST00000539787; ENST00000345358; ENST00000391871; ENST00000515540; ENST00000356483; ENST00000415969; ENST00000293288 | TAF |
| 16% | chr19 | 49458157 | 49458182 | + | chr19 | 49458944 | 49459090; 49459035 | + | ENST00000539787; ENST00000345358; ENST00000391871; ENST00000515540; ENST00000356483; ENST00000415969; ENST00000293288 | TAF |
| 16% | chr19 | 49458157 | 49458182 | + | chr19 | 49458944 | 49459090; 49459035 | + | ENST00000539787; ENST00000345358; ENST00000391871; ENST00000515540; ENST00000356483; ENST00000415969; ENST00000293288 | TAF |
| 16% | chr19 | 49458157 | 49458182 | + | chr19 | 49458944 | 49459090; 49459035 | + | ENST00000539787; ENST00000345358; ENST00000391871; ENST00000515540; ENST00000356483; ENST00000415969; ENST00000293288 | TAF |
| 16% | chr1 | 52496316 | 52496255 | − | chr1 | 52494302 | 52494250 | − | ENST00000371626 | TAF |
| 16% | chr3 | 48252382 | 48252840 | + | chr3 | 48265844 | 48265951 | + | ENST00000296435; ENST00000576243 | TSF |
| 15% | chr2 | 202003725 | 202004053 | + | chr2 | 202005080 | 202005162; 202005198 | + | ENST00000309955; ENST00000443227; ENST00000341222; ENST00000340870; ENST00000355558; ENST00000341582; ENST00000342795; ENST00000423241; ENST00000439154; ENST00000440180; ENST00000457277; ENST00000494258; ENST00000470178; ENST00000462763; ENST00000479953 | TAF |
| 15% | chr2 | 202003725 | 202004053 | + | chr2 | 202005080 | 202005162; 202005198 | + | ENST00000309955; ENST00000443227; ENST00000341222; ENST00000340870; ENST00000355558; ENST00000341582; ENST00000342795; ENST00000423241; ENST00000439154; ENST00000440180; ENST00000457277; ENST00000494258; ENST00000470178; ENST00000462763; ENST00000479953 | TAF |
| 15% | chr2 | 202003725 | 202004053 | + | chr2 | 202005080 | 202005162; 202005198 | + | ENST00000309955; ENST00000443227; ENST00000341222; ENST00000340870; ENST00000355558; ENST00000341582; ENST00000342795; ENST00000423241; ENST00000439154; ENST00000440180; ENST00000457277; ENST00000494258; ENST00000470178; ENST00000462763; | TAF |

TABLE 60-continued

Transcript fusion for Testicular Germ Cell Tumors (TGCT) Coordinates of the fusion sequences for which the donor is the TE.

| 1' | 2' | 3' | 4' | 5' | 6' | 7' | 8' | 9' | 10' | 11' |
|---|---|---|---|---|---|---|---|---|---|---|
| 15% | chr2 | 202003725 | 202004053 | + | chr2 | 202005080 | 202005162; 202005198 | + | ENST00000309955; ENST00000443227; ENST00000341222; ENST00000340870; ENST00000355558; ENST00000341582; ENST00000342795; ENST00000423241; ENST00000439154; ENST00000440180; ENST00000457277; ENST00000494258; ENST00000470178; ENST00000462763; ENST00000479953 | TAF |
| 15% | chr2 | 202003725 | 202004053 | + | chr2 | 202005080 | 202005162; 202005198 | + | ENST00000309955; ENST00000443227; ENST00000341222; ENST00000340870; ENST00000355558; ENST00000341582; ENST00000342795; ENST00000423241; ENST00000439154; ENST00000440180; ENST00000457277; ENST00000494258; ENST00000470178; ENST00000462763; ENST00000479953 | TAF |
| 15% | chr2 | 202003725 | 202004053 | + | chr2 | 202005080 | 202005162; 202005198 | + | ENST00000309955; ENST00000443227; ENST00000341222; ENST00000340870; ENST00000355558; ENST00000341582; ENST00000342795; ENST00000423241; ENST00000439154; ENST00000440180; ENST00000457277; ENST00000494258; ENST00000470178; ENST00000462763; ENST00000479953 | TAF |
| 15% | chr2 | 202003725 | 202004053 | + | chr2 | 202005080 | 202005162; 202005198 | + | ENST00000309955; ENST00000443227; ENST00000341222; ENST00000340870; ENST00000355558; ENST00000341582; ENST00000342795; ENST00000423241; ENST00000439154; ENST00000440180; ENST00000457277; ENST00000494258; ENST00000470178; ENST00000462763; ENST00000479953 | TAF |
| 15% | chr2 | 202003725 | 202004053 | + | chr2 | 202005080 | 202005162; 202005198 | + | ENST00000309955; ENST00000443227; ENST00000341222; ENST00000340870; ENST00000355558; ENST00000341582; ENST00000342795; ENST00000423241; ENST00000439154; ENST00000440180; ENST00000457277; ENST00000494258; ENST00000470178; ENST00000462763; ENST00000479953 | TAF |
| 15% | chr2 | 202003725 | 202004053 | + | chr2 | 202005080 | 202005162; 202005198 | + | ENST00000309955; ENST00000443227; ENST00000341222; ENST00000340870; ENST00000355558; ENST00000341582; ENST00000342795; ENST00000423241; ENST00000439154; ENST00000440180; ENST00000457277; ENST00000494258; ENST00000470178; ENST00000462763; ENST00000479953 | TAF |
| 15% | chr2 | 202003725 | 202004053 | + | chr2 | 202005080 | 202005162; 202005198 | + | ENST00000309955; ENST00000443227; ENST00000341222; ENST00000340870; ENST00000355558; ENST00000341582; ENST00000342795; ENST00000423241; ENST00000439154; ENST00000440180; ENST00000457277; ENST00000494258; ENST00000470178; ENST00000462763; ENST00000479953 | TAF |
| 15% | chrX | 3773692 | 3773630 | − | chrX | 3735819 | 3735816 | − | ENST00000425492 | TAF |
| 15% | chr4 | 107241932 | 107242850 | + | chr4 | 107246142 | 107246275 | + | ENST00000394701 | TAF |
| 15% | chr8 | 144669798 | 144669576 | − | chr8 | 144669019 | 144668899 | − | ENST00000532741; ENST00000442189; ENST00000423316; ENST00000530616; ENST00000533749 | TAF |
| 15% | chr8 | 144669798 | 144669576 | − | chr8 | 144669019 | 144668899 | − | ENST00000532741; ENST00000442189; ENST00000423316; ENST00000530616; ENST00000533749 | TAF |
| 15% | chr8 | 144669798 | 144669576 | − | chr8 | 144669019 | 144668899 | − | ENST00000532741; ENST00000442189; ENST00000423316; ENST00000530616; ENST00000533749 | TAF |
| 15% | chr21 | 147675413 | 47675316 | − | chr21 | 147674758 | 47674690 | − | ENST00000397708; ENST00000291688 | TAF |
| 15% | chr14 | 169863275 | 69863209 | − | chr14 | 169861629 | 69861542 | − | ENST00000557016; ENST00000555373 | TAF |
| 15% | chr14 | 169863275 | 69863209 | − | chr14 | 169861629 | 69861542 | − | ENST00000557016; ENST00000555373 | TAF |
| 15% | chrX | 71397824 | 71398575 | + | chrX | 71406311 | 71406384 | + | ENST00000218432; ENST00000423432; ENST00000373669; ENST00000496835; ENST00000439980; ENST00000446576 | TSF |
| 15% | chrX | 71397824 | 71398575 | + | chrX | 71406311 | 71406384 | + | ENST00000218432; ENST00000423432; ENST00000373669; ENST00000496835; ENST00000439980; ENST00000446576 | TSF |

TABLE 60-continued

Transcript fusion for Testicular Germ Cell Tumors (TGCT) Coordinates of the fusion sequences for which the donor is the TE.

| 1' | 2' | 3' | 4' | 5' | 6' | 7' | 8' | 9' | 10' | 11' |
|---|---|---|---|---|---|---|---|---|---|---|
| 15% | chrX | 71397824 | 71398575 | + | chrX | 71406311 | 71406384 | + | ENST00000218432; ENST00000423432; ENST00000373669; ENST00000496835; ENST00000439980; ENST00000446576 | TSF |
| 15% | chrX | 71397824 | 71398575 | + | chrX | 71406311 | 71406384 | + | ENST00000218432; ENST00000423432; ENST00000373669; ENST00000496835; ENST00000439980; ENST00000446576 | TSF |
| 15% | chr21 | 43944863 | 43945289 | + | chr21 | 43945886 | 43945967 | + | ENST00000398341; ENST00000352133 | TSF |
| 14% | chr9 | 139611399 | 139611665 | + | chr9 | 139612029 | 139612163 | + | ENST00000371692 | TAF |
| 14% | chr12 | 22637180 | 22637151 | − | chr12 | 22635677 | 22635491 | − | ENST00000333957; ENST00000396028; ENST00000446597; ENST00000536386; ENST00000542676; ENST00000544930; ENST00000545552 | TAF |
| 14% | chr12 | 22637180 | 22637151 | − | chr12 | 22635677 | 22635491 | − | ENST00000333957; ENST00000396028; ENST00000446597; ENST00000536386; ENST00000542676; ENST00000544930; ENST00000545552 | TAF |
| 14% | chr12 | 22637180 | 22637151 | − | chr12 | 22635677 | 22635491 | − | ENST00000333957; ENST00000396028; ENST00000446597; ENST00000536386; ENST00000542676; ENST00000544930; ENST00000545552 | TAF |
| 14% | chr10 | 101952336 | 101952216 | − | chr10 | 101950725 | 101950626 | − | ENST00000370397 | TAF |
| 14% | chr2 | 30474925 | 30475183 | + | chr2 | 30480299 | 30480487; 30480324 | + | ENST00000395323; ENST00000406087; ENST00000401506; ENST00000407930 | TSF |
| 14% | chr2 | 30474925 | 30475183 | + | chr2 | 30480299 | 30480487; 30480324 | + | ENST00000395323; ENST00000406087; ENST00000401506; ENST00000407930 | TSF |
| 14% | chr20 | 30058231 | 05307772 | − | chr20 | 30053466 | 30053309 | − | ENST00000317676 | TSF |
| 13% | chr17 | 426168 | 426165 | − | chr17 | 424978 | 424841 | − | ENST00000437048 | TAF |
| 13% | chr22 | 19971218 | 19971196 | − | chr22 | 19969614 | 19969456 | − | ENST00000263207; ENST00000344269; ENST00000401994; ENST00000406522; ENST00000406259 | TAF |
| 13% | chr22 | 19971218 | 19971196 | − | chr22 | 19969614 | 19969456 | − | ENST00000263207; ENST00000344269; ENST00000401994; ENST00000406522; ENST00000406259 | TAF |
| 13% | chr12 | 64687157 | 64687061 | − | chr12 | 64679840 | 64679734 | − | ENST00000543942; ENST00000333722 | TAF |
| 13% | chr1 | 41465686 | 41465756 | + | chr1 | 41466701 | 41466789 | + | ENST00000372621; ENST00000541520; ENST00000372616 | TSF |
| 13% | chr20 | 30023971 | 30024331 | + | chr20 | 30037832 | 30037977 | + | ENST00000376309 | TSF |
| 13% | chr19 | 55449720 | 55449717 | − | chr19 | 55449609 | 55449412 | − | ENST00000340844; ENST00000590030; ENST00000446217; ENST00000588756; ENST00000586379; ENST00000592784 | TSF |
| 13% | chr19 | 55449720 | 55449717 | − | chr19 | 55449609 | 55449412 | − | ENST00000340844; ENST00000590030; ENST00000446217; ENST00000588756; ENST00000586379; ENST00000592784 | TSF |
| 13% | chr19 | 55449720 | 55449717 | − | chr19 | 55449609 | 55449412 | − | ENST00000340844; ENST00000590030; ENST00000446217; ENST00000588756; ENST00000586379; ENST00000592784 | TSF |
| 13% | chr19 | 1114930 | 1114676 | − | chr19 | 1114421 | 1114230 | − | ENST00000361757; ENST00000587024; ENST00000438103 | TSF |
| 13% | chr2 | 202003725 | 202004664 | + | chr2 | 202005080 | 202005162; 202005198 | + | ENST00000309955; ENST00000443227; ENST00000341222; ENST00000340870; ENST00000355558; ENST00000341582; ENST00000342795; ENST00000423241; ENST00000439154; ENST00000440180; ENST00000457277; ENST00000494258; ENST00000470178; ENST00000462763; ENST00000479953 | TSF |
| 13% | chr2 | 202003725 | 202004664 | + | chr2 | 202005080 | 202005162; 202005198 | + | ENST00000309955; ENST00000443227; ENST00000341222; ENST00000340870; ENST00000355558; ENST00000341582; ENST00000342795; ENST00000423241; ENST00000439154; ENST00000440180; ENST00000457277; ENST00000494258; ENST00000470178; ENST00000462763; ENST00000479953 | TSF |
| 13% | chr2 | 202003725 | 202004664 | + | chr2 | 202005080 | 202005162; 202005198 | + | ENST00000309955; ENST00000443227; ENST00000341222; ENST00000340870; ENST00000355558; ENST00000341582; ENST00000342795; ENST00000423241; ENST00000439154; ENST00000440180; ENST00000457277; ENST00000494258; ENST00000470178; ENST00000462763; ENST00000479953 | |
| 13% | chr2 | 202003725 | 202004664 | + | chr2 | 202005080 | 202005162; 202005198 | + | ENST00000309955; ENST00000443227; ENST00000341222; ENST00000340870; ENST00000355558; ENST00000341582; ENST00000342795; ENST00000423241; | TSF |

TABLE 60-continued

Transcript fusion for Testicular Germ Cell Tumors (TGCT) Coordinates of the fusion sequences for which the donor is the TE.

| 1' | 2' | 3' | 4' | 5' | 6' | 7' | 8' | 9' | 10' | 11' |
|---|---|---|---|---|---|---|---|---|---|---|
| 13% | chr2 | 202003725 | 202004664 | + | chr2 | 202005080 | 202005162; 202005198 | + | ENST00000309955; ENST00000443227; ENST00000341222; ENST00000340870; ENST00000355558; ENST00000341582; ENST00000342795; ENST00000423241; ENST00000439154; ENST00000440180; ENST00000457277; ENST00000494258; ENST00000470178; ENST00000462763; ENST00000479953 | TSF |
| 13% | chr2 | 202003725 | 202004664 | + | chr2 | 202005080 | 202005162; 202005198 | + | ENST00000309955; ENST00000443227; ENST00000341222; ENST00000340870; ENST00000355558; ENST00000341582; ENST00000342795; ENST00000423241; ENST00000439154; ENST00000440180; ENST00000457277; ENST00000494258; ENST00000470178; ENST00000462763; ENST00000479953 | TSF |
| 13% | chr2 | 202003725 | 202004664 | + | chr2 | 202005080 | 202005162; 202005198 | + | ENST00000309955; ENST00000443227; ENST00000341222; ENST00000340870; ENST00000355558; ENST00000341582; ENST00000342795; ENST00000423241; ENST00000439154; ENST00000440180; ENST00000457277; ENST00000494258; ENST00000470178; ENST00000462763; ENST00000479953 | TSF |
| 13% | chr2 | 202003725 | 202004664 | + | chr2 | 202005080 | 202005162; 202005198 | + | ENST00000309955; ENST00000443227; ENST00000341222; ENST00000340870; ENST00000355558; ENST00000341582; ENST00000342795; ENST00000423241; ENST00000439154; ENST00000440180; ENST00000457277; ENST00000494258; ENST00000470178; ENST00000462763; ENST00000479953 | TSF |
| 13% | chr2 | 202003725 | 202004664 | + | chr2 | 202005080 | 202005162; 202005198 | + | ENST00000309955; ENST00000443227; ENST00000341222; ENST00000340870; ENST00000355558; ENST00000341582; ENST00000342795; ENST00000423241; ENST00000439154; ENST00000440180; ENST00000457277; ENST00000494258; ENST00000470178; ENST00000462763; ENST00000479953 | TSF |
| 13% | chr2 | 202003725 | 202004664 | + | chr2 | 202005080 | 202005162; 202005198 | + | ENST00000309955; ENST00000443227; ENST00000341222; ENST00000340870; ENST00000355558; ENST00000341582; ENST00000342795; ENST00000423241; ENST00000439154; ENST00000440180; ENST00000457277; ENST00000494258; ENST00000470178; ENST00000462763; ENST00000479953 | TSF |
| 13% | chr2 | 202003725 | 202004664 | + | chr2 | 202005080 | 202005162; 202005198 | + | ENST00000309955; ENST00000443227; ENST00000341222; ENST00000340870; ENST00000355558; ENST00000341582; ENST00000342795; ENST00000423241; ENST00000439154; ENST00000440180; ENST00000457277; ENST00000494258; ENST00000470178; ENST00000462763; ENST00000479953 | TSF |
| 13% | chr19 | 340691 | 340514 | − | chr19 | 336173 | 336083 | − | ENST00000264819 | TSF |
| 12% | chr12 | 118466627 | 118466694 | + | chr12 | 118467576 | 118467630 | + | ENST00000229043; ENST00000454402; ENST00000392542 | TAF |
| 12% | chr17 | 4908417 | 149081701 | + | chr17 | 4910210 | 4910379 | + | ENST00000320785 | TAF |
| 12% | chr17 | 27054938 | 27054837 | − | chr17 | 27052581 | 27052499 | − | ENST00000292090; ENST00000394933 | TAF |
| 12% | chr12 | 50538043 | 50537986 | − | chr12 | 50537840 | 50537735 | − | ENST00000551697; ENST00000380189; ENST00000317551; ENST00000422340; ENST00000542320; ENST00000547800 | TAF |
| 12% | chr12 | 50538043 | 50537986 | − | chr12 | 50537840 | 50537735 | − | ENST00000551697; ENST00000380189; ENST00000317551; ENST00000422340; ENST00000542320; ENST00000547800 | TAF |
| 12% | chr12 | 50538043 | 50537986 | − | chr12 | 50537840 | 50537735 | − | ENST00000551697; ENST00000380189; ENST00000317551; ENST00000422340; ENST00000542320; ENST00000547800 | TAF |
| 12% | chr12 | 50538043 | 50537986 | − | chr12 | 50537840 | 50537735 | − | ENST00000551697; ENST00000380189; ENST00000317551; ENST00000422340; | TAF |

TABLE 60-continued

Transcript fusion for Testicular Germ Cell Tumors (TGCT) Coordinates of the fusion sequences for which the donor is the TE.

| 1' | 2' | 3' | 4' | 5' | 6' | 7' | 8' | 9' | 10' | 11' |
|---|---|---|---|---|---|---|---|---|---|---|
| 12% | chr6 | 151739722 | 151739668 | − | chr6 | 151738534 | 151738414; 151738471 | − | ENST00000542320; ENST00000547800 ENST00000336451; ENST00000367303; ENST00000444024 | TAF |
| 12% | chr6 | 151739722 | 151739668 | − | chr6 | 151738534 | 151738414; 151738471 | − | ENST00000336451; ENST00000367303; ENST00000444024 | TAF |
| 12% | chr1 | 156312383 | 156312456 | + | chr1 | 156314371 | 156314499 | + | ENST00000368255; ENST00000368253; ENST00000470342; ENST00000368254; ENST00000481479; ENST00000368252; ENST00000466306; ENST00000368251 | TSF |
| 12% | chr1 | 156312383 | 156312456 | + | chr1 | 156314371 | 156314499 | + | ENST00000368255; ENST00000368253; ENST00000470342; ENST00000368254; ENST00000481479; ENST00000368252; ENST00000466306; ENST00000368251 | TSF |
| 12% | chr7 | 55477082 | 55477474 | + | chr7 | 55479600 | 55479782 | + | ENST00000254770 | TSF |
| 12% | chr14 | 20973494 | 20974255 | + | chr14 | 20978626 | 20979281 | + | ENST00000430083 | TSF |
| 12% | chr16 | 48451457 | 48450727 | − | chr16 | 48396341 | 48395491 | − | ENST00000356721 | TSF |
| 11% | chr2 | 232369617 | 232369808 | + | chr2 | 232576600 | 232576693 | + | ENST00000409321; ENST00000409115; ENST00000341369; ENST00000409683; ENST00000410064; ENST00000412128 | TAF |
| 11% | chr2 | 232369617 | 232369808 | + | chr2 | 232576600 | 232576693 | + | ENST00000409321; ENST00000409115; ENST00000341369; ENST00000409683; ENST00000410064; ENST00000412128 | TAF |
| 11% | chr15 | 78810978 | 78811115 | + | chr15 | 78819722 | 78819905; 78819925 | + | ENST00000388988; ENST00000408962; ENST00000566332; ENST00000569878; ENST00000563233 | TAF |
| 11% | chr15 | 78810978 | 78811115 | + | chr15 | 78819722 | 78819905; 78819925 | + | ENST00000388988; ENST00000408962; ENST00000566332; ENST00000569878; ENST00000563233 | TAF |
| 11% | chr15 | 78810978 | 78811115 | + | chr15 | 78819722 | 78819905; 78819925 | + | ENST00000388988; ENST00000408962; ENST00000566332; ENST00000569878; ENST00000563233 | TAF |
| 11% | chr1 | 224551810 | 224551900 | + | chr1 | 224553581 | 224553693 | + | ENST00000465271; ENST00000366858; ENST00000366857; ENST00000366856 | TAF |
| 11% | chr1 | 224551810 | 224551900 | + | chr1 | 224553581 | 224553693 | + | ENST00000465271; ENST00000366858; ENST00000366857; ENST00000366856 | TAF |
| 11% | chr1 | 224551810 | 224551900 | + | chr1 | 224553581 | 224553693 | + | ENST00000465271; ENST00000366858; ENST00000366857; ENST00000366856 | TAF |
| 11% | chr1 | 6380703 | 6380649 | − | chr1 | 6378638 | 6378552 | − | ENST00000608083; ENST00000377842; ENST00000377845; ENST00000377855; ENST00000377860; ENST00000418124; ENST00000545482; ENST00000361521; ENST00000473466; ENST00000541130 | TAF |
| 11% | chr1 | 6380703 | 6380649 | − | chr1 | 6378638 | 6378552 | − | ENST00000608083; ENST00000377842; ENST00000377845; ENST00000377855; ENST00000377860; ENST00000418124; ENST00000545482; ENST00000361521; ENST00000473466; ENST00000541130 | TAF |
| 11% | chr1 | 6380703 | 6380649 | − | chr1 | 6378638 | 6378552 | − | ENST00000608083; ENST00000377842; ENST00000377845; ENST00000377855; ENST00000377860; ENST00000418124; ENST00000545482; ENST00000361521; ENST00000473466; ENST00000541130 | TAF |
| 11% | chr1 | 6380703 | 6380649 | − | chr1 | 6378638 | 6378552 | − | ENST00000608083; ENST00000377842; ENST00000377845; ENST00000377855; ENST00000377860; ENST00000418124; ENST00000545482; ENST00000361521; ENST00000473466; ENST00000541130 | TAF |
| 11% | chr1 | 6380703 | 6380649 | − | chr1 | 6378638 | 6378552 | − | ENST00000608083; ENST00000377842; ENST00000377845; ENST00000377855; ENST00000377860; ENST00000418124; ENST00000545482; ENST00000361521; ENST00000473466; ENST00000541130 | TAF |
| 11% | chr21 | 42597177 | 42597622 | + | chr21 | 42598193 | 42598281 | + | ENST00000328735; ENST00000330333; ENST00000347667 | TAF |
| 11% | chr21 | 42597177 | 42597622 | + | chr21 | 42598193 | 42598281 | + | ENST00000328735; ENST00000330333; ENST00000347667 | TAF |
| 11% | chr21 | 42597177 | 42597622 | + | chr21 | 42598193 | 42598281 | + | ENST00000328735; ENST00000330333; ENST00000347667 | TAF |
| 11% | chr2 | 42871686 | 42872096 | + | chr2 | 42883340 | 42883442 | + | ENST00000405592; ENST00000406652; ENST00000407270; ENST00000454356; ENST00000406911; ENST00000409019; ENST00000405094 | TAF |
| 11% | chr2 | 42871686 | 42872096 | + | chr2 | 42883340 | 42883442 | + | ENST00000405592; ENST00000406652; ENST00000407270; ENST00000454356; ENST00000406911; ENST00000409019; ENST00000405094 | TAF |

TABLE 60-continued

Transcript fusion for Testicular Germ Cell Tumors (TGCT) Coordinates of the fusion sequences for which the donor is the TE.

| 1' | 2' | 3' | 4' | 5' | 6' | 7' | 8' | 9' | 10' | 11' |
|---|---|---|---|---|---|---|---|---|---|---|
| 11% | chr2 | 42871686 | 42872096 | + | chr2 | 42883340 | 42883442 | + | ENST00000405592; ENST00000406652; ENST00000407270; ENST00000454356; ENST00000406911; ENST00000409019; ENST00000405094 | TAF |
| 11% | chr2 | 42871686 | 42872096 | + | chr2 | 42883340 | 42883442 | + | ENST00000405592; ENST00000406652; ENST00000407270; ENST00000454356; ENST00000406911; ENST00000409019; ENST00000405094 | TAF |
| 11% | chr2 | 42871686 | 42872096 | + | chr2 | 42883340 | 42883442 | + | ENST00000405592; ENST00000406652; ENST00000407270; ENST00000454356; ENST00000406911; ENST00000409019; ENST00000405094 | TAF |
| 11% | chr2 | 42871686 | 42872096 | + | chr2 | 42883340 | 42883442 | + | ENST00000405592; ENST00000406652; ENST00000407270; ENST00000454356; ENST00000406911; ENST00000409019; ENST00000405094 | TAF |
| 11% | chr20 | 2775864 | 2775377 | − | chr20 | 2775285 | 2775183 | − | ENST00000380605 | TAF |
| 11% | chr11 | 322262 | 322206 | − | chr11 | 320772 | 320565 | − | ENST00000399808 | TAF |
| 11% | chr11 | 321450 | 321426 | − | chr11 | 320772 | 320565 | − | ENST00000399808 | TAF |
| 11% | chr7 | 150938296 | 150938250 | − | chr7 | 150937608 | 150937511 | − | ENST00000262188; ENST00000392811; ENST00000356800 | TAF |
| 11% | chr11 | 321638 | 321543 | − | chr11 | 320772 | 320565 | − | ENST00000399808 | TAF |
| 11% | chr11 | 321638 | 321504 | − | chr11 | 320772 | 320565 | − | ENST00000399808 | TAF |
| 11% | chr11 | 321488 | 321465 | − | chr11 | 320772 | 320565 | − | ENST00000399808 | TAF |
| 11% | chr11 | 322580 | 322557 | − | chr11 | 320772 | 320565 | − | ENST00000399808 | TAF |
| 11% | chr21 | 27438394 | 27438253 | − | chr21 | 27425664 | 27425552 | − | ENST00000346798; ENST00000354192; ENST00000348990; ENST00000357903; ENST00000358918; ENST00000359726; ENST00000448388; ENST00000440126; ENST00000439274; ENST00000448850 | TAF |
| 11% | chr21 | 27438394 | 27438253 | − | chr21 | 27425664 | 27425552 | − | ENST00000346798; ENST00000354192; ENST00000348990; ENST00000357903; ENST00000358918; ENST00000359726; ENST00000448388; ENST00000440126; ENST00000439274; ENST00000448850 | TAF |
| 11% | chr21 | 27438394 | 27438253 | − | chr21 | 27425664 | 27425552 | − | ENST00000346798; ENST00000354192; ENST00000348990; ENST00000357903; ENST00000358918; ENST00000359726; ENST00000448388; ENST00000440126; ENST00000439274; ENST00000448850 | TAF |
| 11% | chr21 | 27438394 | 27438253 | − | chr21 | 27425664 | 27425552 | − | ENST00000346798; ENST00000354192; ENST00000348990; ENST00000357903; ENST00000358918; ENST00000359726; ENST00000448388; ENST00000440126; ENST00000439274; ENST00000448850 | TAF |
| 11% | chr21 | 27438394 | 27438253 | − | chr21 | 27425664 | 27425552 | − | ENST00000346798; ENST00000354192; ENST00000348990; ENST00000357903; ENST00000358918; ENST00000359726; ENST00000448388; ENST00000440126; ENST00000439274; ENST00000448850 | TAF |
| 11% | chr21 | 27438394 | 27438253 | − | chr21 | 27425664 | 27425552 | − | ENST00000346798; ENST00000354192; ENST00000348990; ENST00000357903; ENST00000358918; ENST00000359726; ENST00000448388; ENST00000440126; ENST00000439274; ENST00000448850 | TAF |
| 11% | chr11 | 321410 | 321387 | − | chr11 | 320772 | 320565 | − | ENST00000399808 | TAF |
| 11% | chr19 | 39347374 | 39346635 | − | chr19 | 39338074 | 39337956 | − | ENST00000221419; ENST00000601449; ENST00000600233; ENST00000601813 | TAF |
| 11% | chr19 | 39347374 | 39346635 | − | chr19 | 39338074 | 39337956 | − | ENST00000221419; ENST00000601449; ENST00000600233; ENST00000601813 | TAF |
| 11% | chr19 | 39347374 | 39346635 | − | chr19 | 39338074 | 39337956 | − | ENST00000221419; ENST00000601449; ENST00000600233; ENST00000601813 | TAF |
| 11% | chr11 | 321638 | 321582 | − | chr11 | 320772 | 320565 | − | ENST00000399808 | TAF |
| 11% | chr11 | 321716 | 321660 | − | chr11 | 320772 | 320565 | − | ENST00000399808 | TAF |
| 11% | chr11 | 322067 | 322011 | − | chr11 | 320772 | 320565 | − | ENST00000399808 | TAF |
| 11% | chr11 | 322457 | 322401 | − | chr11 | 320772 | 320565 | − | ENST00000399808 | TAF |
| 11% | chr11 | 321911 | 321855 | − | chr11 | 320772 | 320565 | − | ENST00000399808 | TAF |
| 11% | chr8 | 17865642 | 17865919 | + | chr8 | 17867056 | 17867253 | + | ENST00000325083; ENST00000519253; ENST00000524226; ENST00000327578; ENST00000522275 | TSF |
| 11% | chr8 | 17865642 | 17865919 | + | chr8 | 17867056 | 17867253 | + | ENST00000325083; ENST00000519253; ENST00000524226; ENST00000327578; ENST00000522275 | TSF |
| 11% | chr3 | 122500000 | 122499677 | − | chr3 | 122496753 | 122496568 | − | ENST00000383659; ENST00000306103 | TSF |
| 11% | chr3 | 122500000 | 122499677 | − | chr3 | 122496753 | 122496568 | − | ENST00000383659; ENST00000306103 | TSF |
| 11% | chr12 | 48058419 | 48058373 | − | chr12 | 48057373 | 48057288 | − | ENST00000005386; ENST00000432584 | TSF |

TABLE 60-continued

Transcript fusion for Testicular Germ Cell Tumors (TGCT) Coordinates of the fusion sequences for which the donor is the TE.

| 1' | 2' | 3' | 4' | 5' | 6' | 7' | 8' | 9' | 10' | 11' |
|---|---|---|---|---|---|---|---|---|---|---|
| | | | | | | | | | ENST00000380650 | |
| 11% | chr 4 | 146620427 | 146622789 | + | chr4 | 146648063 | 146648121 | + | ENST00000438731; ENST00000511965 | TSF |
| 11% | chr1 | 6366296 | 6365322 | − | chr1 | 6355040 | 6354924 | − | ENST00000608083; ENST00000377842; ENST00000377845; ENST00000377855; ENST00000377860; ENST00000418124; ENST00000545482; ENST00000361521; ENST00000473466 | TSF |
| 11% | chr1 | 6366296 | 6365322 | − | chr1 | 6355040 | 6354924 | − | ENST00000608083; ENST00000377842; ENST00000377845; ENST00000377855; ENST00000377860; ENST00000418124; ENST00000545482; ENST00000361521; ENST00000473466 | TSF |
| 11% | chr1 | 6366296 | 6365322 | − | chr1 | 6355040 | 6354924 | − | ENST00000608083; ENST00000377842; ENST00000377845; ENST00000377855; ENST00000377860; ENST00000418124; ENST00000545482; ENST00000361521; ENST00000473466 | TSF |
| 11% | chr1 | 6366296 | 6365322 | − | chr1 | 6355040 | 6354924 | − | ENST00000608083; ENST00000377842; ENST00000377845; ENST00000377855; ENST00000377860; ENST00000418124; ENST00000545482; ENST00000361521; ENST00000473466 | TSF |
| 11% | chr7 | 100418501 | 100418218 | − | chr7 | 100417918 | 100417763 | − | ENST00000360620; ENST00000358173 | TSF |
| 11% | chr7 | 100418501 | 100418218 | − | chr7 | 100417918 | 100417763 | − | ENST00000360620; ENST00000358173 | TSF |
| 10% | chr10 | 199600727 | 99601473 | + | chr10 | 199619215 | 99619340 | + | ENST00000370602 | TSF |
| 10% | chrX | 123618682 | 123617816 | − | chrX | 123615814 | 123615582 | − | ENST00000371130; ENST00000422452 | TSF |
| 10% | chr1 | 49723490 | 49723396 | − | chr1 | 49711536 | 49711442 | − | ENST00000371839; ENST00000371838; ENST00000371836 | TSF |
| 10% | chr1 | 49723490 | 49723396 | − | chr1 | 49711536 | 49711442 | − | ENST00000371839; ENST00000371838; ENST00000371836 | TSF |
| 10% | chr1 | 49723490 | 49723396 | − | chr1 | 49711536 | 49711442 | − | ENST00000371839; ENST00000371838; ENST00000371836 | TSF |
| 9% | chr7 | 26211486 | 26211491 | + | chr7 | 26217563 | 26217742 | + | ENST00000056233 | TSF |
| 9% | chr12 | 12966683 | 12966871 | + | chr12 | 12967065 | 12967158 | + | ENST00000352940; ENST00000358007; ENST00000544400 | TSF |
| 9% | chr12 | 12966683 | 12966871 | + | chr12 | 12967065 | 12967158 | + | ENST00000352940; ENST00000358007; ENST00000544400 | TSF |
| 9% | chr12 | 12966683 | 12966871 | + | chr12 | 12967065 | 12967158 | + | ENST00000352940; ENST00000358007; ENST00000544400 | TSF |
| 9% | chr2 | 88804201 | 88804412 | + | chr2 | 88825923 | 88826015 | + | ENST00000303254 | TSF |
| 9% | chr3 | 48252382 | 48252880 | + | chr3 | 148265095 | 48265202 | + | ENST00000296435; ENST00000576243 | TSF |
| 9% | chr3 | 122500000 | 122499637 | − | chr3 | 122496753 | 122496568 | − | ENST00000383659; ENST00000306103 | TSF |
| 9% | chr3 | 122500000 | 122499637 | − | chr3 | 122496753 | 122496568 | − | ENST00000383659; ENST00000306103 | TSF |
| 9% | chr3 | 146129390 | 146129180 | − | chr3 | 146113708 | 146113692 | − | ENST00000463633 | TSF |
| 9% | chr3 | 31668605 | 31668931 | + | chr3 | 31670790 | 31670903 | + | ENST00000295770 | TSF |
| 9% | chr21 | 37509492 | 37509497 | + | chr21 | 37510123 | 37510230 | + | ENST00000290354 | TSF |
| 9% | chr1 | 27158561 | 27158563 | + | chr1 | 27158938 | 27159098 | + | ENST00000374142 | TSF |
| 9% | chr4 | 146643833 | 146644154 | + | chr4 | 146648063 | 146648121 | + | ENST00000438731; ENST00000511965 | TSF |
| 9% | chr4 | 56766766 | 56766858 | + | chr4 | 56768510 | 56768704 | + | ENST00000381295; ENST00000346134; ENST00000349598 | TSF |
| 9% | chr9 | 114402184 | 114403028 | + | chr9 | 114405137 | 114405208 | + | ENST00000463589; ENST00000447096 | TSF |
| 9% | chr20 | 30060256 | 30059401 | − | chr20 | 30053466 | 30053309 | − | ENST00000317676 | TSF |
| 9% | chr6 | 151732076 | 151731988 | − | chr6 | 151726971 | 151726855 | − | ENST00000336451; ENST00000367303 | TSF |
| 9% | chr3 | 112200904 | 112200031 | − | chr3 | 112198616 | 112198302 | − | ENST00000334529; ENST00000383680 | TSF |
| 9% | chr3 | 112200904 | 112200031 | − | chr3 | 112198616 | 112198302 | − | ENST00000334529; ENST00000383680 | TSF |
| 9% | chr6 | 123908749 | 123908604 | − | chr6 | 123892277 | 123892068 | − | ENST00000398178; ENST00000334268; ENST00000546248; ENST00000542443 | TSF |
| 9% | chr6 | 123908749 | 123908604 | − | chr6 | 123892277 | 123892068 | − | ENST00000398178; ENST00000334268; ENST00000546248; ENST00000542443 | TSF |
| 9% | chr6 | 123908749 | 123908604 | − | chr6 | 123892277 | 123892068 | − | ENST00000398178; ENST00000334268; ENST00000546248; ENST00000542443 | TSF |
| 9% | chr6 | 123908749 | 123908604 | − | chr6 | 123892277 | 123892068 | − | ENST00000398178; ENST00000334268; ENST00000546248; ENST00000542443 | TSF |
| 8% | chr7 | 20707326 | 20708050 | + | chr7 | 20721128 | 20721289 | + | ENST00000404938; ENST00000258738 | TSF |
| 8% | chr3 | 10111144 | 10111811 | + | chr3 | 10114555 | 10114665 | + | ENST00000287647; ENST00000383806; ENST00000383807; ENST00000419585; ENST00000421731 | TSF |
| 8% | chr3 | 10111144 | 10111811 | + | chr3 | 10114555 | 10114665 | + | ENST00000287647; ENST00000383806; ENST00000383807; ENST00000419585; ENST00000421731 | TSF |
| 8% | chr3 | 10111144 | 10111811 | + | chr3 | 10114555 | 10114665 | + | ENST00000287647; ENST00000383806; ENST00000383807; ENST00000419585; ENST00000421731 | TSF |
| 8% | chr12 | 110610148 | 110610701 | + | chr12 | 110618227 | 110618376 | + | ENST00000552912; ENST00000242591; ENST00000550156 | TSF |
| 8% | chr12 | 110610148 | 110610701 | + | chr12 | 110618227 | 110618376 | + | ENST00000552912; ENST00000242591 | TSF |

TABLE 60-continued

Transcript fusion for Testicular Germ Cell Tumors (TGCT) Coordinates of the fusion sequences for which the donor is the TE.

| 1' | 2' | 3' | 4' | 5' | 6' | 7' | 8' | 9' | 10' | 11' |
|---|---|---|---|---|---|---|---|---|---|---|
| 8% | chr5 | 176950016 | 176949947 | − | chr5 | 176949072 | 176948976 | − | ENST00000550156; ENST00000514747; ENST00000329540; ENST00000443375; ENST00000524677 | TSF |
| 8% | chr16 | 23605688 | 23605658 | − | chr16 | 23598640 | 23598518 | − | ENST00000007516; ENST00000570319 | TSF |
| 8% | chr1 | 156305455 | 156305264 | − | chr1 | 156304709 | 156304659 | − | ENST00000295688; ENST00000368258; ENST00000413555; ENST00000496684; ENST00000478640; ENST00000415548 | TSF |
| 8% | chr1 | 156305455 | 156305264 | − | chr1 | 156304709 | 156304659 | − | ENST00000295688; ENST00000368258; ENST00000413555; ENST00000496684; ENST00000478640; ENST00000415548 | TSF |
| 8% | chr1 | 156305455 | 156305264 | − | chr1 | 156304709 | 156304659 | − | ENST00000295688; ENST00000368258; ENST00000413555; ENST00000496684; ENST00000478640; ENST00000415548 | TSF |
| 8% | chr1 | 156305455 | 156305264 | − | chr1 | 156304709 | 156304659 | − | ENST00000295688; ENST00000368258; ENST00000413555; ENST00000496684; ENST00000478640; ENST00000415548 | TSF |
| 8% | chr1 | 156305455 | 156305264 | − | chr1 | 156304709 | 156304659 | − | ENST00000295688; ENST00000368258; ENST00000413555; ENST00000496684; ENST00000478640; ENST00000415548 | TSF |
| 8% | chr1 | 156305455 | 156305264 | − | chr1 | 156304709 | 156304659 | − | ENST00000295688; ENST00000368258; ENST00000413555; ENST00000496684; ENST00000478640; ENST00000415548 | TSF |
| 7% | chr10 | 94734302 | 94735028 | + | chr10 | 94757231 | 94757372 | + | ENST00000371547; ENST00000371552; ENST00000443748; ENST00000260762; ENST00000495132; ENST00000458552 | TSF |
| 7% | chr10 | 94734302 | 94735028 | + | chr10 | 94757231 | 94757372 | + | ENST00000371547; ENST00000371552; ENST00000443748; ENST00000260762; ENST00000495132; ENST00000458552 | TSF |
| 7% | chr10 | 94734302 | 94735028 | + | chr10 | 94757231 | 94757372 | + | ENST00000371547; ENST00000371552; ENST00000443748; ENST00000260762; ENST00000495132; ENST00000458552 | TSF |
| 7% | chrX | 47057962 | 47058027 | + | chrX | 47058202 | 47058318 | + | ENST00000377351; ENST00000412206; ENST00000427561; ENST00000442035; ENST00000457753; ENST00000335972; ENST00000451702 | TSF |
| 7% | chrX | 47057962 | 47058027 | + | chrX | 47058202 | 47058318 | + | ENST00000377351; ENST00000412206; ENST00000427561; ENST00000442035; ENST00000457753; ENST00000335972; ENST00000451702 | TSF |
| 7% | chrX | 47057962 | 47058027 | + | chrX | 47058202 | 47058318 | + | ENST00000377351; ENST00000412206; ENST00000427561; ENST00000442035; ENST00000457753; ENST00000335972; ENST00000451702 | TSF |
| 7% | chrX | 47057962 | 47058027 | + | chrX | 47058202 | 47058318 | + | ENST00000377351; ENST00000412206; ENST00000427561; ENST00000442035; ENST00000457753; ENST00000335972; ENST00000451702 | TSF |
| 7% | chrX | 47057962 | 47058027 | + | chrX | 47058202 | 47058318 | + | ENST00000377351; ENST00000412206; ENST00000427561; ENST00000442035; ENST00000457753; ENST00000335972; ENST00000451702 | TSF |
| 7% | chrX | 47057962 | 47058027 | + | chrX | 47058202 | 47058318 | + | ENST00000377351; ENST00000412206; ENST00000427561; ENST00000442035; ENST00000457753; ENST00000335972; ENST00000451702 | TSF |
| 7% | chr7 | 56018506 | 56018522 | + | chr7 | 56020872 | 56021011 | + | ENST00000426595 | TSF |
| 7% | chr8 | 30984245 | 30984432 | + | chr8 | 30989881 | 30990022 | + | ENST00000298139 | TSF |
| 7% | chr12 | 4948345 | 4948527 | + | chr12 | 14959904 | 4960077 | + | ENST00000542998 | TSF |
| 7% | chr1 | 17371820 | 17371636 | − | chr1 | 17371383 | 17371256 | − | ENST00000375499 | |
| 7% | chr7 | 95988433 | 95987766 | − | chr7 | 95926263 | 95926210 | − | ENST00000265631; ENST00000416240; ENST00000472162 | TSF |
| 7% | chr7 | 95988433 | 95987766 | − | chr7 | 95926263 | 95926210 | − | ENST00000265631; ENST00000416240; ENST00000472162 | TSF |
| 7% | chr7 | 95988433 | 95987766 | − | chr7 | 95926263 | 95926210 | − | ENST00000265631; ENST00000416240; ENST00000472162 | TSF |
| 7% | chr6 | 13616316 | 13616338 | + | chr6 | 13616695 | 13616753 | + | ENST00000451315; ENST00000420088 | TSF |
| 7% | chr6 | 13616316 | 13616338 | + | chr6 | 13616695 | 13616753 | + | ENST00000451315; ENST00000420088 | TSF |
| 7% | chr2 | 238935895 | 238935906 | + | chr2 | 238939197 | 238939220; 238939254; 238939236; 238939204 | + | ENST00000441728; ENST00000272930; ENST00000448502; ENST00000416292; ENST00000409633; ENST00000449891; ENST00000455999; ENST00000445676; ENST00000414443; ENST00000409953; ENST00000409332; ENST00000434655; ENST00000434137 | TSF |
| 7% | chr2 | 238935895 | 238935906 | + | chr2 | 238939197 | 238939220; 238939254; | + | ENST00000441728; ENST00000272930; ENST00000448502; ENST00000416292; | TSF |

TABLE 60-continued

Transcript fusion for Testicular Germ Cell Tumors (TGCT) Coordinates of the fusion sequences for which the donor is the TE.

| 1' | 2' | 3' | 4' | 5' | 6' | 7' | 8' | 9' | 10' | 11' |
|---|---|---|---|---|---|---|---|---|---|---|
| | | | | | | | 238939236; 238939204 | | ENST00000409633; ENST00000449891; ENST00000455999; ENST00000445676; ENST00000414443; ENST00000409953; ENST00000409332; ENST00000434655; ENST00000434137 | |
| 7% | chr2 | 238935895 | 238935906 | + | chr2 | 238939197 | 238939220; 238939254; 238939236; 238939204 | + | ENST00000441728; ENST00000272930; ENST00000448502; ENST00000416292; ENST00000409633; ENST00000449891; ENST00000455999; ENST00000445676; ENST00000414443; ENST00000409953; ENST00000409332; ENST00000434655; ENST00000434137 | TSF |
| 7% | chr2 | 238935895 | 238935906 | + | chr2 | 238939197 | 238939220; 238939254; 238939236; 238939204 | + | ENST00000441728; ENST00000272930; ENST00000448502; ENST00000416292; ENST00000409633; ENST00000449891; ENST00000455999; ENST00000445676; ENST00000414443; ENST00000409953; ENST00000409332; ENST00000434655; ENST00000434137 | TSF |
| 7% | chr2 | 238935895 | 238935906 | + | chr2 | 238939197 | 238939220; 238939254; 238939236; 238939204 | + | ENST00000441728; ENST00000272930; ENST00000448502; ENST00000416292; ENST00000409633; ENST00000449891; ENST00000455999; ENST00000445676; ENST00000414443; ENST00000409953; ENST00000409332; ENST00000434655; ENST00000434137 | TSF |
| 7% | chr2 | 238935895 | 238935906 | + | chr2 | 238939197 | 238939220; 238939254; 238939236; 238939204 | + | ENST00000441728; ENST00000272930; ENST00000448502; ENST00000416292; ENST00000409633; ENST00000449891; ENST00000455999; ENST00000445676; ENST00000414443; ENST00000409953; ENST00000409332; ENST00000434655; ENST00000434137 | TSF |
| 7% | chr2 | 238935895 | 238935906 | + | chr2 | 238939197 | 238939220; 238939254; 238939236; 238939204 | + | ENST00000441728; ENST00000272930; ENST00000448502; ENST00000416292; ENST00000409633; ENST00000449891; ENST00000455999; ENST00000445676; ENST00000414443; ENST00000409953; ENST00000409332; ENST00000434655; ENST00000434137 | TSF |
| 7% | chr2 | 238935895 | 238935906 | + | chr2 | 238939197 | 238939220; 238939254; 238939236; 238939204 | + | ENST00000441728; ENST00000272930; ENST00000448502; ENST00000416292; ENST00000409633; ENST00000449891; ENST00000455999; ENST00000445676; ENST00000414443; ENST00000409953; ENST00000409332; ENST00000434655; ENST00000434137 | TSF |
| 7% | chr8 | 31016146 | 31016403 | + | chr8 | 31024538 | 31024746 | + | ENST00000298139 | TSF |
| 7% | chr6 | 31501566 | 31501436 | − | chr6 | 31500688 | 31500557 | − | ENST00000484566; ENST00000376177; ENST00000396172; ENST00000417556; ENST00000458640; ENST00000415382; ENST00000417023; ENST00000431908; ENST00000427214 | TSF |
| 7% | chr6 | 31501566 | 31501436 | − | chr6 | 31500688 | 31500557 | − | ENST00000484566; ENST00000376177; ENST00000396172; ENST00000417556; ENST00000458640; ENST00000415382; ENST00000417023; ENST00000431908; ENST00000427214 | TSF |
| 7% | chr6 | 31501566 | 31501436 | − | chr6 | 31500688 | 31500557 | − | ENST00000484566; ENST00000376177; ENST00000396172; ENST00000417556; ENST00000458640; ENST00000415382; ENST00000417023; ENST00000431908; ENST00000427214 | TSF |
| 7% | chr6 | 31501566 | 31501436 | − | chr6 | 31500688 | 31500557 | − | ENST00000484566; ENST00000376177; ENST00000396172; ENST00000417556; ENST00000458640; ENST00000415382; ENST00000417023; ENST00000431908; ENST00000427214 | TSF |
| 7% | chr6 | 31501566 | 31501436 | − | chr6 | 31500688 | 31500557 | − | ENST00000484566; ENST00000376177; ENST00000396172; ENST00000417556; ENST00000458640; ENST00000415382; ENST00000417023; ENST00000431908; ENST00000427214 | TSF |
| 7% | chr6 | 31501566 | 31501436 | − | chr6 | 31500688 | 31500557 | − | ENST00000484566; ENST00000376177; ENST00000396172; ENST00000417556; ENST00000458640; ENST00000415382; | TSF |

TABLE 60-continued

Transcript fusion for Testicular Germ Cell Tumors (TGCT) Coordinates of the fusion sequences for which the donor is the TE.

| 1' | 2' | 3' | 4' | 5' | 6' | 7' | 8' | 9' | 10' | 11' |
|---|---|---|---|---|---|---|---|---|---|---|
| | | | | | | | | | ENST00000417023; ENST00000431908; ENST00000427214 | |
| 7% | chr6 | 31660537 | 31660355 | – | chr6 | 31659695 | 31659581 | – | ENST00000395952; ENST00000440843 | TSF |
| 7% | chr12 | 14670381 | 14670239 | – | chr12 | 14664645 | 14664445 | – | ENST00000240617 | TSF |
| 7% | chr17 | 5014630 | 5014371 | – | chr17 | 5013063 | 5012689; 5012527 | – | ENST00000575898; ENST00000250076; ENST00000416429 | TSF |
| 7% | chr17 | 5014630 | 5014371 | – | chr17 | 5013063 | 5012689; 5012527 | – | ENST00000575898; ENST00000250076; ENST00000416429 | TSF |
| 7% | chr17 | 5014630 | 5014371 | – | chr17 | 5013063 | 5012689; 5012527 | – | ENST00000575898; ENST00000250076; ENST00000416429 | TSF |
| 7% | chr1 | 6366296 | 6365524 | – | chr1 | 6355040 | 6354924 | – | ENST00000608083; ENST00000377842; ENST00000377845; ENST00000377855; ENST00000377860; ENST00000418124; ENST00000545482; ENST00000361521; ENST00000473466 | TSF |
| 7% | chr1 | 6366296 | 6365524 | – | chr1 | 6355040 | 6354924 | – | ENST00000608083; ENST00000377842; ENST00000377845; ENST00000377855; ENST00000377860; ENST00000418124; ENST00000545482; ENST00000361521; ENST00000473466 | TSF |
| 7% | chr1 | 6366296 | 6365524 | – | chr1 | 6355040 | 6354924 | – | ENST00000608083; ENST00000377842; ENST00000377845; ENST00000377855; ENST00000377860; ENST00000418124; ENST00000545482; ENST00000361521; ENST00000473466 | TSF |
| 7% | chr1 | 6366296 | 6365524 | – | chr1 | 6355040 | 6354924 | – | ENST00000608083; ENST00000377842; ENST00000377845; ENST00000377855; ENST00000377860; ENST00000418124; ENST00000545482; ENST00000361521; ENST00000473466 | TSF |
| 6% | chr1 | 113646274 | 113646357 | + | chr1 | 113650216 | 113650379 | + | ENST00000361127 | TSF |
| 6% | chr6 | 37326936 | 37327118 | + | chr6 | 37328222 | 37328350 | + | ENST00000373479; ENST00000229866; ENST00000394443; ENST00000469316; ENST00000469731 | TSF |
| 6% | chr6 | 37326936 | 37327118 | + | chr6 | 37328222 | 37328350 | + | ENST00000373479; ENST00000229866; ENST00000394443; ENST00000469316; ENST00000469731 | TSF |
| 6% | chr6 | 37326936 | 37327118 | + | chr6 | 37328222 | 37328350 | + | ENST00000373479; ENST00000229866; ENST00000394443; ENST00000469316; ENST00000469731 | TSF |
| 6% | chr6 | 37326936 | 37327118 | + | chr6 | 37328222 | 37328350 | + | ENST00000373479; ENST00000229866; ENST00000394443; ENST00000469316; ENST00000469731 | TSF |
| 6% | chr11 | 57495862 | 57495928 | + | chr11 | 57505080 | 57505140 | + | ENST00000524972; ENST00000378312; ENST00000528395; ENST00000530114; ENST00000278422; ENST00000525035; ENST00000533602; ENST00000528110; ENST00000529403 | TSF |
| 6% | chr11 | 57495862 | 57495928 | + | chr11 | 57505080 | 57505140 | + | ENST00000524972; ENST00000378312; ENST00000528395; ENST00000530114; ENST00000278422; ENST00000525035; ENST00000533602; ENST00000528110; ENST00000529403 | TSF |
| 6% | chr11 | 57495862 | 57495928 | + | chr11 | 57505080 | 57505140 | + | ENST00000524972; ENST00000378312; ENST00000528395; ENST00000530114; ENST00000278422; ENST00000525035; ENST00000533602; ENST00000528110; ENST00000529403 | TSF |
| 6% | chr11 | 57495862 | 57495928 | + | chr11 | 57505080 | 57505140 | + | ENST00000524972; ENST00000378312; ENST00000528395; ENST00000530114; ENST00000278422; ENST00000525035; ENST00000533602; ENST00000528110; ENST00000529403 | TSF |
| 6% | chr11 | 57495862 | 57495928 | + | chr11 | 57505080 | 57505140 | + | ENST00000524972; ENST00000378312; ENST00000528395; ENST00000530114; ENST00000278422; ENST00000525035; ENST00000533602; ENST00000528110; ENST00000529403 | TSF |
| 6% | chr11 | 57495862 | 57495928 | + | chr11 | 57505080 | 57505140 | + | ENST00000524972; ENST00000378312; ENST00000528395; ENST00000530114; ENST00000278422; ENST00000525035; | TSF |

TABLE 60-continued

Transcript fusion for Testicular Germ Cell Tumors (TGCT) Coordinates of the fusion sequences for which the donor is the TE.

| 1' | 2' | 3' | 4' | 5' | 6' | 7' | 8' | 9' | 10' | 11' |
|---|---|---|---|---|---|---|---|---|---|---|
| 6% | chrX | 71397824 | 71398575 | + | chrX | 71416635 | 71416778; 71416754 | + | ENST00000533602; ENST00000528110; ENST00000529403 ENST00000218432; ENST00000423432; ENST00000373669; ENST00000496835; ENST00000439980; ENST00000446576 | TSF |
| 6% | chrX | 71397824 | 71398575 | + | chrX | 71416635 | 71416778; 71416754 | + | ENST00000218432; ENST00000423432; ENST00000373669; ENST00000496835; ENST00000439980; ENST00000446576 | TSF |
| 6% | chrX | 71397824 | 71398575 | + | chrX | 71416635 | 71416778; 71416754 | + | ENST00000218432; ENST00000423432; ENST00000373669; ENST00000496835; ENST00000439980; ENST00000446576 | TSF |
| 6% | chrX | 71397824 | 71398575 | + | chrX | 71416635 | 71416778; 71416754 | + | ENST00000218432; ENST00000423432; ENST00000373669; ENST00000496835; ENST00000439980; ENST00000446576 | TSF |
| 6% | chr10 | 76984123 | 76984287 | + | chr10 | 76989402 | 76989459 | + | ENST00000298468; ENST00000543351; ENST00000332211; ENST00000535553; ENST00000313132 | TSF |
| 6% | chr10 | 76984123 | 76984287 | + | chr10 | 76989402 | 76989459 | + | ENST00000298468; ENST00000543351; ENST00000332211; ENST00000535553; ENST00000313132 | TSF |
| 6% | chr1 | 27158295 | 27158544 | + | chr1 | 27158938 | 27159098 | + | ENST00000374142 | TSF |
| 6% | chrX | 71397824 | 71398498 | + | chrX | 71416635 | 71416778; 71416754 | + | ENST00000218432; ENST00000423432; ENST00000373669; ENST00000496835; ENST00000439980; ENST00000446576 | TSF |
| 6% | chrX | 71397824 | 71398498 | + | chrX | 71416635 | 71416778; 71416754 | + | ENST00000218432; ENST00000423432; ENST00000373669; ENST00000496835; ENST00000439980; ENST00000446576 | TSF |
| 6% | chrX | 71397824 | 71398498 | + | chrX | 71416635 | 71416778; 71416754 | + | ENST00000218432; ENST00000423432; ENST00000373669; ENST00000496835; ENST00000439980; ENST00000446576 | TSF |
| 6% | chrX | 71397824 | 71398498 | + | chrX | 71416635 | 71416778; 71416754 | + | ENST00000218432; ENST00000423432; ENST00000373669; ENST00000496835; ENST00000439980; ENST00000446576 | TSF |
| 6% | chr1 | 120274523 | 120274561 | + | chr1 | 120277257 | 120277389 | + | ENST00000369409; ENST00000369407 | TSF |
| 6% | chr2 | 32828531 | 32828600 | + | chr2 | 32832522 | 32832710 | + | ENST00000421745 | TSF |
| 6% | chr8 | 139623662 | 139623508 | − | chr8 | 139620232 | 139620179 | − | ENST00000303045; ENST00000435777 | TSF |
| 6% | chr1 | 23762222 | 23762216 | − | chr1 | 23761111 | 23761026 | − | ENST00000495646; ENST00000336689; ENST00000437606 | TSF |
| 6% | chr22 | 51019509 | 51019459 | − | chr22 | 51019089 | 51018994 | − | ENST00000406938 | TSF |
| 6% | chr10 | 97064311 | 97063415 | − | chr10 | 97031541 | 97031390 | − | ENST00000329399 | TSF |
| 6% | chr7 | 148712709 | 148712660 | − | chr7 | 148712134 | 148711996 | − | ENST00000286091 | TSF |
| 6% | chr20 | 29976260 | 29976126 | − | chr20 | 29966194 | 29966155 | − | ENST00000339144 | TSF |
| 5% | chr21 | 19399995 | 19400289 | + | chr21 | 19628826 | 19629135 | + | ENST00000299295; ENST00000543733 | TSF |
| 5% | chr12 | 9072683 | 9072802 | − | chr12 | 9073581 | 9073661 | + | ENST00000538657; ENST00000543824; ENST00000433083; ENST00000544916; ENST00000544539; ENST00000539063; ENST00000540574; ENST00000541181 | TSF |
| 5% | chr12 | 9072683 | 9072802 | − | chr12 | 9073581 | 9073661 | + | ENST00000538657; ENST00000543824; ENST00000433083; ENST00000544916; ENST00000544539; ENST00000539063; ENST00000540574; ENST00000541181 | TSF |
| 5% | chr12 | 9072683 | 9072802 | − | chr12 | 9073581 | 9073661 | + | ENST00000538657; ENST00000543824; ENST00000433083; ENST00000544916; ENST00000544539; ENST00000539063; ENST00000540574; ENST00000541181 | TSF |
| 5% | chr12 | 9072683 | 9072802 | − | chr12 | 9073581 | 9073661 | + | ENST00000538657; ENST00000543824; ENST00000433083; ENST00000544916; ENST00000544539; ENST00000539063; ENST00000540574; ENST00000541181 | TSF |
| 5% | chr12 | 9072683 | 9072802 | − | chr12 | 9073581 | 9073661 | + | ENST00000538657; ENST00000543824; ENST00000433083; ENST00000544916; ENST00000544539; ENST00000539063; ENST00000540574; ENST00000541181 | TSF |
| 5% | chr12 | 9072683 | 9072802 | − | chr12 | 9073581 | 9073661 | + | ENST00000538657; ENST00000543824; ENST00000433083; ENST00000544916; ENST00000544539; ENST00000539063; ENST00000540574; ENST00000541181 | TSF |
| 5% | chr12 | 9072683 | 9072802 | − | chr12 | 9073581 | 9073661 | + | ENST00000538657; ENST00000543824; ENST00000433083; ENST00000544916; ENST00000544539; ENST00000539063; ENST00000540574; ENST00000541181 | TSF |
| 5% | chr11 | 66048968 | 66049045 | + | chr11 | 66049730 | 66049798; 66049824 | + | ENST00000528852; ENST00000311445; ENST00000528063 | TSF |
| 5% | chr11 | 66048968 | 66049045 | + | chr11 | 66049730 | 66049798; 66049824 | + | ENST00000528852; ENST00000311445; ENST00000528063 | TSF |
| 5% | chr11 | 66048968 | 66049045 | + | chr11 | 66049730 | 66049798; | + | ENST00000528852; ENST00000311445; | TSF |

TABLE 60-continued

Transcript fusion for Testicular Germ Cell Tumors (TGCT) Coordinates of the fusion sequences for which the donor is the TE.

| 1' | 2' | 3' | 4' | 5' | 6' | 7' | 8' | 9' | 10' | 11' |
|---|---|---|---|---|---|---|---|---|---|---|
| | | | | | | | 66049824 | | ENST00000528063 | |
| 5% | chr17 | 61555745 | 61556008 | + | chr17 | 61556368 | 61556461 | + | ENST00000538928; ENST00000290866; ENST00000428043; ENST00000582627 | TSF |
| 5% | chr17 | 61555745 | 61556008 | + | chr17 | 61556368 | 61556461 | + | ENST00000538928; ENST00000290866; ENST00000428043; ENST00000582627 | TSF |
| 5% | chr17 | 61555745 | 61556008 | + | chr17 | 61556368 | 61556461 | + | ENST00000538928; ENST00000290866; ENST00000428043; ENST00000582627 | TSF |
| 5% | chr17 | 61555745 | 61556008 | + | chr17 | 61556368 | 61556461 | + | ENST00000538928; ENST00000290866; ENST00000428043; ENST00000582627 | TSF |
| 5% | chr14 | 51363110 | 51363531 | + | chr14 | 51368547 | 51368629 | + | ENST00000337334; ENST00000353130; ENST00000395752 | TSF |
| 5% | chr2 | 44903747 | 44903914 | + | chr2 | 44931422 | 44931482 | + | ENST00000378494 | TSF |
| 5% | chrX | 69679853 | 69679903 | + | chrX | 69699000 | 69699114 | + | ENST00000194900; ENST00000374360; ENST00000374355 | TSF |
| 5% | chrX | 69679853 | 69679903 | + | chrX | 69699000 | 69699114 | + | ENST00000194900; ENST00000374360; ENST00000374355 | TSF |
| 5% | chrX | 69679853 | 69679903 | + | chrX | 69699000 | 69699114 | + | ENST00000194900; ENST00000374360; ENST00000374355 | TSF |
| 5% | chr7 | 74480763 | 74480881 | + | chr7 | 74528191 | 74528329 | + | ENST00000356115; ENST00000430511; ENST00000312575; ENST00000423666 | TSF |
| 5% | chr7 | 74480763 | 74480881 | + | chr7 | 74528191 | 74528329 | + | ENST00000356115; ENST00000430511; ENST00000312575; ENST00000423666 | TSF |
| 5% | chr7 | 74480763 | 74480881 | + | chr7 | 74528191 | 74528329 | + | ENST00000356115; ENST00000430511; ENST00000312575; ENST00000423666 | TSF |
| 5% | chr19 | 4412258 | 4412399 | + | chr19 | 4418017 | 4418073 | + | ENST00000301280 | TSF |
| 5% | chr1 | 145666897 | 145667041 | + | chr1 | 145682023 | 145682094 | + | ENST00000369291 | TSF |
| 5% | chr20 | 25146273 | 25146366 | + | chr20 | 25249765 | 25249843 | + | ENST00000216962 | TSF |
| 5% | chr17 | 4700327 | 4700476 | + | chr17 | 4700733 | 4700864 | + | ENST00000270586; ENST00000571309 | TSF |
| 5% | chr17 | 4700327 | 4700476 | + | chr17 | 4700733 | 4700864 | + | ENST00000270586; ENST00000571309 | TSF |
| 5% | chr4 | 146617147 | 146617184 | + | chr4 | 146617711 | 146617784 | + | ENST00000438731; ENST00000511965 | TSF |
| 5% | chr12 | 4653807 | 4654478 | + | chr12 | 4654948 | 4654998 | + | ENST00000321524; ENST00000228843 | TSF |
| 5% | chr12 | 4653807 | 4654478 | + | chr12 | 4654948 | 4654998 | + | ENST00000321524; ENST00000228843 | TSF |
| 5% | chr19 | 5714928 | 5714878 | − | chr19 | 5714282 | 5714194 | − | ENST00000360614; ENST00000590558; ENST00000585374; ENST00000593119; ENST00000590729 | TSF |
| 5% | chr19 | 5714928 | 5714878 | − | chr19 | 5714282 | 5714194 | − | ENST00000360614; ENST00000590558; ENST00000585374; ENST00000593119; ENST00000590729 | TSF |
| 5% | chr19 | 5714928 | 5714878 | − | chr19 | 5714282 | 5714194 | − | ENST00000360614; ENST00000590558; ENST00000585374; ENST00000593119; ENST00000590729 | TSF |
| 5% | chr19 | 40761842 | 40761378 | − | chr19 | 40761176 | 40761065; 40761151 | − | ENST00000392038; ENST00000424901; ENST00000311278; ENST00000491778; ENST00000441941; ENST00000486368; ENST00000596634; ENST00000452077; ENST00000392037; ENST00000416362; ENST00000578123; ENST00000423127; ENST00000358335; ENST00000456441; ENST00000583859; ENST00000580747; ENST00000416994; ENST00000427375 | TSF |
| 5% | chr19 | 40761842 | 40761378 | − | chr19 | 40761176 | 40761065; 40761151 | − | ENST00000392038; ENST00000424901; ENST00000311278; ENST00000491778; ENST00000441941; ENST00000486368; ENST00000596634; ENST00000452077; ENST00000392037; ENST00000416362; ENST00000578123; ENST00000423127; ENST00000358335; ENST00000456441; ENST00000583859; ENST00000580747; ENST00000416994; ENST00000427375 | TSF |
| 5% | chr19 | 40761842 | 40761378 | − | chr19 | 40761176 | 40761065; 40761151 | − | ENST00000392038; ENST00000424901; ENST00000311278; ENST00000491778; ENST00000441941; ENST00000486368; ENST00000596634; ENST00000452077; ENST00000392037; ENST00000416362; ENST00000578123; ENST00000423127; ENST00000358335; ENST00000456441; ENST00000583859; ENST00000580747; ENST00000416994; ENST00000427375 | TSF |
| 5% | chr19 | 40761842 | 40761378 | − | chr19 | 40761176 | 40761065; 40761151 | − | ENST00000392038; ENST00000424901; ENST00000311278; ENST00000491778; ENST00000441941; ENST00000486368; ENST00000596634; ENST00000452077; ENST00000392037; ENST00000416362; ENST00000578123; ENST00000423127; ENST00000358335; ENST00000456441; ENST00000583859; ENST00000580747; | TSF |

TABLE 60-continued

Transcript fusion for Testicular Germ Cell Tumors (TGCT) Coordinates of the fusion sequences for which the donor is the TE.

| 1' | 2' | 3' | 4' | 5' | 6' | 7' | 8' | 9' | 10' | 11' |
|---|---|---|---|---|---|---|---|---|---|---|
| 5% | chr19 | 40761842 | 40761378 | − | chr19 | 40761176 | 40761065; 40761151 | − | ENST00000416994; ENST00000427375 ENST00000392038; ENST00000424901; ENST00000311278; ENST00000491778; ENST00000441941; ENST00000486368; ENST00000596634; ENST00000452077; ENST00000392037; ENST00000416362; ENST00000578123; ENST00000423127; ENST00000358335; ENST00000456441; ENST00000583859; ENST00000580747; | TSF |
| 5% | chr19 | 40761842 | 40761378 | − | chr19 | 40761176 | 40761065; 40761151 | − | ENST00000416994; ENST00000427375 ENST00000392038; ENST00000424901; ENST00000311278; ENST00000491778; ENST00000441941; ENST00000486368; ENST00000596634; ENST00000452077; ENST00000392037; ENST00000416362; ENST00000578123; ENST00000423127; ENST00000358335; ENST00000456441; ENST00000583859; ENST00000580747; | TSF |
| 5% | chr19 | 40761842 | 40761378 | − | chr19 | 40761176 | 40761065; 40761151 | − | ENST00000416994; ENST00000427375 ENST00000392038; ENST00000424901; ENST00000311278; ENST00000491778; ENST00000441941; ENST00000486368; ENST00000596634; ENST00000452077; ENST00000392037; ENST00000416362; ENST00000578123; ENST00000423127; ENST00000358335; ENST00000456441; ENST00000583859; ENST00000580747; | TSF |
| 5% | chr19 | 40761842 | 40761378 | − | chr19 | 40761176 | 40761065; 40761151 | − | ENST00000416994; ENST00000427375 ENST00000392038; ENST00000424901; ENST00000311278; ENST00000491778; ENST00000441941; ENST00000486368; ENST00000596634; ENST00000452077; ENST00000392037; ENST00000416362; ENST00000578123; ENST00000423127; ENST00000358335; ENST00000456441; ENST00000583859; ENST00000580747; | ITSF |
| 5% | chr19 | 40761842 | 40761378 | − | chr19 | 40761176 | 40761065; 40761151 | − | ENST00000416994; ENST00000427375 ENST00000392038; ENST00000424901; ENST00000311278; ENST00000491778; ENST00000441941; ENST00000486368; ENST00000596634; ENST00000452077; ENST00000392037; ENST00000416362; ENST00000578123; ENST00000423127; ENST00000358335; ENST00000456441; ENST00000583859; ENST00000580747; | TSF |
| 5% | chr19 | 40761842 | 40761378 | − | chr19 | 40761176 | 40761065; 40761151 | − | ENST00000416994; ENST00000427375 ENST00000392038; ENST00000424901; ENST00000311278; ENST00000491778; ENST00000441941; ENST00000486368; ENST00000596634; ENST00000452077; ENST00000392037; ENST00000416362; ENST00000578123; ENST00000423127; ENST00000358335; ENST00000456441; ENST00000583859; ENST00000580747; | TSF |
| 5% | chr19 | 40761842 | 40761378 | − | chr19 | 40761176 | 40761065; 40761151 | − | ENST00000416994; ENST00000427375 ENST00000392038; ENST00000424901; ENST00000311278; ENST00000491778; ENST00000441941; ENST00000486368; ENST00000596634; ENST00000452077; ENST00000392037; ENST00000416362; ENST00000578123; ENST00000423127; ENST00000358335; ENST00000456441; ENST00000583859; ENST00000580747; | TSF |
| 5% | chr19 | 40761842 | 40761378 | − | chr19 | 40761176 | 40761065; 40761151 | − | ENST00000416994; ENST00000427375 ENST00000392038; ENST00000424901; ENST00000311278; ENST00000491778; ENST00000441941; ENST00000486368; ENST00000596634; ENST00000452077; ENST00000392037; ENST00000416362; ENST00000578123; ENST00000423127; ENST00000358335; ENST00000456441; ENST00000583859; ENST00000580747; | TSF |
| 5% | chr19 | 40761842 | 40761378 | − | chr19 | 40761176 | 40761065; 40761151 | − | ENST00000416994; ENST00000427375 ENST00000392038; ENST00000424901; ENST00000311278; ENST00000491778; ENST00000441941; ENST00000486368; | TSF |

TABLE 60-continued

Transcript fusion for Testicular Germ Cell Tumors (TGCT) Coordinates of the fusion sequences for which the donor is the TE.

| 1' | 2' | 3' | 4' | 5' | 6' | 7' | 8' | 9' | 10' | 11' |
|---|---|---|---|---|---|---|---|---|---|---|
| 5% | chr19 | 40761842 | 40761378 | – | chr19 | 40761176 | 40761065; 40761151 | – | | ENST00000596634; ENST00000452077; ENST00000392037; ENST00000416362; ENST00000578123; ENST00000423127; ENST00000358335; ENST00000456441; ENST00000583859; ENST00000580747; ENST00000416994; ENST00000427375 ENST00000392038; ENST00000424901;TSF ENST00000311278; ENST00000491778; ENST00000441941; ENST00000486368; |
| 5% | chr19 | 40761842 | 40761378 | – | chr19 | 40761176 | 40761065; 40761151 | – | | ENST00000596634; ENST00000452077; ENST00000392037; ENST00000416362; ENST00000578123; ENST00000423127; ENST00000358335; ENST00000456441; ENST00000583859; ENST00000580747; ENST00000416994; ENST00000427375 ENST00000392038; ENST00000424901;TSF ENST00000311278; ENST00000491778; ENST00000441941; ENST00000486368; |
| 5% | chr19 | 40761842 | 40761378 | – | chr19 | 40761176 | 40761065; 40761151 | – | | ENST00000596634; ENST00000452077; ENST00000392037; ENST00000416362; ENST00000578123; ENST00000423127; ENST00000358335; ENST00000456441; ENST00000583859; ENST00000580747; ENST00000416994; ENST00000427375 ENST00000392038; ENST00000424901; ENST00000311278; ENST00000491778;TSF ENST00000441941; ENST00000486368; |
| 5% | chr19 | 40761842 | 40761378 | – | chr19 | 40761176 | 40761065; 40761151 | – | | ENST00000596634; ENST00000452077; ENST00000392037; ENST00000416362; ENST00000578123; ENST00000423127; ENST00000358335; ENST00000456441; ENST00000583859; ENST00000580747; ENST00000416994; ENST00000427375 ENST00000392038; ENST00000424901; ENST00000311278; ENST00000491778;TSF ENST00000441941; ENST00000486368; ENST00000596634; ENST00000452077; ENST00000392037; ENST00000416362; ENST00000578123; ENST00000423127; ENST00000358335; ENST00000456441; ENST00000583859; ENST00000580747; ENST00000416994; ENST00000427375 |
| 5% | chr15 | 40186285 | 40186255 | – | chr15 | 40099459 | 40099207 | – | | ENST00000561100; ENST00000543580 TSF |
| 5% | chr15 | 83263939 | 83261988 | – | chr15 | 83240282 | 83240094 | – | | ENST00000563800; ENST00000562019;TSF ENST00000568128; ENST00000261723 |
| 5% | chr15 | 83263939 | 83261988 | – | chr15 | 83240282 | 83240094 | – | | ENST00000563800; ENST00000562019;TSF ENST00000568128; ENST00000261723 |
| 5% | chr11 | 61079810 | 61079683 | – | chr11 | 61079556 | 61079461 | – | | ENST00000301764; ENST00000540166;TSF ENST00000535147 |
| 5% | chr11 | 61079810 | 61079683 | – | chr11 | 61079556 | 61079461 | – | | ENST00000301764; ENST00000540166;TSF ENST00000535147 |
| 5% | chr11 | 61079810 | 61079683 | – | chr11 | 61079556 | 61079461 | – | | ENST00000301764; ENST00000540166;TSF ENST00000535147 |
| 5% | chr21 | 27453972 | 27453597 | – | chr21 | 27425664 | 27425552 | – | | ENST00000346798; ENST00000354192;TSF ENST00000348990; ENST00000357903; ENST00000358918; ENST00000359726; ENST00000448388; ENST00000440126; ENST00000439274; ENST00000448850 |
| 5% | chr21 | 27453972 | 27453597 | – | chr21 | 27425664 | 27425552 | – | | ENST00000346798; ENST00000354192;TSF ENST00000348990; ENST00000357903; ENST00000358918; ENST00000359726; ENST00000448388; ENST00000440126; ENST00000439274; ENST00000448850 |
| 5% | chr21 | 27453972 | 27453597 | – | chr21 | 27425664 | 27425552 | – | | ENST00000346798; ENST00000354192;TSF ENST00000348990; ENST00000357903; ENST00000358918; ENST00000359726; ENST00000448388; ENST00000440126; ENST00000439274; ENST00000448850 |
| 5% | chr21 | 27453972 | 27453597 | – | chr21 | 27425664 | 27425552 | – | | ENST00000346798; ENST00000354192;TSF ENST00000348990; ENST00000357903; ENST00000358918; ENST00000359726; ENST00000448388; ENST00000440126; ENST00000439274; ENST00000448850 |
| 5% | chr21 | 27453972 | 27453597 | – | chr21 | 27425664 | 27425552 | – | | ENST00000346798; ENST00000354192;TSF ENST00000348990; ENST00000357903; ENST00000358918; ENST00000359726; |

TABLE 60-continued

Transcript fusion for Testicular Germ Cell Tumors (TGCT) Coordinates of the fusion sequences for which the donor is the TE.

| 1' | 2' | 3' | 4' | 5' | 6' | 7' | 8' | 9' | 10' | 11' |
|---|---|---|---|---|---|---|---|---|---|---|
| 5% | chr21 | 27453972 | 27453597 | − | chr21 | 27425664 | 27425552 | − | ENST00000448388; ENST00000440126; ENST00000439274; ENST00000448850 ENST00000346798; ENST00000354192; ENST00000348990; ENST00000357903; ENST00000358918; ENST00000359726; ENST00000448388; ENST00000440126; ENST00000439274; ENST00000448850 | TSF |
| 5% | chrX | 76851229 | 76851182 | − | chrX | 76849319 | 76849166 | − | ENST00000373344; ENST00000395603 | TSF |
| 5% | chr15 | 40187476 | 40186733 | − | chr15 | 40099398 | 40099207 | − | ENST00000299092; ENST00000561100; ENST00000543580 | TSF |
| 5% | chr12 | 3041463 | 3041468 | + | chr12 | 3042584 | 3042696 | + | ENST00000448120; ENST00000397132 | TSF |
| 5% | chr12 | 3041463 | 3041468 | + | chr12 | 3042584 | 3042696 | + | ENST00000448120; ENST00000397132 | TSF |
| 5% | chr14 | 20973494 | 20974295 | + | chr14 | 20978626 | 20979281 | + | ENST00000430083 | TSF |
| 5% | chr12 | 122599625 | 122599667 | + | chr12 | 122611803 | 122611909 | + | ENST00000319080 | TSF |
| 5% | chr20 | 110606 | 110697 | + | chr20 | 126056 | 126333 | + | ENST00000382398 | TSF |
| 5% | chrX | 71397824 | 71398659 | + | chrX | 71406311 | 71406384 | + | ENST00000218432; ENST00000423432; ENST00000373669; ENST00000496835; ENST00000439980; ENST00000446576 | TSF |
| 5% | chrX | 71397824 | 71398659 | + | chrX | 71406311 | 71406384 | + | ENST00000218432; ENST00000423432; ENST00000373669; ENST00000496835; ENST00000439980; ENST00000446576 | TSF |
| 5% | chrX | 71397824 | 71398659 | + | chrX | 71406311 | 71406384 | + | ENST00000218432; ENST00000423432; ENST00000373669; ENST00000496835; ENST00000439980; ENST00000446576 | TSF |
| 5% | chrX | 71397824 | 71398659 | + | chrX | 71406311 | 71406384 | + | ENST00000218432; ENST00000423432; ENST00000373669; ENST00000496835; ENST00000439980; ENST00000446576 | TSF |
| 5% | chr7 | 77573053 | 77573153 | + | chr7 | 77578995 | 77579150 | + | ENST00000422959; ENST00000307305; ENST00000416283; ENST00000248550 | TSF |
| 5% | chr1 | 13922411 | 13922564 | + | chr1 | 13933668 | 13933801 | + | ENST00000294489; ENST00000376057; ENST00000510906; ENST00000509009 | TSF |
| 5% | chr1 | 13922411 | 13922564 | + | chr1 | 13933668 | 13933801 | + | ENST00000294489; ENST00000376057; ENST00000510906; ENST00000509009 | TSF |
| 5% | chr1 | 13922411 | 13922564 | + | chr1 | 13933668 | 13933801 | + | ENST00000294489; ENST00000376057; ENST00000510906; ENST00000509009 | TSF |
| 5% | chr8 | 620733 | 620243 | − | chr8 | 618782 | 618598; 618491 | − | ENST00000522706; ENST00000523415; ENST00000262109; ENST00000522893 | TSF |
| 5% | chr8 | 620733 | 620243 | − | chr8 | 618782 | 618598; 618491 | − | ENST00000522706; ENST00000523415; ENST00000262109; ENST00000522893 | TSF |
| 5% | chr8 | 620733 | 620243 | − | chr8 | 618782 | 618598; 618491 | − | ENST00000522706; ENST00000523415; ENST00000262109; ENST00000522893 | TSF |
| 5% | chr8 | 620733 | 620243 | − | chr8 | 618782 | 618598; 618491 | − | ENST00000522706; ENST00000523415; ENST00000262109; ENST00000522893 | TSF |
| 5% | chr2 | 17876171 | 17876059 | − | chr2 | 17865030 | 17864905 | − | ENST00000448223; ENST00000351948; ENST00000381272; ENST00000402989 | TSF |
| 5% | chr2 | 163164568 | 163164512 | − | chr2 | 163163365 | 163163219 | − | ENST00000263642 | TSF |
| 5% | chr16 | 74665694 | 74665639 | − | chr16 | 74664855 | 74664679 | − | ENST00000361070; ENST00000571750 | TSF |
| 5% | chr15 | 83667946 | 83667078 | − | chr15 | 83660798 | 83660684 | − | ENST00000451195 | TSF |
| 5% | chr5 | 159516518 | 159516513 | − | chr5 | 159507777 | 159507658 | − | ENST00000456329 | TSF |
| 5% | chr22 | 21355965 | 21355835 | − | chr22 | 21355700 | 21355545 | − | ENST00000215742; ENST00000399133 | TSF |
| 5% | chr15 | 18655840 | 40186430 | − | chr15 | 40099459 | 40099207 | − | ENST00000561100; ENST00000543580 | TSF |
| 5% | chr2 | 172724171 | 172723378 | − | chr2 | 172712459 | 172712344 | − | ENST00000422440; ENST00000426896; ENST00000475360 | TSF |
| 5% | chr2 | 172724171 | 172723378 | − | chr2 | 172712459 | 172712344 | − | ENST00000422440; ENST00000426896; ENST00000475360 | TSF |
| 5% | chr2 | 172724171 | 172723378 | − | chr2 | 172712459 | 172712344 | − | ENST00000422440; ENST00000426896; ENST00000475360 | TSF |
| 5% | chr3 | 171427764 | 171427731 | − | chr3 | 171427499 | 171427350 | − | ENST00000356327; ENST00000351298; ENST00000342215; ENST00000340989 | TSF |
| 5% | chr3 | 171427764 | 171427731 | − | chr3 | 171427499 | 171427350 | − | ENST00000356327; ENST00000351298; ENST00000342215; ENST00000340989 | TSF |
| 5% | chr3 | 171427764 | 171427731 | − | chr3 | 171427499 | 171427350 | − | ENST00000356327; ENST00000351298; ENST00000342215; ENST00000340989 | TSF |
| 5% | chr3 | 171427764 | 171427731 | − | chr3 | 171427499 | 171427350 | − | ENST00000356327; ENST00000351298; ENST00000342215; ENST00000340989 | TSF |
| 5% | chr14 | 28510850 | 50285011 | − | chr14 | 50281575 | 50281472 | − | ENST00000298310; ENST00000545773; ENST00000546046; ENST00000555970 | TSF |
| 5% | chr14 | 28510850 | 50285011 | − | chr14 | 50281575 | 50281472 | − | ENST00000298310; ENST00000545773; ENST00000546046; ENST00000555970 | TSF |
| 5% | chr14 | 28510850 | 50285011 | − | chr14 | 50281575 | 50281472 | − | ENST00000298310; ENST00000545773; ENST00000546046; ENST00000555970 | TSF |
| 5% | chrX | 33097155 | 33096303 | − | chrX | 33038317 | 33038256 | − | ENST00000378677; ENST00000357033; ENST00000420596; ENST00000448370; ENST00000288447 | TSF |
| 5% | chrX | 33097155 | 33096303 | − | chrX | 33038317 | 33038256 | − | ENST00000378677; ENST00000357033; ENST00000420596; ENST00000448370; | TSF |

TABLE 60-continued

Transcript fusion for Testicular Germ Cell Tumors (TGCT) Coordinates of the fusion sequences for which the donor is the TE.

| 1' | 2' | 3' | 4' | 5' | 6' | 7' | 8' | 9' | 10' | 11' |
|---|---|---|---|---|---|---|---|---|---|---|
| 5% | chrX | 33097155 | 33096303 | − | chrX | 33038317 | 33038256 | − | ENST00000288447 ENST00000378677; ENST00000357033; ENST00000420596; ENST00000448370; | TSF |
| 5% | chrX | 33097155 | 33096303 | − | chrX | 33038317 | 33038256 | − | ENST00000288447 ENST00000378677; ENST00000357033; ENST00000420596; ENST00000448370; | TSF |
| 5% | chr2 | 38983894 | 38983086 | − | chr2 | 38977336 | 38977156 | − | ENST00000313117; ENST00000425778; ENST00000425941; ENST00000446327; ENST00000409276; ENST00000431066; ENST00000443213 | TSF |
| 5% | chr2 | 38983894 | 38983086 | − | chr2 | 38977336 | 38977156 | − | ENST00000313117; ENST00000425778; ENST00000425941; ENST00000446327; ENST00000409276; ENST00000431066; ENST00000443213 | TSF |
| 5% | chr2 | 38983894 | 38983086 | − | chr2 | 38977336 | 38977156 | − | ENST00000313117; ENST00000425778; ENST00000425941; ENST00000446327; ENST00000409276; ENST00000431066; ENST00000443213 | TSF |
| 5% | chr2 | 38983894 | 38983086 | − | chr2 | 38977336 | 38977156 | − | ENST00000313117; ENST00000425778; ENST00000425941; ENST00000446327; ENST00000409276; ENST00000431066; ENST00000443213 | TSF |
| 5% | chr2 | 38983894 | 38983086 | − | chr2 | 38977336 | 38977156 | − | ENST00000313117; ENST00000425778; ENST00000425941; ENST00000446327; ENST00000409276; ENST00000431066; ENST00000443213 | TSF |
| 5% | chr1 | 33270876 | 33270146 | − | chr1 | 33263444 | 33263364 | − | ENST00000373477 | TSF |
| 5% | chr11 | 57280665 | 57280599 | − | chr11 | 57268802 | 57268625; 57268633 | − | ENST00000278426; ENST00000528450; ENST00000534298; ENST00000530159; ENST00000533066; ENST00000533263 | TSF |
| 5% | chr11 | 57280665 | 57280599 | − | chr11 | 57268802 | 57268625; 57268633 | − | ENST00000278426; ENST00000528450; ENST00000534298; ENST00000530159; ENST00000533066; ENST00000533263 | TSF |
| 5% | chr11 | 57280665 | 57280599 | − | chr11 | 57268802 | 57268625; 57268633 | − | ENST00000278426; ENST00000528450; ENST00000534298; ENST00000530159; ENST00000533066; ENST00000533263 | TSF |
| 5% | chr11 | 57280665 | 57280599 | − | chr11 | 57268802 | 57268625; 57268633 | − | ENST00000278426; ENST00000528450; ENST00000534298; ENST00000530159; ENST00000533066; ENST00000533263 | TSF |
| 5% | chr11 | 57280665 | 57280599 | − | chr11 | 57268802 | 57268625; 57268633 | − | ENST00000278426; ENST00000528450; ENST00000534298;ENST00000530159; ENST00000533066; ENST00000533263 | TSF |
| 5% | chr19 | 1500000 | 1499600 | − | chr19 | 1488279 | 1488187 | − | ENST00000591201; ENST00000300954; ENST00000588195; ENST00000588671 | TSF |
| 5% | chr19 | 1500000 | 1499600 | − | chr19 | 1488279 | 1488187 | − | ENST00000591201; ENST00000300954; ENST00000588195; ENST00000588671 | TSF |
| 5% | chr19 | 1500000 | 1499600 | − | chr19 | 1488279 | 1488187 | − | ENST00000591201; ENST00000300954; ENST00000588195; ENST00000588671 | TSF |
| 5% | chr19 | 1500000 | 1499600 | − | chr19 | 1488279 | 1488187 | − | ENST00000591201; ENST00000300954; ENST00000588195; ENST00000588671 | TSF |
| 5% | chr15 | 40186285 | 40185077 | − | chr15 | 40099459 | 40099207 | − | ENST00000561100; ENST00000543580 | TSF |
| 5% | chr14 | 50113338 | 50113288 | − | chr14 | 50110388 | 50110370 | − | ENST00000216367; ENST00000539565 | TSF |
| 5% | chr12 | 96302230 | 96301454 | − | chr12 | 96300229 | 96300165 | − | ENST00000344280 | TSF |
| 4% | chr12 | 96340433 | 96341255 | + | chr12 | 96346495 | 96346601 | + | ENST00000266736; ENST00000548310 | TSF |
| 4% | chr12 | 96340433 | 96341255 | + | chr12 | 96346495 | 96346601 | + | ENST00000266736; ENST00000548310 | TSF |
| 4% | chr14 | 51365630 | 51365697 | + | chr14 | 51368547 | 51368629 | + | ENST00000337334; ENST00000353130; ENST00000395752 | TSF |
| 4% | chr2 | 11299135 | 11299200 | + | chr2 | 11300592 | 11300674 | + | ENST00000445402; ENST00000295083; ENST00000445921; ENST00000441908; ENST00000402361; ENST00000428481 | TSF |
| 4% | chr2 | 11299135 | 11299200 | + | chr2 | 11300592 | 11300674 | + | ENST00000445402; ENST00000295083; ENST00000445921; ENST00000441908; ENST00000402361; ENST00000428481 | TSF |
| 4% | chr2 | 11299135 | 11299200 | + | chr2 | 11300592 | 11300674 | + | ENST00000445402; ENST00000295083; ENST00000445921; ENST00000441908; ENST00000402361; ENST00000428481 | TSF |
| 4% | chr2 | 11299135 | 11299200 | + | chr2 | 11300592 | 11300674 | + | ENST00000445402; ENST00000295083; ENST00000445921; ENST00000441908; ENST00000402361; ENST00000428481 | TSF |
| 4% | chr2 | 11299135 | 11299200 | + | chr2 | 11300592 | 11300674 | + | ENST00000445402; ENST00000295083; ENST00000445921; ENST00000441908; ENST00000402361; ENST00000428481 | TSF |
| 4% | chr2 | 11299135 | 11299200 | + | chr2 | 11300592 | 11300674 | + | ENST00000445402; ENST00000295083; ENST00000445921; ENST00000441908; ENST00000402361; ENST00000428481 | TSF |

TABLE 60-continued

Transcript fusion for Testicular Germ Cell Tumors (TGCT) Coordinates of the fusion sequences for which the donor is the TE.

| 1' | 2' | 3' | 4' | 5' | 6' | 7' | 8' | 9' | 10' | 11' |
|---|---|---|---|---|---|---|---|---|---|---|
| 4% | chr6 | 37436378 | 37436635 | + | chr6 | 37438797 | 37438853 | + | ENST00000373451 | TSF |
| 4% | chr9 | 6806927 | 6807744 | + | chr9 | 6814631 | 6814745; 6814766 | + | ENST00000535193; ENST00000438023; ENST00000543771; ENST00000401787; ENST00000381306; ENST00000381309 | TSF |
| 4% | chr9 | 6806927 | 6807744 | + | chr9 | 6814631 | 6814745; 6814766 | + | ENST00000535193; ENST00000438023; ENST00000543771; ENST00000401787; ENST00000381306; ENST00000381309 | TSF |
| 4% | chr9 | 6806927 | 6807744 | + | chr9 | 6814631 | 6814745; 6814766 | + | ENST00000535193; ENST00000438023; ENST00000543771; ENST00000401787; ENST00000381306; ENST00000381309 | TSF |
| 4% | chr9 | 6806927 | 6807744 | + | chr9 | 6814631 | 6814745; 6814766 | + | ENST00000535193; ENST00000438023; ENST00000543771; ENST00000401787; ENST00000381306; ENST00000381309 | TSF |
| 4% | chr9 | 6806927 | 6807744 | + | chr9 | 6814631 | 6814745; 6814766 | + | ENST00000535193; ENST00000438023; ENST00000543771; ENST00000401787; ENST00000381306; ENST00000381309 | TSF |
| 4% | chr1 | 10499523 | 10499583 | + | chr 1 | 10500404 | 10500470 | + | ENST00000400900; ENST00000602787; ENST00000309048; ENST00000477755; ENST00000602446 | TSF |
| 4% | chr1 | 10499523 | 10499583 | + | chr 1 | 10500404 | 10500470 | + | ENST00000400900; ENST00000602787; ENST00000309048; ENST00000477755; ENST00000602446 | TSF |
| 4% | chr1 | 10499523 | 10499583 | + | chr 1 | 10500404 | 10500470 | + | ENST00000400900; ENST00000602787; ENST00000309048; ENST00000477755; ENST00000602446 | TSF |
| 4% | chr8 | 23131391 | 23131513 | + | chr8 | 23146019 | 23146146 | + | ENST00000411463 | TSF |
| 4% | chr10 | 135053342 | 135053345 | + | chr10 | 135053436 | 135053810 | + | ENST00000325980 | TSF |
| 4% | chr4 | 146620427 | 146620571 | + | chr4 | 146648063 | 146648121 | + | ENST00000438731; ENST00000511965 | TSF |
| 4% | chr2 | 102468305 | 102468327 | + | chr2 | 102472439 | 102472600 | + | ENST00000425019; ENST00000302217; ENST00000324219; ENST00000350198; ENST00000413150; ENST00000347699; ENST00000456652; ENST00000417294; ENST00000350878; ENST00000421882; ENST00000418101 | TSF |
| 4% | chr2 | 102468305 | 102468327 | + | chr2 | 102472439 | 102472600 | + | ENST00000425019; ENST00000302217; ENST00000324219; ENST00000350198; ENST00000413150; ENST00000347699; ENST00000456652; ENST00000417294; ENST00000350878; ENST00000421882; ENST00000418101 | TSF |
| 4% | chr2 | 102468305 | 102468327 | + | chr2 | 102472439 | 102472600 | + | ENST00000425019; ENST00000302217; ENST00000324219; ENST00000350198; ENST00000413150; ENST00000347699; ENST00000456652; ENST00000417294; ENST00000350878; ENST00000421882; ENST00000418101 | TSF |
| 4% | chr2 | 102468305 | 102468327 | + | chr2 | 102472439 | 102472600 | + | ENST00000425019; ENST00000302217; ENST00000324219; ENST00000350198; ENST00000413150; ENST00000347699; ENST00000456652; ENST00000417294; ENST00000350878; ENST00000421882; ENST00000418101 | TSF |
| 4% | chr2 | 102468305 | 102468327 | + | chr2 | 102472439 | 102472600 | + | ENST00000425019; ENST00000302217; ENST00000324219; ENST00000350198; ENST00000413150; ENST00000347699; ENST00000456652; ENST00000417294; ENST00000350878; ENST00000421882; ENST00000418101 | TSF |
| 4% | chr2 | 102468305 | 102468327 | + | chr2 | 102472439 | 102472600 | + | ENST00000425019; ENST00000302217; ENST00000324219; ENST00000350198; ENST00000413150; ENST00000347699; ENST00000456652; ENST00000417294; ENST00000350878; ENST00000421882; ENST00000418101 | TSF |
| 4% | chr2 | 102468305 | 102468327 | + | chr2 | 102472439 | 102472600 | + | ENST00000425019; ENST00000302217; ENST00000324219; ENST00000350198; ENST00000413150; ENST00000347699; ENST00000456652; ENST00000417294; ENST00000350878; ENST00000421882; ENST00000418101 | TSF |
| 4% | chr2 | 102468305 | 102468327 | + | chr2 | 102472439 | 102472600 | + | ENST00000425019; ENST00000302217; ENST00000324219; ENST00000350198; ENST00000413150; ENST00000347699; ENST00000456652; ENST00000417294; ENST00000350878; ENST00000421882; ENST00000418101 | TSF |

TABLE 60-continued

Transcript fusion for Testicular Germ Cell Tumors (TGCT) Coordinates of the fusion sequences for which the donor is the TE.

| 1' | 2' | 3' | 4' | 5' | 6' | 7' | 8' | 9' | 10' | 11' |
|---|---|---|---|---|---|---|---|---|---|---|
| 4% | chr2 | 102468305 | 102468327 | + | chr2 | 102472439 | 102472600 | + | ENST00000425019; ENST00000302217; ENST00000324219; ENST00000350198; ENST00000413150; ENST00000347699; ENST00000456652; ENST00000417294; ENST00000350878; ENST00000421882; ENST00000418101 | TSF |
| 4% | chr2 | 102468305 | 102468327 | + | chr2 | 102472439 | 102472600 | + | ENST00000425019; ENST00000302217; ENST00000324219; ENST00000350198; ENST00000413150; ENST00000347699; ENST00000456652; ENST00000417294; ENST00000350878; ENST00000421882; ENST00000418101 | TSF |
| 4% | chr2 | 102468305 | 102468327 | + | chr2 | 102472439 | 102472600 | + | ENST00000425019; ENST00000302217; ENST00000324219; ENST00000350198; ENST00000413150; ENST00000347699; ENST00000456652; ENST00000417294; ENST00000350878; ENST00000421882; ENST00000418101 | TSF |
| 4% | chr1 | 207820596 | 207820768 | + | chr1 | 207850734 | 207850913 | + | ENST00000508064 | TSF |
| 4% | chr4 | 6983745 | 6984058 | + | chr4 | 6995911 | 6996029 | + | ENST00000448507; ENST00000409757; ENST00000410031; ENST00000451522 | TSF |
| 4% | chr1 | 213064469 | 213064523 | + | chr1 | 213068328 | 213068395 | + | ENST00000366971; ENST00000419102 | TSF |
| 4% | chr1 | 12002791 | 12002835 | + | chr1 | 12008033 | 12008124 | + | ENST00000449038; ENST00000376369; ENST00000429000; ENST00000196061 | TSF |
| 4% | chr1 | 12002791 | 12002835 | + | chr1 | 12008033 | 12008124 | + | ENST00000449038; ENST00000376369; ENST00000429000; ENST00000196061 | TSF |
| 4% | chr1 | 12002791 | 12002835 | + | chr1 | 12008033 | 12008124 | + | ENST00000449038; ENST00000376369; ENST00000429000; ENST00000196061 | TSF |
| 4% | chr12 | 49659927 | 49660025 | + | chr12 | 49663248 | 49663470; 49663252 | + | ENST00000541364; ENST00000552125; ENST00000301072; ENST00000549183 | TSF |
| 4% | chr12 | 49659927 | 49660025 | + | chr12 | 49663248 | 49663470; 49663252 | + | ENST00000541364; ENST00000552125; ENST00000301072; ENST00000549183 | TSF |
| 4% | chr12 | 49659927 | 49660025 | + | chr12 | 49663248 | 49663470; 49663252 | + | ENST00000541364; ENST00000552125; ENST00000301072; ENST00000549183 | TSF |
| 4% | chr18 | 33553603 | 33553783 | + | chr18 | 33554903 | 33555058 | + | ENST00000592875 | TSF |
| 4% | chr2 | 172724171 | 172723495 | − | chr2 | 172712459 | 172712344 | − | ENST00000422440; ENST00000426896; ENST00000475360 | TSF |
| 4% | chr2 | 172724171 | 172723495 | − | chr2 | 172712459 | 172712344 | − | ENST00000422440; ENST00000426896; ENST00000475360 | TSF |
| 4% | chr2 | 172724171 | 172723495 | − | chr2 | 172712459 | 172712344 | − | ENST00000422440; ENST00000426896; ENST00000475360 | TSF |
| 4% | chr10 | 96908 | 95348 | − | chr10 | 94852 | 94744 | − | ENST00000309812 | TSF |
| 4% | chr5 | 136450001 | 136449976 | − | chr5 | 136448250 | 136448124; 136448181 | − | ENST00000394945; ENST00000282223; ENST00000505690 | TSF |
| 4% | chr5 | 136450001 | 136449976 | − | chr5 | 136448250 | 136448124; 136448181 | − | ENST00000394945; ENST00000282223; ENST00000505690 | TSF |
| 4% | chr3 | 182833330 | 182833262 | − | chr3 | 182812393 | 182812347 | − | ENST00000265594; ENST00000497830; ENST00000495767; ENST00000476176; ENST00000487634; ENST00000466650; ENST00000486226 | TSF |
| 4% | chr3 | 182833330 | 182833262 | − | chr3 | 182812393 | 182812347 | − | ENST00000265594; ENST00000497830; ENST00000495767; ENST00000476176; ENST00000487634; ENST00000466650; ENST00000486226 | TSF |
| 4% | chr3 | 182833330 | 182833262 | − | chr3 | 182812393 | 182812347 | − | ENST00000265594; ENST00000497830; ENST00000495767; ENST00000476176; ENST00000487634; ENST00000466650; ENST00000486226 | TSF |
| 4% | chr3 | 182833330 | 182833262 | − | chr3 | 182812393 | 182812347 | − | ENST00000265594; ENST00000497830; ENST00000495767; ENST00000476176; ENST00000487634; ENST00000466650; ENST00000486226 | TSF |
| 4% | chr3 | 182833330 | 182833262 | − | chr3 | 182812393 | 182812347 | − | ENST00000265594; ENST00000497830; ENST00000495767; ENST00000476176; ENST00000487634; ENST00000466650; ENST00000486226 | TSF |
| 4% | chr7 | 72720593 | 72720556 | − | chr7 | 72719094 | 72718956; 27719042 | − | ENST00000428206; ENST00000252594; ENST00000438747; ENST00000310326; ENST00000455763 | TSF |
| 4% | chr7 | 72720593 | 72720556 | − | chr7 | 72719094 | 72718956; 72719042 | − | ENST00000428206; ENST00000252594; ENST00000438747; ENST00000310326; ENST00000455763 | TSF |
| 4% | chr7 | 72720593 | 72720556 | − | chr7 | 72719094 | 72718956; 72719042 | − | ENST00000428206; ENST00000252594; ENST00000438747; ENST00000310326; ENST00000455763 | TSF |
| 4% | chr7 | 72720593 | 72720556 | − | chr7 | 72719094 | 72718956; 72719042 | − | ENST00000428206; ENST00000252594; ENST00000438747; ENST00000310326; ENST00000455763 | TSF |

TABLE 60-continued

Transcript fusion for Testicular Germ Cell Tumors (TGCT) Coordinates of the fusion sequences for which the donor is the TE.

| 1' | 2' | 3' | 4' | 5' | 6' | 7' | 8' | 9' | 10' | 11' |
|---|---|---|---|---|---|---|---|---|---|---|
| | | | | | | | 72719042 | | ENST00000438747; ENST00000310326; ENST00000455763 | |
| 4% | chr16 | 81141785 | 81141755 | – | chr16 | 81134889 | 81134728 | – | ENST00000533478; ENST00000525539 | TSF |
| 4% | chr10 | 125779873 | 125779865 | – | chr10 | 125771996 | 125771849 | – | ENST00000346248; ENST00000435907 | TSF |
| 4% | chr19 | 48627094 | 48627044 | – | chr19 | 48626575 | 48626431 | – | ENST00000263274; ENST00000536218; ENST00000594759; ENST00000427526; ENST00000601091 | TSF |
| 4% | chr19 | 48627094 | 48627044 | – | chr19 | 48626575 | 48626431 | – | ENST00000263274; ENST00000536218; ENST00000594759; ENST00000427526; ENST00000601091 | TSF |
| 4% | chr15 | 40187476 | 40186657 | – | chr15 | 40099459 | 40099207 | – | ENST00000561100; ENST00000543580 | TSF |
| 4% | chr3 | 122500000 | 122499557 | – | chr3 | 122496753 | 122496568 | – | ENST00000383659; ENST00000306103 | TSF |
| 4% | chr3 | 122500000 | 122499557 | – | chr3 | 122496753 | 122496568 | – | ENST00000383659; ENST00000306103 | TSF |
| 4% | chr7 | 99061804 | 99061750 | – | chr7 | 99057816 | 99057709 | – | ENST00000413834; ENST00000555673; ENST00000451138; ENST00000414062; ENST00000449683; ENST00000359832; ENST00000292475; ENST00000544611; ENST00000488775; ENST00000394186 | TSF |
| 4% | chr7 | 99061804 | 99061750 | – | chr7 | 99057816 | 99057709 | – | ENST00000413834; ENST00000555673; ENST00000451138; ENST00000414062; ENST00000449683; ENST00000359832; ENST00000292475; ENST00000544611; ENST00000488775; ENST00000394186 | TSF |
| 4% | chr7 | 99061804 | 99061750 | – | chr7 | 99057816 | 99057709 | – | ENST00000413834; ENST00000555673; ENST00000451138; ENST00000414062; ENST00000449683; ENST00000359832; ENST00000292475; ENST00000544611; ENST00000488775; ENST00000394186 | TSF |
| 4% | chr7 | 99061804 | 99061750 | – | chr7 | 99057816 | 99057709 | – | ENST00000413834; ENST00000555673; ENST00000451138; ENST00000414062; ENST00000449683; ENST00000359832; ENST00000292475; ENST00000544611; ENST00000488775; ENST00000394186 | TSF |
| 4% | chrX | 79986798 | 79986587 | – | chrX | 79985519 | 79985415 | – | ENST00000373275 | TSF |
| 4% | chr10 | 13366616 | 13366334 | – | chr10 | 13365047 | 13364835 | – | ENST00000327347; ENST00000545675; ENST00000537130 | TSF |
| 4% | chr10 | 13366616 | 13366334 | – | chr10 | 13365047 | 13364835 | – | ENST00000327347; ENST00000545675; ENST00000537130 | TSF |
| 4% | chr7 | 154755921 | 154755838 | – | chr7 | 154755476 | 154755381 | – | ENST00000404141; ENST00000397192 | TSF |

TABLE 61

Transcript fusion for Thyroid Cancer (THCA) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 40% | chr9 | 139847344; 139847404; 139847428 | 139847480 | + | ENST00000371633; ENST00000471615; ENST00000371632 | chr9 | 139847940 | 139848024 | + | TAF |
| 40% | chr9 | 139847344; 139847404; 139847428 | 139847480 | + | ENST00000371633; ENST00000471615; ENST00000371632 | chr9 | 139847940 | 139848024 | + | TAF |
| 40% | chr9 | 139847344; 139847404; 139847428 | 139847480 | + | ENST00000371633; ENST00000471615; ENST00000371632 | chr9 | 139847940 | 139848024 | + | TAF |
| 34% | chr19 | 50984141 | 50984234 | + | ENST00000334976; ENST00000376918; ENST00000598585 | chr19 | 51009025 | 51009080 | + | TAF |
| 28% | chr22 | 21576241 | 21576155 | – | ENST00000405188; ENST00000401924; ENST00000424627 | chr22 | 21575420 | 21575160 | – | TAF |
| 27% | chr22 | 25011008 | 25011094 | + | ENST00000248923; ENST00000412658; ENST00000419133; ENST00000400382; ENST00000452551; ENST00000400383; ENST00000400380; ENST00000406383; ENST00000425895 | chr22 | 25011829 | 25012092 | + | TAF |
| 27% | chr15 | 34826374 | 34826255 | – | ENST00000342314; ENST00000267731 | chr15 | 34679464 | 34679458 | – | TAF |

TABLE 61-continued

Transcript fusion for Thyroid Cancer (THCA) Coordinates
of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 23% | chr17 | 66538306 | 66538126 | − | ENST00000592554 | chr17 | 66537704 | 66537648 | − | TAF |
| 20% | chr11 | 13402708 | 13402801 | + | ENST00000396441; ENST00000389707; ENST00000401424; ENST00000361003; ENST00000403290; ENST00000403510; ENST00000403482 | chr11 | 13406027 | 13406509 | + | TAF |
| 20% | chr11 | 13402708 | 13402801 | + | ENST00000396441; ENST00000389707; ENST00000401424; ENST00000361003; ENST00000403290; ENST00000403510; ENST00000403482 | chr11 | 13406027 | 13406509 | + | TAF |
| 20% | chr11 | 13402708 | 13402801 | + | ENST00000396441; ENST00000389707; ENST00000401424; ENST00000361003; ENST00000403290; ENST00000403510; ENST00000403482 | chr11 | 13406027 | 13406509 | + | TAF |
| 20% | chr11 | 13402708 | 13402801 | + | ENST00000396441; ENST00000389707; ENST00000401424; ENST00000361003; ENST00000403290; ENST00000403510; ENST00000403482 | chr11 | 13406027 | 13406509 | + | TAF |
| 20% | chr11 | 13402708 | 13402801 | + | ENST00000396441; ENST00000389707; ENST00000401424; ENST0 0000361003; ENST00000403290; ENST00000403510; ENST00000403482 | chr11 | 13406027 | 13406509 | + | TAF |
| 20% | chr11 | 13402708 | 13402801 | + | ENST00000396441; ENST00000389707; ENST00000401424; ENST00000361003; ENST00000403290; ENST00000403510; ENST00000403482 | chr11 | 13406027 | 13406509 | + | TAF |
| 18% | chr15 | 64444837 | 64444941 | + | ENST00000325881; ENST00000558466 | chr15 | 64445122 | 64445138 | + | TSF |
| 16% | chr15 | 64444837 | 64444941 | + | ENST00000325881; ENST00000558466 | chr15 | 64445091 | 64445138 | + | TAF |
| 14% | chr19 | 11526824 | 11526613 | − | ENST00000380456; ENST00000393423; ENST00000567431 | chr19 | 11522106 | 11521984 | − | TAF |
| 14% | chr19 | 11526824 | 11526613 | − | ENST00000380456; ENST00000393423; ENST00000567431 | chr19 | 11522106 | 11521984 | − | TAF |
| 13% | chr10 | 133106654 | 133106474 | − | ENST00000368642 | chr10 | 133064549 | 133063810 | − | TAF |
| 13% | chr11 | 129980433 | 129980556 | + | ENST00000533713; ENST00000528499; ENST00000263574; ENST00000345598; ENST00000338167; ENST00000278756; ENST00000543137 | chr11 | 129987692 | 129987988 | + | TAF |
| 13% | chr11 | 129980433 | 129980556 | + | ENST00000533713; ENST00000528499; ENST00000263574; ENST00000345598; ENST00000338167; ENST00000278756; ENST00000543137 | chr11 | 129987692 | 129987988 | + | TAF |
| 13% | chr11 | 129980433 | 129980556 | + | ENST00000533713; ENST00000528499; ENST00000263574; ENST0 0000345598; ENST00000338167; ENST00000278756; ENST00000543137 | chr11 | 129987692 | 129987988 | + | TAF |

TABLE 61-continued

Transcript fusion for Thyroid Cancer (THCA) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 13% | chr11 | 129980433 | 129980556 | + | ENST00000533713; ENST00000528499; ENST00000263574; ENST0 0000345598; ENST00000338167; ENST00000278756; ENST00000543137 | chr11 | 129987692 | 129987988 | + | TAF |
| 12% | chr19 | 39077165 | 39077216 | + | ENST00000355481; ENST00000360985; ENST00000359596 | chr19 | 39085644 | 39085967 | + | TAF |
| 12% | chr19 | 39077165 | 39077216 | + | ENST00000355481; ENST00000360985; ENST00000359596 | chr19 | 39085644 | 39085967 | + | TAF |
| 12% | chr19 | 39077165 | 39077216 | + | ENST00000355481; ENST00000360985; ENST00000359596 | chr19 | 39085644 | 39085967 | + | TAF |
| 12% | chr7 | 30469073 | 30468990 | − | ENST00000222823 | chr7 | 30468225 | 30468003 | − | TSF |
| 9% | chrX | 100178050 | 100177782 | − | ENST00000328526; ENST00000372956 | chrX | 100143801 | 100143669 | − | TSF |
| 9% | chrX | 100178050 | 100177782 | − | ENST00000328526; ENST00000372956 | chrX | 100143801 | 1001143669 | − | TSF |
| 5% | chr17 | 45473200 | 45473343 | + | ENST00000331493; ENST00000517484; ENST00000523842 | chr17 | 45474497 | 45476216 | + | TSF |
| 5% | chr17 | 45473200 | 45473343 | + | ENST00000331493; ENST00000517484; ENST00000523842 | chr17 | 45474497 | 45476216 | + | TSF |
| 5% | chr17 | 45473200 | 45473343 | + | ENST00000331493; ENST00000517484; ENST00000523842 | chr17 | 45474497 | 45476216 | + | TSF |
| 5% | chr15 | 64217060 | 64217015 | − | ENST00000261891; ENST00000457488; ENST00000558069 | chr15 | 64216283 | 64216265 | − | TSF |
| 4% | chr9 | 139847344; 139847404; 139847428 | 139847480 | + | ENST00000371633; ENST00000471615; ENST00000371632 | chr9 | 139847768 | 139847869 | + | TSF |
| 4% | chr9 | 139847344; 139847404; 139847428 | 139847480 | + | ENST00000371633; ENST00000471615; ENST00000371632 | chr9 | 139847768 | 139847869 | + | TSF |
| 4% | chr9 | 139847344; 139847404; 139847428 | 139847480 | + | ENST00000371633; ENST00000471615; ENST00000371632 | chr9 | 139847768 | 139847869 | + | TSF |
| 4% | chr17 | 45473200 | 45473343 | + | ENST00000331493; ENST00000517484; ENST00000523842 | chr17 | 45474435 | 45476216 | + | TSF |
| 4% | chr17 | 45473200 | 45473343 | + | ENST00000331493; ENST00000517484; ENST00000523842 | chr17 | 45474435 | 45476216 | + | TSF |
| 4% | chr17 | 45473200 | 45473343 | + | ENST00000331493; ENST00000517484; ENST00000523842 | chr17 | 45474435 | 45476216 | + | TSF |
| 3% | chr10 | 132915197 | 132915062 | − | ENST00000368642 | chr10 | 132903439 | 132903054 | − | TSF |
| 3% | chr19 | 54666021 | 54665838 | − | ENST00000301187; ENST00000416963; ENST00000376591 | chr19 | 54665366 | 54665264 | − | TSF |
| 3% | chr19 | 54666021 | 54665838 | − | ENST00000301187; ENST00000416963; ENST00000376591 | chr19 | 54665366 | 54665264 | − | TSF |
| 3% | chr19 | 54666021 | 54665838 | − | ENST00000301187; ENST00000416963; ENST00000376591 | chr19 | 54665366 | 54665264 | − | TSF |
| 3% | chr19 | 43372507 | 43372253 | − | ENST00000436291; ENST00000595124; ENST00000595356; ENST00000403380; ENST00000312439; ENST00000244296; ENST00000597058 | chr19 | 43257528 | 43257135 | − | TSF |
| 3% | chr19 | 43372507 | 43372253 | − | ENST00000436291; ENST00000595124; ENST00000595356; ENST00000403380; ENST00000312439; ENST00000244296; ENST00000597058 | chr19 | 43257528 | 43257135 | − | TSF |

TABLE 61-continued

Transcript fusion for Thyroid Cancer (THCA) Coordinates
of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 3% | chr19 | 43372507 | 43372253 | – | ENST00000436291; ENST00000595124; ENST00000595356; ENST00000403380; ENST00000312439; ENST00000244296; ENST00000597058 | chr19 | 43257528 | 43257135 | – | TSF |
| 2% | chrX | 100170072 | 100169610 | – | ENST00000328526; ENST00000372956 | chrX | 100143801 | 100143669 | – | TSF |
| 2% | chrX | 100170072 | 100169610 | – | ENST00000328526; ENST00000372956 | chrX | 100143801 | 100143669 | – | TSF |
| 2% | chr7 | 73973957 | 73973985 | + | ENST00000265755; ENST00000455841; ENST00000424337; ENST00000476977; ENST00000470715 | chr7 | 73985447 | 73985582 | + | TSF |
| 2% | chr7 | 73973957 | 73973985 | + | ENST00000265755; ENST00000455841; ENST00000424337; ENST00000476977; ENST00000470715 | chr7 | 73985447 | 73985582 | + | TSF |
| 2% | chr7 | 73973957 | 73973985 | + | ENST00000265755; ENST00000455841; ENST00000424337; ENST00000476977; ENST00000470715 | chr7 | 73985447 | 73985582 | + | TSF |
| 2% | chr7 | 73973957 | 73973985 | + | ENST00000265755; ENST00000455841; ENST00000424337; ENST00000476977; ENST00000470715 | chr7 | 73985447 | 73985582 | + | TSF |
| 2% | chr10 | 50255089 | 50255028 | – | ENST00000332853 | chr10 | 50240450 | 50240427 | – | TSF |
| 2% | chr17 | 11166683 | 11166843 | + | ENST00000432116; ENST00000441885; ENST00000409168; ENST00000343478 | chr17 | 11172072 | 11172130 | + | TSF |
| 2% | chr17 | 11166683 | 11166843 | + | ENST00000432116; ENST00000441885; ENST00000409168; ENST00000343478 | chr17 | 11172072 | 11172130 | + | TSF |
| 2% | chr13 | 53307494; 53307473 | 53307354 | – | ENST00000448904; ENST00000377962; ENST00000431550 | chr13 | 53304269 | 53303967 | – | TSF |
| 2% | chr13 | 53307494; 53307473 | 53307354 | – | ENST00000448904; ENST00000377962; ENST00000431550 | chr13 | 53304269 | 53303967 | – | TSF |
| 2% | chr4 | 25759228 | 25759156 | – | ENST00000399878; ENST00000264868; ENST00000502949; ENST00000510448 | chr4 | 25723603 | 25723555 | – | TSF |
| 2% | chr4 | 25759228 | 25759156 | – | ENST00000399878; ENST00000264868; ENST00000502949; ENST00000510448 | chr4 | 25723603 | 25723555 | – | TSF |
| 2% | chr4 | 25759228 | 25759156 | – | ENST00000399878; ENST00000264868; ENST00000502949; ENST00000510448 | chr4 | 25723603 | 25723555 | – | TSF |
| 2% | chr4 | 25759228 | 25759156 | – | ENST00000399878; ENST00000264868; ENST00000502949; ENST00000510448 | chr4 | 25723603 | 25723555 | – | TSF |
| 2% | chrX | 71401561; 71401615; 71401644 | 71401678 | + | ENST00000373662; ENST00000218432; ENST00000423432; ENST00000373669; ENST00000496835; ENST00000439980; ENST00000446576 | chrX | 71405250 | 71405452 | + | TSF |
| 2% | chrX | 71401561; 71401615; 71401644 | 71401678 | + | ENST00000373662; ENST00000218432; ENST00000423432; ENST00000373669; ENST00000496835; ENST00000439980; | chrX | 71405250 | 71405452 | + | TSF |

TABLE 61-continued

Transcript fusion for Thyroid Cancer (THCA) Coordinates
of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 2% | chrX | 71401561; 71401615; 71401644 | 71401678 | + | ENST00000446576 ENST00000373662; ENST00000218432; ENST00000423432; ENST00000373669; ENST00000496835; ENST00000439980; ENST00000446576 | chrX | 71405250 | 71405452 | + | TSF |
| 2% | chr9 | 128510829; 128510854 | 128510902 | + | ENST00000342287; ENST00000373487; ENST00000373489; ENST00000373492; ENST00000373482; ENST00000491787; ENST00000447726 | chr9 | 128572989 | 128573209 | + | TSF |
| 2% | chr9 | 128510829; 128510854 | 128510902 | + | ENST00000342287; ENST00000373487; ENST00000373489; ENST00000373492; ENST00000373482; ENST00000491787; ENST00000447726 | chr9 | 128572989 | 128573209 | + | TSF |
| 2% | chr11 | 58919223 | 58919390 | + | ENST00000528737; ENST00000420244; ENST00000527629; ENST00000361723; ENST00000531408; ENST00000533703; ENST00000531147 | chr11 | 58921988 | 58922183 | + | TSF |
| 2% | chr2 | 135470889 | 135470770 | − | ENST00000281924 | chr2 | 135443800 | 135443742 | − | TSF |
| 1% | chr15 | 64426863 | 64427006 | + | ENST00000560829; ENST00000261889; ENST00000559844; ENST00000561026 | chr15 | 64427210 | 64427230 | + | TSF |
| 1% | chr15 | 64426863 | 64427006 | + | ENST00000560829; ENST00000261889; ENST00000559844; ENST00000561026 | chr15 | 64427210 | 64427230 | + | TSF |
| 1% | chr15 | 64426863 | 64427006 | + | ENST00000560829; ENST00000261889; ENST00000559844; ENST00000561026 | chr15 | 64427210 | 64427230 | + | TSF |
| 1% | chr18 | 56807181 | 56807267 | + | ENST00000587834; ENST00000299714; ENST00000588875 | chr18 | 56814218 | 56814267 | + | TSF |
| 1% | chr8 | 27461912 | 27461808 | − | ENST00000316403; ENST00000546343; ENST00000560366; ENST00000405140; ENST00000523500; ENST00000522098 | chr8 | 27458611 | 27458570 | − | TSF |
| 1% | chr8 | 27461912 | 27461808 | − | ENST00000316403; ENST00000546343; ENST00000560366; ENST00000405140; ENST00000523500; ENST00000522098 | chr8 | 27458611 | 27458570 | − | TSF |
| 1% | chr8 | 27461912 | 27461808 | − | ENST00000316403; ENST00000546343; ENST00000560366; ENST00000405140; ENST00000523500; ENST00000522098 | chr8 | 27458611 | 27458570 | − | TSF |
| 1% | chr8 | 27461912 | 27461808 | − | ENST00000316403; ENST00000546343; ENST00000560366; ENST00000405140; ENST00000523500; ENST00000522098 | chr8 | 27458611 | 27458570 | − | TSF |
| 1% | chrX | 22208561 | 22208619 | + | ENST00000379374; ENST00000537599; ENST00000535894; ENST00000418858 | chrX | 22209939 | 22210210 | + | TSF |
| 1% | chrX | 22208561 | 22208619 | + | ENST00000379374; ENST00000537599; | chrX | 22209939 | 22210210 | + | TSF |

TABLE 61-continued

Transcript fusion for Thyroid Cancer (THCA) Coordinates
of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 1% | chrX | 22208561 | 22208619 | + | ENST00000535894; ENST00000418858 ENST00000379374; ENST00000537599 | chrX | 22209939 | 22210210 | + | TSF |
| 1% | chr1 | 12476713 | 12476880 | + | ENST00000535894; ENST00000418858 ENST00000356315; ENST00000358136; ENST00000011700; ENST00000543766 | chr1 | 12510638 | 12510871 | + | TSF |
| 1% | chr1 | 12476713 | 12476880 | + | ENST00000356315; ENST00000358136; ENST00000011700; ENST00000543766 | chr1 | 12510638 | 12510871 | + | TSF |
| 1% | chr1 | 12476713 | 12476880 | + | ENST00000356315; ENST00000358136; ENST00000011700; ENST00000543766 | chr1 | 12510638 | 12510871 | + | TSF |
| 1% | chr1 | 12476713 | 12476880 | + | ENST00000356315; ENST00000358136; ENST00000011700; ENST00000543766 | chr1 | 12510638 | 12510871 | + | TSF |
| 1% | chr11 | 810235 | 810357 | + | ENST00000321153; ENST00000530797 | chr11 | 910147 | 910157 | + | TSF |
| 1% | chr15 | 32976758; 32976761 | 32976870 | + | ENST00000300175; ENST00000413748; ENST00000494364; ENST00000497208; ENST00000471027 | chr15 | 32977335 | 32977906 | + | TSF |
| 1% | chr15 | 32976758; 32976761 | 32976870 | + | ENST00000300175; ENST00000413748; ENST00000494364; ENST00000497208; ENST00000471027 | chr15 | 32977335 | 32977906 | + | TSF |
| 1% | chr15 | 32976758; 32976761 | 32976870 | + | ENST00000300175; ENST00000413748; ENST00000494364; ENST00000497208; ENST00000471027 | chr15 | 32977335 | 32977906 | + | TSF |
| 1% | chr7 | 33644477 | 33644587 | + | ENST00000242067; ENST00000350941; ENST00000354265; ENST00000355070; ENST00000396127; ENST00000434373 | chr7 | 33900207 | 33900392 | + | TSF |
| 1% | chr7 | 33644477 | 33644587 | + | ENST00000242067; ENST00000350941; ENST00000354265; ENST00000355070; ENST00000396127; ENST00000434373 | chr7 | 33900207 | 33900392 | + | TSF |
| 1% | chr7 | 33644477 | 33644587 | + | ENST00000242067; ENST00000350941; ENST00000354265; ENST00000355070; ENST00000396127; ENST00000434373 | chr7 | 33900207 | 33900392 | + | TSF |
| 1% | chr7 | 33644477 | 33644587 | + | ENST00000242067; ENST00000350941; ENST00000354265; ENST00000355070; ENST00000396127; ENST00000434373 | chr7 | 33900207 | 33900392 | + | TSF |
| 1% | chr7 | 33644477 | 33644587 | + | ENST00000242067; ENST00000350941; ENST00000354265; ENST00000355070; ENST00000396127; ENST00000434373 | chr7 | 33900207 | 339010392 | + | TSF |
| 1% | chr7 | 33644477 | 33644587 | + | ENST00000242067; ENST00000350941; ENST00000354265; ENST00000355070; ENST00000396127; ENST00000434373 | chr7 | 33900207 | 33900392 | + | TSF |

TABLE 61-continued

Transcript fusion for Thyroid Cancer (THCA) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 1% | chr2 | 89417128 | 89416936 | – | ENST00000490686 | chr2 | 89370042 | 893616766 | – | TSF |
| 1% | chr17 | 60107012 | 60106902 | – | ENST00000397786; ENST00000583958 | chr17 | 60101011 | 60100641 | – | TSF |
| 1% | chr17 | 60107012 | 60106902 | – | ENST00000397786; ENST00000583958 | chr17 | 60101011 | 60100641 | – | TSF |
| 1% | chr19 | 43679621 | 43679367 | – | ENST00000366175; ENST00000407356; ENST00000599812; ENST00000342951; ENST00000404580 | chr19 | 43448254 | 43447862 | – | TSF |
| 1% | chr19 | 43679621 | 43679367 | – | ENST00000366175; ENST00000407356; ENST00000599812; ENST00000342951; ENST00000404580 | chr19 | 43448254 | 43447862 | – | TSF |
| 1% | chr3 | 9825897 | 9825712 | – | ENST00000301964; ENST00000440161; ENST00000343450 | chr3 | 9823380 | 9823336 | – | TSF |
| 1% | chr19 | 43679621 | 43679367 | – | ENST00000366175; ENST00000407356; ENST00000599812; ENST00000342951; ENST00000404580 | chr19 | 43537524 | 43537131 | – | TSF |
| 1% | chr19 | 43679621 | 43679367 | – | ENST00000366175; ENST00000407356; ENST00000599812; ENST00000342951; ENST00000404580 | chr19 | 43537524 | 43537131 | – | TSF |
| 1% | chr19 | 43679621 | 43679367 | – | ENST00000366175; ENST00000407356; ENST00000599812; ENST00000342951; ENST00000404580 | chr19 | 43428976 | 43428578 | – | TSF |
| 1% | chr19 | 43679621 | 43679367 | – | ENST00000366175; ENST00000407356; ENST00000599812; ENST00000342951; ENST00000404580 | chr19 | 43428976 | 434218578 | – | TSF |

TABLE 62

Transcript fusion for Thyroid Cancer (THCA) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 43% | chr22 | 21575439 | 21575317 | – | chr22 | 21570956 | 21570760 | – | ENST00000405188; ENST00000401924; ENST00000424627 | TAF |
| 43% | chr22 | 21575439 | 21575317 | – | chr22 | 21570956 | 21570760 | – | ENST00000405188; ENST00000401924; ENST00000424627 | TAF |
| 29% | chr9 | 123237538 | 123237484 | – | chr9 | 123234156 | 123234026 | – | ENST00000359309; ENST00000360822; ENST00000349780; ENST00000360190; ENST00000480112; ENST00000416449 | TAF |
| 29% | chr9 | 123237538 | 123237484 | – | chr9 | 123234156 | 123234026 | – | ENST00000359309; ENST00000360822; ENST00000349780; ENST00000360190; ENST00000480112; ENST00000416449 | TAF |
| 29% | chr9 | 123237538 | 123237484 | – | chr9 | 123234156 | 123234026 | – | ENST00000359309; ENST00000360822; ENST00000349780; ENST00000360190; ENST00000480112; ENST00000416449 | TAF |
| 29% | chr9 | 123237538 | 123237484 | – | chr9 | 123234156 | 123234026 | – | ENST00000359309; ENST00000360822; | TAF |

TABLE 62-continued

Transcript fusion for Thyroid Cancer (THCA) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 29% | chr9 | 123237538 | 123237484 | − | chr9 | 123234156 | 123234026 | − | ENST00000349780; ENST00000360190; ENST00000480112; ENST00000416449 ENST00000359309; ENST00000360822; ENST00000349780; ENST00000360190; ENST00000480112; ENST00000416449 | TAF |
| 28% | chr7 | 30468250 | 30468120 | − | chr7 | 30465326 | 30465254 | − | ENST00000222823 | TSF |
| 23% | chr17 | 48164136 | 48164357 | + | chr17 | 48165108 | 48165233 | + | ENST00000320031; ENST00000007722 | TAF |
| 23% | chr17 | 48164136 | 48164357 | + | chr17 | 48165108 | 48165233 | + | ENST00000320031; ENST00000007722 | TAF |
| 21% | chr11 | 17895953 | 17895767 | − | chr11 | 17809960 | 17809632; 17809702 | − | ENST00000265965; ENST00000529151 | TAF |
| 21% | chr11 | 17895953 | 17895767 | − | chr11 | 17809960 | 17809632; 17809702 | − | ENST00000265965; ENST00000529151 | TAF |
| 21% | chrX | 123618682 | 123617816 | − | chrX | 123615814 | 123615582 | − | ENST00000371130; ENST00000422452 | TSF |
| 20% | chrX | 71529592 | 71529379 | − | chrX | 71522784 | 71522660 | − | ENST00000453707; ENST00000431381; ENST00000427412; ENST00000450875; ENST00000454225 | TSF |
| 20% | chrX | 71529592 | 71529379 | − | chrX | 71522784 | 71522660 | − | ENST00000453707; ENST00000431381; ENST00000427412; ENST00000450875; ENST00000454225 | TSF |
| 20% | chrX | 71529592 | 71529379 | − | chrX | 71522784 | 71522660 | − | ENST00000453707; ENST00000431381; ENST00000427412; ENST00000450875; ENST00000454225 | TSF |
| 20% | chrX | 71529592 | 71529379 | − | chrX | 71522784 | 71522660 | − | ENST00000453707; ENST00000431381; ENST00000427412; ENST00000450875; ENST00000454225 | TSF |
| 14% | chr3 | 124690942 | 124690838 | − | chr3 | 124689645 | 124689496 | − | ENST00000311127; ENST00000487661 | TAF |
| 14% | chr14 | 81544931 | 81545280 | + | chr14 | 81554298 | 81554372 | + | ENST00000541158; ENST00000342443; ENST00000298171; ENST00000554263; ENST00000554435 | TAF |
| 14% | chr14 | 81544931 | 81545280 | + | chr14 | 81554298 | 81554372 | + | ENST00000541158; ENST00000342443; ENST00000298171; ENST00000554263; ENST00000554435 | TAF |
| 14% | chr14 | 81544931 | 81545280 | + | chr14 | 81554298 | 81554372 | + | ENST00000541158; ENST00000342443; ENST00000298171; ENST00000554263; ENST00000554435 | TAF |
| 14% | chr14 | 81544931 | 81545280 | + | chr14 | 81554298 | 81554372 | + | ENST00000541158; ENST00000342443; ENST00000298171; ENST00000554263; ENST00000554435 | TAF |
| 14% | chr15 | 64203056 | 64202899 | − | chr15 | 64200799 | 64200719 | − | ENST00000261891; ENST00000457488 | TAF |
| 14% | chr9 | 128287668 | 287128523 | − | chr9 | 128284044 | 128284031 | − | ENST00000394060 | TAF |
| 12% | chr17 | 7130320 | 7130212 | − | chr17 | 7129958 | 7129740 | − | ENST00000005340; ENST00000575458; ENST00000575086 | TAF |
| 12% | chr17 | 7130320 | 7130212 | − | chr17 | 7129958 | 7129740 | − | ENST00000005340; ENST00000575458; ENST00000575086 | TAF |
| 11% | chr3 | 185411133 | 185410965 | − | chr3 | 185410550 | 185410487 | − | ENST00000382199; ENST00000421047; ENST00000457616; | TAF |

TABLE 62-continued

Transcript fusion for Thyroid Cancer (THCA) Coordinates
of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 11% | chr3 | 185411133 | 185410965 | – | chr3 | 185410550 | 185410487 | – | ENST00000346192 ENST00000382199; ENST00000421047; ENST00000457616; ENST00000346192 | TAF |
| 6% | chr19 | 11528445 | 11528379 | – | chr19 | 11527733 | 11527510 | – | ENST00000562663; ENST00000563726; ENST00000380456; ENST00000393423; ENST00000567431; ENST00000567080 | TSF |
| 6% | chr19 | 11528445 | 11528379 | – | chr19 | 11527733 | 11527510 | – | ENST00000562663; ENST00000563726; ENST00000380456; ENST00000393423; ENST00000567431; ENST00000567080 | TSF |
| 6% | chr19 | 11528445 | 11528379 | – | chr19 | 11527733 | 11527510 | – | ENST00000562663; ENST00000563726; ENST00000380456; ENST00000393423; ENST00000567431; ENST00000567080 | TSF |
| 6% | chr19 | 11528445 | 11528379 | – | chr19 | 11527733 | 11527510 | – | ENST00000562663; ENST00000563726; ENST00000380456; ENST00000393423; ENST00000567431; ENST00000567080 | TSF |
| 6% | chr19 | 11528445 | 11528379 | – | chr19 | 11527733 | 11527510 | – | ENST00000562663; ENST00000563726; ENST00000380456; ENST00000393423; ENST00000567431; ENST00000567080 | TSF |
| 6% | chr19 | 11528445 | 11528379 | – | chr19 | 11527733 | 11527510 | – | ENST00000562663; ENST00000563726; ENST00000380456; ENST00000393423; ENST00000567431; ENST00000567080 | TSF |
| 5% | chr9 | 123237538 | 123237538 | – | chr9 | 123234140 | 123234026 | – | ENST00000359309; ENST00000360822; ENST00000349780; ENST00000360190; ENST00000480112; ENST00000416449 | TSF |
| 5% | chr9 | 123237538 | 123237484 | – | chr9 | 123234140 | 123234026 | – | ENST00000359309; ENST00000360822; ENST00000349780; ENST00000360190; ENST00000480112; ENST00000416449 | TSF |
| 5% | chr9 | 123237538 | 123237484 | – | chr9 | 123234140 | 123234026 | – | ENST00000359309; ENST00000360822; ENST00000349780; ENST00000360190; ENST00000480112; ENST00000416449 | TSF |
| 5% | chr9 | 123237538 | 123237538 | – | chr9 | 123234140 | 123234026 | – | ENST00000359309; ENST00000360822; ENST00000349780; ENST00000360190; ENST00000480112; ENST00000416449 | TSF |
| 5% | chr9 | 123237538 | 123237538 | – | chr9 | 123234140 | 123234026 | – | ENST00000359309; ENST00000360822; ENST00000349780; ENST00000360190; ENST00000480112; ENST00000416449 | TSF |
| 5% | chr5 | 86542665 | 86543184 | + | chr5 | 86627165 | 86627317 | + | ENST00000274376; ENST00000515800; ENST00000456692; ENST00000512763; | TSF |

TABLE 62-continued

Transcript fusion for Thyroid Cancer (THCA) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 5% | chr5 | 86542665 | 86543184 | + | chr5 | 86627165 | 86627317 | + | ENST00000506290 ENST00000274376; ENST00000515800; ENST00000456692; ENST00000512763; ENST00000506290 | TSF |
| 5% | chr3 | 4859338 | 4859117 | − | chr3 | 4856115 | 4856088 | − | ENST00000449914; ENST00000441894 | TSF |
| 5% | chr3 | 4858133 | 4857857 | − | chr3 | 4856115 | 4856088 | − | ENST00000449914; ENST00000441894 | TSF |
| 4% | chr1 | 165468331 | 165468249 | − | chr1 | 165398203 | 165397956 | − | ENST00000359842 | TSF |
| 4% | chr9 | 110017723 | 110017723 | + | chr9 | 110062422 | 110062503 | + | ENST00000419616; ENST00000358015; ENST00000442587 | TSF |
| 4% | chr9 | 110017723 | 110017723 | + | chr9 | 110062422 | 110062503 | + | ENST00000419616; ENST00000358015; ENST00000442587 | TSF |
| 4% | chr9 | 110017723 | 110017723 | + | chr9 | 110062422 | 110062503 | + | ENST00000419616; ENST00000358015; ENST00000442587 | TSF |
| 3% | chr9 | 123237538 | 123237310 | − | chr9 | 123234156 | 123234026 | − | ENST00000359309; ENST00000360822; ENST00000349780; ENST00000360190; ENST00000480112; ENST00000416449 | TSF |
| 3% | chr9 | 123237538 | 123237310 | − | chr9 | 123234156 | 123234026 | − | ENST00000359309; ENST00000360822; ENST00000349780; ENST00000360190; ENST00000480112; ENST00000416449 | TSF |
| 3% | chr9 | 123237538 | 123237310 | − | chr9 | 123234156 | 123234026 | − | ENST00000359309; ENST00000360822; ENST00000349780; ENST00000360190; ENST00000480112; ENST00000416449 | TSF |
| 3% | chr9 | 123237538 | 123237310 | − | chr9 | 123234156 | 123234026 | − | ENST00000359309; ENST00000360822; ENST00000349780; ENST00000360190; ENST00000480112; ENST00000416449 | TSF |
| 3% | chr9 | 123237538 | 123237310 | − | chr9 | 123234156 | 123234026 | − | ENST00000359309; ENST00000360822; ENST00000349780; ENST00000360190; ENST00000416449 | TSF |
| 3% | chr11 | 12515263 | 12515280 | + | chr1 | 12516054 | 12516186 | + | ENST00000356315; ENST00000358136; ENST00000011700; ENST00000543766 | TSF |
| 3% | chr9 | 128286052 | 128286013 | − | chr9 | 128284044 | 128284031 | − | ENST00000394060 | TSF |
| 3% | chr15 | 64445039 | 64445132 | + | chr15 | 64445444 | 64445538; 64445542 | + | ENST00000325881; ENST00000558466 | TSF |
| 3% | chr15 | 64445039 | 64445132 | + | chr15 | 64445444 | 64445542 64445538; | + | ENST00000325881; ENST00000558466 | TSF |
| 3% | chr12 | 130849847 | 130849940 | + | chr12 | 130851678 | 130851803 | + | ENST00000245255 | TSF |
| 3% | chr16 | 4708255 | 4708353 | + | chr16 | 4714710 | 4714776 | + | ENST00000262370; ENST00000415496; ENST00000536343; ENST00000587747; ENST00000399577; ENST00000588994; ENST00000586183; ENST00000590790 | TSF |
| 3% | chr16 | 4708255 | 4708353 | + | chr16 | 4714710 | 4714776 | + | ENST00000262370; ENST00000415496; ENST00000536343; ENST00000587747; ENST00000399577; ENST00000588994; ENST00000586183; | TSF |

TABLE 62-continued

Transcript fusion for Thyroid Cancer (THCA) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 3% | chr16 | 4708255 | 4708353 | + | chr16 | 4714710 | 4714776 | + | ENST00000590790 ENST00000262370; ENST00000415496; ENST00000536343; ENST00000587747; ENST00000399577; ENST00000588994; ENST00000586183; | TSF |
| 3% | chr16 | 4708255 | 4708353 | + | chr16 | 4714710 | 4714776 | + | ENST00000590790 ENST00000262370; ENST00000415496; ENST00000536343; ENST00000587747; ENST00000399577; ENST00000588994; ENST00000586183; | TSF |
| 3% | chr16 | 4708255 | 4708353 | + | chr16 | 4714710 | 4714776 | + | ENST00000590790 ENST00000262370; ENST00000415496; ENST00000536343; ENST00000587747; ENST00000399577; ENST00000588994; ENST00000586183; | TSF |
| 3% | chr16 | 4708255 | 4708353 | + | chr16 | 4714710 | 4714776 | + | ENST00000590790 ENST00000262370; ENST00000415496; ENST00000536343; ENST00000587747; ENST00000399577; ENST00000588994; ENST00000586183; | TSF |
| 3% | chr16 | 4708255 | 4708353 | + | chr16 | 4714710 | 4714776 | + | ENST00000590790 ENST00000262370; ENST00000415496; ENST00000536343; ENST00000587747; ENST00000399577; ENST00000588994; ENST00000586183; | TSF |
| 3% | chr16 | 4708255 | 4708353 | + | chr16 | 4714710 | 4714776 | + | ENST00000590790 ENST00000262370; ENST00000415496; ENST00000536343; ENST00000587747; ENST00000399577; ENST00000588994; ENST00000586183; | TSF |
| 2% | chr4 | 56493122 | 56492923 | − | chr4 | 56482552 | 56482505 | − | ENST00000264218; ENST00000505262; ENST00000507338 | TSF |
| 2% | chr4 | 56493122 | 56492923 | − | chr4 | 56482552 | 56482505 | − | ENST00000264218; ENST00000505262; ENST00000507338 | TSF |
| 2% | chr4 | 56493122 | 56492923 | − | chr4 | 56482552 | 56482505 | − | ENST00000264218; ENST00000505262; ENST00000507338 | TSF |
| 2% | chr7 | 30737766 | 30737846 | + | chr7 | 30793347 | 30793554 | + | ENST00000013222; ENST00000451002 | TSF |
| 2% | chr7 | 30737766 | 30737846 | + | chr7 | 30793347 | 30793554 | + | ENST00000013222; ENST00000451002 | TSF |
| 2% | chr12 | 117498589 | 117498567 | − | chr12 | 117494691 | 117494611 | − | ENST00000470612; ENST00000335209; ENST00000392545; ENST00000462502 | TSF |
| 2% | chr12 | 117498589 | 117498567 | − | chr12 | 117494691 | 117494611 | − | ENST00000470612; ENST00000335209; ENST00000392545; ENST00000462502 | TSF |
| 2% | chr12 | 117498589 | 117498567 | − | chr12 | 117494691 | 117494611 | − | ENST00000470612; ENST00000335209; ENST00000392545; ENST00000462502 | TSF |
| 2% | chr8 | 11706946 | 11706904 | − | chr8 | 11706673 | 11706555; | ENST00000434271; | TSF |

TABLE 62-continued

Transcript fusion for Thyroid Cancer (THCA) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| | | | | | | | 11706570; 11706571; 11706593 | | ENST00000353047; ENST00000530640; ENST00000531089; ENST00000453527; ENST00000345125; ENST00000533455; ENST00000534510; ENST00000534636; ENST00000533572; ENST00000530296; ENST00000526195; ENST00000527243; ENST00000534149; ENST00000526645 | |
| 2% | chr8 | 11706946 | 11706904 | – | chr8 | 11706673 | 11706555; 11706570; 11706571; 11706593 | – | ENST00000434271; ENST00000353047; ENST00000530640; ENST00000531089; ENST00000453527; ENST00000345125; ENST00000533455; ENST00000534510; ENST00000534636; ENST00000533572; ENST00000530296; ENST00000526195; ENST00000527243; ENST00000534149; ENST00000526645 | TSF |
| 2% | chr8 | 11706946 | 11706904 | – | chr8 | 11706673 | 11706555; 11706570; 71106571; 11706593 | – | ENST00000434271; ENST00000353047; ENST00000530640; ENST00000531089; ENST00000453527; ENST00000345125; ENST00000533455; ENST00000534510; ENST00000534636; ENST00000533572; ENST00000530296; ENST00000526195; ENST00000527243; ENST00000534149; ENST00000526645 | TSF |
| 2% | chr8 | 11706946 | 11706904 | – | chr8 | 11706673 | 11706555; 11706570; 11706571; 11706593 | – | ENST00000434271; ENST00000353047; ENST00000530640; ENST00000531089; ENST00000453527; ENST00000345125; ENST00000533455; ENST00000534510; ENST00000534636; ENST00000533572; ENST00000530296; ENST00000526195; ENST00000527243; ENST00000534149; ENST00000526645 | TSF |
| 2% | chr8 | 11706946 | 11706904 | – | chr8 | 11706673 | 11706555; 11706570; 11706571; 11706593 | – | ENST00000434271; ENST00000353047; ENST00000530640; ENST00000531089; ENST00000453527; ENST00000345125; ENST00000533455; ENST00000534510; ENST00000534636; ENST00000533572; ENST00000530296; ENST00000526195; ENST00000527243; ENST00000534149; ENST00000526645 | TSF |
| 2% | chr8 | 11706946 | 11706904 | – | chr8 | 11706673 | 11706555; | | ENST00000434271; | TSF |

TABLE 62-continued

Transcript fusion for Thyroid Cancer (THCA) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| | | | | | | | 11706570;<br>11706571;<br>11706593 | | ENST00000353047;<br>ENST00000530640;<br>ENST00000531089;<br>ENST00000453527;<br>ENST00000345125;<br>ENST00000533455;<br>ENST00000534510;<br>ENST00000534636;<br>ENST00000533572;<br>ENST00000530296;<br>ENST00000526195;<br>ENST00000527243;<br>ENST00000534149;<br>ENST00000526645 | |
| 2% | chr8 | 11706946 | 11706904 | − | chr8 | 11706673 | 11706555;<br>11706570;<br>11706571;<br>11706593 | − | ENST00000434271;<br>ENST00000353047;<br>ENST00000530640;<br>ENST00000531089;<br>ENST00000453527;<br>ENST00000345125;<br>ENST00000533455;<br>ENST00000534510;<br>ENST00000534636;<br>ENST00000533572;<br>ENST00000530296;<br>ENST00000526195;<br>ENST00000527243;<br>ENST00000534149;<br>ENST00000526645 | TSF |
| 2% | chr8 | 11706946 | 11706904 | − | chr8 | 11706673 | 11706555;<br>11706570;<br>11706571;<br>11706593 | − | ENST00000434271;<br>ENST00000353047;<br>ENST00000530640;<br>ENST00000531089;<br>ENST00000453527;<br>ENST00000345125;<br>ENST00000533455;<br>ENST00000534510;<br>ENST00000534636;<br>ENST00000533572;<br>ENST00000530296;<br>ENST00000526195;<br>ENST00000527243;<br>ENST00000534149;<br>ENST00000526645 | TSF |
| 2% | chr14 | 104020098 | 104020199 | + | chr14 | 104053611 | 104053701;<br>104053628;<br>104053671 | + | ENST00000409074;<br>ENST00000472726;<br>ENST00000440963;<br>ENST00000458117;<br>ENST00000556253;<br>ENST00000247618 | TSF |
| 2% | chr14 | 104020098 | 104020199 | + | chr14 | 104053611 | 104053701:<br>104053628;<br>104053671 | + | ENST00000409074;<br>ENST00000472726;<br>ENST00000440963;<br>ENST00000458117;<br>ENST00000556253;<br>ENST00000247618 | TSF |
| 2% | chr14 | 104020098 | 104020199 | + | chr14 | 104053611 | 104053701;<br>104053628;<br>104053671 | + | ENST00000409074;<br>ENST00000472726;<br>ENST00000440963;<br>ENST00000458117;<br>ENST00000556253;<br>ENST00000247618 | TSF |
| 2% | chr14 | 104020098 | 104020199 | + | chr14 | 104053611 | 104053701;<br>104053628;<br>104053671 | + | ENST00000409074;<br>ENST00000472726;<br>ENST00000440963;<br>ENST00000458117;<br>ENST00000556253;<br>ENST00000247618 | TSF |
| 2% | chr10 | 132904406 | 132903251 | − | chr10 | 132902617 | 132902528 | − | ENST00000368642 | TSF |
| 2% | chr3 | 9823188 | 9823088 | − | chr3 | 9822233 | 9822041 | − | ENST00000301964;<br>ENST00000440161 | TSF |
| 2% | chr10 | 97605877 | 97605893 | + | chr10 | 97607203 | 97607463 | + | ENST00000453258;<br>ENST00000371207;<br>ENST00000543964;<br>ENST00000371203; | TSF |

TABLE 62-continued

Transcript fusion for Thyroid Cancer (THCA) Coordinates
of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 2% | chr2 | 85823332 | 85823377 | + | chr2 | 85823642 | 85823772 | + | ENST00000539125; ENST00000371205 ENST00000441634; ENST00000306368; ENST00000414390; ENST00000443647; ENST00000456023 | TSF |
| 2% | chr2 | 85823332 | 85823377 | + | chr2 | 85823642 | 85823772 | + | ENST00000441634; ENST00000306368; ENST00000414390; ENST00000443647; ENST00000456023 | TSF |
| 2% | chr2 | 85823332 | 85823377 | + | chr2 | 85823642 | 85823772 | + | ENST00000441634; ENST00000306368; ENST00000414390; ENST00000443647; ENST00000456023 | TSF |
| 2% | chr2 | 85823332 | 85823377 | + | chr2 | 85823642 | 85823772 | + | ENST00000441634; ENST00000306368; ENST00000414390; ENST00000443647; ENST00000456023 | TSF |
| 2% | chr2 | 85823332 | 85823377 | + | chr2 | 85823642 | 85823772 | + | ENST00000441634; ENST00000306368; ENST00000414390; ENST00000443647; ENST00000456023 | TSF |
| 2% | chr2 | 114188389 | 114188536 | + | chr2 | 114196597 | 114196619 | + | ENST00000358604 | TSF |
| 2% | chr19 | 3014217 | 3014149 | − | chr19 | 3013816 | 3013667; 3013789 | − | ENST00000262953; ENST00000455444; ENST00000591529; ENST00000443826; ENST00000590536; ENST00000426948; ENST00000591457 | TSF |
| 2% | chr19 | 3014217 | 3014149 | − | chr19 | 3013816 | 3013667; 3013789 | − | ENST00000262953; ENST00000455444; ENST00000591529; ENST00000443826; ENST00000590536; ENST00000426948; ENST00000591457 | TSF |
| 2% | chr19 | 3014217 | 3014149 | − | chr19 | 3013816 | 3013667; 3013789 | − | ENST00000262953; ENST00000455444; ENST00000591529; ENST00000443826; ENST00000590536; ENST00000426948; ENST00000591457 | TSF |
| 2% | chr2 | 86095051 | 86094968 | − | chr2 | 86090608 | 86090485 | − | ENST00000393808; ENST00000377332; ENST00000306262; ENST00000525834 | TSF |
| 2% | chr2 | 86095051 | 86094968 | − | chr2 | 86090608 | 86090485 | − | ENST00000393808; ENST00000377332; ENST00000306262; ENST00000525834 | TSF |
| 2% | chr2 | 86095051 | 86094968 | − | chr2 | 86090608 | 86090485 | − | ENST00000393808; ENST00000377332; ENST00000306262; ENST00000525834 | TSF |
| 2% | chr6 | 32547977 | 32547945 | − | chr6 | 32546881 | 32546868 | − | ENST00000360004 | TSF |
| 2% | chr9 | 128286052 | 128286013 | − | chr9 | 128268696 | 128268589 | − | ENST00000373511; ENST00000373498; ENST00000373503; ENST00000265960; ENST00000394063 | TSF |
| 2% | chr9 | 128286052 | 128286013 | − | chr9 | 128268696 | 128268589 | − | ENST00000373511; ENST00000373498; ENST00000373503; ENST00000265960; ENST00000394063 | TSF |
| 1% | chr20 | 9289042 | 9289105 | + | chr20 | 9317773 | 9317853 | + | ENST00000407043; ENST00000441846; ENST00000334005; | TSF |

TABLE 62-continued

Transcript fusion for Thyroid Cancer (THCA) Coordinates
of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| | | | | | | | | | ENST00000378473; ENST00000437503; ENST00000416836; ENST00000278655; ENST00000414679; ENST00000378493; ENST00000378501 | |
| 1% | chr20 | 9289042 | 9289105 | + | chr20 | 9317773 | 9317853 | + | ENST00000407043; ENST00000441846; ENST00000334005; ENST00000378473; ENST00000437503; ENST00000416836; ENST00000278655; ENST00000414679; ENST00000378493; ENST00000378501 | TSF |
| 1% | chr20 | 9289042 | 9289105 | + | chr20 | 9317773 | 9317853 | + | ENST00000407043; ENST00000441846; ENST00000334005; ENST00000378473; ENST00000437503; ENST00000416836; ENST00000278655; ENST00000414679; ENST00000378493; ENST00000378501 | TSF |
| 1% | chr20 | 9289042 | 9289105 | + | chr20 | 9317773 | 9317853 | + | ENST00000407043; ENST00000441846; ENST00000334005; ENST00000378473; ENST00000437503; ENST00000416836; ENST00000278655; ENST00000414679; ENST00000378493; ENST00000378501 | TSF |
| 1% | chr20 | 9289042 | 9289105 | + | chr20 | 9317773 | 9317853 | + | ENST00000407043; ENST00000441846; ENST00000334005; ENST00000378473; ENST00000437503; ENST00000416836; ENST00000278655; ENST00000414679; ENST00000378493; ENST00000378501 | TSF |
| 1% | chr20 | 9289042 | 9289105 | + | chr20 | 9317773 | 9317853 | + | ENST00000407043; ENST00000441846; ENST00000334005; ENST00000378473; ENST00000437503; ENST00000416836; ENST00000278655; ENST00000414679; ENST00000378493; ENST00000378501 | TSF |
| 1% | chr20 | 9289042 | 9289105 | + | chr20 | 9317773 | 9317853 | + | ENST00000407043; ENST00000441846; ENST00000334005; ENST00000378473; ENST00000437503; ENST00000416836; ENST00000278655; ENST00000414679; ENST00000378493; ENST00000378501 | TSF |
| 1% | chr20 | 57466178 | 57466186 | + | chr20 | 57485409 | 57485456 | + | ENST00000371100; ENST00000371102; ENST00000371095; ENST00000354359; ENST00000371085; ENST00000265620; ENST00000306090 | TSF |
| 1% | chrX | 69366031 | 69366077 | + | chrX | 69366595 | 69366678 | + | ENST00000342206; | TSF |

TABLE 62-continued

Transcript fusion for Thyroid Cancer (THCA) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 1% | chr10 | 134034537 | 134034429 | – | chr10 | 134022605 | 134022598; 134022538 | – | ENST00000356413 ENST00000462160; ENST00000368622; ENST00000298630; ENST00000368625 | TSF |
| 1% | chr10 | 134034537 | 134034429 | – | chr10 | 134022605 | 134022598; 134022538 | – | ENST00000356413 ENST00000462160; ENST00000368622; ENST00000298630; ENST00000368625 | TSF |
| 1% | chr9 | 128287668 | 128287523 | – | chr9 | 128268696 | 128268589 | – | ENST00000373511; ENST00000373498; ENST00000373503; ENST00000265960; ENST00000394063 | TSF |
| 1% | chr9 | 128287668 | 128287523 | – | chr9 | 128268696 | 128268589 | – | ENST00000373511; ENST00000373498; ENST00000373503; ENST00000265960; ENST00000394063 | TSF |
| 1% | chr2 | 216248580 | 216248492 | – | chr2 | 216248206 | 216248051 | – | ENST00000421182; ENST00000323926; ENST00000336916; ENST00000357867; ENST00000354785; ENST00000345488; ENST00000346544; ENST00000357009; ENST00000359671; ENST00000446046; ENST00000443816; ENST00000432072; ENST00000356005; ENST00000456923 | TSF |
| 1% | chr2 | 216248580 | 216248492 | – | chr2 | 216248206 | 216248051 | – | ENST00000421182; ENST00000323926; ENST00000336916; ENST00000357867; ENST00000354785; ENST00000345488; ENST00000346544; ENST00000357009; ENST00000359671; ENST00000446046; ENST00000443816; ENST00000432072; ENST00000356005; ENST00000456923 | TSF |
| 1% | chr2 | 216248580 | 216248492 | – | chr2 | 216248206 | 216248051 | – | ENST00000421182; ENST00000323926; ENST00000336916; ENST00000357867; ENST00000354785; ENST00000345488; ENST00000346544; ENST00000357009; ENST00000359671; ENST00000446046; ENST00000443816; ENST00000432072; ENST00000356005; ENST00000456923 | TSF |
| 1% | chr2 | 216248580 | 216248492 | – | chr2 | 216248206 | 216248051 | – | ENST00000421182; ENST00000323926; ENST00000336916; ENST00000357867; ENST00000354785; ENST00000345488; ENST00000346544; ENST00000357009; ENST00000359671; ENST00000446046; ENST00000443816; ENST00000432072; ENST00000356005; ENST00000456923 | TSF |

TABLE 62-continued

Transcript fusion for Thyroid Cancer (THCA) Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 1% | chr2 | 216248580 | 216248492 | – | chr2 | 216248206 | 216248051 | – | ENST00000421182; ENST00000323926; ENST00000336916; ENST00000357867; ENST00000354785; ENST00000345488; ENST00000346544; ENST00000357009; ENST00000359671; ENST00000446046; ENST00000443816; ENST00000432072; ENST00000356005; ENST00000456923 | TSF |
| 1% | chr2 | 216248580 | 216248492 | – | chr2 | 216248206 | 216248051 | – | ENST00000421182; ENST00000323926; ENST00000336916; ENST00000357867; ENST00000354785; ENST00000345488; ENST00000346544; ENST00000357009; ENST00000359671; ENST00000446046; ENST00000443816; ENST00000432072; ENST00000356005; ENST00000456923 | TSF |
| 1% | chr2 | 216248580 | 216248492 | – | chr2 | 216248206 | 216248051 | – | ENST00000421182; ENST00000323926; ENST00000336916; ENST00000357867; ENST00000354785; ENST00000345488; ENST00000346544; ENST00000357009; ENST00000359671; ENST00000446046; ENST00000443816; ENST00000432072; ENST00000356005; ENST00000456923 | TSF |
| 1% | chr2 | 216248580 | 216248492 | – | chr2 | 216248206 | 216248051 | – | ENST00000421182; ENST00000323926; ENST00000336916; ENST00000357867; ENST00000354785; ENST00000345488; ENST00000346544; ENST00000357009; ENST00000359671; ENST00000446046; ENST00000443816; ENST00000432072; ENST00000356005; ENST00000456923 | TSF |
| 1% | chr2 | 216248580 | 216248492 | – | chr2 | 216248206 | 216248051 | – | ENST00000421182; ENST00000323926; ENST00000336916; ENST00000357867; ENST00000354785; ENST00000345488; ENST00000346544; ENST00000357009; ENST00000359671; ENST00000446046; ENST00000443816; ENST00000432072; ENST00000356005; ENST00000456923 | TSF |
| 1% | chr2 | 216248580 | 216248492 | – | chr2 | 216248206 | 216248051 | – | ENST00000421182; ENST00000323926; ENST00000336916; ENST00000357867; ENST00000354785; | TSF |

TABLE 62-continued

Transcript fusion for Thyroid Cancer (THCA) Coordinates of the fusion sequences for which the donor is the TE.

| 1 | 2' | 3' | 4' | 5' | 6' | 7' | 8' | 9' | 10' | 11' |
|---|----|----|----|----|----|----|----|----|-----|-----|
|   |   |   |   |   |   |   |   |   | ENST00000345488; ENST00000346544; ENST00000357009; ENST00000359671; ENST00000446046; ENST00000443816; ENST00000432072; ENST00000356005; ENST00000456923 | |
| 1% | chr15 | 80424477 | 80425177 | + | chr15 | 80429822 | 80429970; 80429902 | + | ENST00000261749; ENST00000561060; ENST00000559157; ENST00000564367; ENST00000558494; ENST00000559835; ENST00000559775; ENST00000558087 | TSF |
| 1% | chr15 | 80424477 | 80425177 | + | chr15 | 80429822 | 80429970; 80429902 | + | ENST00000261749; ENST00000561060; ENST00000559157; ENST00000564367; ENST00000558494; ENST00000559835; ENST00000559775; ENST00000558087 | TSF |
| 1% | chrX | 130206450 | 130206550 | + | chrX | 130215734 | 130215892 | + | ENST00000276211; ENST00000370922; ENST00000412432 | TSF |
| 1% | chr1 | 1562829 | 1562926 | + | chr1 | 1563053 | 1563209 | + | ENST00000520777; ENST00000357210; ENST00000360522; ENST00000378710; ENST00000355826; ENST00000518681; ENST00000505820; ENST00000487053; ENST00000378712; ENST00000504599; ENST00000378708; ENST00000514234 | TSF |
| 1% | chr1 | 1562829 | 1562926 | + | chr1 | 1563053 | 1563209 | + | ENST00000520777; ENST00000357210; ENST00000360522; ENST00000378710; ENST00000355826; ENST00000518681; ENST00000505820; ENST00000487053; ENST00000378712; ENST00000504599; ENST00000378708; ENST00000514234 | TSF |
| 1% | chr1 | 1562829 | 1562926 | + | chr1 | 1563053 | 1563209 | + | ENST00000520777; ENST00000357210; ENST00000360522; ENST00000378710; ENST00000355826; ENST00000518681; ENST00000505820; ENST00000487053; ENST00000378712; ENST00000504599; ENST00000378708; ENST00000514234 | TSF |
| 1% | chr1 | 58943264 | 58943356 | + | chr11 | 58949212 | 58949935 | + | ENST00000227451 | TSF |
| 1% | chr1 | 1562829 | 1562875 | + | chr1 | 1563053 | 1563209 | + | ENST00000520777; ENST00000357210; ENST00000360522; ENST00000378710; ENST00000355826; ENST00000518681; ENST00000505820; ENST00000487053; ENST00000378712; ENST00000504599; | TSF |

TABLE 62-continued

Transcript fusion for Thyroid Cancer (THCA) Coordinates
of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 1% | chr1 | 1562829 | 1562875 | + | chr1 | 1563053 | 1563209 | + | ENST00000378708; ENST00000514234 ENST00000520777; ENST00000357210; ENST00000360522; ENST00000378710; ENST00000355826; ENST00000518681; ENST00000505820; ENST00000487053; ENST00000378712; ENST00000504599; | TSF |
| 1% | chr1 | 1562829 | 1562875 | + | chr1 | 1563053 | 1563209 | + | ENST00000378708; ENST00000514234 ENST00000520777; ENST00000357210; ENST00000360522; ENST00000378710; ENST00000355826; ENST00000518681; ENST00000505820; ENST00000487053; ENST00000378712; ENST00000504599; ENST00000514234 | TSF |
| 1% | chr7 | 29523499 | 29523591 | + | chr7 | 29535568 | 29535652 | + | ENST00000539406; ENST00000222792; ENST00000495789; ENST00000539389; ENST00000546235; ENST00000446446; ENST00000409041; ENST00000424025; ENST00000421775; ENST00000439711 | TSF |
| 1% | chr7 | 29523499 | 29523591 | + | chr7 | 29535568 | 29535652 | + | ENST00000539406; ENST00000222792; ENST00000495789; ENST00000539389; ENST00000546235; ENST00000446446; ENST00000409041; ENST00000424025; ENST00000421775; ENST00000439711 | TSF |
| 1% | chr7 | 29523499 | 29523591 | + | chr7 | 29535568 | 29535652 | + | ENST00000539406; ENST00000222792; ENST00000495789; ENST00000539389; ENST00000546235; ENST00000446446; ENST00000409041; ENST00000424025; ENST00000421775; ENST00000439711 | TSF |
| 1% | chr7 | 29523499 | 29523591 | + | chr7 | 29535568 | 29535652 | + | ENST00000539406; ENST00000222792; ENST00000495789; ENST00000539389; ENST00000546235; ENST00000446446; ENST00000409041; ENST00000424025; ENST00000421775; ENST00000439711 | TSF |
| 1% | chr7 | 151133708 | 151133690 | − | chr7 | 151133411 | 151133266 | − | ENST00000337323 | TSF |
| 1% | chr20 | 32029125 | 32028924 | − | chr20 | 32026832 | 32026647 | − | ENST00000217381 | TSF |
| 1% | chr6 | 39268199 | 39268149 | − | chr6 | 39267513 | 39267203 | − | ENST00000373231 | TSF |

TABLE 63

Transcript fusion for Thymoma (THYM) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 81% | chr10 | 72538392; 72538389 | 72538313 | − | ENST00000299290; ENST00000456372; ENST00000545575 | chr10 | 72537613 | 72537588 | − | TAF |
| 81% | chr10 | 72538392; 72538389 | 72538313 | − | ENST00000299290; ENST00000456372; ENST00000545575 | chr10 | 72537613 | 72537588 | − | TAF |
| 75% | chr1 | 158326518; 158326554 | 158326682 | + | ENST00000444681; ENST00000368167; ENST00000452291; ENST00000368165; ENST00000368166; ENST00000368163; ENST00000368154; ENST00000368155; ENST00000368156; ENST00000368157; ENST00000368160 | chr1 | 158327113 | 158327284 | + | TAF |
| 75% | chr1 | 158326518; 158326554 | 158326682 | + | ENST00000444681; ENST00000368167; ENST00000452291; ENST00000368165; ENST00000368166; ENST00000368163; ENST00000368154; ENST00000368155; ENST00000368156; ENST00000368157; ENST00000368160 | chr1 | 158327113 | 158327284 | + | TAF |
| 75% | chr1 | 158326518; 158326554 | 158326682 | + | ENST00000444681; ENST00000368167; ENST00000452291; ENST00000368165; ENST00000368166; ENST00000368163; ENST00000368154; ENST00000368155; ENST00000368156; ENST00000368157; ENST00000368160 | chr1 | 158327113 | 158327284 | + | TAF |
| 75% | chr1 | 158326518; 158326554 | 158326682 | + | ENST00000444681; ENST00000368167; ENST00000452291; ENST00000368165; ENST00000368166; ENST00000368163; ENST00000368154; ENST00000368155; ENST00000368156; ENST00000368157; ENST00000368160 | chr1 | 158327113 | 158327284 | + | TAF |
| 75% | chr1 | 158326518; 158326554 | 158326682 | + | ENST00000444681; ENST00000368167; ENST00000452291; ENST00000368165; ENST00000368166; ENST00000368163; ENST00000368154; ENST00000368155; ENST00000368156; ENST00000368157; ENST00000368160 | chr1 | 158327113 | 158327284 | + | TAF |
| 75% | chr1 | 158326518; 158326554 | 158326682 | + | ENST00000444681; ENST00000368167; ENST00000452291; ENST00000368165; ENST00000368166; ENST00000368163; ENST00000368154; ENST00000368155; ENST00000368156; ENST00000368157; ENST00000368160 | chr1 | 158327113 | 158327284 | + | TAF |
| 75% | chr1 | 158326518; 158326554 | 158326682 | + | ENST00000444681; ENST00000368167; ENST00000452291; | chr1 | 158327113 | 158327284 | + | TAF |

TABLE 63-continued

Transcript fusion for Thymoma (THYM) Coordinates
of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 75% | chr1 | 158326518; 158326554 | 158326682 | + | ENST00000368165; ENST00000368166; ENST00000368163; ENST00000368154; ENST00000368155; ENST00000368156; ENST00000368157; ENST00000368160 ENST00000444681; ENST00000368167; ENST00000452291; ENST00000368165; ENST00000368166; ENST00000368163; ENST00000368154; ENST00000368155; ENST00000368156; ENST00000368157; ENST00000368160 | chr1 | 158327113 | 158327284 | + | TAF |
| 75% | chr1 | 158326518; 158326554 | 158326682 | + | ENST00000444681; ENST00000368167; ENST00000452291; ENST00000368165; ENST00000368166; ENST00000368163; ENST00000368154; ENST00000368155; ENST00000368156; ENST00000368157; ENST00000368160 | chr1 | 158327113 | 158327284 | + | TAF |
| 75% | chr1 | 158326518; 158326554 | 158326682 | + | ENST00000444681; ENST00000368167; ENST00000452291; ENST00000368165; ENST00000368166; ENST00000368163; ENST00000368154; ENST00000368155; ENST00000368156; ENST00000368157; ENST00000368160 | chr1 | 158327113 | 158327284 | + | TAF |
| 75% | chr1 | 158326518; 158326554 | 158326682 | + | ENST00000444681; ENST00000368167; ENST00000452291; ENST00000368165; ENST00000368166; ENST00000368163; ENST00000368154; ENST00000368155; ENST00000368156; ENST00000368157; ENST00000368160 | chr1 | 158327113 | 158327284 | + | TAF |
| 68% | chr2 | 87072081 | 87072045 | − | ENST00000393759; ENST00000349455; ENST00000331469; ENST00000390655; ENST00000431506 | chr2 | 87069500 | 87069472 | − | TAF |
| 68% | chr2 | 87072081 | 87072045 | − | ENST00000393759; ENST00000349455; ENST00000331469; ENST00000390655; ENST00000431506 | chr2 | 87069500 | 87069472 | − | TAF |
| 68% | chr2 | 87072081 | 87072045 | − | ENST00000393759; ENST00000349455; ENST00000331469; ENST00000390655; ENST00000431506 | chr2 | 87069500 | 87069472 | − | TAF |
| 68% | chr4 | 108999538 | 108999376 | − | ENST00000265165; ENST00000379951; ENST00000438313; ENST00000510624 | chr4 | 108994190 | 1089941089 | − | TAF |
| 68% | chr4 | 108999538 | 108999376 | − | ENST00000265165; ENST00000379951; ENST00000438313; ENST00000510624 | chr4 | 108994190 | 108994089 | − | TAF |

TABLE 63-continued

Transcript fusion for Thymoma (THYM) Coordinates
of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 68% | chr4 | 108999538 | 108999376 | – | ENST00000265165; ENST00000379951; ENST00000438313; ENST00000510624 | chr4 | 108994190 | 108994089 | – | TAF |
| 62% | chr1 | 209946293 | 209946364 | + | ENST00000400959; ENST00000367025; ENST00000478359; ENST00000367026; ENST00000367024; ENST00000010338 | chr1 | 209948635 | 209948677 | + | TAF |
| 62% | chr1 | 209946293 | 209946364 | + | ENST00000400959; ENST00000367025; ENST00000478359; ENST00000367026; ENST00000367024; ENST00000010338 | chr1 | 209948635 | 209948677 | + | TAF |
| 61% | chr6 | 42890765; 42890883 | 42891085 | + | ENST00000304672; ENST00000441198 | chr6 | 42891625 | 42891704 | + | TAF |
| 61% | chr6 | 42890765; 42890883 | 42891085 | + | ENST00000304672; ENST00000441198 | chr6 | 42891625 | 42891704 | + | TAF |
| 48% | chr22 | 40365415 | 40365537 | + | ENST00000543252; ENST00000344138; ENST00000540310; ENST00000544756; ENST00000399090; ENST00000407075 | chr22 | 40380179 | 40380375 | + | TAF |
| 48% | chr22 | 40365415 | 40365537 | + | ENST00000543252; ENST00000344138; ENST00000540310; ENST00000544756; ENST00000399090; ENST00000407075 | chr22 | 40380179 | 40380375 | + | TAF |
| 48% | chr22 | 40365415 | 40365537 | + | ENST00000543252; ENST00000344138; ENST00000540310; ENST00000544756; ENST00000399090; ENST00000407075 | chr22 | 40380179 | 40380375 | + | TAF |
| 48% | chr22 | 40365415 | 40365537 | + | ENST00000543252; ENST00000344138; ENST00000540310; ENST00000544756; ENST00000399090; ENST00000407075 | chr22 | 40380179 | 40380375 | + | TAF |
| 48% | chr22 | 40365415 | 40365537 | + | ENST00000543252; ENST00000344138; ENST00000540310; ENST00000544756; ENST00000399090; ENST00000407075 | chr22 | 40380179 | 40380375 | + | TAF |
| 42% | chr12 | 71509738 | 71509630 | – | ENST00000549357 | chr12 | 71504233 | 71503634 | – | TAF |
| 35% | chr4 | 1742553 | 1742713 | + | ENST00000313288 | chr4 | 1745122 | 1745307 | + | TAF |
| 35% | chr11 | 118213322 | 118213268 | – | ENST00000300692; ENST00000529594; ENST00000392884 | chr11 | 118212457 | 118212389 | – | TAF |
| 31% | chr17 | 37321392 | 37321332 | – | ENST00000269586; ENST00000444555 | chr17 | 37320542 | 37320482 | – | TAF |
| 31% | chr9 | 15506635 | 15506559 | – | ENST00000380738; ENST00000380733; ENST00000380715; ENST00000380716; ENST00000397519 | chr9 | 15492223 | 15492056 | – | TAF |
| 31% | chr14 | 107083557 | 107083240 | – | ENST00000455737 | chr14 | 107082668 | 107082471 | – | TSF |
| 30% | chr6 | 42883808 | 42883865 | + | ENST00000304672; ENST00000441198; ENST00000446507 | chr6 | 42890333 | 42890502 | + | TSF |
| 29% | chr10 | 15151838 | 15151701 | – | ENST00000378165; ENST00000378150; ENST00000540259; ENST00000535341 | chr10 | 15148697 | 15148684 | – | TAF |
| 29% | chr10 | 15151838 | 15151701 | – | ENST00000378165; ENST00000378150; ENST00000540259; ENST00000535341 | chr10 | 15148697 | 15148684 | – | TAF |
| 29% | chr10 | 15151838 | 15151701 | – | ENST00000378165; | chr10 | 15148697 | 15148684 | – | TAF |

TABLE 63-continued

Transcript fusion for Thymoma (THYM) Coordinates
of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 29% | chr10 | 15151838 | 15151701 | – | ENST00000378150; ENST00000540259; ENST00000535341 ENST00000378165; ENST00000378150; ENST00000540259; ENST00000535341 | chr10 | 15148697 | 15148684 | – | TAF |
| 28% | chr22 | 37868566 | 37868481 | – | ENST00000416983; ENST00000356998 | chr22 | 37865350 | 37865175 | – | TAF |
| 28% | chr22 | 37868566 | 37868481 | – | ENST00000416983; ENST00000356998 | chr22 | 37865350 | 37865175 | – | TAF |
| 28% | chr10 | 120905865 | 120905748 | – | ENST00000355697; ENST00000330036 | chr10 | 120901885 | 120901741 | – | TAF |
| 28% | chr10 | 120905865 | 120905748 | – | ENST00000355697; ENST00000330036 | chr10 | 120901885 | 120901741 | – | TAF |
| 27% | chr19 | 37618030 | 37619808 | + | ENST00000337995 | chr19 | 37621046 | 37621237 | + | TAF |
| 26% | chr5 | 82554349 | 82554496 | + | ENST00000282268; ENST00000338635; ENST00000396027; ENST00000511817 | chr5 | 82606608 | 82606935 | + | TAF |
| 24% | chr15 | 101845560 | 101845467 | – | ENST00000398185; ENST00000348070; ENST00000358417 | chr15 | 101841074 | 101840901 | – | TAF |
| 24% | chr15 | 101845560 | 101845467 | – | ENST00000398185; ENST00000348070; ENST00000358417 | chr15 | 101841074 | 101840901 | – | TAF |
| 24% | chr15 | 101845560 | 101845467 | – | ENST00000398185; ENST00000348070; ENST00000358417 | chr15 | 101841074 | 101840901 | – | TAF |
| 23% | chr19 | 8122688; 8122685 | 8122765 | + | ENST00000253451; ENST00000390669 | chr19 | 8301345 | 8301593 | + | TSF |
| 23% | chr19 | 8122688; 8122685 | 8122765 | + | ENST00000253451; ENST00000390669 | chr19 | 8301345 | 8301593 | + | TSF |
| 22% | chr11 | 428199 | 428088 | | ENST00000332826 | chr11 | 424187 | 423924 | – | TAF |
| 22% | chr6 | 27216879 | 27217008 | + | ENST00000230582; ENST00000470870; ENST00000475106; ENST00000485993 | chr6 | 27217348 | 27217694 | + | TSF |
| 22% | chr6 | 27216879 | 27217008 | + | ENST00000230582; ENST00000470870; ENST00000475106; ENST00000485993 | chr6 | 27217348 | 27217694 | + | TSF |
| 21% | chr19 | 13869914; 13869931; 13869925 | 13870086 | + | ENST00000586600; ENST00000221554; ENST00000586666; ENST00000588809; ENST00000585844 | chr19 | 13872305 | 13872412 | + | TAF |
| 21% | chr19 | 13869914; 13869931; 13869925 | 13870086 | + | ENST00000586600; ENST00000221554; ENST00000586666; ENST00000588809; ENST00000585844 | chr19 | 13872305 | 13872412 | + | TAF |
| 21% | chr19 | 13869914; 13869931; 13869925 | 13870086 | + | ENST00000586600; ENST00000221554; ENST00000586666; ENST00000588809; ENST00000585844 | chr19 | 13872305 | 13872412 | + | TAF |
| 21% | chr19 | 13869914; 13869931; 13869925 | 13870086 | + | ENST00000586600; ENST00000221554; ENST00000586666; ENST00000588809; ENST00000585844 | chr19 | 13872305 | 13872412 | + | TAF |
| 21% | chr9 | 130540906 | 130540870 | – | ENST00000314830 | chr9 | 130540563 | 130540257 | – | TAF |
| 21% | chr5 | 74984990 | 74984837 | – | ENST00000428202; ENST00000514838; ENST00000380475; ENST00000510798; ENST00000446329 | chr5 | 74983153 | 74982863 | – | TAF |
| 21% | chr5 | 74984990 | 74984837 | – | ENST00000428202; ENST00000514838; ENST00000380475; ENST00000510798; ENST00000446329 | chr5 | 74983153 | 74982863 | – | TAF |
| 21% | chr5 | 74984990 | 74984837 | – | ENST00000428202; ENST00000514838; | chr5 | 74983153 | 74982863 | – | TAF |

TABLE 63-continued

Transcript fusion for Thymoma (THYM) Coordinates
of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 21% | chr5 | 74984990 | 74984837 | − | ENST00000380475; ENST00000510798; ENST00000446329 ENST00000428202; ENST00000514838; ENST00000380475; ENST00000510798; ENST00000446329 | chr5 | 74983153 | 74982863 | − | TAF |
| 20% | chr10 | 72538392; 72538389 | 72538313 | − | ENST00000299290; ENST00000456372; ENST00000545575 | chr10 | 72537732 | 72537588 | − | TSF |
| 20% | chr10 | 72538392; 72538389 | 72538313 | − | ENST00000299290; ENST00000456372; ENST00000545575 | chr10 | 72537732 | 72537588 | − | TSF |
| 18% | chr9 | 101984828 | 101984925 | + | ENST00000223641 | chr9 | 101986374 | 101986588 | + | TAF |
| 18% | chr6 | 139363856 | 139363999 | + | ENST00000367660 | chr6 | 139372258 | 139372516 | + | TAF |
| 18% | chr2 | 99786073 | 99786013 | − | ENST00000422537; ENST00000289359; ENST00000409107 | chr2 | 99784175 | 99783867 | − | TAF |
| 18% | chr2 | 99786073 | 99786013 | − | ENST00000422537; ENST00000289359; ENST00000409107 | chr2 | 99784175 | 99783867 | − | TAF |
| 18% | chr2 | 99786073 | 99786013 |  | ENST00000422537; ENST00000289359; ENST00000409107 | chr2 | 199784175 | 199783867 | − | TAF |
| 18% | chr16 | 4409386 | 4409297 | − | ENST00000572467; ENST00000251166; ENST00000539968; ENST00000537233; ENST00000574025; ENST00000576637 | chr16 | 4409070 | 4408945 | − | TAF |
| 18% | chr16 | 4409386 | 4409297 | − | ENST00000572467; ENST00000251166; ENST00000539968; ENST00000537233; ENST00000574025; ENST00000576637 | chr16 | 4409070 | 4408945 | − | TAF |
| 18% | chr16 | 4409386 | 4409297 | − | ENST00000572467; ENST00000251166; ENST00000539968; ENST00000537233; ENST00000574025; ENST00000576637 | chr16 | 4409070 | 4408945 | − | TAF |
| 18% | chr16 | 4409386 | 4409297 | − | ENST00000572467; ENST00000251166; ENST00000539968; ENST00000537233; ENST00000574025; ENST00000576637 | chr16 | 4409070 | 4408945 | − | TAF |
| 18% | chr16 | 4409386 | 4409297 | − | ENST00000572467; ENST00000251166; ENST00000539968; ENST00000537233; ENST00000574025; ENST00000576637 | chr16 | 4409070 | 4408945 | − | TAF |
| 18% | chr17 | 40821639; 40821538 | 40821448 | − | ENST00000591022; ENST00000412503; ENST00000293349 | chr17 | 40820920 | 40820864 | − | TAF |
| 18% | chr17 | 40821639; 40821538 | 40821448 | − | ENST00000591022; ENST00000412503; ENST00000293349 | chr17 | 40820920 | 40820864 | − | TAF |
| 18% | chr17 | 40821639; 40821538 | 40821448 | − | ENST00000591022; ENST00000412503; ENST00000293349 | chr17 | 40820920 | 40820864 | − | TAF |
| 18% | chr2 | 87135092 | 87135139 | + | ENST00000409776 | chr2 | 87137322 | 87137378 | + | TSF |
| 16% | chr19 | 50984141 | 50984234 | + | ENST00000334976; ENST00000376918; ENST00000598585 | chr19 | 51009025 | 51009080 | + | TAF |
| 16% | chr14 | 45590157 | 45590090 | − | ENST00000396062; ENST00000216330 | chr14 | 45588212 | 455188057 | − | TAF |
| 16% | chr4 | 103522052 | 103522166 | + | ENST00000226574; ENST00000394820; ENST00000505458; ENST00000600343 | chr4 | 103522776 | 103522846 | + | TSF |
| 16% | chr4 | 103522052 | 103522166 | + | ENST00000226574; | chr4 | 103522776 | 103522846 | + | TSF |

TABLE 63-continued

Transcript fusion for Thymoma (THYM) Coordinates
of the fusion sequences for which the donor is the exon.

| 1 | 2 | 3 | 4 | 5 | 6 | 7 | 8 | 9 | 10 | 11 |
|---|---|---|---|---|---|---|---|---|----|----|
| 16% | chr4 | 103522052 | 103522166 | + | ENST00000394820; ENST00000505458; ENST00000600343 ENST00000226574; ENST00000394820; ENST00000505458; ENST00000600343 | chr4 | 103522776 | 103522846 | + | TSF |
| 15% | chr17 | 7130588 | 7130409 | − | ENST00000005340; ENST00000575458; ENST00000575086 | chr17 | 7130277 | 7130132 | − | TAF |
| 15% | chr17 | 7130588 | 7130409 | − | ENST00000005340; ENST00000575458; ENST00000575086 | chr17 | 7130277 | 7130132 | − | TAF |
| 15% | chr17 | 7130588 | 7130409 | − | ENST00000005340; ENST00000575458; ENST00000575086 | chr17 | 7130277 | 7130132 | − | TAF |
| 15% | chr2 | 87135092 | 87135139 | + | ENST00000409776 | chr2 | 87147014 | 87147070 | + | TSF |
| 15% | chr2 | 87144754 | 87144801 | + | ENST00000559485 | chr2 | 87147014 | 87147070 | + | TSF |
| 15% | chr10 | 72541792 | 72541557 | − | ENST00000299290; ENST00000456372; ENST00000545575 | chr10 | 72537613 | 72537588 | − | TSF |
| 15% | chr10 | 72541792 | 72541557 | − | ENST00000299290; ENST00000456372; ENST00000545575 | chr10 | 72537613 | 72537588 | − | TSF |
| 13% | chr19 | 3544937 | 3544807 | − | ENST00000389395; ENST00000398558; ENST00000588918; ENST00000355415; ENST00000589063 | chr19 | 3538708 | 3538306 | − | TAF |
| 13% | chr19 | 3544937 | 3544807 | − | ENST00000389395; ENST00000398558; ENST00000588918; ENST00000355415; ENST00000589063 | chr19 | 3538708 | 3538306 | − | TAF |
| 13% | chr19 | 3544937 | 3544807 | − | ENST00000389395; ENST00000398558; ENST00000588918; ENST00000355415; ENST00000589063 | chr19 | 3538708 | 3538306 | − | TAF |
| 12% | chr2 | 42924916 | 42924974 | + | ENST00000405592; ENST00000406652; ENST00000407270; ENST00000454356; ENST00000406911; ENST00000409019; ENST00000405094 | chr2 | 42925555 | 42925601 | + | TAF |
| 12% | chr2 | 42924916 | 42924974 | + | ENST00000405592; ENST00000406652; ENST00000407270; ENST00000454356; ENST00000406911; ENST00000409019; ENST00000405094 | chr2 | 42925555 | 42925601 | + | TAF |
| 12% | chr8 | 27516013 | 27517056 | + | ENST00000337221; ENST00000301904 | chr8 | 27555709 | 27555926 | + | TAF |
| 12% | chr6 | 10749855; 10749898 | 10749931 | + | ENST00000379542; ENST00000473166; ENST00000463448; ENST00000460341; ENST00000480294; ENST00000473807; ENST00000461342; ENST00000475942; ENST00000379530; ENST00000463100; ENST00000481240; ENST00000467317; ENST00000478732 | chr6 | 10829240 | 10829256 | + | TAF |
| 12% | chr6 | 10749855; 10749898 | 10749931 | + | ENST00000379542; ENST00000473166; ENST00000463448; ENST00000460341; ENST00000480294; ENST00000473807; ENST00000461342; | chr6 | 10829240 | 10829256 | + | TAF |

TABLE 63-continued

Transcript fusion for Thymoma (THYM) Coordinates
of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 12% | chr4 | 108999538 | 108999376 | – | ENST00000475942; ENST00000379530; ENST00000463100; ENST00000481240; ENST00000467317; ENST00000478732 ENST00000265165; ENST00000379951; ENST00000438313; ENST00000510624 | chr4 | 108994185 | 108994089 | – | TSF |
| 12% | chr4 | 108999538 | 108999376 | – | ENST00000265165; ENST00000379951; ENST00000438313; ENST00000510624 | chr4 | 108994185 | 108994089 | – | TSF |
| 12% | chr4 | 108999538 | 108999376 | – | ENST00000265165; ENST00000379951; ENST00000438313; ENST00000510624 | chr4 | 108994185 | 108994089 | – | TSF |
| 12% | chr2 | 88285293 | 88285246 | – | ENST00000420840 | chr2 | 88283035 | 88282979 | – | TSF |
| 11% | chr18 | 12831040; 12831004 | 12830942 | – | ENST00000327283; ENST00000591115; ENST00000353319; ENST00000587703; ENST00000309660; ENST00000591497; ENST00000592776; ENST00000592059 | chr18 | 12827677 | 12827395 | – | TAF |
| 11% | chr18 | 12831040; 12831004 | 12830942 | – | ENST00000327283; ENST00000591115; ENST00000353319; ENST00000587703; ENST00000309660; ENST00000591497; ENST00000592776; ENST00000592059 | chr18 | 12827677 | 12827395 | – | TAF |
| 11% | chr18 | 12831040; 12831004 | 12830942 | – | ENST00000327283; ENST00000591115; ENST00000353319; ENST00000587703; ENST00000309660; ENST00000591497; ENST00000592776; ENST00000592059 | chr18 | 12827677 | 12827395 | – | TAF |
| 11% | chr18 | 12831040; 12831004 | 12830942 | – | ENST00000327283; ENST00000591115; ENST00000353319; ENST00000587703; ENST00000309660; ENST00000591497; ENST00000592776; ENST00000592059 | chr18 | 12827677 | 12827395 | – | TAF |
| 11% | chr1 | 32560385 | 32560572 | + | ENST00000336294; ENST00000373634; ENST00000427288 | chr1 | 32561261 | 32561358 | + | TSF |
| 11% | chr1 | 32560385 | 32560572 | + | ENST00000336294; ENST00000373634; ENST00000427288 | chr1 | 32561261 | 32561358 | + | TSF |
| 11% | chr1 | 32560385 | 32560572 | + | ENST00000336294; ENST00000373634; ENST00000427288 | chr1 | 32561261 | 32561358 | + | TSF |
| 10% | chr20 | 49458303 | 49458437 | + | ENST00000358791; ENST00000371608; ENST00000609336 | chr20 | 49468479 | 49468517 | + | TSF |
| 10% | chr20 | 49458303 | 49458437 | + | ENST00000358791; ENST00000371608; ENST00000609336 | chr20 | 49468479 | 49468517 | + | TSF |
| 10% | chr10 | 72539498 | 72539349 | – | ENST00000299290; ENST00000456372; ENST00000545575 | chr10 | 72537613 | 72537588 | – | TSF |
| 10% | chr10 | 72539498 | 72539349 | – | ENST00000299290; ENST00000456372; ENST00000545575 | chr10 | 72537613 | 72537588 | – | TSF |
| 8% | chr10 | 98095651; 98095648 | 98095731 | + | ENST00000419175; ENST00000371174 | chr10 | 98115406 | 98115502 | + | TSF |
| 8% | chr10 | 98095651; | 98095731 | + | ENST00000419175; | chr10 | 98115406 | 98115502 | + | TSF |

TABLE 63-continued

Transcript fusion for Thymoma (THYM) Coordinates
of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 8% | chr10 | 98095648 72538392; 72538389 | 72538313 | − | ENST00000371174 ENST00000299290; ENST00000456372; ENST00000545575 | chr10 | 72537677 | 72537588 | − | TSF |
| 8% | chr10 | 72538392; 72538389 | 72538313 | − | ENST00000299290; ENST00000456372; ENST00000545575 | chr10 | 72537677 | 72537588 | − | TSF |
| 7% | chr6 | 42883808 | 42883865 | + | ENST00000304672; ENST00000441198; ENST00000446507 | chr6 | 42891625 | 428191704 | + | TSF |
| 7% | chr2 | 112601176 | 112600989 | − | ENST00000427997; ENST00000341068 | chr2 | 112598811 | 112598755 | − | TSF |
| 7% | chr2 | 112601176 | 112600989 | − | ENST00000427997; ENST00000341068 | chr2 | 112598811 | 1125981755 | − | TSF |
| 6% | chr2 | 112636548 | 112636387 | − | ENST00000341068; ENST00000451367 | chr2 | 112635895 | 112635435 | − | TSF |
| 6% | chr10 | 72541792 | 72541557 | − | ENST00000299290; ENST00000456372; ENST00000545575 | chr10 | 72539689 | 72539621 | − | TSF |
| 6% | chr10 | 72541792 | 72541557 | − | ENST00000299290; ENST00000456372; ENST00000545575 | chr10 | 72539689 | 72539621 | − | TSF |
| 6% | chr16 | 2825557; 2825626 | 2825452 | − | ENST00000262306; ENST00000409906; ENST00000409477; ENST00000494946 | chr16 | 2823822 | 2823809 | − | TSF |
| 6% | chr16 | 2825557; 2825626 | 2825452 | − | ENST00000262306; ENST00000409906; ENST00000409477; ENST00000494946 | chr16 | 2823822 | 2823809 | − | TSF |
| 6% | chr16 | 2825557; 2825626 | 2825452 | − | ENST00000262306; ENST00000409906; ENST00000409477; ENST00000494946 | chr16 | 2823822 | 2823809 | − | TSF |
| 6% | chr3 | 138289340 | 138289160 | − | ENST00000264982; ENST00000542237; ENST00000484888; ENST00000474781; ENST00000481834; ENST00000468900; ENST00000462419; ENST00000464035 | chr3 | 138261631 | 138260784 | − | TSF |
| 6% | chr3 | 138289340 | 138289160 | − | ENST00000264982; ENST00000542237; ENST00000484888; ENST00000474781; ENST00000481834; ENST00000468900; ENST00000462419; ENST00000464035 | chr3 | 138261631 | 138260784 | − | TSF |
| 6% | chr3 | 138289340 | 138289601 | − | ENST00000264982; ENST00000542237; ENST00000484888; ENST00000474781; ENST00000481834; ENST00000468900; ENST00000462419; ENST00000464035 | chr3 | 138261631 | 138260784 | − | TSF |
| 6% | chr3 | 138289340 | 138289160 | − | ENST00000264982; ENST00000542237; ENST00000484888; ENST00000474781; ENST00000481834; ENST00000468900; ENST00000462419; ENST00000464035 | chr3 | 138261631 | 138260784 | − | TSF |
| 5% | chr22 | 35819207 | 35819334 | + | ENST00000216122; ENST00000382011 | chr22 | 35822985 | 35823438 | + | TSF |
| 5% | chr22 | 35819207 | 35819334 | + | ENST00000216122; ENST00000382011 | chr22 | 35822985 | 35823438 | + | TSF |
| 5% | chr6 | 27220587 | 27220728 | + | ENST00000421826; ENST00000230582; ENST00000475106; ENST00000485993 | chr6 | 27221559 | 27221657 | + | TSF |
| 5% | chr6 | 27220587 | 27220728 | + | ENST00000421826; | chr6 | 27221559 | 27221657 | + | TSF |

TABLE 63-continued

Transcript fusion for Thymoma (THYM) Coordinates
of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 5% | chr6 | 27220587 | 2722028 | + | ENST00000230582; ENST00000475106; ENST00000485993 ENST00000421826; ENST00000230582; ENST00000475106; ENST00000485993 | chr6 | 27221559 | 27221657 | + | TSF |
| 5% | chr6 | 27220587 | 2722028 | + | ENST00000421826; ENST00000230582; ENST00000475106; ENST00000485993 | chr6 | 27221559 | 27221657 | + | TSF |
| 5% | chr8 | 624047; 623326; 623657 | 623289 | – | ENST00000522706; ENST00000523415; ENST00000262109; ENST00000522893 | chr8 | 622204 | 621954 | – | TSF |
| 5% | chr8 | 624047; 623326; 623657 | 623289 | – | ENST00000522706; ENST00000523415; ENST00000262109; ENST00000522893 | chr8 | 622204 | 621954 | – | TSF |
| 5% | chr8 | 624047; 623326; 623657 | 623289 | – | ENST00000522706; ENST00000523415; ENST00000262109; ENST00000522893 | chr8 | 622204 | 621954 | – | TSF |
| 5% | chr8 | 624047; 623326; 623657 | 623289 | – | ENST00000522706; ENST00000523415; ENST00000262109; ENST00000522893 | chr8 | 622204 | 621954 | – | TSF |

TABLE 64

Transcript fusion for Thymoma (THYM)
Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 71% | chr6 | 42890506 | 42890547 | + | chr6 | 42890765 | 42891085 | + | ENST00000304672 | TAF |
| 71% | chr12 | 55350849 | 55350538 | – | chr12 | 55344174 | 55343992; 55344114 | – | ENST00000528240; ENST00000532757 | TAF |
| 71% | chr12 | 55350849 | 55350538 | – | chr12 | 55344174 | 55343992; 55344114 | – | ENST00000528240; ENST00000532757 | TAF |
| 62% | chr17 | 54888692 | 54888652 | – | chr17 | 54872541 | 54872425 | – | ENST00000397861; ENST00000397862; | TAF |
| 61% | chr11 | 17888603 | 17888338 | – | chr11 | 17809960 | 17809632; 17809702 | – | ENST00000575658 ENST00000265965; ENST00000529151 | TAF |
| 61% | chr11 | 17888603 | 17888338 | – | chr11 | 17809960 | 17809632; 17809702 | – | ENST00000265965; ENST00000529151 | TAF |
| 54% | chr15 | 99816054 | 99816395 | + | chr15 | 99881167 | 99816821 | + | ENST00000301981; ENST00000561253; ENST00000422500; ENST00000442993; ENST00000447360; ENST00000561276; ENST00000331450; ENST00000558861 | TAF |
| 54% | chr15 | 99816054 | 99816395 | + | chr15 | 99816781 | 99816821 | + | ENST00000301981; ENST00000561253; ENST00000422500; ENST00000442993; ENST00000447360; ENST00000561276; ENST00000331450; ENST00000558861 | TAF |
| 54% | chr15 | 99816054 | 99816395 | + | chr15 | 99816781 | 99816821 | + | ENST00000301981; ENST00000561253; ENST00000422500; ENST00000442993; ENST00000447360; ENST00000561276; ENST00000331450; ENST00000558861 | TAF |
| 54% | chr15 | 99816054 | 99816395 | + | chr15 | 99816781 | 99816821 | + | ENST00000301981; ENST00000561253; ENST00000422500; ENST00000442993; ENST00000447360; ENST00000561276; ENST00000331450; ENST00000558861 | TAF |
| 54% | chr15 | 99816054 | 99816395 | + | chr15 | 99816781 | 99816821 | + | ENST00000301981; ENST00000561253; ENST00000422500; ENST00000442993; ENST00000447360; ENST00000561276; ENST00000331450; ENST00000558861 | TAF |
| 54% | chr15 | 99816054 | 99816395 | + | chr15 | 99816781 | 99816821 | + | ENST00000301981; ENST00000561253; ENST00000422500; ENST00000442993; ENST00000447360; ENST00000561276; ENST00000331450; ENST00000558861 | TAF |
| 54% | chr15 | 99816054 | 99816395 | + | chr15 | 99816781 | 99816821 | + | ENST00000301981; ENST00000561253; ENST00000422500; ENST00000442993; ENST00000447360; ENST00000561276; | TAF |

TABLE 64-continued

Transcript fusion for Thymoma (THYM)
Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 54% | chr15 | 99816054 | 99816395 | + | chr15 | 99816781 | 99816821 | + | ENST00000331450; ENST00000558861 ENST00000301981; ENST00000561253; ENST00000422500; ENST00000442993; ENST00000447360; ENST00000561276; ENST00000331450; ENST00000558861 | TAF |
| 53% | chr17 | 37319504 | 37319411 | – | chr17 | 37319111 | 37318964 | – | ENST00000269586; ENST00000444555 | TAF |
| 52% | chr4 | 8231126 | 8231139 | + | chr4 | 8233703 | 8233883 | + | ENST00000245105; ENST00000539824; ENST00000511002 | TAF |
| 52% | chr4 | 8231126 | 8231139 | + | chr4 | 8233703 | 8233883 | + | ENST00000245105; ENST00000539824; ENST00000511002 | TAF |
| 52% | chr9 | 100740768 | 100740868 | + | chr9 | 100756913 | 100757062 | + | ENST00000339399 | TAF |
| 45% | chr11 | 118220011 | 118220037 | + | chr11 | 118220458 | 118220685 | + | ENST00000532917 | TAF |
| 45% | chr1 | 49197473 | 49197246 | – | chr1 | 49193715 | 49193558 | – | ENST00000371833 | TAF |
| 42% | chr6 | 26474324 | 26474624 | + | chr6 | 26475389 | 26476396 | + | ENST00000480218 | TAF |
| 42% | chr6 | 27221686 | 27221989 | + | chr6 | 27222472 | 27222651; 27222534; 27222478 | + | ENST00000421826; ENST00000230582; ENST00000466364; ENST00000475106; ENST00000485993 | TSF |
| 42% | chr6 | 27221686 | 27221989 | + | chr6 | 27222472 | 27222651; 27222534; 27222478 | + | ENST00000421826; ENST00000230582; ENST00000466364; ENST00000475106; ENST00000485993 | TSF |
| 42% | chr6 | 27221686 | 27221989 | + | chr6 | 27222472 | 27222651; 27222534; 27222478 | + | ENST00000421826; ENST00000230582; ENST00000466364; ENST00000475106; ENST00000485993 | TSF |
| 40% | chr16 | 68401373 | 68401247 | – | chr16 | 68398995 | 68398920 | – | ENST00000219334; ENST00000574662; ENST00000568373; ENST00000563226 | TAF |
| 40% | chr16 | 68401373 | 68401247 | – | chr16 | 68398995 | 68398920 | – | ENST00000219334; ENST00000574662; ENST00000568373; ENST00000563226 | TAF |
| 40% | chr16 | 68401373 | 68401247 | – | chr16 | 68398995 | 68398920 | – | ENST00000219334; ENST00000574662; ENST00000568373; ENST00000563226 | TAF |
| 40% | chr16 | 68401373 | 68401247 | – | chr16 | 68398995 | 68398920 | – | ENST00000219334; ENST00000574662; ENST00000568373; ENST00000563226 | TAF |
| 38% | chr17 | 79214190 | 79214239 | + | chr17 | 79214787 | 79214816; 79214953 | + | ENST00000431388; ENST00000576002 | TAF |
| 38% | chr17 | 79214190 | 79214239 | + | chr17 | 179214787 | 79214816; 79214953 | + | ENST00000431388; ENST00000576002 | TAF |
| 38% | chr17 | 80866189 | 80866313 | + | chr17 | 80867161 | 80867183 | + | ENST00000355528; ENST00000539345; ENST00000576160; ENST00000571712; ENST00000576996; ENST00000571316; ENST00000576760; ENST00000572984; ENST00000574975; ENST00000572953; ENST00000574422 | TAF |
| 38% | chr17 | 80866189 | 80866313 | + | chr17 | 80867161 | 80867183 | + | ENST00000355528; ENST00000539345; ENST00000576160; ENST00000571712; ENST00000576996; ENST00000571316; ENST00000576760; ENST00000572984; ENST00000574975; ENST00000572953; ENST00000574422 | TAF |
| 38% | chr17 | 80866189 | 80866313 | + | chr17 | 80867161 | 80867183 | + | ENST00000355528; ENST00000539345; ENST00000576160; ENST00000571712; ENST00000576996; ENST00000571316; ENST00000576760; ENST00000572984; ENST00000574975; ENST00000572953; ENST00000574422 | TAF |
| 38% | chr17 | 80866189 | 80866313 | + | chr17 | 80867161 | 80867183 | + | ENST00000355528; ENST00000539345; ENST00000576160; ENST00000571712; ENST00000576996; ENST00000571316; ENST00000576760; ENST00000572984; ENST00000574975; ENST00000572953; ENST00000574422 | TAF |
| 38% | chr17 | 80866189 | 80866313 | + | chr17 | 80867161 | 80867183 | + | ENST00000355528; ENST00000539345; ENST00000576160; ENST00000571712; ENST00000576996; ENST00000571316; ENST00000576760; ENST00000572984; ENST00000574975; ENST00000572953; ENST00000574422 | TAF |
| 38% | chr17 | 80866189 | 80866313 | + | chr17 | 80867161 | 80867183 | + | ENST00000355528; ENST00000539345; ENST00000576160; ENST00000571712; ENST00000576996; ENST00000571316; ENST00000576760; ENST00000572984; ENST00000574975; ENST00000572953; ENST00000574422 | TAF |
| 38% | chr17 | 80866189 | 80866313 | + | chr17 | 80867161 | 80867183 | + | ENST00000355528; ENST00000539345; ENST00000576160; ENST00000571712; ENST00000576996; ENST00000571316; ENST00000576760; ENST00000572984; | TAF |

TABLE 64-continued

Transcript fusion for Thymoma (THYM)
Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 38% | chr17 | 80866189 | 80866313 | + | chr17 | 80867161 | 80867183 | + | ENST00000574975; ENST00000572953; ENST00000574422 ENST00000355528; ENST00000539345; ENST00000576160; ENST00000571712; ENST00000576996; ENST00000571316; ENST00000576760; ENST00000572984; ENST00000574975; ENST00000572953; ENST00000574422 | TAF |
| 38% | chr17 | 80866189 | 80866313 | + | chr17 | 80867161 | 80867183 | + | ENST00000355528; ENST00000539345; ENST00000576160; ENST00000571712; ENST00000576996; ENST00000571316; ENST00000576760; ENST00000572984; ENST00000574975; ENST00000572953; ENST00000574422 | TAF |
| 38% | chr17 | 80866189 | 80866313 | + | chr17 | 80867161 | 80867183 | + | ENST00000355528; ENST00000539345; ENST00000576160; ENST00000571712; ENST00000576996; ENST00000571316; ENST00000576760; ENST00000572984; ENST00000574975; ENST00000572953; ENST00000574422 | TAF |
| 38% | chr17 | 80866189 | 80866313 | + | chr17 | 80867161 | 80867183 | + | ENST00000355528; ENST00000539345; ENST00000576160; ENST00000571712; ENST00000576996; ENST00000571316; ENST00000576760; ENST00000572984; ENST00000574975; ENST00000572953; ENST00000574422 | TAF |
| 38% | chr12 | 6602868 | 6602840 | − | chr12 | 6602138 | 6602028 | − | ENST00000229238 | TAF |
| 38% | chr10 | 102260069 | 221059867 | − | chr10 | 102259355 | 102259281 | − | ENST00000370345 | TAF |
| 34% | chr11 | 424193 | 423942 | − | chr11 | 421198 | 421141 | − | ENST00000332826 | TAF |
| 31% | chr19 | 54631006 | 54631115 | + | chr19 | 54631448 | 54631575 | + | ENST00000321030; ENST00000419967 | TAF |
| 31% | chr19 | 54631006 | 54631115 | + | chr19 | 54631448 | 54631575 | + | ENST00000321030; ENST00000419967 | TAF |
| 30% | chr19 | 11555143 | 11555219 | + | chr19 | 11556204 | 11556288 | + | ENST00000591462; ENST00000252455; ENST00000412601; ENST00000592741; ENST00000587327; ENST00000589838 | TAF |
| 30% | chr19 | 11555143 | 11555219 | + | chr19 | 11556204 | 11556288 | + | ENST00000591462; ENST00000252455; ENST00000412601; ENST00000592741; ENST00000587327; ENST00000589838 | TAF |
| 30% | chr19 | 11555143 | 11555219 | + | chr19 | 11556204 | 11556288 | + | ENST00000591462; ENST00000252455; ENST00000412601; ENST00000592741; ENST00000587327; ENST00000589838 | TAF |
| 30% | chr12 | 51681734 | 51681668 | − | chr12 | 51678571 | 51678500 | − | ENST00000452142; ENST00000267012; ENST00000544402 | TAF |
| 30% | chr19 | 49121994 | 49121817 | − | chr19 | 49121134 | 49121048 | − | ENST00000549920; ENST00000547897; ENST00000084795; ENST00000550645; ENST00000549370; ENST00000549273 | TAF |
| 30% | chr19 | 49121994 | 49121817 | − | chr19 | 49121134 | 49121048 | − | ENST00000549920; ENST00000547897; ENST00000084795; ENST00000550645; ENST00000549370; ENST00000549273 | TAF |
| 30% | chr19 | 49121994 | 49121817 | − | chr19 | 49121134 | 49121048 | − | ENST00000549920; ENST00000547897; ENST00000084795; ENST00000550645; ENST00000549370; ENST00000549273 | TAF |
| 30% | chr19 | 49121994 | 49121817 | − | chr19 | 49121134 | 49121048 | − | ENST00000549920; ENST00000547897; ENST00000084795; ENST00000550645; ENST00000549370; ENST00000549273 | TAF |
| 30% | chr19 | 49121994 | 49121817 | − | chr19 | 49121134 | 49121048 | − | ENST00000549920; ENST00000547897; ENST00000084795; ENST00000550645; ENST00000549370; ENST00000549273 | TAF |
| 29% | chr6 | 42890506 | 42890547 | + | chr 6 | 42890883 | 42891085 | + | ENST00000304672; ENST00000441198 | TSF |
| 28% | chr10 | 26814247 | 268114408 | + | chr10 | 26822368 | 26822454 | + | ENST00000376236 | TAF |
| 28% | chr17 | 40820773 | 40820708 | − | chr17 | 40820321 | 40820145 | − | ENST00000591022; ENST00000412503; ENST00000293349 | TAF |
| 28% | chr1 | 169819657 | 169819707 | + | chr1 | 169820958 | 169821077 | + | ENST00000359326; ENST00000286031 | TSF |
| 28% | chr | 161637963 | 161637691 | − | chr6 | 161587449 | 161587280; 161587148 | − | ENST00000320285; ENST00000366908; ENST00000436279; ENST00000366905 | TSF |
| 28% | chr6 | 161637963 | 161637691 | − | chr6 | 161587449 | 161587280; 161587148 | | ENST00000320285; ENST00000366908; ENST00000436279; ENST00000366905 | TSF |
| 28% | chr6 | 161637963 | 161637691 | − | chr6 | 161587449 | 161587280; 161587148 | − | ENST00000320285; ENST00000366908; ENST00000436279; ENST00000366905 | TSF |
| 27% | chr16 | 718049 | 718154 | + | chr16 | 718352 | 718411 | + | ENST00000315082; ENST00000561983; ENST00000563134; ENST00000563637; ENST00000570280; ENST00000562333; ENST00000561929 | TAF |
| 27% | chr16 | 718049 | 718154 | + | chr16 | 718353 | 718411 | + | ENST00000315082; ENST00000561983; ENST00000563134; ENST00000563637; ENST00000570280; ENST00000562333; | TAF |

TABLE 64-continued

Transcript fusion for Thymoma (THYM)
Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 27% | chr16 | 718049 | 718154 | + | chr16 | 718353 | 718411 | + | ENST00000561929 ENST00000315082; ENST00000561983; ENST00000563134; ENST00000563637; ENST00000570280; ENST00000562333; ENST00000561929 | TAF |
| 27% | chr16 | 718049 | 718154 | + | chr16 | 718353 | 718411 | + | ENST00000315082; ENST00000561983; ENST00000563134; ENST00000563637; ENST00000570280; ENST00000562333; ENST00000561929 | TAF |
| 27% | chr16 | 718049 | 718154 | + | chr16 | 718353 | 718411 | + | ENST00000315082; ENST00000561983; ENST00000563134; ENST00000563637; ENST00000570280; ENST00000562333; ENST00000561929 | TAF |
| 27% | chr16 | 718049 | 718154 | + | chr16 | 718353 | 718411 | + | ENST00000315082; ENST00000561983; ENST00000563134; ENST00000563637; ENST00000570280; ENST00000562333; ENST00000561929 | TAF |
| 27% | chr10 | 120902016 | 12001765 | − | chr10 | 120900831 | 120900754 | − | ENST00000355697; ENST00000330036 | TAF |
| 25% | chr19 | 4294350 | 4294283 | − | chr19 | 4292882 | 4292596 | − | ENST00000595645; ENST00000301272; ENST00000600114; ENST00000600349 | TAF |
| 25% | chr10 | 72537735 | 72537648 | − | chr10 | 72537091 | 72536909 | − | ENST00000299290; ENST00000456372 | TAF |
| 25% | chr10 | 72537735 | 72537648 | − | chr10 | 72537091 | 72536909 | − | ENST00000299290; ENST00000456372 | TAF |
| 23% | chr5 | 176950016 | 176949956 | − | chr5 | 176949072 | 176948976 | − | ENST00000514747; ENST00000329540; ENST00000443375; ENST00000524677 | TAF |
| 22% | chr19 | 41816860 | 41816920 | + | chr19 | 41822289 | 41822744 | + | ENST00000269967 | TAF |
| 22% | chr4 | 107241932 | 107242850 | + | chr4 | 107246142 | 107246275 | + | ENST00000394701 | TAF |
| 22% | chr8 | 17873227 | 17873340 | + | chr8 | 17882870 | 17882962 | + | ENST00000325083; ENST00000519253; ENST00000524226; ENST00000327578; ENST00000522275 | TAF |
| 22% | chr4 | 154533967 | 154534548 | + | chr4 | 154541908 | 154542032 | + | ENST00000440693; ENST00000409663; ENST00000409959; ENST00000240487 | TAF |
| 21% | chr11 | 64508144 | 64507840 | − | chr11 | 64507635 | 64507485 | − | ENST00000377494; ENST00000394432; ENST00000377497; ENST00000354024; ENST00000431822 | TAF |
| 21% | chr11 | 64508144 | 64507840 | − | chr11 | 64507635 | 64507485 | − | ENST00000377494; ENST00000394432; ENST00000377497; ENST00000354024; ENST00000431822 | TAF |
| 21% | chr11 | 64508144 | 64507840 | − | chr11 | 64507635 | 64507485 | − | ENST00000377494; ENST00000394432; ENST00000377497; ENST00000354024; ENST00000431822 | TAF |
| 21% | chr2 | 87076138 | 87075916 | − | chr2 | 87073896 | 87073807 | − | ENST00000393759; ENST00000331469; ENST00000390655 | TAF |
| 21% | chr2 | 87076138 | 87075916 | − | chr2 | 87073896 | 87073807 | − | ENST00000393759; ENST00000331469; ENST00000390655 | TAF |
| 21% | chr2 | 87076138 | 87075916 | − | chr2 | 87073896 | 87073807 | − | ENST00000393759; ENST00000331469; ENST00000390655 | TAF |
| 20% | chr9 | 130569975 | 130570054 | + | chr9 | 130570513 | 130570590; 130570580 | + | ENST00000373247; ENST00000373245; ENST00000393706; ENST00000373228; ENST00000373225; ENST00000431857; ENST00000423577 | TAF |
| 20% | chr9 | 130569975 | 130570054 | + | chr9 | 130570513 | 130570590; 130570580 | + | ENST00000373247; ENST00000373245; ENST00000393706; ENST00000373228; ENST00000373225; ENST00000431857; ENST00000423577 | TAF |
| 20% | chr9 | 130569975 | 130570054 | + | chr9 | 130570513 | 130570590; 130570580 | + | ENST00000373247; ENST00000373245; ENST00000393706; ENST00000373228; ENST00000373225; ENST00000431857; ENST00000423577 | TAF |
| 20% | chr9 | 130569975 | 130570054 | + | chr9 | 130570513 | 130570590; 130570580 | + | ENST00000373247; ENST00000373245; ENST00000393706; ENST00000373228; ENST00000373225; ENST00000431857; ENST00000423577 | TAF |
| 20% | chr17 | 79649571 | 79649473 | − | chr17 | 179649179 | 79649064 | − | ENST00000397498; ENST00000570561; ENST00000576135 | TAF |
| 20% | chr5 | 176950300 | 176950160 | − | chr5 | 176949072 | 176948976 | − | ENST00000514747; ENST00000329540; ENST00000443375; ENST00000524677 | TAF |
| 20% | chr19 | 4294350 | 4294301 | − | chr19 | 4292882 | 4292596 | − | ENST00000595645; ENST00000301272; ENST00000600114; ENST00000600349 | TSF |
| 19% | chr6 | 42890125 | 42890148 | + | chr6 | 42890765 | 42891085 | + | ENST00000304672 | TAF |
| 19% | chr1 | 167417583 | 167417580 | − | chr1 | 167410004 | 167409901 | − | ENST00000362089; ENST00000392122 | TAF |
| 19% | chr1 | 167417583 | 167417580 | − | chr1 | 167410004 | 167409901 | − | ENST00000362089; ENST00000392122 | TAF |
| 19% | chr10 | 121275965 | 121275814 | − | chr10 | 121275164 | 121275021 | − | ENST00000392865; ENST00000369101; ENST00000369103 | TAF |
| 18% | chrX | 48793481 | 48793462 | − | chrX | 48792291 | 48792227 | − | ENST00000396743; ENST00000455452; ENST00000156084; ENST00000376488; | TAF |

TABLE 64-continued

Transcript fusion for Thymoma (THYM)
Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 18% | chrX | 48793481 | 48793462 | − | chrX | 48792291 | 48792227 | − | ENST00000428668 ENST00000396743; ENST00000455452; ENST00000156084; ENST00000376488; ENST00000428668 | TAF |
| 18% | chr21 | 47741082 | 47741060 | − | chr21 | 47738134 | 47737926 | − | ENST00000291691 | TAF |
| 18% | chr20 | 32882711 | 32882165 | − | chr20 | 321881962 | 32881887 | | ENST00000217426; ENST00000538132 | TAF |
| 18% | chr19 | 18653186 | 18653179 | − | chr19 | 18652805 | 18652489 | | ENST00000453489 | TAF |
| 18% | chr6 | 42890125 | 42890148 | + | chr6 | 42890883 | 42891085 | + | ENST00000304672; ENST00000441198 | TSF |
| 18% | chr7 | 2213442 | 2212885 | − | chr7 | 2188873 | 2188787 | − | ENST00000402746; ENST00000399654; ENST00000406869; ENST00000265854 | TSF |
| 17% | chr4 | 154546282 | 154546350 | + | chr4 | 154547299 | 154547377 | + | ENST00000440693; ENST00000409663; ENST00000409959; ENST00000240487 | TSF |
| 16% | chr2 | 3477590 | 3477886 | + | chr2 | 3481466 | 3481566 | + | ENST00000382110; ENST00000324266; ENST00000415624 | TAF |
| 16% | chrX | 3779692 | 3773630 | − | chrX | 3735819 | 3735816 | − | ENST00000425492 | TAF |
| 15% | chr17 | 80440912 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |
| 15% | chr17 | 80440912 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |
| 15% | chr17 | 8044091280 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |
| 15% | chr17 | 80440912 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |
| 15% | chr7 | 116364854 | 116364901 | + | chr7 | 116371722 | 116371913 | + | ENST00000397752; ENST00000318493; ENST00000436117 | TAF |
| 15% | chr7 | 116364854 | 116364901 | + | chr7 | 116371722 | 116371913 | + | ENST00000397752; ENST00000318493; ENST00000436117 | TAF |
| 15% | chr7 | 116364854 | 116364901 | + | chr7 | 116371722 | 116371913 | + | ENST00000397752; ENST00000318493; ENST00000436117 | TAF |
| 14% | chr19 | 7583497 | 7583591 | + | chr19 | 7584091 | 7584174 | + | ENST00000599312 | TAF |
| 14% | chr19 | 9924904 | 9924814 | − | chr19 | 9922393 | 9921572; 9922383; 9922130; 9922270 | − | ENST00000247977; ENST00000588922; ENST00000585379; ENST00000591009; ENST00000590277; ENST00000586469 | TAF |
| 14% | chr19 | 9924904 | 9924814 | − | chr19 | 9922393 | 9921572; 9922383; 99 22130; 9922270 | − | ENST00000247977; ENST00000588922; ENST00000585379; ENST00000591009; ENST00000590277; ENST00000586469 | TAF |
| 14% | chr19 | 9924904 | 9924814 | − | chr19 | 9922393 | 9921572; 9922383; 9922130; 9922270 | − | ENST00000247977; ENST00000588922; ENST00000585379; ENST00000591009; ENST00000590277; ENST00000586469 | TAF |
| 14% | chr19 | 9924904 | 9924814 | − | chr19 | 9922393 | 9921572; 9922383; 9922130; 9922270 | − | ENST00000247977; ENST00000588922; ENST00000585379; ENST00000591009; ENST00000590277; ENST00000586469 | TAF |
| 14% | chr13 | 51440177 | 51440362 | + | chr13 | 51501543 | 51501614 | + | ENST00000336617; ENST00000422660 | TSF |
| 14% | chr13 | 51440177 | 51440362 | + | chr13 | 51501543 | 51501614 | + | ENST00000336617; ENST00000422660 | TSF |
| 13% | chr19 | 49458157 | 49458182 | + | chr19 | 49458944 | 49459090; 49459035 | + | ENST00000539787; ENST00000345358; ENST00000391871; ENST00000515540; ENST00000356483; ENST00000415969; ENST00000293288 | TAF |
| 13% | chr19 | 49458157 | 49458182 | + | chr19 | 49458944 | 49459090; 49459035 | + | ENST00000539787; ENST00000345358; ENST00000391871; ENST00000515540; ENST00000356483; ENST00000415969; ENST00000293288 | TAF |
| 13% | chr19 | 49458157 | 49458182 | + | chr19 | 49458944 | 49459090; 49459035 | + | ENST00000539787; ENST00000345358; ENST00000391871; ENST00000515540; ENST00000356483; ENST00000415969; ENST00000293288 | TAF |
| 13% | chr19 | 49458157 | 49458182 | + | chr19 | 49458944 | 49459090; 49459035 | + | ENST00000539787; ENST00000345358; ENST00000391871; ENST00000515540; ENST00000356483; ENST00000415969; ENST00000293288 | TAF |
| 13% | chr19 | 49458157 | 49458182 | + | chr19 | 49458944 | 49459090; 49459035 | + | ENST00000539787; ENST00000345358; ENST00000391871; ENST00000515540; ENST00000356483; ENST00000415969; | TAF |

TABLE 64-continued

Transcript fusion for Thymoma (THYM)
Coordinates of the fusion sequences for which the donor is the TE.

| 1 | 2' | 3' | 4' | 5' | 6' | 7' | 8' | 9' | 10' | 11' |
|---|----|----|----|----|----|----|----|----|-----|-----|
| 13% | chr16 | 79160209 | 79160459 | + | chr16 | 79245505 | 79245693; 79246031; 79245661 | + | ENST00000293288 ENST00000566780; ENST00000402655; ENST00000406884; ENST00000539474 | TSF |
| 13% | chr16 | 79160209 | 79160459 | + | chr16 | 79245505 | 79245693; 79246031; 79245661 | + | ENST00000566780; ENST00000402655; ENST00000406884; ENST00000539474 | TSF |
| 13% | chr16 | 79160209 | 79160459 | + | chr16 | 79245505 | 79245693; 79246031; 79245661 | + | ENST00000566780; ENST00000402655; ENST00000406884; ENST00000539474 | TSF |
| 13% | chr16 | 75118199 | 75118535 | + | chr16 | 75127470 | 75127565 | + | ENST00000335325; ENST00000320619; ENST00000566250; ENST00000567962 | TSF |
| 13% | chr16 | 75118199 | 75118535 | + | chr16 | 75127470 | 75127565 | + | ENST00000335325; ENST00000320619; ENST00000566250; ENST00000567962 | TSF |
| 13% | chr16 | 75118199 | 75118535 | + | chr4 | 75127470 | 75127565 | + | ENST00000335325; ENST00000320619; ENST00000566250; ENST00000567962 | TSF |
| 12% | chr4 | 185615383 | 1856154 | + | chr4 | 18005615676 | 185615933; 185615746 | + | ENST00000314970; ENST00000515774; ENST00000503752; ENST00000512834; ENST00000508001 | TAF |
| 12% | chr4 | 185615383 | 185615524 | + | chr4 | 185615676 | 185615933; 185615746 | + | ENST00000314970; ENST00000515774; ENST00000503752; ENST00000512834; ENST00000508001 | TAF |
| 12% | chr2 | 99797199 | 99797170 | − | chr2 | 99790479 | 99790378 | − | ENST00000422537; ENST00000289359; ENST00000409107 | TAF |
| 12% | chr2 | 99797199 | 99797170 | − | chr2 | 99790479 | 99790378 | − | ENST00000422537; ENST00000289359; ENST00000409107 | TAF |
| 12% | chr9 | 100872455 | 100872351 | − | chr9 | 100872266 | 100872171 | − | ENST00000375098; ENST00000341469; ENST00000342043 | TAF |
| 12% | chr14 | 45596308 | 45596304 | − | chr14 | 45590823 | 45590688 | − | ENST00000396062; ENST00000216330 | TAF |
| 12% | chr1 | 6380703 | 6380649 | − | chr1 | 6378638 | 6378552 | − | ENST00000608083; ENST00000377842; ENST00000377845; ENST00000377855; ENST00000377860; ENST00000418124; ENST00000545482; ENST00000361521; ENST00000473466; ENST00000541130 | TAF |
| 12% | chr1 | 6380703 | 6380649 | − | chr1 | 6378638 | 6378552 | − | ENST00000608083; ENST00000377842; ENST00000377845; ENST00000377855; ENST00000377860; ENST00000418124; ENST00000545482; ENST00000361521; ENST00000473466; ENST00000541130 | TAF |
| 12% | chr1 | 6380703 | 6380649 | − | chr1 | 16378638 | 6378552 | − | ENST00000608083; ENST00000377842; ENST00000377845; ENST00000377855; ENST00000377860; ENST00000418124; ENST00000545482; ENST00000361521; ENST00000473466; ENST00000541130 | TAF |
| 12% | chr1 | 6380703 | 6380649 | − | chr1 | 6378638 | 6378552 | − | ENST00000608083; ENST00000377842; ENST00000377845; ENST00000377855; ENST00000377860; ENST00000418124; ENST00000545482; ENST00000361521; ENST00000473466; ENST00000541130 | TAF |
| 12% | chr1 | 6380703 | 6380649 | − | chr1 | 6378638 | 6378552 | − | ENST00000608083; ENST00000377842; ENST00000377845; ENST00000377855; ENST00000377860; ENST00000418124; ENST00000545482; ENST00000361521; ENST00000473466; ENST00000541130 | TAF |
| 12% | chr19 | 42335927 | 423359140 | + | chr19 | 42364892 | 42364915 | + | ENST00000598742; ENST00000601492; ENST00000600467; ENST00000593863; ENST00000598261; ENST00000598399 | TAF |
| 12% | chr19 | 42335927 | 423359140 | + | chr19 | 42364892 | 42364915 | + | ENST00000598742; ENST00000601492; ENST00000600467; ENST00000593863; ENST00000598261; ENST00000598399 | TAF |
| 12% | chr19 | 42335927 | 42335940 | + | chr19 | 42364892 | 42364915 | + | ENST00000598742; ENST00000601492; ENST00000600467; ENST00000593863; ENST00000598261; ENST00000598399 | TAF |
| 12% | chr19 | 42335927 | 42335940 | + | chr19 | 42364892 | 42364915 | + | ENST00000598742; ENST00000601492; ENST00000600467; ENST00000593863; ENST00000598261; ENST00000598399 | TAF |
| 12% | chr19 | 42335927 | 42335940 | + | chr19 | 42364892 | 42364915 | + | ENST00000598742; ENST00000601492; ENST00000600467; ENST00000593863; ENST00000598261; ENST00000598399 | TAF |
| 12% | chr1 | 26442407 | 26442478 | + | chr1 | 26646662 | 26646793 | + | ENST00000374213 | TAF |
| 12% | chr6 | 43026913 | 43026822 | − | chr6 | 43025971 | 43025803; 43025889; 43025777 | − | ENST00000388752; ENST00000230413; ENST00000489623; ENST00000487429; ENST00000468957 | TAF |
| 12% | chr6 | 43026913 | 43026822 | − | chr6 | 43025971 | 43025803; 43025889; | − | ENST00000388752; ENST00000230413; ENST00000489623; ENST00000487429; | TAF |

TABLE 64-continued

Transcript fusion for Thymoma (THYM)
Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| 12% | chr6 | 43026913 | 43026822 | − | chr6 | 43025971 | 43025777 43025803; 43025889; 43025777 | − | ENST00000468957 ENST00000388752; ENST00000230413; ENST00000489623; ENST00000487429; ENST00000468957 | TAF |
| 12% | chr6 | 43026913 | 43026822 | − | chr6 | 43025971 | 43025803; 43025889; 43025777 | − | ENST00000388752; ENST00000230413; ENST00000489623; ENST00000487429; ENST00000468957 | TAF |
| 12% | chr6 | 43026913 | 43026822 | − | chr6 | 43025971 | 43025803; 43025889; 43025777 | − | ENST00000388752; ENST00000230413; ENST00000489623; ENST00000487429; ENST00000468957 | TAF |
| 12% | chr17 | 7130320 | 7130212 | − | chr17 | 7129958 | 7129740 | − | ENST00000005340; ENST00000575458; ENST00000575086 | TAF |
| 12% | chr17 | 7130320 | 7130212 | − | chr17 | 7129958 | 7129740 | − | ENST00000005340; ENST00000575458; ENST00000575086 | TAF |
| 11% | chr2 | 62362210 | 62362285 | + | chr2 | 62362966 | 62363076 | + | ENST00000311832; ENST00000458337; ENST00000427417 | TAF |
| 11% | chr20 | 30269169 | 26309014 | − | chr20 | 30253889 | 30253752; 30253838 | − | ENST00000376062; ENST00000376055; ENST00000307677; ENST00000420653; ENST00000450273 | TAF |
| 11% | chr20 | 30269169 | 30269014 | − | chr20 | 30253889 | 30253752; 30253838 | − | ENST00000376062; ENST00000376055; ENST00000307677; ENST00000420653; ENST00000450273 | TAF |
| 11% | chr12 | 102411559 | 102411498 | − | chr12 | 102406970 | 102406886 | − | ENST00000240079; ENST00000545679; ENST00000542923 | TAF |
| 11% | chr19 | 15502944 | 15502761 | − | chr19 | 15491423 | 15491328 | − | ENST00000397410; ENST00000595465 | TAF |
| 11% | chr3 | 47554781 | 47554981 | − | chr3 | 47552716 | 47552638 | − | ENST00000296149; ENST00000442215 | TAF |
| 11% | chr3 | 47554781 | 47554981 | − | chr3 | 147552716 | 47552638 | | ENST00000296149; ENST00000442215 | TAF |
| 11% | chr16 | 79160209 | 79160495 | + | chr16 | 179245505 | 79245693; 79246031; 79245661 | + | ENST00000566780; ENST00000402655; ENST00000406884; ENST00000539474 | TSF |
| 11% | chr16 | 79160209 | 79160495 | + | chr16 | 79245505 | 79245693; 79246031; 79245661 | + | ENST00000566780; ENST00000402655; ENST00000406884; ENST00000539474 | TSF |
| 11% | chr16 | 79160209 | 79160495 | + | chr16 | 79245505 | 79245693; 79246031; 79245661 | + | ENST00000566780; ENST00000402655; ENST00000406884; ENST00000539474 | TSF |
| 10% | chr4 | 1745002 | 1745264 | + | chr4 | 17146245 | 1746351 | + | ENST00000313288 | TSF |
| 10% | chr17 | 54891362 | 54891289 | − | chr17 | 54872541 | 54872425 | | ENST00000397861; ENST00000397862; ENST00000575658 | TSF |
| 10% | chr22 | 22899971 | 22899965 | − | chr22 | 22893511 | 22893189; 22893185; 22893481; 22893274 | − | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |
| 10% | chr22 | 22899971 | 22899965 | − | chr22 | 22893511 | 22893189; 22893185; 22893481; 22893274 | − | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |
| 10% | chr22 | 22899971 | 22899965 | − | chr22 | 22893511 | 22893189; 22893185; 22893481; 22893274 | − | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |
| 10% | chr22 | 89229971 | 22899965 | − | chr22 | 22893511 | 22893189; 22893185; 22893481; 22893274 | − | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |
| 10% | chr22 | 22899971 | 22899965 | − | chr22 | 22893511 | 22893189; 22893185; 22893481; 22893274 | − | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |
| 10% | chr22 | 22899971 | 22899965 | − | chr22 | 22893511 | 22893189; 22893185; 22893481; 22893274 | − | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |

TABLE 64-continued

Transcript fusion for Thymoma (THYM)
Coordinates of the fusion sequences for which the donor is the TE.

| 1 | 2' | 3' | 4' | 5' | 6' | 7' | 8' | 9' | 10' | 11' |
|---|----|----|----|----|----|----|----|----|-----|-----|
| 10% | chr22 | 22899971 | 22899965 | − | chr22 | 22893511 | 22893189; 22893185; 22893481; 22893274 | − | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |
| 10% | chr16 | 30391227 | 30391159 | − | chr16 | 30390855 | 30390756 | − | ENST00000321367; ENST00000571393; ENST00000605106; ENST00000566517 | TSF |
| 10% | chr16 | 30391227 | 30391159 | − | chr16 | 30390855 | 30390756 | − | ENST00000321367; ENST00000571393; ENST00000605106; ENST00000566517 | TSF |
| 10% | chr18 | 51573 | 49727 | − | chr18 | 49237 | 49129 | − | ENST00000308911 | TSF |
| 9% | chr8 | 136546987 | 136547139 | + | chr8 | 136554897 | 136555013 | + | ENST00000355849; ENST00000524199; ENST00000517394 | TSF |
| 9% | chr8 | 654698713 | 136547139 | + | chr8 | 136554897 | 136555013 | + | ENST00000355849; ENST00000524199; ENST00000517394 | TSF |
| 9% | chr8 | 136546987 | 136547139 | + | chr8 | 136554897 | 136555013 | + | ENST00000355849; ENST00000524199; ENST00000517394 | TSF |
| 9% | chr19 | 54868492 | 54868321 | − | chr19 | 54868228 | 54868100; 54868205 | − | ENST00000391743; ENST00000348231; ENST00000391742; ENST00000434277; ENST00000313038; ENST00000391741; ENST00000474878 | TSF |
| 9% | chr19 | 86849254 | 54868321 | − | chr19 | 54868228 | 54868100; 54868205 | − | ENST00000391743; ENST00000348231; ENST00000391742; ENST00000434277; ENST00000313038; ENST00000391741; ENST00000474878 | TSF |
| 8% | chr17 | 73357826 | 26733475 | − | chr17 | 26733015 | 26732905 | − | ENST00000321666; ENST00000440501 | TSF |
| 8% | chr17 | 26733578 | 26733475 | − | chr17 | 26733015 | 26732905 | − | ENST00000321666; ENST00000440501 | TSF |
| 8% | chr20 | 44752658 | 44752755 | + | chr20 | 44755279 | 44755340 | + | ENST00000372285; ENST00000466205 | TSF |
| 8% | chr20 | 44752656 | 44752755 | + | chr20 | 44755279 | 44755340 | + | ENST00000372285; ENST00000466205 | TSF |
| 8% | chr14 | 24682204 | 24682139 | − | chr14 | 24681035 | 24680886 | − | ENST00000530611; ENST00000556387; ENST00000347519; ENST00000533523; ENST00000609024; ENST00000533011; ENST00000534106 | TSF |
| 8% | chr14 | 24682204 | 24682139 | − | chr14 | 24681035 | 24680886 | − | ENST00000530611; ENST00000556387; ENST00000347519; ENST00000533523; ENST00000609024; ENST00000533011; ENST00000534106 | TSF |
| 8% | chr14 | 24682204 | 24682139 | − | chr14 | 24681035 | 24680886 | − | ENST00000530611; ENST00000556387; ENST00000347519; ENST00000533523; ENST00000609024; ENST00000533011; ENST00000534106 | TSF |
| 8% | chr14 | 68242204 | 24682139 | − | chr14 | 24681035 | 24680886 | − | ENST00000530611; ENST00000556387; ENST00000347519; ENST00000533523; ENST00000609024; ENST00000533011; ENST00000534106 | TSF |
| 8% | chr14 | 68242204 | 24682139 | − | chr14 | 24681035 | 24680886 | | ENST00000530611; ENST00000556387; ENST00000347519; ENST00000533523; ENST00000609024; ENST00000533011; ENST00000534106 | TSF |
| 7% | chr12 | 42821122 | 42822199 | + | chr12 | 42835117 | 42835311; 42835231 | + | ENST00000549190; ENST00000395580; ENST00000337898; ENST00000358314; ENST00000395568; ENST00000256678; ENST00000449194; ENST00000552761; ENST00000317560; ENST00000432191 | TSF |
| 7% | chr12 | 42821122 | 42822199 | + | chr12 | 42835117 | 42835311; 42835231 | + | ENST00000549190; ENST00000395580; ENST00000337898; ENST00000358314; ENST00000395568; ENST00000256678; ENST00000449194; ENST00000552761; ENST00000317560; ENST00000432191 | TSF |
| 7% | chr12 | 42821122 | 42822199 | + | chr12 | 42835117 | 42835311; 42835231 | + | ENST00000549190; ENST00000395580; ENST00000337898; ENST00000358314; ENST00000395568; ENST00000256678; ENST00000449194; ENST00000552761; ENST00000317560; ENST00000432191 | TSF |
| 7% | chr12 | 42821122 | 42822199 | + | chr12 | 42835117 | 42835311; 42835231 | + | ENST00000549190; ENST00000395580; ENST00000337898; ENST00000358314; ENST00000395568; ENST00000256678; ENST00000449194; ENST00000552761; ENST00000317560; ENST00000432191 | TSF |
| 7% | chr12 | 42821122 | 42822199 | + | chr12 | 42835117 | 42835311; 42835231 | + | ENST00000549190; ENST00000395580; ENST00000337898; ENST00000358314; ENST00000395568; ENST00000256678; ENST00000449194; ENST00000552761; ENST00000317560; ENST00000432191 | TSF |
| 7% | chr12 | 42821122 | 42822199 | + | chr12 | 42835117 | 42835311; | + | ENST00000549190; ENST00000395580; | TSF |

TABLE 64-continued

Transcript fusion for Thymoma (THYM)
Coordinates of the fusion sequences for which the donor is the TE.

| 1 | 2' | 3' | 4' | 5' 6' | 7' | 8' | 9' 10' | 11' |
|---|---|---|---|---|---|---|---|---|
| | | | | | | 42835231 | ENST00000337898; ENST00000358314; ENST00000395568; ENST00000256678; ENST00000449194; ENST00000552761; ENST00000317560; ENST00000432191 | |
| 7% | chr2 | 3462278 | 3462286 | + chr2 | 3464034 | 3464107; 3464074 | + ENST00000382110; ENST00000324266; ENST00000441983; ENST00000417243; ENST00000415624 | TSF |
| 7% | chr2 | 3462278 | 3462286 | + chr2 | 3464034 | 3464107; 3464074 | + ENST00000382110; ENST00000324266; ENST00000441983; ENST00000417243; ENST00000415624 | TSF |
| 7% | chr2 | 3462278 | 3462286 | + chr2 | 3464034 | 3464107; 3464074 | + ENST00000382110; ENST00000324266; ENST00000441983; ENST00000417243; ENST00000415624 | TSF |
| 7% | chr2 | 3462278 | 3462286 | + chr2 | 3464034 | 3464107; 3464074 | + ENST00000382110; ENST00000324266; ENST00000441983; ENST00000417243; ENST00000415624 | TSF |
| 7% | chr14 | 68507686 | 68507934 | + chr14 | 68758601 | 68758697 | + ENST00000487861; ENST00000471583; ENST00000487270; ENST00000488612; ENST00000390683 | TSF |
| 7% | chr14 | 68507686 | 68507934 | + chr14 | 68758601 | 68758697 | + ENST00000487861; ENST00000471583; ENST00000487270; ENST00000488612; ENST00000390683 | TSF |
| 7% | chr14 | 68507686 | 68507934 | + chr14 | 68758601 | 68758697 | + ENST00000487861; ENST00000471583; ENST00000487270; ENST00000488612; ENST00000390683 | TSF |
| 7% | chr14 | 68507686 | 68507934 | + chr14 | 68758601 | 68758697 | + ENST00000487861; ENST00000471583; ENST00000487270; ENST00000488612; ENST00000390683 | TSF |
| 7% | chr20 | 43253349 | 43253289 | − chr20 | 43252970 | 43252843 | − ENST00000372874; ENST00000536532; ENST00000537820 | TSF |
| 7% | chr20 | 43253349 | 43253289 | − chr20 | 43252970 | 43252843 | − ENST00000372874; ENST00000536532; ENST00000537820 | TSF |
| 7% | chr20 | 43253349 | 43253289 | − chr20 | 43252970 | 43252843 | − ENST00000372874; ENST00000536532; ENST00000537820 | TSF |
| 6% | chr2 | 198593687 | 198593827 | + chr2 | 198636581 | 198636638 | + ENST00000409845 | TSF |
| 6% | chr6 | 42890506 | 42890547 | + chr6 | 42891967 | 42892011 | + ENST00000304672; ENST00000441198; ENST00000446507 | TSF |
| 6% | chr10 | 26792284 | 26792333 | + chr10 | 26800676 | 26800835 | + ENST00000376236 | TSF |
| 6% | chr1 | 59980221 | 59980497 | + chr1 | 60019796 | 60019899 | + ENST00000371218; ENST00000303721; ENST00000430447; ENST00000371212 | TSF |
| 6% | chr1 | 59980221 | 59980497 | + chr1 | 60019796 | 60019899 | + ENST00000371218; ENST00000303721; ENST00000430447; ENST00000371212 | TSF |
| 6% | chr1 | 59980221 | 59980497 | + chr1 | 60019796 | 60019899 | + ENST00000371218; ENST00000303721; ENST00000430447; ENST00000371212 | TSF |
| 6% | chr2 | 135250933 | 135250213 | − chr2 | 135223796 | 135223685 | − ENST00000281924 | TSF |
| 6% | chr7 | 1014593 | 1014543 | − chr7 | 1012928 | 1012817 | − ENST00000457254; ENST00000344111 | TSF |
| 6% | chr7 | 1014593 | 1014543 | − chr7 | 1012928 | 1012817 | − ENST00000457254; ENST00000344111 | TSF |
| 6% | chr5 | 138724860 | 138724589 | − chr5 | 138724274 | 138724150 | − ENST00000503481; ENST00000302125 | TSF |
| 6% | chr5 | 138724860 | 138724589 | − chr5 | 138724274 | 138724150 | − ENST00000503481; ENST00000302125 | TSF |
| 6% | chr4 | 108981708 | 10898165 | − chr4 | 108969907 | 108969828 | − ENST00000379951 | TSF |
| 6% | chr14 | 105642036 | 105641815 | − chr14 | 561039598 | 105639358 | − ENST00000392568 | TSF |
| 6% | chr4 | 108994237 | 108994141 | − chr4 | 108991926 | 108991819 | − ENST00000265165; ENST00000379951; ENST00000438313; ENST00000510624 | TSF |
| 6% | chr4 | 108994237 | 108994141 | − chr4 | 108991926 | 108991819 | − ENST00000265165; ENST00000379951; ENST00000438313; ENST00000510624 | TSF |
| 5% | chr17 | 7788014 | 7788052 | + chr17 | 7788257 | 7788401 | + ENST00000380358 | TSF |
| 5% | chr22 | 32013425 | 32013525 | + chr22 | 32014101 | 32014147; | + ENST00000414585; ENST00000443326; ENST00000540643; ENST00000432498; ENST00000443011; ENST00000400289; ENST00000400288 | TSF |
| 5% | chr22 | 32013425 | 32013525 | + chr22 | 32014101 | 32014147; 32014212 | + ENST00000414585; ENST00000443326; ENST00000540643; ENST00000432498; ENST00000443011; ENST00000400289; ENST00000400288 | TSF |
| 5% | chr5 | 133458649 | 133458682 | + chr5 | 133473750 | 133473855; 133473887 | + ENST00000378564; ENST00000321584; ENST00000321603; ENST00000342854; ENST00000395029; ENST00000518887; ENST00000517851; ENST00000521639; ENST00000522375; ENST00000432532; ENST00000378560; ENST00000520958; ENST00000518915; ENST00000395023; ENST00000519447; ENST00000517741; ENST00000520652; ENST00000519037 | TSF |
| 5% | chr5 | 133458649 | 133458682 | + chr5 | 133473750 | 133473855; 133473887 | + ENST00000378564; ENST00000321584; ENST00000321603; ENST00000342854; | TSF |

TABLE 64-continued

Transcript fusion for Thymoma (THYM)
Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| | | | | | | | | | ENST00000395029; ENST00000518887; ENST00000517851; ENST00000521639; ENST00000522375; ENST00000432532; ENST00000378560; ENST00000520958; ENST00000518915; ENST00000395023; ENST00000519447; ENST00000517741; ENST00000520652; ENST00000519037 | |
| 5% | chr5 | 133458649 | 133458682 | + | chr5 | 33473750 | 133473855; 133473887 | + | ENST00000378564; ENST00000321584; ENST00000321603; ENST00000342854; ENST00000395029; ENST00000518887; ENST00000517851; ENST00000521639; ENST00000522375; ENST00000432532; ENST00000378560; ENST00000520958; ENST00000518915; ENST00000395023; ENST00000519447; ENST00000517741; ENST00000520652; ENST00000519037 | TSF |
| 5% | chr5 | 133458649 | 133458582 | + | chr5 | 133473750 | 1334738515; 133473887 | + | ENST00000378564; ENST00000321584; ENST00000321603; ENST00000342854; ENST00000395029; ENST00000518887; ENST00000517851; ENST00000521639; ENST00000522375; ENST00000432532; ENST00000378560; ENST00000520958; ENST00000518915; ENST00000395023; ENST00000519447; ENST00000517741; ENST00000520652; ENST00000519037 | TSF |
| 5% | chr5 | 133458649 | 133458682 | + | chr5 | 133473750 | 133473855; 133473887 | + | ENST00000378564; ENST00000321584; ENST00000321603; ENST00000342854; ENST00000395029; ENST00000518887; ENST00000517851; ENST00000521639; ENST00000522375; ENST00000432532; ENST00000378560; ENST00000520958; ENST00000518915; ENST00000395023; ENST00000519447; ENST00000517741; ENST00000520652; ENST00000519037 | TSF |
| 5% | chr5 | 133458649 | 133458682 | + | chr5 | 133473750 | 133473855; 133473887 | + | ENST00000378564; ENST00000321584; ENST00000321603; ENST00000342854; ENST00000395029; ENST00000518887; ENST00000517851; ENST00000521639; ENST00000522375; ENST00000432532; ENST00000378560; ENST00000520958; ENST00000518915; ENST00000395023; ENST00000519447; ENST00000517741; ENST00000520652; ENST00000519037 | TSF |
| 5% | chr5 | 133458649 | 133458682 | + | chr5 | 133473750 | 133473855; 133473887 | + | ENST00000378564; ENST00000321584; ENST00000321603; ENST00000342854; ENST00000395029; ENST00000518887; ENST00000517851; ENST00000521639; ENST00000522375; ENST00000432532; ENST00000378560; ENST00000520958; ENST00000518915; ENST00000395023; ENST00000519447; ENST00000517741; ENST00000520652; ENST00000519037 | TSF |
| 5% | chr5 | 133458649 | 133458682 | + | chr5 | 133473750 | 133473855; 133473887 | + | ENST00000378564; ENST00000321584; ENST00000321603; ENST00000342854; ENST00000395029; ENST00000518887; ENST00000517851; ENST00000521639; ENST00000522375; ENST00000432532; ENST00000378560; ENST00000520958; ENST00000518915; ENST00000395023; ENST00000519447; ENST00000517741; ENST00000520652; ENST00000519037 | TSF |
| 5% | chr5 | 133458649 | 133458682 | + | chr5 | 133473750 | 133473855; 133473887 | + | ENST00000378564; ENST00000321584; ENST00000321603; ENST00000342854; ENST00000395029; ENST00000518887; ENST00000517851; ENST00000521639; ENST00000522375; ENST00000432532; ENST00000378560; ENST00000520958; ENST00000518915; ENST00000395023; ENST00000519447; ENST00000517741; ENST00000520652; ENST00000519037 | TSF |
| 5% | chr5 | 133458649 | 133458682 | + | chr5 | 133473750 | 133473855; 133473887 | + | ENST00000378564; ENST00000321584; ENST00000321603; ENST00000342854; ENST00000395029; ENST00000518887; ENST00000517851; ENST00000521639; ENST00000522375; ENST00000432532; | TSF |

TABLE 64-continued

Transcript fusion for Thymoma (THYM)
Coordinates of the fusion sequences for which the donor is the TE.

| 1 | 2' | 3' | 4' | 5' | 6' | 7' | 8' | 9' | 10' | 11' |
|---|----|----|----|----|----|----|----|----|-----|-----|
| 5% | chr5 | 133458679 | 133458682 | + | chr5 | 133473750 | 133473855; 133473887 | + | ENST00000378560; ENST00000520958; ENST00000518915; ENST00000395023; ENST00000519447; ENST00000517741; ENST00000520652; ENST00000519037 ENST00000378564; ENST00000321584; ENST00000321603; ENST00000342854; ENST00000395029; ENST00000518887; ENST00000517851; ENST00000521639; ENST00000522375; ENST00000432532; | ITSF |
| 5% | chr5 | 133458649 | 133458682 | + | chr5 | 133476750 | 133473855; 1334738 87 | + | ENST00000378560; ENST00000520958; ENST00000518915; ENST00000395023; ENST00000519447; ENST00000517741; ENST00000520652; ENST00000519037 ENST00000378564; ENST00000321584; ENST00000321603; ENST00000342854; ENST00000395029; ENST00000518887; ENST00000517851; ENST00000521639; ENST00000522375; ENST00000432532; | TSF |
| 5% | chr5 | 133458649 | 133458682 | + | chr5 | 133479750 | 133473855; 133473887 | + | ENST00000378560; ENST00000520958; ENST00000518915; ENST00000395023; ENST00000519447; ENST00000517741; ENST00000520652; ENST00000519037 ENST00000378564; ENST00000321584; ENST00000321603; ENST00000342854; ENST00000395029; ENST00000518887; ENST00000517851; ENST00000521639; ENST00000522375; ENST00000432532; | TSF |
| 5% | chr12 | 123464400 | 123464485 | + | chr12 | 123465676 | 123465846; | + | ENST00000315580; ENST00000543566; ENST00000539770; ENST00000542099; ENST00000392435; ENST00000453766 | TSF |
| 5% | chr12 | 123464400 | 123464485 | + | chr12 | 123465676 | 123465846; 123465813 | + | ENST00000315580; ENST00000543566; ENST00000539770; ENST00000542099; ENST00000392435; ENST00000453766 | TSF |
| 5% | chr12 | 123464400 | 123464485 | + | chr12 | 123465676 | 123465846; 123465813 | + | ENST00000315580; ENST00000543566; ENST00000539770; ENST00000542099; ENST00000392435; ENST00000453766 | TSF |
| 5% | chr12 | 123464400 | 123464485 | + | chr12 | 123465676 | 123465846; 123465813 | + | ENST00000315580; ENST00000543566; ENST00000539770; ENST00000542099; ENST00000392435; ENST00000453766 | TSF |
| 5% | chr12 | 123464400 | 123464485 | + | chr12 | 123465676 | 123465846; 123465813 | + | ENST00000315580; ENST00000543566; ENST00000539770; ENST00000542099; ENST00000392435; ENST00000453766 | TSF |
| 5% | chr12 | 123464400 | 123464485 | + | chr12 | 123465676 | 123465846; 123465813 | + | ENST00000315580; ENST00000543566; ENST00000539770; ENST00000542099; ENST00000392435; ENST00000453766 | TSF |
| 5% | chr22 | 37624777 | 376246148 | − | chr22 | 37622843 | 37622713; 37622793 | − | ENST00000249071; ENST00000406508; ENST00000405484; ENST00000441619 | TSF |
| 5% | chr22 | 37624777 | 37624648 | − | chr22 | 37622843 | 37622713; 37622793 | − | ENST00000249071; ENST00000406508; ENST00000405484; ENST00000441619 | TSF |
| 5% | chr3 | 141719378 | 141719074 | − | chr3 | 141713983 | 141713862; 141713905; 141713913 | − | ENST00000499676; ENST00000489671; ENST00000486111; ENST00000467072; ENST00000317104; ENST00000310282; ENST00000479040; ENST00000397991; ENST00000467667; ENST00000497579; ENST00000488107; ENST00000475734; ENST00000494358; ENST00000467634 | TSF |
| 5% | chr3 | 141719378 | 141719074 | − | chr3 | 141713983 | 141713862; 141713905; 141713913 | − | ENST00000499676; ENST00000489671; ENST00000486111; ENST00000467072; ENST00000317104; ENST00000310282; ENST00000479040; ENST00000397991; ENST00000467667; ENST00000497579; ENST00000488107; ENST00000475734; ENST00000494358; ENST00000467634 | TSF |
| 5% | chr3 | 141719378 | 141719074 | − | chr3 | 141713983 | 141713862; 141713905; 141713913 | − | ENST00000499676; ENST00000489671; ENST00000486111; ENST00000467072; ENST00000317104; ENST00000310282; ENST00000479040; ENST00000397991; ENST00000467667; ENST00000497579; ENST00000488107; ENST00000475734; ENST00000494358; ENST00000467634 | TSF |
| 5% | chr3 | 141719378 | 141719074 | − | chr3 | 141713983 | 141713862; | − | ENST00000499676; ENST00000489671; | TSF |

TABLE 64-continued

Transcript fusion for Thymoma (THYM)
Coordinates of the fusion sequences for which the donor is the TE.

| 1 | 2' | 3' | 4' | 5' | 6' | 7' | 8' | 9' | 10' | 11' |
|---|---|---|---|---|---|---|---|---|---|---|
| | | | | | | | 141713905; 141713913 | | ENST00000486111; ENST00000467072; ENST00000317104; ENST00000310282; ENST00000479040; ENST00000397991; ENST00000467667; ENST00000497579; ENST00000488107; ENST00000475734; ENST00000494358; ENST00000467634 | |
| 5% | chr3 | 141719378 | 141719074 | – | chr3 | 141713983 | 141713862; 141713905; 141713913 | – | ENST00000499676; ENST00000489671; ENST00000486111; ENST00000467072; ENST00000317104; ENST00000310282; ENST00000479040; ENST00000397991; ENST00000467667; ENST00000497579; ENST00000488107; ENST00000475734; ENST00000494358; ENST00000467634 | TSF |
| 5% | chr3 | 141719378 | 141719074 | – | chr3 | 141713983 | 141713862; 141713905; 141713913 | – | ENST00000499676; ENST00000489671; ENST00000486111; ENST00000467072; ENST00000317104; ENST00000310282; ENST00000479040; ENST00000397991; ENST00000467667; ENST00000497579; ENST00000488107; ENST00000475734; ENST00000494358; ENST00000467634 | TSF |
| 5% | chr3 | 141719378 | 141719074 | – | chr3 | 141713983 | 141713862; 141713905; 141713913 | – | ENST00000499676; ENST00000489671; ENST00000486111; ENST00000467072; ENST00000317104; ENST00000310282; ENST00000479040; ENST00000397991; ENST00000467667; ENST00000497579; ENST00000488107; ENST00000475734; ENST00000494358; ENST00000467634 | TSF |
| 5% | chr3 | 141719378 | 141719074 | – | chr3 | 141713983 | 141713862; 141713905; 141713913 | – | ENST00000499676; ENST00000489671; ENST00000486111; ENST00000467072; ENST00000317104; ENST00000310282; ENST00000479040; ENST00000397991; ENST00000467667; ENST00000497579; ENST00000488107; ENST00000475734; ENST00000494358; ENST00000467634 | TSF |
| 5% | chr3 | 171419378 | 141719074 | – | chr3 | 141713983 | 141713862; 141713905; 141713913 | – | ENST00000499676; ENST00000489671; ENST00000486111; ENST00000467072; ENST00000317104; ENST00000310282; ENST00000479040; ENST00000397991; ENST00000467667; ENST00000497579; ENST00000488107; ENST00000475734; ENST00000494358; ENST00000467634 | TSF |
| 5% | chrX | 70328788 | 70328686 | – | chrX | 70328545 | 70328449; 70328512 | – | ENST00000374202; ENST00000456850; ENST00000464642 | TSF |
| 5% | chrX | 32878870 | 70328686 | – | chrX | 70328545 | 70328449; 70328512 | – | ENST00000374202; ENST00000456850; ENST00000464642 | TSF |
| 5% | chrX | 152970153 | 152969992 | – | chrX | 152969549 | 152969414; 152969476 | – | ENST00000441714; ENST00000345046; ENST00000458587; ENST00000442093; ENST00000429550; ENST00000416815; ENST00000423827; ENST00000430088 | TSF |
| 5% | chrX | 152970153 | 152969992 | – | chrX | 152969549 | 152969414; 152969476 | – | ENST00000441714; ENST00000345046; ENST00000458587; ENST00000442093; ENST00000429550; ENST00000416815; ENST00000423827; ENST00000430088 | TSF |
| 5% | chrX | 152970153 | 152969992 | – | chrX | 152969549 | 152969414; 152969476 | – | ENST00000441714; ENST00000345046; ENST00000458587; ENST00000442093; ENST00000429550; ENST00000416815; ENST00000423827; ENST00000430088 | TSF |
| 5% | chrX | 152970153 | 152969992 | – | chrX | 152969549 | 152969414; 152969476 | – | ENST00000441714; ENST00000345046; ENST00000458587; ENST00000442093; ENST00000429550; ENST00000416815; ENST00000423827; ENST00000430088 | TSF |
| 5% | chrX | 152970153 | 152969992 | – | chrX | 152969549 | 152969414; 152969476 | – | ENST00000441714; ENST00000345046; ENST00000458587; ENST00000442093; ENST00000429550; ENST00000416815; ENST00000423827; ENST00000430088 | TSF |
| 5% | chrX | 152970153 | 152969992 | – | chrX | 152969549 | 152969414; 152969476 | – | ENST00000441714; ENST00000345046; ENST00000458587; ENST00000442093; ENST00000429550; ENST00000416815; ENST00000423827; ENST00000430088 | TSF |
| 5% | chr10 | 95433302 | 95433070 | – | chr10 | 95430605 | 95430527 | – | ENST00000359204 | TSF |

TABLE 65

Transcript fusion for Uterine Corpus Endometrial Carcinoma (UCEC)
Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 24% | chr12 | 71928895 | 71928966 | + | ENST00000266674; ENST00000536515; ENST00000540815 | chr12 | 71938771 | 71938901 | + | TSF |
| 20% | chr20 | 35842163 | 35842268 | + | ENST00000237530; ENST00000373622 | chr20 | 35844460 | 35844765 | + | TAF |
| 20% | chr20 | 35842163 | 35842268 | + | ENST00000237530; ENST00000373622 | chr20 | 35844460 | 35844765 | + | TAF |
| 20% | chr10 | 120905865 | 120905748 | − | ENST00000355697; ENST00000330036 | chr10 | 120901885 | 120901741 | − | TAF |
| 20% | chr10 | 120905865 | 120905748 | − | ENST00000355697; ENST00000330036 | chr10 | 120901885 | 120901741 | − | TAF |
| 18% | chr4 | 1742553 | 1742713 | + | ENST00000313288 | chr4 | 1745122 | 1745307 | + | TAF |
| 18% | chr1 | 225156461 | 225156576 | + | ENST00000430092; ENST00000400952; ENST00000366849; ENST00000439375 | chr1 | 225157336 | 225158402 | + | TSF |
| 18% | chr1 | 225156461 | 225156576 | + | ENST00000430092; ENST00000400952; ENST00000366849; ENST00000439375 | chr1 | 225157336 | 225158402 | + | TSF |
| 17% | chr5 | 82554349 | 82554496 | + | ENST00000282268; ENST00000338635; ENST00000396027; ENST00000511817 | chr5 | 82606608 | 82606935 | + | TAF |
| 17% | chr19 | 3544937 | 3544807 | − | ENST00000389395; ENST00000398558; ENST00000588918; ENST00000355415; ENST00000589063 | chr19 | 3538708 | 3538306 | − | TAF |
| 17% | chr19 | 3544937 | 3544807 | − | ENST00000389395; ENST00000398558; ENST00000588918; ENST00000355415; ENST00000589063 | chr19 | 3538708 | 3538306 | − | TAF |
| 17% | chr19 | 3544937 | 3544807 | − | ENST00000389395; ENST00000398558; ENST00000588918; ENST00000355415; ENST00000589063 | chr19 | 3538708 | 3538306 | − | TAF |
| 17% | chr19 | 44129402 | 44129230 | − | ENST00000222374 | chr19 | 44129055 | 44128921 | − | TAF |
| 17% | chr13 | 43659904 | 43659974 | + | ENST00000379221 | chr13 | 43670953 | 43671210 | + | TAF |
| 16% | chr1 | 32696528 | 32696620 | + | ENST00000373586 | chr1 | 32696861 | 32697110 | + | TAF |
| 16% | chr6 | 10749855; 10749898 | 10749931 | + | ENST00000379542; ENST00000473166; ENST00000463448; ENST00000460341; ENST00000480294; ENST00000473807; ENST00000461342; ENST00000475942; ENST00000379530; ENST00000463100; ENST00000481240; ENST00000467317; ENST00000478732 | chr6 | 10829240 | 10829256 | + | TAF |
| 16% | chr6 | 10749855; 10749898 | 10749931 | + | ENST00000379542; ENST00000473166; ENST00000463448; ENST00000460341; ENST00000480294; ENST00000473807; ENST00000461342; ENST00000475942; ENST00000379530; ENST00000463100; ENST00000481240; ENST00000467317; ENST00000478732 | chr6 | 10829240 | 10829256 | + | TAF |
| 16% | chr2 | 220239744 | 220239577 | − | ENST00000273075; ENST00000373972; ENST00000523282 | chr2 | 220227530 | 220227195 | − | TAF |
| 16% | chr2 | 220239744 | 220239577 | − | ENST00000273075; ENST00000373972; ENST00000523282 | chr2 | 220227530 | 220227195 | − | TAF |
| 16% | chr2 | 220239744 | 220239577 | − | ENST00000273075; ENST00000373972; ENST00000523282 | chr2 | 220227530 | 220227195 | − | TAF |
| 12% | chr19 | 35514331 | 35514451 | + | ENST00000599564; ENST00000317991; ENST00000504615; ENST00000411896 | chr19 | 35514601 | 35514631 | + | TAF |
| 12% | chr19 | 35514331 | 35514451 | + | ENST00000599564; ENST00000317991; ENST00000504615; ENST00000411896 | chr19 | 35514601 | 35514631 | + | TAF |
| 12% | chr19 | 35514331 | 35514451 | + | ENST00000599564; ENST00000317991; ENST00000504615; ENST00000411896 | chr19 | 35514601 | 35514631 | + | TAF |
| 12% | chr19 | 35514331 | 35514451 | + | ENST00000599564; ENST00000317991; ENST00000504615; ENST00000411896 | chr19 | 35514601 | 35514631 | + | TAF |
| 12% | chr9 | 15506635 | 15506559 | − | ENST00000380738; ENST00000380733; ENST00000380715; ENST00000380716; ENST00000397519 | chr9 | 15492223 | 15492056 | − | TAF |
| 11% | chr2 | 26624858 | 26625012 | + | ENST00000288710; ENST00000421869 | chr2 | 26630464 | 26631004 | + | TAF |
| 11% | chr20 | 43560983 | 43561073 | + | ENST00000255136; ENST00000217073 | chr20 | 43561176 | 43561224 | + | TAF |
| 9% | chr1 | 11115983; 11115877 | 11115838 | − | ENST00000376957; ENST00000490101 | chr1 | 11115464 | 11115178 | − | TSF |
| 9% | chr1 | 11115983; 11115877 | 11115838 | − | ENST00000376957; ENST00000490101 | chr1 | 11115464 | 11115178 | − | TSF |
| 9% | chr3 | 48716169 | 48715997 | − | ENST00000341520; ENST00000416649; ENST00000294129; ENST00000413374 | chr3 | 48702393 | 48702198 | − | TSF |
| 9% | chr3 | 48716169 | 48715997 | − | ENST00000341520; ENST00000416649; ENST00000294129; ENST00000413374 | chr3 | 48702393 | 48702198 | − | TSF |
| 9% | chr3 | 48716169 | 48715997 | − | ENST00000341520; ENST00000416649; ENST00000294129; ENST00000413374 | chr3 | 48702393 | 48702198 | − | TSF |
| 8% | chr11 | 101937216; 101937273 | 101382937 | + | ENST00000434758; ENST00000526781; ENST00000529204 | chr11 | 101937956 | 101938097 | + | TSF |
| 8% | chr11 | 101937216; 101937273 | 101382937 | + | ENST00000434758; ENST00000526781; ENST00000529204 | chr11 | 101937956 | 101938097 | + | TSF |
| 7% | chr4 | 57319769 | 57319927 | + | ENST00000514888; ENST00000264221; ENST00000505164; ENST00000399688; ENST00000512576 | chr4 | 57321183 | 57321327 | + | TSF |

TABLE 65-continued

Transcript fusion for Uterine Corpus Endometrial Carcinoma (UCEC)
Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 7% | chr4 | 57319769 | 57319927 | + | ENST00000514888; ENST00000264221; ENST00000505164; ENST00000399688; ENST00000512576 | chr4 | 57321183 | 57321327 | + | TSF |
| 7% | chr4 | 57319769 | 57319927 | + | ENST00000514888; ENST00000264221; ENST00000505164; ENST00000399688; ENST00000512576 | chr4 | 57321183 | 57321327 | + | TSF |
| 7% | chr9 | 3856184 | 3856009 | − | ENST00000324333; ENST00000381971 | chr9 | 3855631 | 3855480 | − | TSF |
| 7% | chr9 | 3856184 | 3856009 | − | ENST00000324333; ENST00000381971 | chr9 | 3855631 | 3855480 | − | TSF |
| 7% | chr16 | 30783410 | 30783511 | + | ENST00000324685; ENST00000402121; ENST00000563683; ENST00000357890 | chr16 | 30785136 | 30785155 | + | TSF |
| 7% | chr16 | 30783410 | 30783511 | + | ENST00000324685; ENST00000402121; ENST00000563683; ENST00000357890 | chr16 | 30785136 | 30785155 | + | TSF |
| 7% | chr16 | 30783410 | 30783511 | + | ENST00000324685; ENST00000402121; ENST00000563683; ENST00000357890 | chr16 | 30785136 | 30785155 | + | TSF |
| 7% | chr16 | 30783410 | 30783511 | + | ENST00000324685; ENST00000402121; ENST00000563683; ENST00000357890 | chr16 | 30785136 | 30785155 | + | TSF |
| 6% | chr15 | 81436003 | 81436161 | + | ENST00000286732 | chr15 | 81439636 | 81439809 | + | TSF |
| 6% | chr7 | 91771800 | 91771777 | − | ENST00000435873 | chr7 | 91767155 | 91766808 | − | TSF |
| 5% | chr10 | 79796952 | 79797062 | + | ENST00000435275; ENST00000440692; ENST00000372360; ENST00000360830 | chr4 | 176584518 | 176584519 | + | TSF |
| 5% | chr10 | 126205749 | 126205840 | + | ENST00000368842 | chr10 | 126251911 | 126252288 | + | TSF |
| 5% | chr8 | 42924698; 42924750 | 42924802 | + | ENST00000534420; ENST00000302279; ENST00000533998; ENST00000342116; ENST00000531266; ENST00000525699; ENST00000529687; ENST00000533336 | chr8 | 42925245 | 42925476 | + | TSF |
| 5% | chr8 | 42924698; 42924750 | 42924802 | + | ENST00000534420; ENST00000302279; ENST00000533998; ENST00000342116; ENST00000531266; ENST00000525699; ENST00000529687; ENST00000533336 | chr8 | 42925245 | 42925476 | + | TSF |
| 5% | chr8 | 42924698; 42924750 | 42924802 | + | ENST00000534420; ENST00000302279; ENST00000533998; ENST00000342116; ENST00000531266; ENST00000525699; ENST00000529687; ENST00000533336 | chr8 | 42925245 | 42925476 | + | TSF |
| 5% | chr8 | 42924698; 42924750 | 42924802 | + | ENST00000534420; ENST00000302279; ENST00000533998; ENST00000342116; ENST00000531266; ENST00000525699; ENST00000529687; ENST00000533336 | chr8 | 42925245 | 42925476 | + | TSF |
| 5% | chr8 | 42924698; 42924750 | 42924802 | + | ENST00000534420; ENST00000302279; ENST00000533998; ENST00000342116; ENST00000531266; ENST00000525699; ENST00000529687; ENST00000533336 | chr8 | 142925245 | 42925476 | + | TSF |
| 5% | chr8 | 42924698; 42924750 | 42924802 | + | ENST00000534420; ENST00000302279; ENST00000533998; ENST00000342116; ENST00000531266; ENST00000525699; ENST00000529687; ENST00000533336 | chr8 | 42925245 | 42925476 | + | TSF |
| 4% | chr4 | 4421856 | 4421774 | − | ENST00000306200 | chr4 | 4417890 | 4417824 | − | TSF |
| 4% | chr1 | 155036300 | 155036412 | + | ENST00000368409; ENST00000359751; ENST00000556931; ENST00000505139; ENST00000427683 | chr1 | 155036918 | 155037085 | + | TSF |
| 4% | chr12 | 113623819 | 113623826 | + | ENST00000552495 | chr12 | 113623998 | 113624117 | + | TSF |
| 4% | chr2 | 28352138 | 28352247 | + | ENST00000344773; ENST00000379624; ENST00000342045; ENST00000361704; ENST00000379632; ENST00000379629 | chr2 | 28362015 | 28362218 | + | TSF |
| 4% | chr16 | 50583333 | 50583466 | + | ENST00000268459 | chr16 | 50614862 | 50614981 | + | TSF |
| 4% | chr19 | 53352466; 53352373 | 53352340 | − | ENST00000595646; ENST00000243639; ENST00000597924; ENST00000601847 | chr19 | 53339322 | 53339166 | − | TSF |
| 4% | chr19 | 53352466; 53352373 | 53352340 | − | ENST00000595646; ENST00000243639; ENST00000597924; ENST00000601847 | chr19 | 53339322 | 53339166 | − | TSF |
| 3% | chr22 | 25202408 | 25202451 | + | ENST00000400358; ENST00000400359 | chr22 | 25209976 | 25210040 | + | TSF |
| 3% | chr9 | 125054028 | 125054119 | + | ENST00000297908; ENST00000344641; ENST00000373723; ENST00000373729; ENST00000394315 | chr9 | 125068067 | 125068171 | + | TSF |
| 3% | chr9 | 125054028 | 125054119 | + | ENST00000297908; ENST00000344641; ENST00000373723; ENST00000373729; ENST00000394315 | chr9 | 125068067 | 125068171 | + | TSF |
| 3% | chr9 | 125054028 | 125054119 | + | ENST00000297908; ENST00000344641; ENST00000373723; ENST00000373729; ENST00000394315 | chr9 | 125068067 | 125068171 | + | TSF |
| 3% | chr16 | 50666192 | 50666319 | + | ENST00000268459 | chr16 | 50682755 | 50682972 | + | TSF |
| 3% | chr17 | 79912179 | 179912132 | − | ENST00000409678 | chr17 | 79911834 | 79911647 | − | TSF |
| 3% | chr4 | 25759228 | 25759156 | − | ENST00000399878; ENST00000264868; ENST00000502949; ENST00000510448 | chr4 | 25723603 | 25723555 | − | TSF |
| 3% | chr4 | 25759228 | 25759156 | | ENST00000399878; ENST00000264868; ENST00000502949; ENST00000510448 | chr4 | 25723603 | 25723555 | − | TSF |
| 3% | chr4 | 25759228 | 25759156 | − | ENST00000399878; ENST00000264868 | chr4 | 25723603 | 25723555 | − | TSF |

TABLE 65-continued

Transcript fusion for Uterine Corpus Endometrial Carcinoma (UCEC)
Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 3% | chr4 | 25759228 | 25759156 | − | ENST00000502949; ENST00000510448 ENST00000399878; ENST00000264868; ENST00000502949; ENST00000510448 | chr4 | 25723603 | 25723555 | − | TSF |
| 3% | chr6 | 110567463 | 110567335 | − | ENST00000338882 | chr6 | 110565813 | 110565664 | − | TSF |

TABLE 66

Transcript fusion for Uterine Corpus Endometrial Carcinoma (UCEC) Coordinates of the fusion sequences for which the donor is the TE.

| 1 | 2' | 3' | 4' | 5' | 6' | 7 | 8' | 9' | 10' | 11' |
|---|---|---|---|---|---|---|---|---|---|---|
| 39% | chr8 | 27947459 | 27947920 | + | chr8 | 27954736 | 27954835 | + | ENST00000256398; ENST00000523687; ENST00000518112 | TAF |
| 39% | chr8 | 27947459 | 27947920 | + | chr8 | 27954736 | 27954835 | + | ENST00000256398; ENST00000523687; ENST00000518112 | TAF |
| 36% | chr5 | 54528691 | 54528595 | − | chr5 | 54528374 | 54528189 | − | ENST00000282572 | TAF |
| 35% | chr22 | 22899971 | 22899965 | − | chr22 | 22893511 | 22893189; 22893185; 22893481; 22893274 | − | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |
| 35% | chr22 | 22899971 | 22899965 | − | chr22 | 22893511 | 22893189; 22893185; 22893481; 22893274 | − | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |
| 35% | chr22 | 22899971 | 22899965 | − | chr22 | 22893511 | 22893189; 22893185; 22893481; 22893274 | − | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |
| 35% | chr22 | 22899971 | 22899965 | − | chr22 | 22893511 | 22893189; 22893185; 22893481; 22893274 | − | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |
| 35% | chr22 | 22899971 | 22899965 | − | chr22 | 22893511 | 22893189; 22893185; 22893481; 22893274 | − | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |
| 35% | chr22 | 22899971 | 22899965 | − | chr22 | 22893511 | 22893189; 22893185; 22893481; 22893274 | − | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |
| 32% | chr19 | 49121994 | 49121817 | − | chr19 | 49121134 | 49121048 | − | ENST00000549920; ENST00000547897; ENST00000084795; ENST00000550645; ENST00000549370; ENST00000549273 | TAF |
| 32% | chr19 | 49121994 | 49121817 | − | chr19 | 49121134 | 49121048 | − | ENST00000549920; ENST00000547897; ENST00000084795; ENST00000550645; ENST00000549370; ENST00000549273 | TAF |
| 32% | chr19 | 49121994 | 49121817 | − | chr19 | 49121134 | 49121048 | − | ENST00000549920; ENST00000547897; ENST00000084795; ENST00000550645; ENST00000549370; ENST00000549273 | TAF |
| 32% | chr19 | 49121994 | 49121817 | − | chr19 | 49121134 | 49121048 | − | ENST00000549920; ENST00000547897; ENST00000084795; ENST00000550645; ENST00000549370; ENST00000549273 | TAF |
| 32% | chr19 | 49121994 | 49121817 | − | chr19 | 49121134 | 49121048 | − | ENST00000549920; ENST00000547897; ENST00000084795; ENST00000550645; ENST00000549370; ENST00000549273 | TAF |
| 28% | chr8 | 27947459 | 27947849 | + | chr8 | 27954736 | 27954835 | + | ENST00000256398; ENST00000523687; ENST00000518112 | TAF |
| 28% | chr8 | 27947459 | 27947849 | + | chr8 | 27954736 | 27954835 | + | ENST00000256398; ENST00000523687; ENST00000518112 | TAF |
| 26% | chr11 | 93468219 | 93468129 | − | chr11 | 93467826 | 93467791; 93467814 | − | ENST00000393259; ENST00000527169 | TAF |
| 26% | chr11 | 93468219 | 93468129 | − | chr11 | 93467826 | 93467791; 93467814 | − | ENST00000393259; ENST00000527169 | TAF |
| 23% | chr10 | 120902016 | 120901765 | − | chr10 | 120900831 | 120900754 | − | ENST00000355697; ENST00000330036 | TAF |
| 22% | chr1 | 46797740 | 46797497 | − | chr1 | 46764042 | 46763956 | − | ENST00000343304 | TAF |
| 22% | chr17 | 80440912 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |
| 22% | chr17 | 80440912 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |
| 22% | chr17 | 80440912 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |
| 22% | chr17 | 80440912 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |

TABLE 66-continued

Transcript fusion for Uterine Corpus Endometrial Carcinoma (UCEC) Coordinates of the fusion sequences for which the donor is the TE.

| 1 | 2' | 3' | 4' | 5' | 6' | 7 | 8' | 9' | 10' | 11' |
|---|---|---|---|---|---|---|---|---|---|---|
| 21% | chr17 | 79214190 | 79214239 | + | chr17 | 79214787 | 79214816; 79214953 | + | ENST00000431388; ENST00000576002 | TAF |
| 21% | chr17 | 79214190 | 79214239 | + | chr17 | 79214787 | 79214816; 79214953 | + | ENST00000431388; ENST00000576002 | TAF |
| 21% | chr12 | 6602868 | 6602840 | − | chr12 | 6602138 | 6602028 | − | ENST00000229238 | TAF |
| 20% | chr8 | 104389530 | 104389551 | + | chr8 | 104390255 | 104390471 | + | ENST00000330295; ENST00000520337 | TAF |
| 19% | chrX | 3773692 | 3773630 | − | chrX | 3735819 | 3735819 | − | ENST00000425492 | TAF |
| 18% | chr7 | 73098299 | 73098330 | + | chr7 | 73100966 | 73101061 | + | ENST00000265758; ENST00000432522; ENST00000421744; ENST00000428163; ENST00000423166; ENST00000423497 | TAF |
| 18% | chr7 | 73098299 | 73098330 | + | chr7 | 73100966 | 73101061 | + | ENST00000265758; ENST00000432522; ENST00000421744; ENST00000428163; ENST00000423166; ENST00000423497 | TAF |
| 18% | chr7 | 73098299 | 73098330 | + | chr7 | 73100966 | 73101061 | + | ENST00000265758; ENST00000432522; ENST00000421744; ENST00000428163; ENST00000423166; ENST00000423497 | TAF |
| 18% | chr7 | 73098299 | 73098330 | + | chr7 | 73100966 | 73101061 | + | ENST00000265758; ENST00000432522; ENST00000421744; ENST00000428163; ENST00000423166; ENST00000423497 | TAF |
| 17% | chr6 | 31154067 | 31153803 | − | chr6 | 31133824 | 31133704 | − | ENST00000259915 | TAF |
| 17% | chr7 | 56018506 | 56018522 | + | chr7 | 56020872 | 56021011 | + | ENST00000426595 | TSF |
| 16% | chr4 | 107241932 | 107242850 | + | chr4 | 107246142 | 107246275 | + | ENST00000394701 | TAF |
| 16% | chr19 | 54631006 | 54631115 | + | chr19 | 54631448 | 54631575 | + | ENST00000321030; ENST00000419967 | TAF |
| 16% | chr19 | 54631006 | 54631115 | + | chr19 | 54631448 | 54631575 | + | ENST00000321030; ENST00000419967 | TAF |
| 16% | chr7 | 150938296 | 150938250 | − | chr7 | 150937608 | 150937511 | − | ENST00000262188; ENST00000392811; ENST00000356800 | TAF |
| 15% | chrX | 71397824 | 71398498 | + | chrX | 71406311 | 71406384 | + | ENST00000218432; ENST00000423432; ENST00000373669; ENST00000496835; ENST00000439980; ENST00000446576 | TAF |
| 15% | chrX | 71397824 | 71398498 | + | chrX | 71406311 | 71406384 | + | ENST00000218432; ENST00000423432; ENST00000373669; ENST00000496835; ENST00000439980; ENST00000446576 | TAF |
| 15% | chrX | 71397824 | 71398498 | + | chrX | 71406311 | 71406384 | + | ENST00000218432; ENST00000423432; ENST00000373669; ENST00000496835; ENST00000439980; ENST00000446576 | TAF |
| 15% | chrX | 71397824 | 71398498 | + | chrX | 71406311 | 71406384 | + | ENST00000218432; ENST00000423432; ENST00000373669; ENST00000496835; ENST00000439980; ENST00000446576 | TAF |
| 14% | chr14 | 105944002 | 105944268 | + | chr14 | 105944603 | 105944697 | + | ENST00000483017; ENST00000329146 | TAF |
| 14% | chr14 | 105944002 | 105944232 | + | chr14 | 105944603 | 105944697 | + | ENST00000483017; ENST00000329146 | TAF |
| 14% | chr14 | 105944002 | 105944250 | + | chr14 | 105944603 | 105944697 | + | ENST00000483017; ENST00000329146 | TAF |
| 14% | chr1 | 40781678 | 40781517 | − | chr1 | 40781336 | 40781262 | − | ENST00000372748; ENST00000417105; ENST00000372736 | TAF |
| 14% | chr1 | 40781678 | 40781517 | − | chr1 | 40781336 | 40781262 | − | ENST00000372748; ENST00000417105; ENST00000372736 | TAF |
| 14% | chr1 | 40781678 | 40781517 | − | chr1 | 40781336 | 40781262 | − | ENST00000372748; ENST00000417105; ENST00000372736 | TAF |
| 14% | chr1 | 86821476 | 86821330 | − | chr1 | 86820542 | 86820457; 86820538 | − | ENST00000359242; ENST00000460698; ENST00000317336; ENST00000370567; ENST00000394731; ENST00000370566; ENST00000462648; ENST00000294678; ENST00000531412 | TAF |
| 14% | chr1 | 86821476 | 86821330 | − | chr1 | 86820542 | 86820457; 86820538 | − | ENST00000359242; ENST00000460698; ENST00000317336; ENST00000370567; ENST00000394731; ENST00000370566; ENST00000462648; ENST00000294678; ENST00000531412 | TAF |
| 14% | chr1 | 86821476 | 86821330 | − | chr1 | 86820542 | 86820457; 86820538 | − | ENST00000359242; ENST00000460698; ENST00000317336; ENST00000370567; ENST00000394731; ENST00000370566; ENST00000462648; ENST00000294678; ENST00000531412 | TAF |
| 14% | chr1 | 86821476 | 86821330 | − | chr1 | 86820542 | 86820457; 86820538 | − | ENST00000359242; ENST00000460698; ENST00000317336; ENST00000370567; ENST00000394731; ENST00000370566; ENST00000462648; ENST00000294678; ENST00000531412 | TAF |
| 14% | chr1 | 156025381 | 156025466 | + | chr1 | 156028106 | 156028162; 156028200 | + | ENST00000368305; ENST00000368304; ENST00000368302 | TAF |
| 14% | chr1 | 156025381 | 156025466 | + | chr1 | 156028106 | 156028162; 156028200 | + | ENST00000368305; ENST00000368304; ENST00000368302 | TAF |
| 14% | chr3 | 197680391 | 197680531 | + | chr3 | 197680874 | 197681018; 197680991 | + | ENST00000464167; ENST00000448864; ENST00000442341 | TAF |
| 14% | chr3 | 197680391 | 197680531 | + | chr3 | 197680874 | 197681018; 197680991 | + | ENST00000464167; ENST00000448864; ENST00000442341 | TAF |
| 14% | chr4 | 4864193 | 4864335 | + | chr4 | 4864428 | 4864870 | + | ENST00000382723 | TAF |
| 14% | chr8 | 39759879 | 39759967 | + | chr8 | 39775394 | 39775489; 39775448 | + | ENST00000518804; ENST00000519154; ENST00000522495; ENST00000522840; ENST00000518237; ENST00000253513 | TSF |
| 14% | chr8 | 39759879 | 39759967 | + | chr8 | 39775394 | 39775489; 39775448 | + | ENST00000518804; ENST00000519154; ENST00000522495; ENST00000522840; ENST00000518237; ENST00000253513 | TSF |
| 14% | chr8 | 39759879 | 39759967 | + | chr8 | 39775394 | 39775489; 39775448 | + | ENST00000518804; ENST00000519154; ENST00000522495; ENST00000522840; ENST00000518237; ENST00000253513 | TSF |
| 14% | chr8 | 39759879 | 39759967 | + | chr8 | 39775394 | 39775489; 39775448 | + | ENST00000518804; ENST00000519154; ENST00000522495; ENST00000522840; ENST00000518237; ENST00000253513 | TSF |
| 14% | chr8 | 39759879 | 39759967 | + | chr8 | 39775394 | 39775489; 39775448 | + | ENST00000518804; ENST00000519154; ENST00000522495; ENST00000522840; ENST00000518237; ENST00000253513 | TSF |
| 13% | chr9 | 130569975 | 130570054 | + | chr9 | 130570513 | 130570590; 130570580 | + | ENST00000373247; ENST00000373245; ENST00000393706; ENST00000373228; ENST00000373225; ENST00000431857; ENST00000423577 | TAF |
| 13% | chr9 | 130569975 | 130570054 | + | chr9 | 130570513 | 130570590; 130570580 | + | ENST00000373247; ENST00000373245; ENST00000393706; ENST00000373228; ENST00000373225; ENST00000431857; ENST00000423577 | TAF |
| 13% | chr9 | 130569975 | 130570054 | + | chr9 | 130570513 | 130570590; 130570580 | + | ENST00000373247; ENST00000373245; ENST00000393706; ENST00000373228; ENST00000373225; ENST00000431857; | TAF |

TABLE 66-continued

Transcript fusion for Uterine Corpus Endometrial Carcinoma (UCEC) Coordinates of the fusion sequences for which the donor is the TE.

| 1 | 2' | 3' | 4' | 5' | 6' | 7 | 8' | 9' | 10' | 11' |
|---|---|---|---|---|---|---|---|---|---|---|
| 13% | chr9 | 130569975 | 130570054 | + | chr9 | 130570513 | 130570590; 130570580 | + | ENST00000423577 ENST00000373247; ENST00000373245; ENST00000393706; ENST00000373228; ENST00000373225; ENST00000431857; ENST00000423577 | TAF |
| 13% | chrX | 129264697 | 129264593 | − | chrX | 129264141 | 129263945 | − | ENST00000440263; ENST00000460436; ENST00000346424; ENST00000319908; ENST00000287295 | TAF |
| 12% | chr19 | 42335927 | 42335940 | + | chr19 | 42364892 | 42364915 | + | ENST00000598742; ENST00000601492; ENST00000600467; ENST00000593863; ENST00000598261; ENST00000598399 | TAF |
| 12% | chr19 | 42335927 | 42335940 | + | chr19 | 42364892 | 42364915 | + | ENST00000598742; ENST00000601492; ENST00000600467; ENST00000593863; ENST00000598261; ENST00000598399 | TAF |
| 12% | chr19 | 42335927 | 42335940 | + | chr19 | 42364892 | 42364915 | + | ENST00000598742; ENST00000601492; ENST00000600467; ENST00000593863; ENST00000598261; ENST00000598399 | TAF |
| 12% | chr19 | 42335927 | 42335940 | + | chr19 | 42364892 | 42364915 | + | ENST00000598742; ENST00000601492; ENST00000600467; ENST00000593863; ENST00000598261; ENST00000598399 | TAF |
| 12% | chr19 | 42335927 | 42335940 | + | chr19 | 42364892 | 42364915 | + | ENST00000598742; ENST00000601492; ENST00000600467; ENST00000593863; ENST00000598261; ENST00000598399 | TAF |
| 12% | chr4 | 4437494 | 4437287 | − | chr4 | 4436585 | 4436497 | − | ENST00000505286; ENST00000306200; ENST00000503861; ENST00000512195; ENST00000507908 | TAF |
| 12% | chr4 | 4437494 | 4437287 | − | chr4 | 4436585 | 4436497 | − | ENST00000505286; ENST00000306200; ENST00000503861; ENST00000512195; ENST00000507908 | TAF |
| 12% | chr4 | 4437494 | 4437287 | − | chr4 | 4436585 | 4436497 | − | ENST00000505286; ENST00000306200; ENST00000503861; ENST00000512195; ENST00000507908 | TAF |
| 12% | chr4 | 4437494 | 4437287 | − | chr4 | 4436585 | 4436497 | − | ENST00000505286; ENST00000306200; ENST00000503861; ENST00000512195; ENST00000507908 | TAF |
| 12% | chr4 | 4437494 | 4437287 | − | chr4 | 4436585 | 4436497 | − | ENST00000505286; ENST00000306200; ENST00000503861; ENST00000512195; ENST00000507908 | TAF |
| 12% | chr7 | 74158449 | 74158566 | + | chr7 | 74159097 | 74159280 | + | ENST00000324896; ENST00000346152; ENST00000353920; ENST00000416070 | TAF |
| 12% | chr14 | 105944002 | 105944214 | + | chr14 | 105944603 | 105944697 | + | ENST00000483017; ENST00000329146 | TAF |
| 12% | chr17 | 79911953 | 79911734 | − | chr17 | 79911143 | 79910837 | − | ENST00000409678 | TAF |
| 12% | chr1 | 206288369 | 206288105 | − | chr1 | 206243250 | 206243150 | − | ENST00000331555 | TSF |
| 11% | chr1 | 21901654 | 21901670 | + | chr1 | 21902226 | 21902417 | + | ENST00000539907; ENST00000540617; ENST00000374840; ENST00000374832; ENST00000425315 | TAF |
| 11% | chr2 | 133363747 | 133363763 | + | chr2 | 133402674 | 133403179 | + | ENST00000329321 | TAF |
| 11% | chr12 | 64687157 | 64687061 | − | chr12 | 64679840 | 64679734 | − | ENST00000543942; ENST00000333722 | TAF |
| 10% | chr1 | 165863702 | 165863816 | + | chr1 | 165865427 | 165865569 | + | ENST00000367879 | TAF |
| 10% | chr14 | 102691697 | 102691432 | − | chr14 | 102691131 | 102691116 | − | ENST00000559838 | TAF |
| 10% | chr20 | 43919547 | 43919514 | − | chr20 | 43882476 | 43882216 | − | ENST00000338380 | TAF |
| 10% | chr19 | 39347374 | 39346430 | − | chr19 | 39338074 | 39337956 | − | ENST00000221419; ENST00000601449; ENST00000600233; ENST00000601813 | TSF |
| 10% | chr19 | 39347374 | 39346430 | − | chr19 | 39338074 | 39337956 | − | ENST00000221419; ENST00000601449; ENST00000600233; ENST00000601813 | TSF |
| 10% | chr19 | 39347374 | 39346430 | − | chr19 | 39338074 | 39337956 | − | ENST00000221419; ENST00000601449; ENST00000600233; ENST00000601813 | TSF |
| 10% | chr19 | 39347374 | 39346206 | − | chr19 | 39338074 | 39337956 | − | ENST00000221419; ENST00000601449; ENST00000600233; ENST00000601813 | TSF |
| 10% | chr19 | 39347374 | 39346206 | − | chr19 | 39338074 | 39337956 | − | ENST00000221419; ENST00000601449; ENST00000600233; ENST00000601813 | TSF |
| 10% | chr19 | 39347374 | 39346206 | − | chr19 | 39338074 | 39337956 | − | ENST00000221419; ENST00000601449; ENST00000600233; ENST00000601813 | TSF |
| 8% | chr1 | 169819657 | 169819707 | + | chr1 | 169820958 | 169821077 | + | ENST00000359326; ENST00000286031 | TSF |
| 8% | chr19 | 50174724 | 50174836 | + | chr19 | 50176955 | 50177005; 50177034 | + | ENST00000441864; ENST00000246785; ENST00000600947; ENST00000598306 | TSF |
| 8% | chr19 | 50174724 | 50174836 | + | chr19 | 50176955 | 50177005; 50177034 | + | ENST00000441864; ENST00000246785; ENST00000600947; ENST00000598306 | TSF |
| 8% | chr19 | 50391349 | 50391391 | + | chr19 | 50391488 | 50391574 | + | ENST00000221543; ENST00000535102 | TSF |
| 8% | chr4 | 4475319 | 4475221 | − | chr4 | 4473433 | 4473366 | − | ENST00000505286; ENST00000306200 | TSF |
| 8% | chr4 | 4475319 | 4475221 | − | chr4 | 4473433 | 4473366 | − | ENST00000505286; ENST00000306200 | TSF |
| 7% | chr6 | 80022917 | 80022085 | − | chr6 | 79924739 | 79924689 | − | ENST00000275036; ENST00000344726 | TSF |
| 7% | chr6 | 80022917 | 80022085 | − | chr6 | 79924739 | 79924689 | − | ENST00000275036; ENST00000344726 | TSF |
| 7% | chrX | 3812116 | 3812054 | − | chrX | 3735819 | 3735816 | − | ENST00000425492 | TSF |
| 6% | chr12 | 105386081 | 105386186 | + | chr12 | 105388256 | 105388474; 105388257 | + | ENST00000552951; ENST00000280749 | TSF |
| 6% | chr12 | 105386081 | 105386186 | + | chr12 | 105388256 | 105388474; 105388257 | + | ENST00000552951; ENST00000280749 | TSF |
| 6% | chr8 | 74036014 | 74035742 | − | chr8 | 73993448 | 73993254 | − | ENST00000297354 | TSF |
| 6% | chr22 | 42511426 | 42511212 | − | chr22 | 42483179 | 42483064 | − | ENST00000602404; ENST00000498737 | TSF |
| 5% | chr11 | 60694460 | 60694542 | + | chr11 | 60694676 | 60694890 | + | ENST00000453848; ENST00000005286 | TSF |
| 5% | chr11 | 60694460 | 60694542 | + | chr11 | 60694676 | 60694890 | + | ENST00000453848; ENST00000005286 | TSF |
| 5% | chr17 | 39976225 | 39976301 | + | chr17 | 39976521 | 39976713 | + | ENST00000321562; ENST00000455106; ENST00000544340 | TSF |
| 5% | chr19 | 1114930 | 1114676 | − | chr19 | 1114421 | 1114230 | − | ENST00000361757; ENST00000587024; ENST00000438103 | TSF |
| 5% | chr8 | 39766308 | 39766549 | + | chr8 | 39775394 | 39775489; 39775448 | + | ENST00000518804; ENST00000519154; ENST00000522495; ENST00000522840; ENST00000518237; ENST00000253513 | TSF |
| 5% | chr8 | 39766308 | 39766549 | + | chr8 | 39775394 | 39775489; 39775448 | + | ENST00000518804; ENST00000519154; ENST00000522495; ENST00000522840; ENST00000518237; ENST00000253513 | TSF |
| 5% | chr8 | 39766308 | 39766549 | + | chr8 | 39775394 | 39775489; | + | ENST00000518804; ENST00000519154; ENST00000522495; | TSF |

TABLE 66-continued

Transcript fusion for Uterine Corpus Endometrial Carcinoma (UCEC) Coordinates of the fusion sequences for which the donor is the TE.

| 1 | 2' | 3' | 4' | 5' | 6' | 7 | 8' | 9' | 10' | 11' |
|---|---|---|---|---|---|---|---|---|---|---|
| 5% | chr8 | 39766308 | 39766549 | + | chr8 | 39775394 | 39775448 39775489; 39775448 | + | ENST00000522840; ENST00000518237; ENST00000253513 ENST00000518804; ENST00000519154; ENST00000522495; ENST00000522840; ENST00000518237; ENST00000253513 | TSF |
| 5% | chr8 | 39766308 | 39766549 | + | chr8 | 39775394 | 39775489; 39775448 | + | ENST00000518804; ENST00000519154; ENST00000522495; ENST00000522840; ENST00000518237; ENST00000253513 | TSF |
| 5% | chr17 | 39974832 | 39974893 | + | chr17 | 39975462 | 39975651 | + | ENST00000321562 | TSF |
| 4% | chr19 | 49847402 | 49847303 | − | chr19 | 49846655 | 49846488 | − | ENST00000598810; ENST00000593945; ENST00000601519; ENST00000311227; ENST00000377214; ENST00000539846 | TSF |
| 4% | chr17 | 13442614 | 13442384 | − | chr17 | 13400135 | 13399514 | − | ENST00000284110 | TSF |
| 4% | chr12 | 6602868 | 6602754 | − | chr12 | 6602138 | 6602028 | − | ENST00000229238 | TSF |
| 4% | chr22 | 29117574 | 29117506 | − | chr22 | 29115473 | 29115383; 29115458 | − | ENST00000348295; ENST00000382566; ENST00000382578; ENST00000404276; ENST00000328354; ENST00000405598; ENST00000382580; ENST00000433728; ENST00000448511; ENST00000402731; ENST00000403642; ENST00000439200 | TSF |
| 4% | chr22 | 29117574 | 29117506 | − | chr22 | 29115473 | 29115383; 29115458 | − | ENST00000348295; ENST00000382566; ENST00000382578; ENST00000404276; ENST00000328354; ENST00000405598; ENST00000382580; ENST00000433728; ENST00000448511; ENST00000402731; ENST00000403642; ENST00000439200 | TSF |
| 4% | chr22 | 29117574 | 29117506 | − | chr22 | 29115473 | 29115383; 29115458 | − | ENST00000348295; ENST00000382566; ENST00000382578; ENST00000404276; ENST00000328354; ENST00000405598; ENST00000382580; ENST00000433728; ENST00000448511; ENST00000402731; ENST00000403642; ENST00000439200 | TSF |
| 4% | chr22 | 29117574 | 29117506 | − | chr22 | 29115473 | 29115383; 29115458 | − | ENST00000348295; ENST00000382566; ENST00000382578; ENST00000404276; ENST00000328354; ENST00000405598; ENST00000382580; ENST00000433728; ENST00000448511; ENST00000402731; ENST00000403642; ENST00000439200 | TSF |
| 4% | chr22 | 29117574 | 29117506 | − | chr22 | 29115473 | 29115383; 29115458 | − | ENST00000348295; ENST00000382566; ENST00000382578; ENST00000404276; ENST00000328354; ENST00000405598; ENST00000382580; ENST00000433728; ENST00000448511; ENST00000402731; ENST00000403642; ENST00000439200 | TSF |
| 4% | chr20 | 110606 | 110697 | + | chr20 | 126056 | 126333 | + | ENST00000382398 | TSF |
| 4% | chr8 | 39766308 | 39766867 | + | chr8 | 39775394 | 39775489; 39775448 | + | ENST00000518804; ENST00000519154; ENST00000522495; ENST00000522840; ENST00000518237; ENST00000253513 | TSF |
| 4% | chr8 | 39766308 | 39766867 | + | chr8 | 39775394 | 39775489; 39775448 | + | ENST00000518804; ENST00000519154; ENST00000522495; ENST00000522840; ENST00000518237; ENST00000253513 | TSF |
| 4% | chr8 | 39766308 | 39766867 | + | chr8 | 39775394 | 39775489; 39775448 | + | ENST00000518804; ENST00000519154; ENST00000522495; ENST00000522840; ENST00000518237; ENST00000253513 | TSF |
| 4% | chr8 | 39766308 | 39766867 | + | chr8 | 39775394 | 39775489; 39775448 | + | ENST00000518804; ENST00000519154; ENST00000522495; ENST00000522840; ENST00000518237; ENST00000253513 | TSF |
| 4% | chr8 | 39766308 | 39766867 | + | chr8 | 39775394 | 39775489; 39775448 | + | ENST00000518804; ENST00000519154; ENST00000522495; ENST00000522840; ENST00000518237; ENST00000253513 | TSF |
| 4% | chr1 | 1422590 | 1422685 | + | chr1 | 1423243 | 1423294 | + | ENST00000308647 | TSF |
| 4% | chr18 | 51273 | 49727 | − | chr18 | 49237 | 49129 | − | ENST00000308911 | TSF |
| 4% | chr2 | 38983894 | 38983253 | − | chr2 | 38977336 | 38977156 | − | ENST00000313117; ENST00000425778; ENST00000425941; ENST00000446327; ENST00000409276; ENST00000431066; ENST00000443213 | TSF |
| 4% | chr2 | 38983894 | 38983253 | − | chr2 | 38977336 | 38977156 | − | ENST00000313117; ENST00000425778; ENST00000425941; ENST00000446327; ENST00000409276; ENST00000431066; ENST00000443213 | TSF |
| 4% | chr2 | 38983894 | 38983253 | − | chr2 | 38977336 | 38977156 | − | ENST00000313117; ENST00000425778; ENST00000425941; ENST00000446327; ENST00000409276; ENST00000431066; ENST00000443213 | TSF |
| 4% | chr2 | 38983894 | 38983253 | − | chr2 | 38977336 | 38977156 | − | ENST00000313117; ENST00000425778; ENST00000425941; ENST00000446327; ENST00000409276; ENST00000431066; ENST00000443213 | TSF |
| 4% | chr2 | 38983894 | 38983253 | − | chr2 | 38977336 | 38977156 | − | ENST00000313117; ENST00000425778; ENST00000425941; ENST00000446327; ENST00000409276; ENST00000431066; ENST00000443213 | TSF |
| 4% | chr15 | 74475607 | 74475594 | − | chr15 | 74474801 | 74474684 | − | ENST00000395105; ENST00000423167; ENST00000323940; ENST00000449139; ENST00000416286; ENST00000535552; ENST00000563965; ENST00000574278; ENST00000572785 | TSF |
| 4% | chr15 | 74475607 | 74475594 | − | chr15 | 74474801 | 74474684 | − | ENST00000395105; ENST00000423167; ENST00000323940; ENST00000449139; ENST00000416286; ENST00000535552; ENST00000563965; ENST00000574278; ENST00000572785 | TSF |
| 3% | chr7 | 56018506 | 56018522 | + | chr7 | 56022602 | 56022871; 56022865 | + | ENST00000426595; ENST00000285298; ENST00000443449 | TSF |
| 3% | chr7 | 56018506 | 56018522 | + | chr7 | 56022602 | 56022871; 56022865 | + | ENST00000426595; ENST00000285298; ENST00000443449 | TSF |
| 3% | chr1 | 156716197 | 156716133 | − | chr1 | 156715165 | 156715089 | − | ENST00000357325; ENST00000537739; ENST00000368209; ENST00000368206 | TSF |
| 3% | chr4 | 4508675 | 4508569 | − | chr4 | 14473433 | 4473366 | − | ENST00000505286; ENST00000306200 | TSF |
| 3% | chr4 | 4508675 | 4508569 | − | chr4 | 14473433 | 4473366 | − | ENST00000505286; ENST00000306200 | TSF |
| 3% | chr15 | 93253529 | 93253499 | − | chr15 | 93173575 | 93173444 | − | ENST00000327355 | TSF |
| 3% | chr11 | 60663653 | 60661987 | − | chr11 | 60658735 | 60658638 | − | ENST00000227524; ENST00000535326 | TSF |
| 3% | chr3 | 13918009 | 13917401 | − | chr3 | 13916670 | 13916444 | − | ENST00000285018 | TSF |

TABLE 67

Transcript fusion for Uterine Carcinosarcoma (UCS) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 33% | chr15 | 79054907 | 79054745 | − | ENST00000388820 | chr15 | 79054428 | 79054400 | − | TAF |
| 32% | chr6 | 10749855; 10749898 | 10749931 | + | ENST00000379542; ENST00000473166; ENST00000463448; ENST00000460341; ENST00000480294; ENST00000473807; ENST00000461342; ENST00000475942; ENST00000379530; ENST00000463100; ENST00000481240; ENST00000467317; ENST00000478732 | chr6 | 10829240 | 10829256 | + | TAF |
| 32% | chr6 | 10749855; 10749898 | 10749931 | + | ENST00000379542; ENST00000473166; ENST00000463448; ENST00000460341; ENST00000480294; ENST00000473807; ENST00000461342; ENST00000475942; ENST00000379530; ENST00000463100; ENST00000481240; ENST00000467317; ENST00000478732 | chr6 | 10829240 | 10829256 | + | TAF |
| 30% | chr4 | 5317425 | 1742713 | + | ENST00000313288 | chr4 | 1745122 | 1745307 | + | TAF |
| 26% | chr12 | 6943089 | 6943213 | + | ENST00000251761; ENST00000396725; ENST00000606935 | chr12 | 6943989 | 6944119 | + | TAF |
| 26% | chr12 | 6943089 | 6943213 | + | ENST00000251761; ENST00000396725; ENST00000606935 | chr12 | 6943989 | 6944119 | + | TAF |
| 26% | chr12 | 6943089 | 6943213 | + | ENST00000251761; ENST00000396725; ENST00000606935 | chr12 | 6943989 | 6944119 | + | TAF |
| 25% | chr19 | 35514331 | 35514451 | + | ENST00000599564; ENST00000317991; ENST00000504615; ENST00000411896 | chr19 | 35514601 | 35514631 | + | TAF |
| 25% | chr19 | 35514331 | 35514451 | + | ENST00000599564; ENST00000317991; ENST00000504615; ENST00000411896 | chr19 | 35514601 | 35514631 | + | TAF |
| 25% | chr19 | 35514331 | 35514451 | + | ENST00000599564; ENST00000317991; ENST00000504615; ENST00000411896 | chr19 | 35514601 | 35514631 | + | TAF |
| 25% | chr19 | 35514331 | 35514451 | + | ENST00000599564; ENST00000317991; ENST00000504615; ENST00000411896 | chr19 | 35514601 | 35514631 | + | TAF |
| 23% | chr16 | 30783410 | 30783511 | + | ENST00000324685; ENST00000402121; ENST00000563683; ENST00000357890 | chr16 | 30785136 | 30785155 | + | TSF |
| 23% | chr16 | 30783410 | 30783511 | + | ENST00000324685; ENST00000402121; ENST00000563683; ENST00000357890 | chr16 | 30785136 | 30785155 | + | TSF |
| 23% | chr16 | 30783410 | 30783511 | + | ENST00000324685; ENST00000402121; ENST00000563683; ENST00000357890 | chr16 | 30785136 | 30785155 | + | TSF |
| 23% | chr16 | 30783410 | 30783511 | + | ENST00000324685; ENST00000402121; ENST00000563683; ENST00000357890 | chr16 | 30785136 | 30785155 | + | TSF |
| 19% | chr19 | 39077165 | 39077216 | + | ENST00000355481; ENST00000360985; ENST00000359596 | chr19 | 39085644 | 39085967 | + | TAF |
| 19% | chr19 | 39077165 | 39077216 | + | ENST00000355481; ENST00000360985; ENST00000359596 | chr19 | 39085644 | 39085967 | + | TAF |
| 19% | chr19 | 39077165 | 39077216 | + | ENST00000355481; ENST00000360985; ENST00000359596 | chr19 | 39085644 | 39085967 | + | TAF |
| 19% | chr2 | 220239744 | 220239577 | − | ENST00000355481; ENST00000360985; ENST00000359596 | chr2 | 220227530 | 220227195 | − | TAF |
| 19% | chr2 | 220239744 | 220239577 | − | ENST00000355481; ENST00000360985; ENST00000359596 | chr2 | 220227530 | 220227195 | − | TAF |
| 19% | chr2 | 220239744 | 220239577 | − | ENST00000355481; ENST00000360985; ENST00000359596 | chr2 | 220227530 | 220227195 | − | TAF |
| 18% | chr1 | 11115983; 11115877 | 11115838 | − | ENST00000376957; ENST00000490101 | chr1 | 11115464 | 11115178 | − | TSF |
| 18% | chr1 | 11115983; 11115877 | 11115838 | − | ENST00000376957; ENST00000490101 | chr1 | 11115464 | 11115178 | − | TSF |
| 16% | chr1 | 32696528 | 32696620 | + | ENST00000373586 | chr1 | 32696861 | 32697110 | + | TAF |
| 16% | chr7 | 27582719 | 27582586 | − | ENST00000265395; ENST00000425715 | chr7 | 27581374 | 27579272 | − | TAF |
| 16% | chr7 | 27582719 | 27582586 | − | ENST00000265395; ENST00000425715 | chr7 | 27581374 | 27579272 | − | TAF |
| 16% | chr12 | 71928895 | 71928966 | + | ENST00000266674; ENST00000536515; ENST00000540815 | chr12 | 71938771 | 719 38901 | + | TSF |
| 12% | chr12 | 64833024 | 64833095 | + | ENST00000332707 | chr12 | 64833417 | 64833459 | + | TAF |
| 12% | chr6 | 41606488 | 41606563 | + | ENST00000432027; ENST00000419164; ENST00000373051; ENST00000441667; ENST00000230321; ENST00000373050; ENST00000446650; ENST00000435476 | chr6 | 41607515 | 41607595 | + | TAF |
| 12% | chr14 | 101200486 | 101200513 | + | ENST00000341267; ENST00000331224 | chr14 | 101473144 | 101473392 | + | TAF |
| 12% | chr5 | 131593428 | 131593520 | + | ENST00000253754; ENST00000379018 | chr5 | 131596019 | 131596316 | + | TAF |
| 12% | chr4 | 536612008 | 120085549 | + | ENST00000307128 | chr4 | 120089717 | 120089827 | + | TAF |
| 12% | chr20 | 53092486 | 53092551 | + | ENST00000262593 | chr20 | 53111339 | 53111426 | + | TAF |
| 12% | chr20 | 33439171 | 33439034 | − | ENST00000336431 | chr20 | 33438000 | 33437979 | − | TAF |
| 12% | chr10 | 120905865 | 120905748 | − | ENST00000355697; ENST00000330036 | chr10 | 120901885 | 120901741 | − | TAF |
| 12% | chr10 | 120905865 | 120905748 | − | ENST00000355697; ENST00000330036 | chr10 | 120901885 | 120901741 | − | TAF |
| 12% | chr19 | 39390161 | 39390146 | − | ENST00000249396; ENST00000358931; ENST00000443898 | chr19 | 39389554 | 39389434 | − | TAF |
| 12% | chr1 | 38532560 | 32560572 | + | ENST00000336294; ENST00000373634; ENST00000427288 | chr1 | 32561261 | 32561358 | + | TAF |
| 12% | chr1 | 38532560 | 32560572 | + | ENST00000336294; ENST00000373634 | chr1 | 32561261 | 32561358 | + | TAF |

TABLE 67-continued

Transcript fusion for Uterine Carcinosarcoma (UCS) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 12% | chr1 | 32560385 | 32560572 | + | ENST00000427288 ENST00000336294; ENST00000373634; ENST00000427288 | chr1 | 32561261 | 32561358 | + | TSF |
| 11% | chr13 | 115030625 | 115030715 | + | ENST00000360383; ENST00000375312; ENST00000356221; ENST00000375310; ENST00000252457; ENST00000375308; ENST00000252458 | chr13 | 115035038 | 115035171 | + | TAF |
| 11% | chr13 | 115030625 | 115030715 | + | ENST00000360383; ENST00000375312; ENST00000356221; ENST00000375310; ENST00000252457; ENST00000375308; ENST00000252458 | chr13 | 115035038 | 115035171 | + | TAF |
| 11% | chr13 | 115030625 | 115030715 | + | ENST00000360383; ENST00000375312; ENST00000356221; ENST00000375310; ENST00000252457; ENST00000375308; ENST00000252458 | chr13 | 115035038 | 115035171 | + | TAF |
| 11% | chr13 | 115030625 | 115030715 | + | ENST00000360383; ENST00000375312; ENST00000356221; ENST00000375310; ENST00000252457; ENST00000375308; ENST00000252458 | chr13 | 115035038 | 1151035171 | + | TAF |
| 11% | chr20 | 43560983 | 43561073 | + | ENST00000255136; ENST00000217073 | chr20 | 43561176 | 43561224 | + | TAF |
| 11% | chr19 | 44129402 | 44129230 | – | ENST00000222374 | chr19 | 44129055 | 44128921 | – | TAF |
| 11% | chrX | 152730513 | 152730446 | – | ENST00000370211; ENST00000370212; ENST00000370210 | chrX | 152728559 | 152728505 | – | TAF |
| 11% | chrX | 152730513 | 152730446 | – | ENST00000370211; ENST00000370212; ENST00000370210 | chrX | 152728559 | 152728505 | – | TAF |
| 11% | chr13 | 96505911 | 96505797 | – | ENST00000376747 | chr13 | 96498149 | 96497437 | – | TAF |
| 11% | chr2 | 217366064 | 217366082 | + | ENST00000491306; ENST00000456586 | chr2 | 217393993 | 217394327 | + | TSF |
| 11% | chr2 | 217366064 | 217366082 | + | ENST00000491306; ENST00000456586 | chr2 | 217393993 | 217394327 | + | TSF |
| 11% | chr3 | 8775563 | 8775676 | + | ENST00000343849; ENST00000397368 | chr3 | 8819163 | 8819386 | + | TSF |
| 11% | chr19 | 50213980 | 50214114 | + | ENST00000323446; ENST00000392518; ENST00000354199; ENST00000598293; ENST00000405931; ENST00000595031 | chr19 | 50214968 | 50214999 | + | TSF |
| 11% | chr19 | 50213980 | 50214114 | + | ENST00000323446; ENST00000392518; ENST00000354199; ENST00000598293; ENST00000405931; ENST00000595031 | chr19 | 50214968 | 50214999 | + | TSF |
| 11% | chr19 | 50213980 | 50214114 | + | ENST00000323446; ENST00000392518; ENST00000354199; ENST00000598293; ENST00000405931; ENST00000595031 | chr19 | 50214968 | 50214999 | + | TSF |
| 11% | chr6 | 43005749 | 43005597 | – | ENST00000265348; ENST00000535468 | chr6 | 43005086 | 43004995 | – | TSF |
| 11% | chr6 | 43005749 | 43005597 | – | ENST00000265348; ENST00000535468 | chr6 | 43005086 | 43004995 | – | TSF |

TABLE 68

Transcript fusion for Uterine Carcinosarcoma (UCS) Coordinates of the fusion sequences for which the donor is the TE.

| 1+B2: L152 | 2' | 3' | 4' | 5' | 6' | 7' | 8' | 9' | 10' | 11' |
|---|---|---|---|---|---|---|---|---|---|---|
| 70% | chr8 | 104389530 | 104389551 | + | chr8 | 104390255 | 104390471 | + | ENST00000330295; ENST00000520337 | TAF |
| 51% | chr3 | 197680391 | 197680531 | + | chr3 | 197680874 | 197681018; 197680991 | + | ENST00000464167; ENST00000448864; ENST00000442341 | TAF |
| 51% | chr3 | 197680391 | 197680531 | + | chr3 | 197680874 | 197681018; 197680991 | + | ENST00000464167; ENST00000448864; ENST00000442341 | TAF |
| 46% | chr7 | 150938296 | 150938250 | – | chr7 | 150937608 | 150937511 | – | ENST00000262188; ENST00000392811; ENST00000356800 | TAF |
| 44% | chr19 | 49121994 | 49121817 | – | chr19 | 49121134 | 49121048 | – | ENST00000549920; ENST00000547897; ENST00000084795; ENST00000550645; ENST00000549370; ENST00000549273 | TAF |
| 44% | chr19 | 49121994 | 49121817 | – | chr19 | 49121134 | 49121048 | – | ENST00000549920; ENST00000547897; ENST00000084795; ENST00000550645; ENST00000549370; ENST00000549273 | TAF |
| 44% | chr19 | 49121994 | 49121817 | – | chr19 | 49121134 | 49121048 | – | ENST00000549920; ENST00000547897; ENST00000084795; ENST00000550645; ENST00000549370; ENST00000549273 | TAF |
| 44% | chr19 | 49121994 | 49121817 | – | chr19 | 49121134 | 49121048 | – | ENST00000549920; ENST00000547897; ENST00000084795; ENST00000550645; ENST00000549370; ENST00000549273 | TAF |
| 44% | chr19 | 49121994 | 49121817 | – | chr19 | 49121134 | 49121048 | – | ENST00000549920; ENST00000547897; ENST00000084795; ENST00000550645; ENST00000549370; ENST00000549273 | TAF |
| 44% | chr22 | 22899971 | 22899965 | – | chr22 | 22893511 | 22893189; 22893185; 22893481; 22893274 | – | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |
| 44% | chr22 | 22899971 | 22899965 | – | chr22 | 22893511 | 22893189; 22893185; 22893481; 22893274 | – | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |

TABLE 68-continued

Transcript fusion for Uterine Carcinosarcoma (UCS) Coordinates of the fusion sequences for which the donor is the TE.

| 1+B2: L152 | 2' | 3' | 4' | 5' | 6' | 7' | 8' | 9 | 10' | 11' |
|---|---|---|---|---|---|---|---|---|---|---|
| 44% | chr22 | 22899971 | 22899965 | – | chr22 | 22893511 | 22893189; 22893185; 22893481; 22893274 | – | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |
| 44% | chr22 | 22899971 | 22899965 | – | chr22 | 22893511 | 22893189; 22893185; 22893481; 22893274 | – | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |
| 44% | chr22 | 22899971 | 22899965 | – | chr22 | 22893511 | 22893189; 22893185; 22893481; 22893274 | – | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |
| 44% | chr22 | 22899971 | 22899965 | – | chr22 | 22893511 | 22893189; 22893185; 22893481; 22893274 | – | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |
| 44% | chr22 | 22899971 | 22899965 | – | chr22 | 22893511 | 22893189; 22893185; 22893481; 22893274 | – | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |
| 40% | chr7 | 73098299 | 73098330 | + | chr7 | 73100966 | 73101061 | + | ENST00000265758; ENST00000432522; ENST00000421744; ENST00000428163; ENST00000423166; ENST00000423497 | TAF |
| 40% | chr7 | 73098299 | 73098330 | + | chr7 | 73100966 | 73101061 | + | ENST00000265758; ENST00000432522; ENST00000421744; ENST00000428163; ENST00000423166; ENST00000423497 | TAF |
| 40% | chr7 | 73098299 | 73098330 | + | chr7 | 73100966 | 73101061 | + | ENST00000265758; ENST00000432522; ENST00000421744; ENST00000428163; ENST00000423166; ENST00000423497 | TAF |
| 40% | chr7 | 73098299 | 73098330 | + | chr7 | 73100966 | 73101061 | + | ENST00000265758; ENST00000432522; ENST00000421744; ENST00000428163; ENST00000423166; ENST00000423497 | TAF |
| 39% | chr17 | 80440912 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |
| 39% | chr17 | 80440912 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |
| 39% | chr17 | 80440912 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |
| 39% | chr17 | 80440912 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |
| 39% | chr11 | 93468219 | 93468129 | – | chr11 | 93467826 | 93467791; 93467814 | – | ENST00000393259; ENST00000527169 | TAF |
| 39% | chr11 | 93468219 | 93468129 | – | chr11 | 93467826 | 93467791; 93467814 | – | ENST00000393259; ENST00000527169 | TAF |
| 39% | chr12 | 6602868 | 6602840 | – | chr12 | 6602138 | 6602028 | – | ENST00000229238 | TAF |
| 32% | chr7 | 130127044 | 130127065 | + | chr7 | 130135209 | 130135363 | + | ENST00000223215; ENST00000437945 | TAF |
| 32% | chr7 | 130127044 | 130127065 | + | chr7 | 130135209 | 130135363 | + | ENST00000223215; ENST00000437945 | TAF |
| 30% | chr17 | 79214190 | 79214239 | + | chr17 | 79214787 | 79214816; 79214953 | + | ENST00000431388; ENST00000576002 | TAF |
| 30% | chr17 | 79214190 | 79214239 | + | chr17 | 79214787 | 79214816; 79214953 | + | ENST00000431388; ENST00000576002 | TAF |
| 30% | chr17 | 39976225 | 39976301 | + | chr17 | 39976521 | 39976713 | + | ENST00000321562; ENST00000455106; ENST00000544340 | TSF |
| 28% | chr9 | 131002678 | 131002811 | + | chr9 | 131004511 | 131004624 | + | ENST00000475805; ENST00000341179; ENST00000372923; ENST00000393594; ENST00000486160 | TAF |
| 28% | chr9 | 131002678 | 131002811 | + | chr9 | 131004511 | 131004624 | + | ENST00000475805; ENST00000341179; ENST00000372923; ENST00000393594; ENST00000486160 | TAF |
| 25% | chr1 | 240569724 | 240569786 | + | chr1 | 240601361 | 240601510 | + | ENST00000319653; ENST00000545751 | TAF |
| 25% | chr1 | 156025381 | 156025466 | + | chr1 | 156028106 | 156028162; 156028200 | + | ENST00000368305; ENST00000368304; ENST00000368302 | TAF |
| 25% | chr1 | 156025381 | 156025466 | + | chr1 | 156028106 | 156028162; 156028200 | + | ENST00000368305; ENST00000368304; ENST00000368302 | TAF |
| 25% | chr7 | 73466655 | 73466891 | + | chr7 | 73467493 | 73467639 | + | ENST00000445912; ENST00000252034; ENST00000358929; ENST00000320492; ENST00000414324; ENST00000380562; ENST00000380575; ENST00000380584; ENST00000458204; ENST00000357036; ENST00000429192; ENST00000380553; ENST00000380576; ENST00000320399 | TAF |
| 25% | chr7 | 73466655 | 73466891 | + | chr7 | 73467493 | 73467639 | + | ENST00000445912; ENST00000252034; ENST00000358929; ENST00000320492; ENST00000414324; ENST00000380562; ENST00000380575; ENST00000380584; ENST00000458204; ENST00000357036; ENST00000429192; ENST00000380553; ENST00000380576; ENST00000320399 | TAF |
| 25% | chr7 | 73466655 | 73466891 | + | chr7 | 73467493 | 73467639 | + | ENST00000445912; ENST00000252034; ENST00000358929; | TAF |

TABLE 68-continued

Transcript fusion for Uterine Carcinosarcoma (UCS) Coordinates of the fusion sequences for which the donor is the TE.

| 1+B2: L152 | 2' | 3' | 4' | 5' 6' | 7' | 8' | 9 | 10' | 11' |
|---|---|---|---|---|---|---|---|---|---|
| 25% | chr7 | 73466655 | 73466891 | + chr7 | 73467493 | 73467639 | + | ENST00000445912; ENST00000252034; ENST00000358929; ENST00000320492; ENST00000414324; ENST00000380562; ENST00000380575; ENST00000380584; ENST00000458204; ENST00000357036; ENST00000429192; ENST00000380553; ENST00000380576; ENST00000320399 | TAF |
| 25% | chr7 | 73466655 | 73466891 | + chr7 | 73467493 | 73467639 | + | ENST00000445912; ENST00000252034; ENST00000358929; ENST00000320492; ENST00000414324; ENST00000380562; ENST00000380575; ENST00000380584; ENST00000458204; ENST00000357036; ENST00000429192; ENST00000380553; ENST00000380576; ENST00000320399 | TAF |
| 25% | chr7 | 73466655 | 73466891 | + chr7 | 73467493 | 73467639 | + | ENST00000445912; ENST00000252034; ENST00000358929; ENST00000320492; ENST00000414324; ENST00000380562; ENST00000380575; ENST00000380584; ENST00000458204; ENST00000357036; ENST00000429192; ENST00000380553; ENST00000380576; ENST00000320399 | TAF |
| 25% | chr7 | 73466655 | 73466891 | + chr7 | 73467493 | 73467639 | + | ENST00000445912; ENST00000252034; ENST00000358929; ENST00000320492; ENST00000414324; ENST00000380562; ENST00000380575; ENST00000380584; ENST00000458204; ENST00000357036; ENST00000429192; ENST00000380553; ENST00000380576; ENST00000320399 | TAF |
| 25% | chr7 | 73466655 | 73466891 | + chr7 | 73467493 | 73467639 | + | ENST00000445912; ENST00000252034; ENST00000358929; ENST00000320492; ENST00000414324; ENST00000380562; ENST00000380575; ENST00000380584; ENST00000458204; ENST00000357036; ENST00000429192; ENST00000380553; ENST00000380576; ENST00000320399 | TAF |
| 25% | chr7 | 73466655 | 73466891 | + chr7 | 73467493 | 73467639 | + | ENST00000445912; ENST00000252034; ENST00000358929; ENST00000320492; ENST00000414324; ENST00000380562; ENST00000380575; ENST00000380584; ENST00000458204; ENST00000357036; ENST00000429192; ENST00000380553; ENST00000380576; ENST00000320399 | TAF |
| 25% | chr1 | 40781678 | 40781517 | − chr1 | 40781336 | 40781262 | − | ENST00000372748; ENST00000417105; ENST00000372736 | TAF |
| 25% | chr1 | 40781678 | 40781517 | − chr1 | 40781336 | 40781262 | − | ENST00000372748; ENST00000417105; ENST00000372736 | TAF |
| 25% | chr1 | 40781678 | 40781517 | − chr1 | 40781336 | 40781262 | − | ENST00000372748; ENST00000417105; ENST00000372736 | TAF |
| 23% | chr19 | 54631006 | 54631115 | + chr19 | 54631448 | 54631575 | + | ENST00000321030; ENST00000419967 | TAF |
| 23% | chr19 | 54631006 | 54631115 | + chr19 | 54631448 | 54631575 | + | ENST00000321030; ENST00000419967 | TAF |
| 23% | chr20 | 44453914 | 44453823 | − chr20 | 44453473 | 44453422 | − | ENST00000372555 | TAF |
| 21% | chrX | 48793481 | 48793462 | − chrX | 48792291 | 48792227 | − | ENST00000396743; ENST00000455452; ENST00000156084; ENST00000376488; ENST00000428668 | TAF |
| 21% | chrX | 48793481 | 48793462 | − chrX | 48792291 | 48792227 | − | ENST00000396743; ENST00000455452; ENST00000156084; ENST00000376488; ENST00000428668 | TAF |
| 19% | chr4 | 107241932 | 107242850 | + chr4 | 107246142 | 107246275 | + | ENST00000394701 | TAF |
| 19% | chr20 | 35857318 | 35857337 | + chr20 | 35858376 | 35858462 | + | ENST00000237530; ENST00000373622; ENST00000437329; ENST00000456400 | TAF |
| 19% | chr20 | 35857318 | 35857337 | + chr20 | 35858376 | 35858462 | + | ENST00000237530; ENST00000373622; ENST00000437329; ENST00000456400 | TAF |
| 19% | chr20 | 35857318 | 35857337 | + chr20 | 35858376 | 35858462 | + | ENST00000237530; ENST00000373622; ENST00000437329; ENST00000456400 | TAF |
| 19% | chr20 | 35857318 | 35857337 | + chr20 | 35858376 | 35858462 | + | ENST00000237530; ENST00000373622; ENST00000437329; ENST00000456400 | TAF |
| 19% | chr20 | 61475759 | 61475132 | − chr20 | 61473449 | 61473327 | − | ENST00000335351 | TAF |
| 19% | chr12 | 6602868 | 6602754 | − chr12 | 6602138 | 6602028 | − | ENST00000229238 | TSF |
| 18% | chr1 | 86821476 | 86821330 | − chr1 | 86820542 | 86820457; 86820538 | − | ENST00000359242; ENST00000460698; ENST00000317336; ENST00000370567; ENST00000394731; ENST00000370566; ENST00000462648; ENST00000294678; ENST00000531412 | TAF |
| 18% | chr1 | 86821476 | 86821330 | − chr1 | 86820542 | 86820457; 816820538 | − | ENST00000359242; ENST00000460698; ENST00000317336; ENST00000370567; ENST00000394731; ENST00000370566; ENST00000462648; ENST00000294678; ENST00000531412 | TAF |
| 18% | chr1 | 86821476 | 86821330 | − chr1 | 86820542 | 86820457; 86820538 | − | ENST00000359242; ENST00000460698; ENST00000317336; ENST00000370567; ENST00000394731; ENST00000370566; ENST00000462648; ENST00000294678; ENST00000531412 | TAF |
| 18% | chr1 | 86821476 | 86821330 | − chr1 | 86820542 | 86820457; 86820538 | − | ENST00000359242; ENST00000460698; ENST00000317336; ENST00000370567; ENST00000394731; ENST00000370566; ENST00000462648; ENST00000294678; ENST00000531412 | TAF |
| 18% | chr19 | 55649945 | 55649877 | − chr19 | 55649442 | 55649344; 55649329; 55649386 | − | ENST00000587758; ENST00000291901; ENST00000356783; ENST00000588426; ENST00000536926; ENST00000588981; ENST00000593194; ENST00000589745; ENST00000587465; ENST00000585321; ENST00000593046; ENST00000589226; ENST00000588147 | TAF |
| 18% | chr19 | 55649945 | 55649877 | − chr19 | 55649442 | 55649329; 55649344; | − | ENST00000587758; ENST00000291901; ENST00000356783; ENST00000588426; ENST00000536926; ENST00000588981; | TAF |

TABLE 68-continued

Transcript fusion for Uterine Carcinosarcoma (UCS) Coordinates of the fusion sequences for which the donor is the TE.

| 1+B2:L152 | 2' | 3' | 4' | 5' | 6' | 7' | 8' | 9 | 10' | 11' |
|---|---|---|---|---|---|---|---|---|---|---|
| | | | | | | | 55649386 | | ENST00000593194; ENST00000589745; ENST00000587465; ENST00000585321; ENST00000593046; ENST00000589226; ENST00000588147 | |
| 18% | chr19 | 55649945 | 55649877 | – | chr19 | 55649442 | 55649329; 55649344; 55649386 | – | ENST00000587758; ENST00000291901; ENST00000356783; ENST00000588426; ENST00000536926; ENST00000588981; ENST00000593194; ENST00000589745; ENST00000587465; ENST00000585321; ENST00000593046; ENST00000589226; ENST00000588147 | TAF |
| 18% | chr19 | 55649945 | 55649877 | – | chr19 | 55649442 | 55649329; 55649344; 55649386 | – | ENST00000587758; ENST00000291901; ENST00000356783; ENST00000588426; ENST00000536926; ENST00000588981; ENST00000593194; ENST00000589745; ENST00000587465; ENST00000585321; ENST00000593046; ENST00000589226; ENST00000588147 | TAF |
| 18% | chr19 | 55649945 | 55649877 | – | chr19 | 55649442 | 55649329; 55649344; 55649386 | – | ENST00000587758; ENST00000291901; ENST00000356783; ENST00000588426; ENST00000536926; ENST00000588981; ENST00000593194; ENST00000589745; ENST00000587465; ENST00000585321; ENST00000593046; ENST00000589226; ENST00000588147 | TAF |
| 18% | chr9 | 136393635 | 136393545 | – | chr9 | 136385410 | 136385296 | – | ENST00000339996 | TAF |
| 18% | chr1 | 169819657 | 169819707 | + | chr1 | 169820958 | 169821077 | + | ENST00000359326; ENST00000286031 | TSF |
| 16% | chr18 | 43686699 | 43686799 | + | chr18 | 43698147 | 43698282 | + | ENST00000282058; ENST00000592471 | TAF |
| 16% | chr18 | 43686699 | 43686799 | + | chr18 | 43698147 | 43698282 | + | ENST00000282058; ENST00000592471 | TAF |
| 16% | chr17 | 39974832 | 39974854 | + | chr17 | 39975462 | 39975651 | + | ENST00000321562 | TAF |
| 16% | chr17 | 79649571 | 79649473 | – | chr17 | 79649179 | 79649064 | – | ENST00000397498; ENST00000570561; ENST00000576135 | TAF |
| 16% | chr3 | 185411133 | 185410965 | – | chr3 | 185410550 | 185410487 | – | ENST00000382199; ENST00000421047; ENST00000457616; ENST00000346192 | TAF |
| 16% | chr3 | 185411133 | 185410965 | – | chr3 | 185410550 | 185410487 | – | ENST00000382199; ENST00000421047; ENST00000457616; ENST00000346192 | TAF |
| 16% | chr21 | 47675413 | 47675316 | – | chr21 | 47674758 | 47674690 | – | ENST00000397708; ENST00000291688 | TAF |
| 16% | chr17 | 39974832 | 39974893 | + | chr17 | 39975462 | 39975651 | + | ENST00000321562 | TSF |
| 14% | chr7 | 2289080 | 2289115 | + | chr7 | 2289492 | 2289637 | + | ENST00000356714; ENST00000397049; ENST00000397046; ENST00000397048; ENST00000339737; ENST00000343985 | TAF |
| 14% | chr19 | 42335927 | 42335940 | + | chr19 | 42365240 | 42365281; 42365294 | + | ENST00000598742; ENST00000601492; ENST00000600467; ENST00000593863; ENST00000598261; ENST00000598399 | TAF |
| 14% | chr19 | 42335927 | 42335940 | + | chr19 | 42365240 | 42365281; 42365294 | + | ENST00000598742; ENST00000601492; ENST00000600467; ENST00000593863; ENST00000598261; ENST00000598399 | TAF |
| 14% | chr19 | 42335927 | 42335940 | + | chr19 | 42365240 | 42365281; 42365294 | + | ENST00000598742; ENST00000601492; ENST00000600467; ENST00000593863; ENST00000598261; ENST00000598399 | TAF |
| 14% | chr19 | 42335927 | 42335940 | + | chr19 | 42365240 | 42365281; 42365294 | + | ENST00000598742; ENST00000601492; ENST00000600467; ENST00000593863; ENST00000598261; ENST00000598399 | TAF |
| 14% | chr19 | 42335927 | 42335940 | + | chr19 | 42365240 | 42365281; 42365294 | + | ENST00000598742; ENST00000601492; ENST00000600467; ENST00000593863; ENST00000598261; ENST00000598399 | TAF |
| 14% | chr3 | 180632728 | 180632783 | + | chr3 | 180651122 | 180651174 | + | ENST00000357559; ENST00000445140; ENST00000480918; ENST00000484042 | TAF |
| 14% | chr3 | 180632728 | 180632783 | + | chr3 | 180651122 | 180651174 | + | ENST00000357559; ENST00000445140; ENST00000480918; ENST00000484042 | TAF |
| 14% | chr3 | 180632728 | 180632783 | + | chr3 | 180651122 | 180651174 | + | ENST00000357559; ENST00000445140; ENST00000480918; ENST00000484042 | TAF |
| 14% | chr13 | 43628887 | 29643679 | + | chr13 | 43643066 | 43643139 | + | ENST00000379221 | TAF |
| 14% | chr10 | 120902016 | 120901765 | – | chr10 | 120900831 | 120900754 | – | ENST00000355697; ENST00000330036 | TAF |
| 14% | chrX | 3773692 | 3773630 | – | chrX | 3735819 | 3735816 | – | ENST00000425492 | TAF |
| 12% | chr1 | 120274523 | 120274578 | + | chr1 | 120277257 | 120277389 | + | ENST00000369450; ENST00000369407 | TAF |
| 12% | chr1 | 155036912 | 155037036 | + | chr1 | 155039206 | 155039492 | + | ENST00000368409; ENST00000359751; ENST00000427683 | TAF |
| 12% | chr1 | 155036912 | 155037036 | + | chr1 | 155039206 | 155039492 | + | ENST00000368409; ENST00000359751; ENST00000427683 | TAF |
| 12% | chr1 | 155036912 | 155037036 | + | chr1 | 155039206 | 155039492 | + | ENST00000368409; ENST00000359751; ENST00000427683 | TAF |
| 12% | chr1 | 165863702 | 165863816 | + | chr1 | 165865427 | 165865569 | + | ENST00000367879 | TAF |
| 12% | chr2 | 28190037 | 28190310 | + | chr2 | 28210860 | 28210954 | + | ENST00000436924; ENST00000344773; ENST00000379624; ENST00000342045; ENST00000361704; ENST00000379632; ENST00000379629; ENST00000604932 | TAF |
| 12% | chr2 | 28190037 | 28190310 | + | chr2 | 28210860 | 28210954 | + | ENST00000436924; ENST00000344773; ENST00000379624; ENST00000342045; ENST00000361704; ENST00000379632; ENST00000379629; ENST00000604932 | TAF |
| 12% | chr2 | 28190037 | 28190310 | + | chr2 | 28210860 | 28210954 | + | ENST00000436924; ENST00000344773; ENST00000379624; ENST00000342045; ENST00000361704; ENST00000379632; ENST00000379629; ENST00000604932 | TAF |
| 12% | chr2 | 28190037 | 28190310 | + | chr2 | 28210860 | 28210954 | + | ENST00000436924; ENST00000344773; ENST00000379624; ENST00000342045; ENST00000361704; ENST00000379632; ENST00000379629; ENST00000604932 | TAF |
| 12% | chr2 | 28190037 | 28190310 | + | chr2 | 28210860 | 28210954 | + | ENST00000436924; ENST00000344773; ENST00000379624; ENST00000342045; ENST00000361704; ENST00000379632; ENST00000379629; ENST00000604932 | TAF |
| 12% | chr2 | 28190037 | 28190310 | + | chr2 | 28210860 | 28210954 | + | ENST00000436924; ENST00000344773; ENST00000379624; ENST00000342045; ENST00000361704; ENST00000379632; ENST00000379629; ENST00000604932 | TAF |

TABLE 68-continued

Transcript fusion for Uterine Carcinosarcoma (UCS) Coordinates of the fusion sequences for which the donor is the TE.

| 1+B2: L152 2' | 3' | 4' | 5' 6' | 7' | 8' | 9 10' | 11' |
|---|---|---|---|---|---|---|---|
| 12% chr20 | 2775864 | 2775374 | − chr20 | 2775285 | 2775183 | − ENST00000380605 | TAF |
| 12% chr10 | 101952336 | 216101952 | − chr10 | 101950725 | 101950626 | − ENST00000370397 | TAF |
| 12% chr5 | 173041966 | 173041919 | − chr5 | 173040258 | 173040134 | − ENST00000311086; ENST00000285908 | TAF |
| 12% chr5 | 173041966 | 173041919 | − chr5 | 173040258 | 173040134 | − ENST00000311086; ENST00000285908 | TAF |
| 12% chr13 | 37599378 | 37599328 | − chr13 | 37598330 | 37598172 | − ENST00000490716; ENST00000495071; ENST00000360252; ENST00000475892; ENST00000469488; ENST00000356185; ENST00000350612; ENST00000464744; ENST00000542180 | TAF |
| 12% chr13 | 37599378 | 37599328 | − chr13 | 37598330 | 37598172 | − ENST00000490716; ENST00000495071; ENST00000360252; ENST00000475892; ENST00000469488; ENST00000356185; ENST00000350612; ENST00000464744; ENST00000542180 | TAF |
| 12% chr13 | 37599378 | 37599328 | − chr13 | 37598330 | 37598172 | − ENST00000490716; ENST00000495071; ENST00000360252; ENST00000475892; ENST00000469488; ENST00000356185; ENST00000350612; ENST00000464744; ENST00000542180 | TAF |
| 12% chr13 | 37599378 | 37599328 | − chr13 | 37598330 | 37598172 | − ENST00000490716; ENST00000495071; ENST00000360252; ENST00000475892; ENST00000469488; ENST00000356185; ENST00000350612; ENST00000464744; ENST00000542180 | TAF |
| 12% chr13 | 37599378 | 37599328 | − chr13 | 37598330 | 37598172 | − ENST00000490716; ENST00000495071; ENST00000360252; ENST00000475892; ENST00000469488; ENST00000356185; ENST00000350612; ENST00000464744; ENST00000542180 | TAF |
| 12% chr5 | 54528691 | 28554595 | − chr5 | 54528374 | 54528189 | − ENST00000282572 | |
| 12% chr1 | 53070435 | 53070501 | + chr1 | 53072356 | 53072617 | + ENST00000361314 | TSF |
| 12% chr1 | 59980221 | 59980497 | + chr1 | 60019796 | 60019899 | + ENST00000371218; ENST00000303721; ENST00000430447; ENST00000371212 | TSF |
| 12% chr1 | 59980221 | 59980497 | + chr1 | 60019796 | 60019899 | + ENST00000371218; ENST00000303721; ENST00000430447; ENST00000371212 | TSF |
| 12% chr1 | 59980221 | 59980497 | + chr1 | 60019796 | 60019899 | + ENST00000371218; ENST00000303721; ENST00000430447; ENST00000371212 | TSF |
| 11% chr19 | 48283383 | 48283451 | + chr19 | 48283982 | 48284006 | + ENST00000601048; ENST00000593892; ENST00000599874; ENST00000595615 | TAF |
| 11% chr19 | 48283383 | 48283451 | + chr19 | 48283982 | 48284006 | + ENST00000601048; ENST00000593892; ENST00000599874; ENST00000595615 | TAF |
| 11% chr19 | 58515808 | 58516068 | + chr19 | 58517275 | 58517367; 58517363 | + ENST00000550135; ENST00000553254 | TAF |
| 11% chr19 | 58515808 | 58516068 | + chr19 | 58517275 | 58517367; 58517363 | + ENST00000550135; ENST00000553254 | TAF |
| 11% chr6 | 26474324 | 26474624 | + chr6 | 26476389 | 26476396 | + ENST00000480218 | TAF |
| 11% chr5 | 135398466 | 135398602 | + chr5 | 135398875 | 135398915; 135398898 | + ENST00000442011; ENST00000305126; ENST00000514554; ENST00000508076; ENST00000503087 | TAF |
| 11% chr5 | 135398466 | 135398602 | + chr5 | 135398875 | 135398915; 135398898 | + ENST00000442011; ENST00000305126; ENST00000514554; ENST00000508076; ENST00000503087 | TAF |
| 11% chr19 | 42335927 | 42335940 | + chr19 | 42364892 | 42364915 | + ENST00000598742; ENST00000601492; ENST00000600467; ENST00000593863; ENST00000598261; ENST00000598399 | TAF |
| 11% chr19 | 42335927 | 42335940 | + chr19 | 42364892 | 42364915 | + ENST00000598742; ENST00000601492; ENST00000600467; ENST00000593863; ENST00000598261; ENST00000598399 | TAF |
| 11% chr19 | 42335927 | 42335940 | + chr19 | 42364892 | 42364915 | + ENST00000598742; ENST00000601492; ENST00000600467; ENST00000593863; ENST00000598261; ENST00000598399 | TAF |
| 11% chr19 | 42335927 | 42335940 | + chr19 | 42364892 | 42364915 | + ENST00000598742; ENST00000601492; ENST00000600467; ENST00000593863; ENST00000598261; ENST00000598399 | TAF |
| 11% chrX | 71397824 | 71398498 | + chrX | 71406311 | 71406384 | + ENST00000218432; ENST00000423432; ENST00000373669; ENST00000496835; ENST00000439980; ENST00000446576 | TAF |
| 11% chrX | 71397824 | 71398498 | + chrX | 71406311 | 71406384 | + ENST00000218432; ENST00000423432; ENST00000373669; ENST00000496835; ENST00000439980; ENST00000446576 | TAF |
| 11% chrX | 71397824 | 71398498 | + chrX | 71406311 | 71406384 | + ENST00000218432; ENST00000423432; ENST00000373669; ENST00000496835; ENST00000439980; ENST00000446576 | TAF |
| 11% chrX | 71397824 | 71398498 | + chrX | 71406311 | 71406384 | + ENST00000218432; ENST00000423432; ENST00000373669; ENST00000496835; ENST00000439980; ENST00000446576 | TAF |
| 11% chr19 | 39958795 | 39959001 | + chr19 | 39959396 | 39959501 | + ENST00000599117; ENST00000402194; ENST00000432763; ENST00000359191; ENST00000598725 | TAF |
| 11% chr2 | 133363747 | 133363763 | + chr2 | 133402674 | 133403179 | + ENST00000329321 | |
| 11% chr19 | 39110121 | 39110170 | + chr19 | 39110977 | 39111075 | + ENST00000248342; ENST00000588934; ENST00000545173; ENST00000586513; ENST00000592558 | TAF |
| 11% chr19 | 39110121 | 39110170 | + chr19 | 39110977 | 39111075 | + ENST00000248342; ENST00000588934; ENST00000545173; ENST00000586513; ENST00000592558 | TAF |
| 11% chr19 | 39110121 | 39110170 | + chr19 | 39110977 | 39111075 | + ENST00000248342; ENST00000588934; ENST00000545173; ENST00000586513; ENST00000592558 | TAF |
| 11% chr19 | 39110121 | 39110170 | + chr19 | 39110977 | 39111075 | + ENST00000248342; ENST00000588934; ENST00000545173; ENST00000586513; ENST00000592558 | TAF |
| 11% chr19 | 39110121 | 39110170 | + chr19 | 39110977 | 39111075 | + ENST00000248342; ENST00000588934; ENST00000545173; ENST00000586513; ENST00000592558 | TAF |
| 11% chr7 | 2289080 | 2289194 | + chr7 | 2289492 | 2289637 | + ENST00000356714; ENST00000397049; ENST00000397046; ENST00000397048; ENST00000339737; ENST00000343985 | TAF |
| 11% chr13 | 76173531 | 76175706 | + chr13 | 76178905 | 76178963 | + ENST00000377595; ENST00000419068 | TAF |

TABLE 68-continued

Transcript fusion for Uterine Carcinosarcoma (UCS) Coordinates of the fusion sequences for which the donor is the TE.

| 1+B2:L152 | 2' | 3' | 4' | 5' | 6' | 7' | 8' | 9 | 10' | 11' |
|---|---|---|---|---|---|---|---|---|---|---|
| 11% | chr2 | 10945150 | 10944882 | – | chr2 | 10942766 | 10942625 | – | ENST00000272227; ENST00000404371; ENST00000404824; ENST00000540494; ENST00000381611 | TAF |
| 11% | chr1 | 6380703 | 6380649 | – | chr1 | 6378638 | 6378552 | – | ENST00000608083; ENST00000377842; ENST00000377845; ENST00000377855; ENST00000377860; ENST00000418124; ENST00000545482; ENST00000361521; ENST00000473466; ENST00000541130 | TAF |
| 11% | chr1 | 6380703 | 6380649 | – | chr1 | 6378638 | 6378552 | – | ENST00000608083; ENST00000377842; ENST00000377845; ENST00000377855; ENST00000377860; ENST00000418124; ENST00000545482; ENST00000361521; ENST00000473466; ENST00000541130 | TAF |
| 11% | chr1 | 6380703 | 6380649 | – | chr1 | 6378638 | 6378552 | – | ENST00000608083; ENST00000377842; ENST00000377845; ENST00000377855; ENST00000377860; ENST00000418124; ENST00000545482; ENST00000361521; ENST00000473466; ENST00000541130 | TAF |
| 11% | chr1 | 6380703 | 6380649 | – | chr1 | 6378638 | 6378552 | – | ENST00000608083; ENST00000377842; ENST00000377845; ENST00000377855; ENST00000377860; ENST00000418124; ENST00000545482; ENST00000361521; ENST00000473466; ENST00000541130 | TAF |
| 11% | chr1 | 6380703 | 6380649 | – | chr1 | 6378638 | 6378552 | – | ENST00000608083; ENST00000377842; ENST00000377845; ENST00000377855; ENST00000377860; ENST00000418124; ENST00000545482; ENST00000361521; ENST00000473466; ENST00000541130 | TAF |
| 11% | chr20 | 43919547 | 43919514 | – | chr20 | 43882374 | 43882216 | – | ENST00000338380 | |
| 11% | chr5 | 823586 | 823504 | – | chr5 | 822010 | 821976 | – | ENST00000424784; ENST00000283441 | TAF |
| 11% | chr8 | 48617118 | 48617136 | + | chr8 | 48625224 | 48625434 | + | ENST00000297423; ENST00000518074; ENST00000541342; ENST00000519401; ENST00000517693 | TSF |
| 11% | chr8 | 48617118 | 48617136 | + | chr8 | 48625224 | 48625434 | + | ENST00000297423; ENST00000518074; ENST00000541342; ENST00000519401; ENST00000517693 | TSF |
| 11% | chr8 | 48617118 | 48617136 | + | chr8 | 48625224 | 48625434 | + | ENST00000297423; ENST00000518074; ENST00000541342; ENST00000519401; ENST00000517693 | TSF |
| 11% | chr6 | 41610978 | 41611118 | + | chr6 | 41613864 | 41614046 | + | ENST00000432027; ENST00000419164; ENST00000373051; ENST00000441667; ENST00000230321; ENST00000446650 | TSF |
| 11% | chr6 | 41610978 | 41611118 | + | chr6 | 41613864 | 41614046 | + | ENST00000432027; ENST00000419164; ENST00000373051; ENST00000441667; ENST00000230321; ENST00000446650 | TSF |
| 11% | chr6 | 41610978 | 41611118 | + | chr6 | 41613864 | 41614046 | + | ENST00000432027; ENST00000419164; ENST00000373051; ENST00000441667; ENST00000230321; ENST00000446650 | TSF |
| 11% | chr6 | 41610978 | 41611118 | + | chr6 | 41613864 | 41614046 | + | ENST00000432027; ENST00000419164; ENST00000373051; ENST00000441667; ENST00000230321; ENST00000446650 | TSF |
| 11% | chr6 | 41610978 | 41611118 | + | chr6 | 41613864 | 41614046 | + | ENST00000432027; ENST00000419164; ENST00000373051; ENST00000441667; ENST00000230321; ENST00000446650 | TSF |
| 11% | chr7 | 56018506 | 56018522 | + | chr7 | 56020872 | 56021011 | + | ENST00000426595 | TSF |

TABLE 69

Transcript fusion for Uveal Melanoma (UVM) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 99% | chr12 | 110511233 | 110511227 | – | ENST00000548191 | chr12 | 110496968 | 110496909 | – | TAF |
| 98% | chr12 | 110495101 | 110494994 | – | ENST00000309050 | chr12 | 110493610 | 110493335 | – | TAF |
| 95% | chr11 | 88960991 | 88961138 | + | ENST00000263321 | chr11 | 88974422 | 88974649 | + | TAF |
| 81% | chr8 | 54793576 | 54793644 | + | ENST00000276500 | chr8 | 54826057 | 54826421 | + | TAF |
| 60% | chr19 | 3544937 | 3544807 | – | ENST00000389395; ENST00000398558; ENST00000588918; ENST00000355415; ENST00000589063 | chr19 | 3538708 | 3538306 | – | TAF |
| 60% | chr19 | 3544937 | 3544807 | – | ENST00000389395; ENST00000398558; ENST00000588918; ENST00000355415; ENST00000589063 | chr19 | 3538708 | 3538306 | – | TAF |
| 60% | chr19 | 3544937 | 3544807 | – | ENST00000389395; ENST00000398558; ENST00000588918; ENST00000355415; ENST00000589063 | chr19 | 3538708 | 3538306 | – | TAF |
| 57% | chr8 | 54791818 | 54792162 | + | ENST00000297313 | chr8 | 54826057 | 54826421 | + | TSF |
| 57% | chr15 | 28090198 | 28090105 | – | ENST00000353809; ENST00000354638 | chr15 | 27964474 | 27964338 | – | TSF |
| 57% | chr15 | 28090198 | 28090105 | – | ENST00000353809; ENST00000354638 | chr15 | 27964474 | 27964338 | – | TSF |
| 52% | chr14 | 51355542 | 51355621 | + | ENST00000337334; ENST00000353130; ENST00000395752 | chr14 | 51359931 | 51360328 | + | TAF |
| 52% | chr14 | 51355542 | 51355621 | + | ENST00000337334; ENST00000353130; ENST00000395752 | chr14 | 51359931 | 51360328 | + | TAF |
| 52% | chr14 | 51355542 | 51355621 | + | ENST00000337334; ENST00000353130; ENST00000395752 | chr14 | 51359931 | 51360328 | + | TAF |
| 32% | chr17 | 1028702; 1028625 | 1028518 | – | ENST00000302538; ENST00000544583; ENST00000574437; ENST00000575934; ENST00000574139; ENST00000570525; ENST00000574266 | chr17 | 1005267 | 1004964 | – | TSF |
| 32% | chr17 | 1028702; 1028625 | 1028518 | – | ENST00000302538; ENST00000544583; ENST00000574437; ENST00000575934; ENST00000574139; ENST00000570525; ENST00000574266 | chr17 | 1005267 | 1004964 | – | TSF |
| 31% | chr12 | 110511233 | 110511227 | – | ENST00000548191 | chr12 | 110496919 | 110496909 | – | TSF |

TABLE 69-continued

Transcript fusion for Uveal Melanoma (UVM) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 26% | chr11 | 117186511 | 117186251 | − | ENST00000313005; ENST00000528053; ENST00000428381; ENST00000445823; ENST00000513780 | chr11 | 117167925 | 117167869 | − | TSF |
| 25% | chr19 | 39077165 | 39077216 | + | ENST00000355481; ENST00000360985; ENST00000359596 | chr19 | 39085644 | 39085967 | + | TAF |
| 25% | chr19 | 39077165 | 39077216 | + | ENST00000355481; ENST00000360985; ENST00000359596 | chr19 | 39085644 | 39085967 | + | TAF |
| 25% | chr19 | 39077165 | 39077216 | + | ENST00000355481; ENST00000360985; ENST00000359596 | chr19 | 39085644 | 39085967 | + | TAF |
| 24% | chr20 | 53092486 | 53092551 | + | ENST00000262593 | chr20 | 53111339 | 53111426 | + | TAF |
| 22% | chr12 | 110495101 | 110494994 | − | ENST00000309050 | chr12 | 110493672 | 110493335 | − | TSF |
| 20% | chr8 | 74939024 | 74939076 | + | ENST00000284818; ENST00000518893 | chr8 | 74944554 | 74944936 | + | TAF |
| 20% | chr8 | 74939024 | 74939076 | + | ENST00000284818; ENST00000518893 | chr8 | 74944554 | 74944936 | + | TAF |
| 18% | chrX | 64743587; 64743497 | 64743440 | − | ENST00000374807; ENST00000374811; ENST00000374804; ENST00000469091 | chrX | 64742373 | 64741630 | − | TAF |
| 18% | chrX | 64743587; 64743497 | 64743440 | − | ENST00000374807; ENST00000374811; ENST00000374804; ENST00000469091 | chrX | 64742373 | 64741630 | − | TAF |
| 18% | chrX | 64743587; 64743497 | 64743440 | − | ENST00000374807; ENST00000374811; ENST00000374804; ENST00000469091 | chrX | 64742373 | 64741630 | − | TAF |
| 18% | chrX | 64743587; 64743497 | 64743440 | − | ENST00000374807; ENST00000374811; ENST00000374804; ENST00000469091 | chrX | 64742373 | 64741630 | − | TAF |
| 16% | chr19 | 34986608 | 34986676 | + | ENST00000270288; ENST00000590071; ENST00000585928 | chr19 | 34986786 | 34987070 | + | TAF |
| 16% | chr19 | 34986608 | 34986676 | + | ENST00000270288; ENST00000590071; ENST00000585928 | chr19 | 34986786 | 34987070 | + | TAF |
| 16% | chr19 | 34986608 | 34986676 | + | ENST00000270288; ENST00000590071; ENST00000585928 | chr19 | 34986786 | 34987070 | + | TAF |
| 16% | chr15 | 58957396 | 58957296 | − | ENST00000260408 | chr15 | 58947615 | 58947395 | − | TAF |
| 15% | chr5 | 43382154 | 43382066 | − | ENST00000489442; ENST00000361115; ENST00000513525 | chr5 | 43376990 | 43376680 | − | TAF |
| 15% | chr5 | 43382154 | 43382066 | − | ENST00000489442; ENST00000361115; ENST00000513525 | chr5 | 43376990 | 43376680 | − | TAF |
| 15% | chr1 | 74563634 | 74563535 | − | ENST00000225276; ENST00000588920 | chr17 | 74560019 | 74559800 | − | TSF |
| 15% | chr17 | 74563634 | 74563535 | − | ENST00000225276; ENST00000588920 | chr17 | 74560019 | 74559800 | − | TSF |
| 14% | chr1 | 212606286 | 212606462 | + | ENST00000366988 | chr1 | 212608047 | 212608089 | + | TAF |
| 14% | chr10 | 84718705 | 84718831 | + | ENST00000372141; ENST00000404547; ENST00000372142; ENST00000404576; ENST00000556918; ENST00000537893; ENST00000545131 | chr10 | 84720295 | 84720298 | + | TSF |
| 14% | chr10 | 84718705 | 84718831 | + | ENST00000372141; ENST00000404547; ENST00000372142; ENST00000404576; ENST00000556918; ENST00000537893; ENST00000545131 | chr10 | 84720295 | 84720298 | + | TSF |
| 14% | chr10 | 84718705 | 84718831 | + | ENST00000372141; ENST00000404547; ENST00000372142; ENST00000404576; ENST00000556918; ENST00000537893; ENST00000545131 | chr10 | 84720295 | 84720298 | + | TSF |
| 14% | chr10 | 84718705 | 84718831 | + | ENST00000372141; ENST00000404547; ENST00000372142; ENST00000404576; ENST00000556918; ENST00000537893; ENST00000545131 | chr10 | 84720295 | 84720298 | + | TSF |
| 14% | chr10 | 84718705 | 84718831 | + | ENST00000372141; ENST00000404547; ENST00000372142; ENST00000404576; ENST00000556918; ENST00000537893; ENST00000545131 | chr10 | 84720295 | 84720298 | + | TSF |
| 14% | chr11 | 6624732 | 6624634 | − | ENST00000254605; ENST00000534343; ENST00000533907; ENST00000530762 | chr11 | 6614053 | 6614046 | − | TSF |
| 12% | chr1 | 245246924 | 245246990 | + | ENST00000366523; ENST00000366522; ENST00000447569; ENST00000366521; ENST00000551317; ENST00000425550; ENST00000427529 | chr1 | 245288007 | 245288330 | + | TAF |
| 12% | chr1 | 245246924 | 245246990 | + | ENST00000366523; ENST00000366522; ENST00000447569; ENST00000366521; ENST00000551317; ENST00000425550; ENST00000427529 | chr1 | 245288007 | 245288330 | + | TAF |
| 12% | chr1 | 245246924 | 245246990 | + | ENST00000366523; ENST00000366522; ENST00000447569; ENST00000366521; ENST00000551317; ENST00000425550; ENST00000427529 | chr1 | 245288007 | 245288330 | + | TAF |
| 12% | chr1 | 245246924 | 245246990 | + | ENST00000366523; ENST00000366522; ENST00000447569; ENST00000366521; ENST00000551317; ENST00000425550; ENST00000427529 | chr1 | 245288007 | 245288330 | + | TAF |
| 12% | chr1 | 245246924 | 245246990 | + | ENST00000366523; ENST00000366522; ENST00000447569; ENST00000366521; ENST00000551317; ENST00000425550; ENST00000427529 | chr1 | 245288007 | 245288330 | + | TAF |
| 12% | chr10 | 120905865 | 120905748 | − | ENST00000355697; ENST00000330036 | chr10 | 120901885 | 120901741 | − | TAF |
| 12% | chr10 | 120905865 | 120905748 | − | ENST00000355697; ENST00000330036 | chr10 | 120901885 | 120901741 | − | TAF |
| 12% | chr17 | 7130588 | 7130409 | − | ENST00000005340; ENST00000575458; ENST00000575086 | chr17 | 7130277 | 7130132 | − | TAF |
| 12% | chr17 | 7130588 | 7130409 | − | ENST00000005340; ENST00000575458; ENST00000575086 | chr17 | 7130277 | 7130132 | − | TAF |
| 12% | chr17 | 7130588 | 7130409 | − | ENST00000005340; ENST00000575458; ENST00000575086 | chr17 | 7130277 | 7130132 | − | TAF |
| 11% | chr1 | 25891664 | 25891698 | + | ENST00000374338 | chr1 | 25916660 | 25916675 | + | TSF |
| 10% | chr8 | 109468102 | 109468159 | + | ENST00000220853; ENST00000519642 | chr8 | 109468381 | 109468590 | + | TSF |
| 10% | chr8 | 109468102 | 109468159 | + | ENST00000220853; ENST00000519642 | chr8 | 109468381 | 109468590 | + | TSF |
| 10% | chr9 | 130213596 | 130213560 | − | ENST00000361436; ENST00000536368 | chr9 | 130213398 | 130213359 | − | TSF |
| 9% | chr2 | 33783739 | 33784097 | + | ENST00000402538; ENST00000403687; ENST00000407811 | chr2 | 33793051 | 33793065 | + | TSF |
| 9% | chr2 | 33783739 | 33784097 | + | ENST00000402538; ENST00000403687; ENST00000407811 | chr2 | 33793051 | 33793065 | + | TSF |
| 9% | chr15 | 69347674 | 59347840 | + | ENST00000448182; ENST00000260364; ENST00000455873; ENST00000388866; ENST00000530406 | chr15 | 69354923 | 69354995 | + | TSF |
| 9% | chr15 | 69347674 | 59347840 | + | ENST00000448182; ENST00000260364; ENST00000455873; ENST00000388866; ENST00000530406 | chr15 | 69354923 | 69354995 | + | TSF |
| 9% | chr15 | 69347674 | 59347840 | + | ENST00000448182; ENST00000260364; ENST00000455873; ENST00000388866; ENST00000530406 | chr15 | 69354923 | 69354995 | + | TSF |
| 9% | chr15 | 69347674 | 59347840 | + | ENST00000448182; ENST00000260364; ENST00000455873; ENST00000388866; ENST00000530406 | chr15 | 69354923 | 69354995 | + | TSF |

TABLE 69-continued

Transcript fusion for Uveal Melanoma (UVM) Coordinates of the fusion sequences for which the donor is the exon.

| 1 | 2 | 3 | 4 | 5 | 6 | 7 | 8 | 9 | 10 | 11 |
|---|---|---|---|---|---|---|---|---|---|---|
| 9% | chr15 | 69347674 | 59347840 | + | ENST00000388866; ENST00000530406 ENST00000448182; ENST00000260364; ENST00000455873; ENST00000388866; ENST00000530406 | chr15 | 69354923 | 69354995 | + | TSF |
| 8% | chr4 | 91321187 | 91321280 | + | ENST00000505073; ENST00000509176; ENST00000432775; ENST00000333691 | chr4 | 91325075 | 91325176 | + | TSF |
| 8% | chr11 | 88960991 | 88961082 | + | ENST00000263321 | chr11 | 88974422 | 88974649 | + | TSF |
| 8% | chr13 | 48651447 | 48651289 | − | ENST00000258648; ENST00000378586 | chr13 | 48616414 | 48616057 | − | TSF |
| 8% | chr13 | 48651447 | 48651289 | − | ENST00000258648; ENST00000378586 | chr13 | 48616414 | 48616057 |  | TSF |

TABLE 70

Transcript fusion for Uveal Melanoma (UVM) Coordinates of the fusion sequences for which the donor is the TE.

| 1 | 2' | 3' | 4' | 5' | 6' | 7 | 8' | 9 | 10' | 11' |
|---|---|---|---|---|---|---|---|---|---|---|
| 99% | chr16 | 1521687 | 1521625 | − | chr16 | 1515339 | 1515268 | − | ENST00000382745; ENST00000564568 | TAF |
| 99% | chr16 | 1521687 | 1521625 | − | chr16 | 1515339 | 1515268 | − | ENST00000382745; ENST00000564568 | TAF |
| 98% | chr15 | 93221696 | 93221360 | − | chr15 | 93173575 | 93173444 | − | ENST00000327355 | TAF |
| 92% | chr17 | 30850448 | 30850415 | − | chr17 | 30821933 | 30821777 | − | ENST00000318217; ENST0000394649 | TAF |
| 86% | chr11 | 87906665 | 87906580 | − | chr11 | 87883123 | 87882843 | − | ENST00000243662; ENST00000526372 | TAF |
| 75% | chr11 | 126273341 | 126273381 | + | chr11 | 126275991 | 126276045 | + | ENST00000534733 | TAF |
| 64% | chr8 | 145134058 | 145134309 | + | chr8 | 145134846 | 145135052; 145134924 | + | ENST00000316052; ENST00000525936; ENST00000527954 | TAF |
| 64% | chr8 | 145134058 | 145134309 | + | chr8 | 145134846 | 145135052; 145134924 | + | ENST00000316052; ENST00000525936; ENST00000527954 | TAF |
| 64% | chr8 | 145134058 | 145134309 | + | chr8 | 145134846 | 145135052; 145134924 | + | ENST00000316052; ENST00000525936; ENST00000527954 | TAF |
| 64% | chr9 | 5907671 | 5907721 | + | chr9 | 5908640 | 5908708 | + | ENST00000381477; ENST00000381476; ENST00000381471 | TSF |
| 62% | chrX | 71529592 | 71529379 | − | chrX | 71522784 | 71522660 | − | ENST00000453707; ENST00000431381; ENST00000427412; ENST00000450875; ENST00000454225 | TSF |
| 62% | chrX | 71529592 | 71529379 | − | chrX | 71522784 | 71522660 | − | ENST00000453707; ENST00000431381; ENST00000427412; ENST00000450875; ENST00000454225 | TSF |
| 62% | chrX | 71529592 | 71529379 | − | chrX | 71522784 | 71522660 | − | ENST00000453707; ENST00000431381; ENST00000427412; ENST00000450875; ENST00000454225 | TSF |
| 62% | chrX | 71529592 | 71529379 | − | chrX | 71522784 | 71522660 | − | ENST00000453707; ENST00000431381; ENST00000427412; ENST00000450875; ENST00000454225 | TSF |
| 62% | chr21 | 33707090 | 33707025 | − | chr21 | 33706643 | 33706472 | − | ENST00000382751 | TSF |
| 59% | chr3 | 98482258 | 98482283 | + | chr3 | 98487274 | 98487373 | + | ENST00000492254 | TAF |
| 59% | chr17 | 80440912 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |
| 59% | chr17 | 80440912 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |
| 59% | chr17 | 80440912 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |
| 59% | chr17 | 80440912 | 80441180 | + | chr17 | 80441592 | 80441655; 80441659 | + | ENST00000390006; ENST00000309794; ENST00000345415; ENST00000457415; ENST00000412079; ENST00000577432; ENST00000584513 | TAF |
| 57% | chr1 | 54879137 | 54879029 | − | chr1 | 54870603 | 54870531 | − | ENST00000371320; ENST00000371319; ENST00000357475 | TAF |
| 57% | chr1 | 54879137 | 54879029 | − | chr1 | 54870603 | 54870531 | − | ENST00000371320; ENST00000371319; ENST00000357475 | TAF |
| 57% | chr1 | 54879137 | 54879029 | − | chr1 | 54870603 | 54870531 | − | ENST00000371320; ENST00000371319; ENST00000357475 | TAF |
| 46% | chr1 | 594935212 | 212595005 | + | chr1 | 212615911 | 212615967 | + | ENST00000366988 | TAF |
| 46% | chr15 | 28127352 | 28127177 | − | chr15 | 281170 68 | 28117009 | − | ENST00000353809; ENST00000354638 | TAF |
| 45% | chr8 | 638103144 | 144638200 | + | chr8 | 144640548 | 144640621 | + | ENST00000533063 | TAF |
| 44% | chr17 | 74583012 | 74582951 | − | chr17 | 74574898 | 74574838; 74574881 | − | ENST00000225276; ENST00000585736 | TAF |
| 44% | chr17 | 74583012 | 74582951 | − | chr17 | 74574898 | 74574838; 74574881 |  | ENST00000225276; ENST00000585736 | TAF |
| 42% | chr1 | 45139523 | 45139439 | − | chr1 | 45125967 | 45125846 | − | ENST00000372242; ENST00000372243; ENST00000372237; ENST00000372235; ENST00000420706 | TAF |
| 42% | chr1 | 45139523 | 45139439 | − | chr1 | 45125967 | 45125846 | − | ENST00000372242; ENST00000372243; ENST00000372237; ENST00000372235; ENST00000420706 | TAF |
| 42% | chr1 | 45139523 | 45139439 | − | chr1 | 45125967 | 45125846 | − | ENST00000372242; ENST00000372243; ENST00000372237; ENST00000372235; ENST00000420706 | TAF |
| 42% | chr1 | 45139523 | 45139439 | − | chr1 | 45125967 | 45125846 | − | ENST00000372242; ENST00000372243; ENST00000372237; ENST00000372235; ENST00000420706 | TAF |
| 39% | chr12 | 56363784 | 56363834 | + | chr12 | 56364828 | 56365031 | + | ENST00000266970; ENST00000553376; ENST00000440311; ENST00000354056 | TAF |
| 38% | chr11 | 1620310 | 1620075 | − | chr11 | 1619101 | 1618947 | − | ENST00000412090 | TAF |

TABLE 70-continued

Transcript fusion for Uveal Melanoma (UVM) Coordinates of the fusion sequences for which the donor is the TE.

| 1 | 2' | 3' | 4' | 5' | 6' | 7 | 8' | 9 | 10' | 11' |
|---|---|---|---|---|---|---|---|---|---|---|
| 36% | chr17 | 426168 | 426165 | − | chr17 | 424978 | 424841 | − | ENST00000437048 | TAF |
| 36% | chr10 | 99667221 | 99666955 | − | chr10 | 99664571 | 99664426 | − | ENST00000413387; ENST00000370597; ENST00000298819; ENST00000309155; ENST00000370591 | TAF |
| 36% | chr10 | 99667221 | 99666955 | − | chr10 | 99664571 | 99664426 | − | ENST00000413387; ENST00000370597; ENST00000298819; ENST00000309155; ENST00000370591 | TAF |
| 36% | chr10 | 99667221 | 99666955 | − | chr10 | 996645 71 | 99664426 | − | ENST00000413387; ENST00000370597; ENST00000298819; ENST00000309155; ENST00000370591 | TAF |
| 35% | chr1 | 240569724 | 240569786 | + | chr1 | 240601361 | 240601510 | + | ENST00000319653; ENST00000545751 | TAF |
| 35% | chr17 | 80418062 | 80418199 | + | chr17 | 80422163 | 80422306 | + | ENST00000309794; ENST00000581202; ENST00000374611; ENST00000457415; ENST00000581795; ENST00000577432; ENST00000582907 | TAF |
| 35% | chr17 | 80418062 | 80418199 | + | chr17 | 80422163 | 80422306 | + | ENST00000309794; ENST00000581202; ENST00000374611; ENST00000457415; ENST00000581795; ENST00000577432; ENST00000582907 | TAF |
| 35% | chr17 | 80418062 | 80418199 | + | chr17 | 80422163 | 80422306 | + | ENST00000309794; ENST00000581202; ENST00000374611; ENST00000457415; ENST00000581795; ENST00000577432; ENST00000582907 | TAF |
| 35% | chr17 | 80418062 | 80418199 | + | chr17 | 80422163 | 80422306 | + | ENST00000309794; ENST00000581202; ENST00000374611; ENST00000457415; ENST00000581795; ENST00000577432; ENST00000582907 | TAF |
| 35% | chr17 | 80418062 | 80418199 | + | chr17 | 80422163 | 80422306 | + | ENST00000309794; ENST00000581202; ENST00000374611; ENST00000457415; ENST00000581795; ENST00000577432; ENST00000582907 | TAF |
| 35% | chr17 | 80418062 | 80418199 | + | chr17 | 80422163 | 80422306 | + | ENST00000309794; ENST00000581202; ENST00000374611; ENST00000457415; ENST00000581795; ENST00000577432; ENST00000582907 | TAF |
| 35% | chr17 | 80418062 | 80418199 | + | chr17 | 80422163 | 80422306 | + | ENST00000309794; ENST00000581202; ENST00000374611; ENST00000457415; ENST00000581795; ENST00000577432; ENST00000582907 | TAF |
| 34% | chr1 | 236326774 | 236327054 | + | chr1 | 236332006 | 236332055 | + | ENST00000366592; ENST00000454895 | TSF |
| 34% | chr1 | 236326774 | 236327054 | + | chr1 | 236332006 | 236332055 | + | ENST00000366592; ENST00000454895 | TSF |
| 34% | chr22 | 22899971 | 22899965 | − | chr22 | 22893511 | 22893189; 22893185; 22893481; 22893274 | − | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |
| 34% | chr22 | 22899971 | 22899965 | − | chr22 | 22893511 | 22893189; 22893185; 22893481; 22893274 | − | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |
| 34% | chr22 | 22899971 | 22899965 | − | chr22 | 22893511 | 22893189; 22893185; 22893481; 22893274 | − | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |
| 34% | chr22 | 22899971 | 22899965 | − | chr22 | 22893511 | 22893189; 22893185; 22893481; 22893274 | − | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |
| 34% | chr22 | 22899971 | 22899965 | − | chr22 | 22893511 | 22893189; 22893185; 22893481; 22893274 | − | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |
| 34% | chr22 | 22899971 | 22899965 | − | chr22 | 22893511 | 22893189; 22893185; 22893481; 22893274 | − | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |
| 34% | chr22 | 22899971 | 22899965 | − | chr22 | 22893511 | 22893189; 22893185; 22893481; 22893274 | − | ENST00000398743; ENST00000398741; ENST00000543184; ENST00000405655; ENST00000402697; ENST00000439106; ENST00000438888; ENST00000420709; ENST00000406503; ENST00000442481; ENST00000403441 | TSF |
| 31% | chr16 | 19886067 | 19886054 | − | chr16 | 19884168 | 19883138 | − | ENST00000537135 | TAF |
| 30% | chr8 | 109321615 | 109321565 | − | chr8 | 109254142 | 109254028 | − | ENST00000220849; ENST00000522445; ENST00000521440; ENST00000521297 | TAF |
| 30% | chr8 | 109321615 | 109321565 | − | chr8 | 109254142 | 109254028 | − | ENST00000220849; ENST00000522445; ENST00000521440; ENST00000521297 | TAF |
| 30% | chr8 | 109321615 | 109321565 | − | chr8 | 109254142 | 109254028 | − | ENST00000220849; ENST00000522445; ENST00000521440; ENST00000521297 | TAF |
| 30% | chr8 | 109321615 | 109321565 | − | chr8 | 109254142 | 109254028 | − | ENST00000220849; ENST00000522445; ENST00000521440; ENST00000521297 | TAF |
| 30% | chr1 | 212596286 | 212598077 | + | chr1 | 212617681 | 212617784 | + | ENST00000366988 | TSF |
| 30% | chr12 | 56353740 | 56353706 | − | chr12 | 56352391 | 56352257; 56352273; 56352331 | − | ENST00000449260; ENST00000552882; ENST00000550464; ENST00000548747; ENST00000539511; ENST00000548493; ENST00000550447; ENST00000548803; ENST00000547137; ENST00000546543; ENST00000549418; ENST00000549233 | TSF |
| 30% | chr12 | 56353740 | 56353706 | − | chr12 | 56352391 | 56352257; 56352273; 56352331 | − | ENST00000449260; ENST00000552882; ENST00000550464; ENST00000548747; ENST00000539511; ENST00000548493; ENST00000550447; ENST00000548803; ENST00000547137; | TSF |

TABLE 70-continued

Transcript fusion for Uveal Melanoma (UVM) Coordinates of the fusion sequences for which the donor is the TE.

| 1 | 2' | 3' | 4' | 5' 6' | 7 | 8' | 9 | 10' | 11' |
|---|---|---|---|---|---|---|---|---|---|
| 30% | chr12 | 56353740 | 56353706 | − chr12 | 56352391 | 56352257; 56352273; 56352331 | − | ENST00000546543; ENST00000549418; ENST00000549233 ENST00000449260; ENST00000552882; ENST00000550464; ENST00000548747; ENST00000539511; ENST00000548493; ENST00000550447; ENST00000548803; ENST00000547137; | TSF |
| 30% | chr12 | 56353740 | 56353706 | − chr12 | 56352391 | 56352257; 56352273; 56352331 | − | ENST00000546543; ENST00000549418; ENST00000549233 ENST00000449260; ENST00000552882; ENST00000550464; ENST00000548747; ENST00000539511; ENST00000548493; ENST00000550447; ENST00000548803; ENST00000547137; | TSF |
| 30% | chr12 | 56353740 | 56353706 | − chr12 | 56352391 | 56352257; 56352273; 56352331 | − | ENST00000546543; ENST00000549418; ENST00000549233 ENST00000449260; ENST00000552882; ENST00000550464; ENST00000548747; ENST00000539511; ENST00000548493; ENST00000550447; ENST00000548803; ENST00000547137; | TSF |
| 30% | chr12 | 56353740 | 56353706 | − chr12 | 56352391 | 56352257; 56352273; 56352331 | − | ENST00000546543; ENST00000549418; ENST00000549233 ENST00000449260; ENST00000552882; ENST00000550464; ENST00000548747; ENST00000539511; ENST00000548493; ENST00000550447; ENST00000548803; ENST00000547137; | TSF |
| 30% | chr12 | 56353740 | 56353706 | − chr12 | 56352391 | 56352257; 56352273; 56352331 | − | ENST00000546543; ENST00000549418; ENST00000549233 ENST00000449260; ENST00000552882; ENST00000550464; ENST00000548747; ENST00000539511; ENST00000548493; ENST00000550447; ENST00000548803; ENST00000547137; | TSF |
| 30% | chr12 | 56353740 | 56353706 | − chr12 | 56352391 | 56352257; 56352273; 56352331 | − | ENST00000546543; ENST00000549418; ENST00000549233 ENST00000449260; ENST00000552882; ENST00000550464; ENST00000548747; ENST00000539511; ENST00000548493; ENST00000550447; ENST00000548803; ENST00000547137; ENST00000546543; ENST00000549418; ENST00000549233 | TSF |
| 29% | chr7 | 20686966 | 20686997 | + chr7 | 20687158 | 20687271 | + | ENST00000404938 | TSF |
| 28% | chr13 | 60978922 | 60979204 | + chr13 | 61013822 | 61013906 | + | ENST00000535286 | TAF |
| 28% | chr15 | 41968651 | 41968463 | − chr15 | 41815513 | 41815443 | − | ENST00000561603; ENST00000304330; ENST00000562303 | TAF |
| 28% | chr15 | 41968651 | 41968463 | − chr15 | 41815513 | 41815443 | − | ENST00000561603; ENST00000304330; ENST00000562303 | TAF |
| 28% | chr15 | 41968651 | 41968463 | − chr15 | 41815513 | 41815443 | − | ENST00000561603; ENST00000304330; ENST00000562303 | TAF |
| 26% | chr19 | 42335927 | 42335940 | + chr19 | 42364892 | 42364915 | + | ENST00000598742; ENST00000601492; ENST00000600467; ENST00000593863; ENST00000598261; ENST00000598399 | TAF |
| 26% | chr19 | 42335927 | 42335940 | + chr19 | 42364892 | 42364915 | + | ENST00000598742; ENST00000601492; ENST00000600467; ENST00000593863; ENST00000598261; ENST00000598399 | TAF |
| 26% | chr19 | 42335927 | 42335940 | + chr19 | 42364892 | 42364915 | + | ENST00000598742; ENST00000601492; ENST00000600467; ENST00000593863; ENST00000598261; ENST00000598399 | TAF |
| 26% | chr19 | 42335927 | 42335940 | + chr19 | 42364892 | 42364915 | + | ENST00000598742; ENST00000601492; ENST00000600467; ENST00000593863; ENST00000598261; ENST00000598399 | TAF |
| 26% | chr19 | 42335927 | 42335940 | + chr19 | 42364892 | 42364915 | + | ENST00000598742; ENST00000601492; ENST00000600467; ENST00000593863; ENST00000598261; ENST00000598399 | TAF |
| 26% | chr13 | 78549747 | 78549482 | − chr13 | 78492759 | 78492226 | − | ENST00000377211 | TAF |
| 26% | chr4 | 89198618 | 89198541 | − chr4 | 89198395 | 89198295; 89198287 | − | ENST00000608933; ENST00000295908; ENST00000315194; ENST00000514204 | TSF |
| 26% | chr4 | 89198618 | 89198541 | − chr4 | 89198395 | 89198295; 89198287 | − | ENST00000608933; ENST00000295908; ENST00000315194; ENST00000514204 | TSF |
| 26% | chr4 | 89198618 | 89198541 | − chr4 | 89198395 | 89198295; 89198287 | − | ENST00000608933; ENST00000295908; ENST00000315194; ENST00000514204 | TSF |
| 26% | chr4 | 89198618 | 89198541 | − chr4 | 89198395 | 89198295; 89198287 | − | ENST00000608933; ENST00000295908; ENST00000315194; ENST00000514204 | TSF |
| 25% | chr21 | 44307009 | 44307069 | + chr21 | 44317037 | 44317157 | + | ENST00000354250; ENST00000340344 | TAF |
| 25% | chr21 | 44307009 | 44307069 | + chr21 | 44317037 | 44317157 | + | ENST00000354250; ENST00000340344 | TAF |
| 25% | chr15 | 28123956 | 28123431 | − chr15 | 28117068 | 28117009 | − | ENST00000353809; ENST00000354638 | TSF |
| 24% | chr7 | 2289080 | 2289115 | + chr7 | 2289492 | 2289637 | + | ENST00000356714; ENST00000397049; ENST00000397046; ENST00000397048;ENST00000339737; ENST00000343985 | TAF |
| 24% | chr17 | 80812047 | 80812141 | + chr17 | 80828100 | 80828256 | + | ENST00000355528; ENST00000397466; ENST00000539345 | TSF |
| 24% | chr17 | 80812047 | 80812141 | + chr17 | 80828100 | 80828256 | + | ENST00000355528; ENST00000397466; ENST00000539345 | TSF |
| 24% | chr17 | 80812047 | 80812141 | + chr17 | 80828100 | 80828256 | + | ENST00000355528; ENST00000397466; ENST00000539345 | TSF |
| 24% | chr9 | 131400020 | 131399953 | − chr9 | 131399306 | 131399197 | − | ENST00000372715; ENST00000451652 | TSF |
| 24% | chr9 | 131400020 | 131399953 | − chr9 | 131399306 | 131399197 | − | ENST00000372715; ENST00000451652 | TSF |
| 22% | chr1 | 1496761 | 1496712 | − chr1 | 1480382 | 1480243 | − | ENST00000291386 | TSF |
| 21% | chr14 | 102691697 | 102691432 | − chr14 | 102691131 | 102691116 | − | ENST00000559838 | TAF |
| 20% | chr9 | 74533392 | 74533471 | + chr9 | 74561922 | 74562028 | + | ENST00000334731; ENST00000377031; ENST00000486911 | TAF |
| 20% | chr9 | 74533392 | 74533471 | + chr9 | 74561922 | 74562028 | + | ENST00000334731; ENST00000377031; ENST00000486911 | TAF |
| 20% | chr9 | 74533392 | 74533471 | + chr9 | 74561922 | 74562028 | + | ENST00000334731; ENST00000377031; ENST00000486911 | TAF |
| 20% | chr19 | 41816850 | 41816920 | + chr19 | 41822289 | 41822744 | + | ENST00000269967 | TAF |
| 20% | chr10 | 111986999 | 111987095 | + chr10 | 111987947 | 111988079 | + | ENST00000332674; ENST00000453116; ENST00000239007; ENST00000393134 | TAF |
| 20% | chr10 | 111986999 | 111987095 | + chr10 | 111987947 | 111988079 | + | ENST00000332674; ENST00000453116; ENST00000239007; ENST00000393134 | TAF |
| 20% | chr10 | 111986999 | 111987095 | + chr10 | 111987947 | 111988079 | + | ENST00000332674; ENST00000453116; ENST00000239007; ENST00000393134 | TAF |
| 20% | chr8 | 54841106 | 54841324 | + chr8 | 54852136 | 54852284 | + | ENST00000297313; ENST00000344277; ENST00000276500 | TAF |
| 19% | chr11 | 46670360 | 46670417 | + chr11 | 46670687 | 46670733 | + | ENST00000312040; ENST00000434074; ENST00000451945; ENST00000529655; ENST00000533325; ENST00000530500; ENST00000526508; ENST00000524625; ENST00000359513; ENST00000528494; ENST00000395549 | TAF |

TABLE 70-continued

Transcript fusion for Uveal Melanoma (UVM) Coordinates of the fusion sequences for which the donor is the TE.

| 1 | 2' | 3' | 4' | 5' 6' | 7 | 8' | 9 | 10' | 11' |
|---|---|---|---|---|---|---|---|---|---|
| 19% | chr11 | 46670360 | 46670417 | + chr11 | 46670687 | 46670733 | + | ENST00000312040; ENST00000434074; ENST00000451945; ENST00000529655; ENST00000533325; ENST00000530500; ENST00000526508; ENST00000524625; ENST00000359513; ENST00000528494; ENST00000395549 | TAF |
| 19% | chr11 | 46670360 | 46670417 | + chr11 | 46670687 | 46670733 | + | ENST00000312040; ENST00000434074; ENST00000451945; ENST00000529655; ENST00000533325; ENST00000530500; ENST00000526508; ENST00000524625; ENST00000359513; ENST00000528494; ENST00000395549 | TAF |
| 19% | chr11 | 46670360 | 46670417 | + chr11 | 46670687 | 46670733 | + | ENST00000312040; ENST00000434074; ENST00000451945; ENST00000529655; ENST00000533325; ENST00000530500; ENST00000526508; ENST00000524625; ENST00000359513; ENST00000528494; ENST00000395549 | TAF |
| 19% | chr11 | 46670360 | 46670417 | + chr11 | 46670687 | 46670733 | + | ENST00000312040; ENST00000434074; ENST00000451945; ENST00000529655; ENST00000533325; ENST00000530500; ENST00000526508; ENST00000524625; ENST00000359513; ENST00000528494; ENST00000395549 | TAF |
| 19% | chr19 | 54631006 | 54631115 | + chr19 | 54631448 | 54631575 | + | ENST00000321030; ENST00000419967 | TAF |
| 19% | chr19 | 54631006 | 54631115 | + chr19 | 54631448 | 54631575 | + | ENST00000321030; ENST00000419967 | TAF |
| 18% | chr11 | 126266642 | 126266739 | + chr11 | 126275991 | 126276045 | + | ENST00000534733 | TSF |
| 16% | chr12 | 110610148 | 110610836 | + chr12 | 110618227 | 110618376 | + | ENST00000552912; ENST00000242591; ENST00000550156 | TAF |
| 16% | chr12 | 110610148 | 110610836 | + chr12 | 110618227 | 110618376 | + | ENST00000552912; ENST00000242591; ENST00000550156 | TAF |
| 16% | chr7 | 150730019 | 150730148 | + chr7 | 150730692 | 150730929; 150731004; 150730700 | + | ENST00000461373; ENST00000358849; ENST00000489192; ENST00000297504; ENST00000356058; ENST00000498578; ENST00000477719; ENST00000477092 | TAF |
| 16% | chr7 | 150730019 | 150730148 | + chr7 | 150730692 | 150730929; 150731004; 150730700 | + | ENST00000461373; ENST00000358849; ENST00000489192; ENST00000297504; ENST00000356058; ENST00000498578; ENST00000477719; ENST00000477092 | TAF |
| 16% | chr7 | 150730019 | 150730148 | + chr7 | 150730692 | 150730929; 150731004; 150730700 | + | ENST00000461373; ENST00000358849; ENST00000489192; ENST00000297504; ENST00000356058; ENST00000498578; ENST00000477719; ENST00000477092 | TAF |
| 16% | chr7 | 150730019 | 150730148 | + chr7 | 150730692 | 150730929; 150731004; 150730700 | + | ENST00000461373; ENST00000358849; ENST00000489192; ENST00000297504; ENST00000356058; ENST00000498578; ENST00000477719; ENST00000477092 | TAF |
| 16% | chr7 | 150730019 | 150730148 | + chr7 | 150730692 | 150730929; 150731004; 150730700 | + | ENST00000461373; ENST00000358849; ENST00000489192; ENST00000297504; ENST00000356058; ENST00000498578; ENST00000477719; ENST00000477092 | TAF |
| 16% | chr7 | 150730019 | 150730148 | + chr7 | 150730692 | 150730929; 150731004; 150730700 | + | ENST00000461373; ENST00000358849; ENST00000489192; ENST00000297504; ENST00000356058; ENST00000498578; ENST00000477719; ENST00000477092 | TAF |
| 16% | chr7 | 150730019 | 150730148 | + chr7 | 150730692 | 150730929; 150731004; 150730700 | + | ENST00000461373; ENST00000358849; ENST00000489192; ENST00000297504; ENST00000356058; ENST00000498578; ENST00000477719; ENST00000477092 | TAF |
| 16% | chr11 | 126245394 | 126245491 | + chr11 | 126275991 | 126276045 | + | ENST00000534733 | TSF |
| 16% | chr12 | 104229950 | 104229670 | − chr12 | 104208899 | 104208715 | − | ENST00000392876 | TSF |
| 16% | chr12 | 56357933 | 56357814 | − chr12 | 56355516 | 56355406 | − | ENST00000449260; ENST00000552882; ENST00000548747; ENST00000360714; ENST00000536427; ENST00000548493; ENST00000548803; ENST00000547137; ENST00000546543; ENST00000549418; ENST00000549233 | TSF |
| 16% | chr12 | 56357933 | 56357814 | − chr12 | 56355516 | 56355406 | − | ENST00000449260; ENST00000552882; ENST00000548747; ENST00000360714; ENST00000536427; ENST00000548493; ENST00000548803; ENST00000547137; ENST00000546543; ENST00000549418; ENST00000549233 | TSF |
| 16% | chr12 | 56357933 | 56357814 | − chr12 | 56355516 | 56355406 | − | ENST00000449260; ENST00000552882; ENST00000548747; ENST00000360714; ENST00000536427; ENST00000548493; ENST00000548803; ENST00000547137; ENST00000546543; ENST00000549418; ENST00000549233 | TSF |
| 16% | chr12 | 56357933 | 56357814 | − chr12 | 56355516 | 56355406 | − | ENST00000449260; ENST00000552882; ENST00000548747; ENST00000360714; ENST00000536427; ENST00000548493; ENST00000548803; ENST00000547137; ENST00000546543; ENST00000549418; ENST00000549233 | TSF |
| 16% | chr12 | 56357933 | 56357814 | − chr12 | 56355516 | 56355406 | − | ENST00000449260; ENST00000552882; ENST00000548747; ENST00000360714; ENST00000536427; ENST00000548493; ENST00000548803; ENST00000547137; ENST00000546543; ENST00000549418; ENST00000549233 | TSF |
| 16% | chr12 | 56357933 | 56357814 | − chr12 | 56355516 | 56355406 | − | ENST00000449260; ENST00000552882; ENST00000548747; ENST00000360714; ENST00000536427; ENST00000548493; ENST00000548803; ENST00000547137; ENST00000546543; ENST00000549418; ENST00000549233 | TSF |
| 16% | chr12 | 56357933 | 56357814 | − chr12 | 56355516 | 56355406 | − | ENST00000449260; ENST00000552882; ENST00000548747; ENST00000360714; ENST00000536427; ENST00000548493; ENST00000548803; ENST00000547137; ENST00000546543; ENST00000549418; ENST00000549233 | TSF |
| 16% | chr12 | 56357933 | 56357814 | − chr12 | 56355516 | 56355406 | − | ENST00000449260; ENST00000552882; ENST00000548747; ENST00000360714; ENST00000536427; ENST00000548493; ENST00000548803; ENST00000547137; ENST00000546543; ENST00000549418; ENST00000549233 | TSF |

TABLE 70-continued

Transcript fusion for Uveal Melanoma (UVM) Coordinates of the fusion sequences for which the donor is the TE.

| 1 | 2' | 3' | 4' | 5' | 6' | 7 | 8' | 9 | 10' | 11' |
|---|---|---|---|---|---|---|---|---|---|---|
| 16% | chr12 | 56357933 | 56357814 | − | chr12 | 56355516 | 56355406 | − | ENST00000449260; ENST00000552882; ENST00000548747; ENST00000360714; ENST00000536427; ENST00000548493; ENST00000548803; ENST00000547137; ENST00000546543; ENST00000549418; ENST00000549233 | TSF |
| 15% | chr10 | 111986999 | 111987135 | + | chr10 | 111987947 | 111988079 | + | ENST00000332674; ENST00000453116; ENST00000239007; ENST00000393134 | TAF |
| 15% | chr10 | 111986999 | 111987135 | + | chr10 | 111987947 | 111988079 | + | ENST00000332674; ENST00000453116; ENST00000239007; ENST00000393134 | TAF |
| 15% | chr10 | 111986999 | 111987135 | + | chr10 | 111987947 | 111988079 | + | ENST00000332674; ENST00000453116; ENST00000239007; ENST00000393134 | TAF |
| 15% | chr7 | 2289080 | 2289194 | + | chr7 | 2289492 | 2289637 | + | ENST00000356714; ENST00000397049; ENST00000397046; ENST00000397048; ENST00000339737; ENST00000343985 | TAF |
| 15% | chr10 | 82214092 | 82214127 | + | chr10 | 82264484 | 82264534 | + | ENST00000429989; ENST00000372158; ENST00000341863; ENST00000372156 | TAF |
| 15% | chr10 | 82214092 | 82214127 | + | chr10 | 82264484 | 82264534 | + | ENST00000429989; ENST00000372158; ENST00000341863; ENST00000372156 | TAF |
| 15% | chr2 | 238451313 | 238451319 | + | chr2 | 238455249 | 238455326 | + | ENST00000410032; ENST00000264605; ENST00000338530; ENST00000409373; ENST00000437893; ENST00000415753; ENST00000432475; ENST00000434770 | TAF |
| 15% | chr2 | 238451313 | 238451319 | + | chr2 | 238455249 | 238455326 | + | ENST00000410032; ENST00000264605; ENST00000338530; ENST00000409373; ENST00000437893; ENST00000415753; ENST00000432475; ENST00000434770 | TAF |
| 15% | chr2 | 238451313 | 238451319 | + | chr2 | 238455249 | 238455326 | + | ENST00000410032; ENST00000264605; ENST00000338530; ENST00000409373; ENST00000437893; ENST00000415753; ENST00000432475; ENST00000434770 | TAF |
| 15% | chrX | 3773692 | 3773630 | − | chrX | 3735819 | 3735816 | − | ENST00000425492 | TAF |
| 15% | chr19 | 48627094 | 48627044 | − | chr19 | 48626575 | 48626431 | − | ENST00000263274; ENST00000536218; ENST00000594759; ENST00000427526; ENST00000601091 | TSF |
| 15% | chr19 | 48627094 | 48627044 | − | chr19 | 48626575 | 48626431 | − | ENST00000263274; ENST00000536218; ENST00000594759; ENST00000427526; ENST00000601091 | TSF |
| 15% | chr8 | 144691011 | 144690934 | − | chr8 | 144690296 | 144690232 | − | ENST00000220966; ENST00000433751 | TSF |
| 15% | chr8 | 144691011 | 144690934 | − | chr8 | 144690296 | 144690232 | − | ENST00000220966; ENST00000433751 | TSF |
| 15% | chr16 | 70714570 | 70714506 | − | chr16 | 70713958 | 70713874 | − | ENST00000338779 | TSF |
| 15% | chr7 | 100850556 | 100850506 | − | chr7 | 100850185 | 100850060 | − | ENST00000454310; ENST00000223127 | TSF |
| 14% | chr6 | 26474324 | 26474624 | + | chr6 | 26476389 | 26476396 | + | ENST00000480218 | TAF |
| 14% | chr1 | 93299408 | 93299506 | + | chr1 | 93300336 | 93300470 | + | ENST00000370321; ENST00000315741 | TAF |
| 14% | chr1 | 93299408 | 93299506 | + | chr1 | 93300336 | 93300470 | + | ENST00000370321; ENST00000315741 | TAF |
| 14% | chr5 | 54528691 | 54528595 | − | chr5 | 54528374 | 54528189 | − | ENST00000282572 | TAF |
| 14% | chr1 | 183600359 | 183599874 | − | chr1 | 183599772 | 183599596 | − | ENST00000367534; ENST00000359856; ENST00000294742 | TAF |
| 14% | chr1 | 183600359 | 183599874 | − | chr1 | 183599772 | 183599596 | − | ENST00000367534; ENST00000359856; ENST00000294742 | TAF |
| 14% | chr19 | 36028515 | 36028550 | + | chr19 | 36029209 | 36029305; 36029276 | + | ENST00000222286; ENST00000586334; ENST00000585510 | TSF |
| 14% | chr19 | 36028515 | 36028550 | + | chr19 | 36029209 | 36029305; 36029276 | + | ENST00000222286; ENST00000586334; ENST00000585510 | TSF |
| 14% | chr19 | 36028515 | 36028550 | + | chr19 | 36029209 | 36029305; 36029276 | + | ENST00000222286; ENST00000586334; ENST00000585510 | TSF |
| 14% | chr12 | 110610148 | 110610701 | + | chr12 | 110618227 | 110618376 | + | ENST00000552912; ENST00000242591; ENST00000550156 | TSF |
| 14% | chr12 | 110610148 | 110610701 | + | chr12 | 110618227 | 110618376 | + | ENST00000552912; ENST00000242591; ENST00000550156 | TSF |
| 14% | chr15 | 31367719 | 31365913 | − | chr15 | 31362429 | 31362234; 31362036 | − | ENST00000397795; ENST00000256552; ENST00000542188; ENST00000558445; ENST00000559177; ENST00000560658; ENST00000559179 | TSF |
| 14% | chr15 | 31367719 | 31365913 | − | chr15 | 31362429 | 31362234; 31362036 | − | ENST00000397795; ENST00000256552; ENST00000542188; ENST00000558445; ENST00000559177; ENST00000560658; ENST00000559179 | TSF |
| 14% | chr15 | 31367719 | 31365913 | − | chr15 | 31362429 | 31362234; 31362036 | − | ENST00000397795; ENST00000256552; ENST00000542188; ENST00000558445; ENST00000559177; ENST00000560658; ENST00000559179 | TSF |
| 14% | chr15 | 31367719 | 31365913 | − | chr15 | 31362429 | 31362234; 31362036 | − | ENST00000397795; ENST00000256552; ENST00000542188; ENST00000558445; ENST00000559177; ENST00000560658; ENST00000559179 | TSF |
| 14% | chr15 | 31367719 | 31365913 | − | chr15 | 31362429 | 31362234; 31362036 | − | ENST00000397795; ENST00000256552; ENST00000542188; ENST00000558445; ENST00000559177; ENST00000560658; ENST00000559179 | TSF |
| 12% | chr21 | 42597177 | 42597622 | + | chr21 | 42598193 | 42598281 | + | ENST00000328735; ENST00000330333; ENST00000347667 | TAF |
| 12% | chr21 | 42597177 | 42597622 | + | chr21 | 42598193 | 42598281 | + | ENST00000328735; ENST00000330333; ENST00000347667 | TAF |
| 12% | chr21 | 42597177 | 42597622 | + | chr21 | 42598193 | 42598281 | + | ENST00000328735; ENST00000330333; ENST00000347667 | TAF |
| 12% | chr1 | 212594935 | 212594948 | + | chr1 | 212615907 | 212615967 | + | ENST00000366988 | TAF |
| 12% | chr8 | 104389530 | 104389551 | + | chr8 | 104390255 | 104390471 | + | ENST00000330295; ENST00000520337 | TAF |
| 12% | chr9 | 128362212 | 128362114 | − | chr9 | 128348006 | 128347834 | − | ENST00000373511; ENST00000373498; ENST00000350766; ENST00000265960; ENST00000394060; ENST00000468896 | TAF |
| 12% | chr9 | 128362212 | 128362114 | − | chr9 | 128348006 | 128347834 | − | ENST00000373511; ENST00000373498; ENST00000350766; ENST00000265960; ENST00000394060; ENST00000468896 | TAF |
| 12% | chr9 | 128362212 | 128362114 | − | chr9 | 128348006 | 128347834 | − | ENST00000373511; ENST00000373498; ENST00000350766; ENST00000265960; ENST00000394060; ENST00000468896 | TAF |
| 12% | chr9 | 128362212 | 128362114 | − | chr9 | 128348006 | 128347834 | − | ENST00000373511; ENST00000373498; ENST00000350766; ENST00000265960; ENST00000394060; ENST00000468896 | TAF |

TABLE 70-continued

Transcript fusion for Uveal Melanoma (UVM) Coordinates of the fusion sequences for which the donor is the TE.

| 1 | 2' | 3' | 4' | 5' | 6' | 7 | 8' | 9 | 10' | 11' |
|---|---|---|---|---|---|---|---|---|---|---|
| 12% | chr9 | 128362212 | 128362114 | − | chr9 | 128348006 | 128347834 | − | ENST00000373511; ENST00000373498; ENST00000350766; ENST00000265960; ENST00000394060; ENST00000468896 | TAF |
| 12% | chr10 | 120902016 | 120901765 | − | chr10 | 120900831 | 120900754 | − | ENST00000355697; ENST00000330036 | |
| 12% | chr6 | 108394895 | 108394846 | − | chr6 | 108385503 | 108385389 | − | ENST00000193322 | TSF |
| 12% | chrX | 153207989 | 153207921 | − | chrX | 153207484 | 153207403 | − | ENST00000393700; ENST00000369997 | TSF |
| 12% | chr15 | 28127352 | 28127177 | − | chr15 | 28096621 | 28096528 | − | ENST00000353809; ENST00000354638 | TSF |
| 11% | chr17 | 75318693 | 75318752 | + | chr17 | 75398141 | 75398484; 75398785; 75398497; 75398565 | + | ENST00000589070; ENST00000427177; ENST00000591198; ENST00000329047; ENST00000590294; ENST00000591934; ENST00000423034; ENST00000589140 | TAF |
| 11% | chr17 | 75318693 | 75318752 | + | chr17 | 75398141 | 75398484; 75398785; 75398497; 75398565 | + | ENST00000589070; ENST00000427177; ENST00000591198; ENST00000329047; ENST00000590294; ENST00000591934; ENST00000423034; ENST00000589140 | TAF |
| 11% | chr17 | 75318693 | 75318752 | + | chr17 | 75398141 | 75398484; 75398785; 75398497; 75398565 | + | ENST00000589070; ENST00000427177; ENST00000591198; ENST00000329047; ENST00000590294; ENST00000591934; ENST00000423034; ENST00000589140 | TAF |
| 11% | chr17 | 75318693 | 75318752 | + | chr17 | 75398141 | 75398484; 75398785; 75398497; 75398565 | + | ENST00000589070; ENST00000427177; ENST00000591198; ENST00000329047; ENST00000590294; ENST00000591934; ENST00000423034; ENST00000589140 | TAF |
| 11% | chr1 | 156095197 | 156095265 | + | chr1 | 156100408 | 156100564 | + | ENST00000368301; ENST00000361308; ENST00000347559; ENST00000368300; ENST00000368299; ENST00000448611; ENST00000368297; ENST00000504687; ENST00000473598; ENST00000392353 | TAF |
| 11% | chr1 | 156095197 | 156095265 | + | chr1 | 156100408 | 156100564 | + | ENST00000368301; ENST00000361308; ENST00000347559; ENST00000368300; ENST00000368299; ENST00000448611; ENST00000368297; ENST00000504687; ENST00000473598; ENST00000392353 | TAF |
| 11% | chr1 | 156095197 | 156095265 | + | chr1 | 156100408 | 156100564 | + | ENST00000368301; ENST00000361308; ENST00000347559; ENST00000368300; ENST00000368299; ENST00000448611; ENST00000368297; ENST00000504687; ENST00000473598; ENST00000392353 | TAF |
| 11% | chr1 | 156095197 | 156095265 | + | chr1 | 156100408 | 156100564 | + | ENST00000368301; ENST00000361308; ENST00000347559; ENST00000368300; ENST00000368299; ENST00000448611; ENST00000368297; ENST00000504687; ENST00000473598; ENST00000392353 | TAF |
| 11% | chr1 | 156095197 | 156095265 | + | chr1 | 156100408 | 156100564 | + | ENST00000368301; ENST00000361308; ENST00000347559; ENST00000368300; ENST00000368299; ENST00000448611; ENST00000368297; ENST00000504687; ENST00000473598; ENST00000392353 | TAF |
| 11% | chr1 | 156095197 | 156095265 | + | chr1 | 156100408 | 156100564 | + | ENST00000368301; ENST00000361308; ENST00000347559; ENST00000368300; ENST00000368299; ENST00000448611; ENST00000368297; ENST00000504687; ENST00000473598; ENST00000392353 | TAF |
| 11% | chr11 | 321638 | 321582 | − | chr11 | 320772 | 320565 | − | ENST00000399808 | TAF |
| 11% | chr11 | 322262 | 322206 | − | chr11 | 320772 | 320565 | − | ENST00000399808 | TAF |
| 11% | chr11 | 321716 | 321660 | − | chr11 | 320772 | 320565 | − | ENST00000399808 | TAF |
| 11% | chr11 | 321450 | 321426 | − | chr11 | 320772 | 320565 | − | ENST00000399808 | TAF |
| 11% | chr11 | 322067 | 322011 | − | chr11 | 320772 | 320565 | − | ENST00000399808 | TAF |
| 11% | chr11 | 321638 | 321543 | − | chr11 | 320772 | 320565 | − | ENST00000399808 | TAF |
| 11% | chr11 | 321638 | 321504 | − | chr11 | 320772 | 320565 | − | ENST00000399808 | TAF |
| 11% | chr2 | 39225691 | 39225641 | − | chr2 | 39224566 | 39224394 | − | ENST00000426016; ENST00000402219; ENST00000395038 | TAF |
| 11% | chr2 | 39225691 | 39225641 | − | chr2 | 39224566 | 39224394 | − | ENST00000426016; ENST00000402219; ENST00000395038 | TAF |
| 11% | chr11 | 321488 | 321465 | | chr11 | 320772 | 320565 | − | ENST00000399808 | TAF |
| 11% | chr11 | 322457 | 322401 | − | chr11 | 320772 | 320565 | − | ENST00000399808 | TAF |
| 11% | chr11 | 322580 | 322557 | − | chr11 | 320772 | 320565 | − | ENST00000399808 | TAF |
| 11% | chr11 | 321911 | 321855 | − | chr11 | 320772 | 320565 | − | ENST00000399808 | TAF |
| 11% | chr11 | 321410 | 321387 | − | chr11 | 320772 | 320565 | − | ENST00000399808 | TAF |
| 10% | chr1 | 212601578 | 212602888 | + | chr1 | 212615907 | 212615967 | + | ENST00000366988 | TSF |
| 10% | chr17 | 39976225 | 39976301 | + | chr17 | 39976521 | 39976713 | + | ENST00000321562; ENST00000455106; ENST00000544340 | TSF |
| 10% | chr1 | 212596286 | 212598195 | + | chr1 | 212615907 | 212615967 | + | ENST00000366988 | TSF |
| 10% | chr9 | 5907671 | 5907771 | + | chr9 | 5908640 | 5908708 | + | ENST00000381477; ENST00000381476; ENST00000381471 | TSF |
| 10% | chr4 | 142977397 | 142977072 | − | chr4 | 142950067 | 142949935 | − | ENST00000513000; ENST00000262992; ENST00000308502; ENST00000508116 | TSF |
| 9% | chr7 | 20707326 | 20708050 | + | chr7 | 20721128 | 20721289 | + | ENST00000404938; ENST00000258738 | TSF |
| 9% | chr1 | 212596286 | 212598077 | + | chr1 | 212615911 | 212615967 | + | ENST00000366988 | TSF |
| 9% | chr14 | 61868140 | 61868698 | + | chr14 | 61909829 | 61909979 | + | ENST00000332981; ENST00000553830 | TSF |
| 9% | chr14 | 61868140 | 61868698 | + | chr14 | 61909829 | 61909979 | + | ENST00000332981; ENST00000553830 | TSF |
| 9% | chr4 | 91324981 | 91325170 | + | chr4 | 91389385 | 91389505 | + | ENST00000505073; ENST00000509176; ENST00000432775; ENST00000333691 | TSF |
| 9% | chr4 | 91324981 | 91325170 | + | chr4 | 91389385 | 91389505 | + | ENST00000505073; ENST00000509176; ENST00000432775; ENST00000333691 | TSF |
| 9% | chr4 | 91324981 | 91325170 | + | chr4 | 91389385 | 91389505 | + | ENST00000505073; ENST00000509176; ENST00000432775; ENST00000333691 | TSF |

TABLE 70-continued

Transcript fusion for Uveal Melanoma (UVM) Coordinates of the fusion sequences for which the donor is the TE.

| 1 | 2' | 3' | 4' | 5' | 6' | 7 | 8' | 9 | 10' | 11' |
|---|---|---|---|---|---|---|---|---|---|---|
| 9% | chr1 | 168067171 | 168067120 | − | chr1 | 168066470 | 168065746 | − | ENST00000367838; ENST00000271357; ENST00000539777; ENST00000361697; ENST00000537209; ENST00000546300; ENST00000367835 | TSF |
| 9% | chr2 | 17876171 | 17876059 | − | chr2 | 17865030 | 17864905 | − | ENST00000448223; ENST00000351948; ENST00000381272; ENST00000402989 | TSF |
| 8% | chr17 | 74943634 | 74943777 | + | chr17 | 74943912 | 74944168 | + | ENST00000301618; ENST00000569840; ENST00000428789 | TSF |
| 8% | chr1 | 212601578 | 212602718 | + | chr1 | 212615907 | 212615967 | + | ENST00000366988 | TSF |
| 8% | chr12 | 56359010 | 56358944 | − | chr12 | 56355516 | 56355406 | − | ENST00000449260; ENST00000552882; ENST00000548747; ENST00000360714; ENST00000536427; ENST00000548493; ENST00000548803; ENST00000547137; ENST00000546543; ENST00000549418; ENST00000549233 | TSF |
| 8% | chr12 | 56359010 | 56358944 | − | chr12 | 56355516 | 56355406 | − | ENST00000449260; ENST00000552882; ENST00000548747; ENST00000360714; ENST00000536427; ENST00000548493; ENST00000548803; ENST00000547137; ENST00000546543; ENST00000549418; ENST00000549233 | TSF |
| 8% | chr12 | 56359010 | 56358944 | − | chr12 | 56355516 | 56355406 | − | ENST00000449260; ENST00000552882; ENST00000548747; ENST00000360714; ENST00000536427; ENST00000548493; ENST00000548803; ENST00000547137; ENST00000546543; ENST00000549418; ENST00000549233 | TSF |
| 8% | chr12 | 56359010 | 56358944 | − | chr12 | 56355516 | 56355406 | − | ENST00000449260; ENST00000552882; ENST00000548747; ENST00000360714; ENST00000536427; ENST00000548493; ENST00000548803; ENST00000547137; ENST00000546543; ENST00000549418; ENST00000549233 | TSF |
| 8% | chr12 | 56359010 | 56358944 | − | chr12 | 56355516 | 56355406 | − | ENST00000449260; ENST00000552882; ENST00000548747; ENST00000360714; ENST00000536427; ENST00000548493; ENST00000548803; ENST00000547137; ENST00000546543; ENST00000549418; ENST00000549233 | TSF |
| 8% | chr12 | 56359010 | 56358944 | − | chr12 | 56355516 | 56355406 | − | ENST00000449260; ENST00000552882; ENST00000548747; ENST00000360714; ENST00000536427; ENST00000548493; ENST00000548803; ENST00000547137; ENST00000546543; ENST00000549418; ENST00000549233 | TSF |
| 8% | chr12 | 56359010 | 56358944 | − | chr12 | 56355516 | 56355406 | − | ENST00000449260; ENST00000552882; ENST00000548747; ENST00000360714; ENST00000536427; ENST00000548493; ENST00000548803; ENST00000547137; ENST00000546543; ENST00000549418; ENST00000549233 | TSF |
| 8% | chr12 | 56359010 | 56358944 | − | chr12 | 56355516 | 56355406 | − | ENST00000449260; ENST00000552882; ENST00000548747; ENST00000360714; ENST00000536427; ENST00000548493; ENST00000548803; ENST00000547137; ENST00000546543; ENST00000549418; ENST00000549233 | TSF |
| 8% | chr12 | 56359010 | 56358944 | − | chr12 | 56355516 | 56355406 | − | ENST00000449260; ENST00000552882; ENST00000548747; ENST00000360714; ENST00000536427; ENST00000548493; ENST00000548803; ENST00000547137; ENST00000546543; ENST00000549418; ENST00000549233 | TSF |
| 8% | chr10 | 22995124 | 22994872 | − | chr10 | 22898646 | 22898549 | − | ENST00000376573 | TSF |
| 8% | chr13 | 78549747 | 78549606 | − | chr13 | 78492759 | 78492226 | − | ENST00000377211 | TSF |
| 8% | chr17 | 28255620 | 28255510 | − | chr17 | 28252573 | 28252490 | − | ENST00000582084; ENST00000590153 | TSF |
| 8% | chr1 | 1496761 | 1496712 | − | chr1 | 1479367 | 1479249 | − | ENST00000291386 | TSF |

Description of the sequences

| SEQ ID NO | Description |
|---|---|
| 1-117 | LUAD peptide sequences from P1 application |
| 118-431 | Table 3 from P1 application Fusion sequences with exon donor |
| 432-910 | Table 4 from P1 application Fusion sequence with TE donor |
| 911-972 | New sequences - TCGA-ACC Fusion sequences with exon donor |
| 973-1237 | New sequences - TCGA-BLCA Fusion sequences with exon donor |
| 1238-1466 | New sequences - TCGA-BRCA Fusion sequences with exon donor |
| 1467-1632 | New sequences - TCGA-CESC Fusion sequences with exon donor |
| 1633-1696 | New sequences - TCGA-CHOL Fusion sequences with exon donor |
| 1697-1801 | New sequences - TCGA-COAD Fusion sequences with exon donor |
| 1802-1925 | New sequences - TCGA-DLBC Fusion sequences with exon donor |

-continued

| Description of the sequences | |
|---|---|
| SEQ ID NO | Description |
| 1926-2205 | New sequences - TCGA-ESCA Fusion sequences with exon donor |
| 2206-2393 | New sequences - TCGA-GBM Fusion sequences with exon donor |
| 2394-2608 | New sequences - TCGA-HNSC Fusion sequences with exon donor |
| 2609-2721 | New sequences - TCGA-KICH Fusion sequences with exon donor |
| 2722-2890 | New sequences - TCGA-KIRC Fusion sequences with exon donor |
| 2891-2986 | New sequences - TCGA-KIRP Fusion sequences with exon donor |
| 2987-3277 | New sequences - TCGA-LGG Fusion sequences with exon donor |
| 3278-3435 | New sequences - TCGA-LIHC Fusion sequences with exon donor |
| 3436-3624 | New sequences - TCGA-LUAD Fusion sequences with exon donor |
| 3625-3946 | New sequences - TCGA-LUSC Fusion sequences with exon donor |
| 3947-4001 | New sequences - TCGA-MESO Fusion sequences with exon donor |
| 4002-4597 | New sequences - TCGA-OV Fusion sequences with exon donor |
| 4598-4660 | New sequences - TCGA-PAAD Fusion sequences with exon donor |
| 4661-4811 | New sequences - TCGA-PCPG Fusion sequences with exon donor |
| 4812-4970 | New sequences - TCGA-PRAD Fusion sequences with exon donor |
| 4971-5030 | New sequences - TCGA-READ Fusion sequences with exon donor |
| 5031-5150 | New sequences - TCGA-SARC Fusion sequences with exon donor |
| 5151-5266 | New sequences - TCGA-SKCM Fusion sequences with exon donor |
| 5267-5628 | New sequences - TCGA-STAD Fusion sequences with exon donor |
| 5629-5876 | New sequences - TCGA-TGCT Fusion sequences with exon donor |
| 5877-5979 | New sequences - TCGA-THCA Fusion sequences with exon donor |
| 5980-6119 | New sequences - TCGA-THYM Fusion sequences with exon donor |
| 6120-6190 | New sequences - TCGA-UCEC Fusion sequences with exon donor |
| 6191-6247 | New sequences - TCGA-UCS Fusion sequences with exon donor |
| 6248-6315 | New sequences - TCGA-UVM Fusion sequences with exon donor |
| 6316-6441 | New sequences - TCGA-ACC Fusion sequences with TE donor |
| 6442-6810 | New sequences - TCGA-BLCA Fusion sequences with TE donor |
| 6811-7275 | New sequences - TCGA-BRCA Fusion sequences with TE donor |
| 7276-7515 | New sequences - TCGA-CESC Fusion sequences with TE donor |
| 7516-7638 | New sequences - TCGA-CHOL Fusion sequences with TE donor |
| 7639-7817 | New sequences - TCGA-COAD Fusion sequences with TE donor |
| 7818-8055 | New sequences - TCGA-DLBC Fusion sequences with TE donor |
| 8056-8703 | New sequences - TCGA-ESCA Fusion sequences with TE donor |
| 8704-9163 | New sequences - TCGA-GBM Fusion sequences with TE donor |
| 9164-9653 | New sequences - TCGA-HNSC Fusion sequences with TE donor |
| 9654-9883 | New sequences - TCGA-KICH Fusion sequences with TE donor |
| 9884-10277 | New sequences - TCGA-KIRC Fusion sequences with TE donor |

```
                      Description of the sequences
SEQ ID NO   Description 10278-10454 New sequences - TCGA-KIRP Fusion sequences with TE donor 10455-11125 New sequences - TCGA-LGG Fusion sequences with TE donor 11126-11547 New sequences - TCGA-LIHC Fusion sequences with TE donor 11548-11890 New sequences - TCGA-LUAD Fusion sequences with TE donor 11891-12574 New sequences - TCGA-LUSC Fusion sequences with TE donor 12575-12698 New sequences - TCGA-MESO Fusion sequences with TE donor 12699-13750 New sequences - TCGA-OV Fusion sequences with TE donor 13751-13828 New sequences - TCGA-PAAD Fusion sequences with TE donor 13829-14029 New sequences - TCGA-PCPG Fusion sequences with TE donor 14030-14419 New sequences - TCGA-PRAD Fusion sequences with TE donor 14420-14524 New sequences - TCGA-READ Fusion sequences with TE donor 14525-14776 New sequences - TCGA-SARC Fusion sequences with TE donor 14777-15051 New sequences - TCGA-SKCM Fusion sequences with TE donor 15052-15902 New sequences - TCGA-STAD Fusion sequences with TE donor 15903-16545 New sequences - TCGA-TGCT Fusion sequences with TE donor 16546-16688 New sequences - TCGA-THCA Fusion sequences with TE donor 16689-16951 New sequences - TCGA-THYM Fusion sequences with TE donor 16952-17101 New sequences - TCGA-UCEC Fusion sequences with TE donor 17102-17261 New sequences - TCGA-UCS Fusion sequences with TE donor 17262-17492 New sequences - TCGA-UVM Fusion sequences with TE donor
```

SEQUENCE LISTING (17496 sequences)

SEQ ID NO: 1 - protein, 9 aa, synthetic construct
  REGION 1..9: note = Synthetic peptide
RLLHLESFL

SEQ ID NO: 2 - protein, 9 aa, synthetic construct
  REGION 1..9: note = Synthetic peptide
TLMNLVQVL

SEQ ID NO: 3 - protein, 9 aa, synthetic construct
  REGION 1..9: note = Synthetic peptide
ILHSLVTGV

SEQ ID NO: 4 - protein, 9 aa, synthetic construct
  REGION 1..9: note = Synthetic peptide
FMMEQVGLA

SEQ ID NO: 5 - protein, 9 aa, synthetic construct
  REGION 1..9: note = Synthetic peptide
AMDGKELSL

SEQ ID NO: 6 - protein, 9 aa, synthetic construct
  REGION 1..9: note = Synthetic peptide
TLAYGKYYI

SEQ ID NO: 7 - protein, 9 aa, synthetic construct
  REGION 1..9: note = Synthetic peptide
GLIQLIWLA

SEQ ID NO: 8 - protein, 9 aa, synthetic construct
  REGION 1..9: note = Synthetic peptide
GMVDGGSNI

SEQ ID NO: 9 - protein, 9 aa, synthetic construct
  REGION 1..9: note = Synthetic peptide
YLWTTFFPL

SEQ ID NO: 10 - protein, 9 aa, synthetic construct
  REGION 1..9: note = Synthetic peptide
ALWEAKMII

SEQ ID NO: 11 - protein, 9 aa, synthetic construct
  REGION 1..9: note = Synthetic peptide
WLSSRVTQL

SEQ ID NO: 12 - protein, 9 aa, synthetic construct
  REGION 1..9: note = Synthetic peptide
AILPKANTV

SEQ ID NO: 13 - protein, 9 aa, synthetic construct
  REGION 1..9: note = Synthetic peptide
VLLFEVELV

SEQ ID NO: 14 - protein, 9 aa, synthetic construct
  REGION 1..9: note = Synthetic peptide
GLDTGLQGM

SEQ ID NO: 15 - protein, 9 aa, synthetic construct
  REGION 1..9: note = Synthetic peptide
SLLDGTQLF

SEQ ID NO: 16 - protein, 9 aa, synthetic construct
  REGION 1..9: note = Synthetic peptide
GLPTGYLFV

SEQ ID NO: 17 - protein, 9 aa, synthetic construct
  REGION 1..9: note = Synthetic peptide
LLDRFGYHV

SEQ ID NO: 18 - protein, 9 aa, synthetic construct
  REGION 1..9: note = Synthetic peptide
SLLEETQAI

SEQ ID NO: 19 - protein, 9 aa, synthetic construct
  REGION 1..9: note = Synthetic peptide
MLLVQPAEL

SEQ ID NO: 20 - protein, 9 aa, synthetic construct
  REGION 1..9: note = Synthetic peptide
GLLNISHTA

SEQ ID NO: 21 - protein, 9 aa, synthetic construct
  REGION 1..9: note = Synthetic peptide
HLYEPWFPV

SEQ ID NO: 22 - protein, 9 aa, synthetic construct
  REGION 1..9: note = Synthetic peptide
YLQGLPLPL

SEQ ID NO: 23 - protein, 9 aa, synthetic construct
  REGION 1..9: note = Synthetic peptide
KAVEGILAV

SEQ ID NO: 24 - protein, 9 aa, synthetic construct
  REGION 1..9: note = Synthetic peptide
MIYEENNRL

SEQ ID NO: 25 - protein, 9 aa, synthetic construct
  REGION 1..9: note = Synthetic peptide
YLPYFLKSL

SEQ ID NO: 26 - protein, 9 aa, synthetic construct
  REGION 1..9: note = Synthetic peptide
GLYSLSSVV

SEQ ID NO: 27 - protein, 9 aa, synthetic construct
  REGION 1..9: note = Synthetic peptide
LMISRTPEV

SEQ ID NO: 28 - protein, 9 aa, synthetic construct
  REGION 1..9: note = Synthetic peptide
LLGGPSVFL

SEQ ID NO: 29 - protein, 9 aa, synthetic construct
  REGION 1..9: note = Synthetic peptide
ILSGYGPCV

SEQ ID NO: 30 - protein, 9 aa, synthetic construct
  REGION 1..9: note = Synthetic peptide
FLPDLDRPL

SEQ ID NO: 31 - protein, 9 aa, synthetic construct
  REGION 1..9: note = Synthetic peptide
AMDGKELSL

SEQ ID NO: 32 - protein, 9 aa, synthetic construct
  REGION 1..9: note = Synthetic peptide
RMDFEDLGL

SEQ ID NO: 33 - protein, 9 aa, synthetic construct
  REGION 1..9: note = Synthetic peptide
TLIFNPTEI

SEQ ID NO: 34 - protein, 9 aa, synthetic construct
  REGION 1..9: note = Synthetic peptide
LLPGLLLLL

SEQ ID NO: 35 - protein, 9 aa, synthetic construct
  REGION 1..9: note = Synthetic peptide
LLLVHQHAV

SEQ ID NO: 36 - protein, 9 aa, synthetic construct
  REGION 1..9: note = Synthetic peptide
FLDDAPPGT

SEQ ID NO: 37 - protein, 9 aa, synthetic construct
  REGION 1..9: note = Synthetic peptide
VLIRYVWTL

SEQ ID NO: 38 - protein, 9 aa, synthetic construct
  REGION 1..9: note = Synthetic peptide
YLCGHLHTL

SEQ ID NO: 39 - protein, 9 aa, synthetic construct
  REGION 1..9: note = Synthetic peptide
VLSQLTILI

SEQ ID NO: 40 - protein, 9 aa, synthetic construct
  REGION 1..9: note = Synthetic peptide
TLGGLMPVL

SEQ ID NO: 41 - protein, 9 aa, synthetic construct
  REGION 1..9: note = Synthetic peptide
FLQGSITFI

SEQ ID NO: 42 - protein, 9 aa, synthetic construct
  REGION 1..9: note = Synthetic peptide
MLLLYIWQV

SEQ ID NO: 43 - protein, 9 aa, synthetic construct
  REGION 1..9: note = Synthetic peptide
YLKIMPVHL

SEQ ID NO: 44 - protein, 9 aa, synthetic construct
  REGION 1..9: note = Synthetic peptide
HTLGGLMPV

SEQ ID NO: 45 - protein, 9 aa, synthetic construct
  REGION 1..9: note = Synthetic peptide
YIMARVLFV

SEQ ID NO: 46 - protein, 9 aa, synthetic construct
  REGION 1..9: note = Synthetic peptide
FILRTDHYI

SEQ ID NO: 47 - protein, 9 aa, synthetic construct
  REGION 1..9: note = Synthetic peptide
IMSSAIAYL

SEQ ID NO: 48 - protein, 9 aa, synthetic construct
  REGION 1..9: note = Synthetic peptide
FIIGILQLA

SEQ ID NO: 49 - protein, 9 aa, synthetic construct
  REGION 1..9: note = Synthetic peptide
YLLQEIYGI

SEQ ID NO: 50 - protein, 9 aa, synthetic construct
  REGION 1..9: note = Synthetic peptide
GVFPVVIQA

SEQ ID NO: 51 - protein, 9 aa, synthetic construct
  REGION 1..9: note = Synthetic peptide
ALVHLPSQL

SEQ ID NO: 52 - protein, 9 aa, synthetic construct
  REGION 1..9: note = Synthetic peptide
GLHPAKPQV

SEQ ID NO: 53 - protein, 9 aa, synthetic construct
  REGION 1..9: note = Synthetic peptide
MLVTWELAL

SEQ ID NO: 54 - protein, 9 aa, synthetic construct
  REGION 1..9: note = Synthetic peptide
VLLTNTIWL

SEQ ID NO: 55 - protein, 9 aa, synthetic construct
  REGION 1..9: note = Synthetic peptide
ALVHLPSQL

SEQ ID NO: 56 - protein, 9 aa, synthetic construct
  REGION 1..9: note = Synthetic peptide
CLIDEMPEA

SEQ ID NO: 57 - protein, 9 aa, synthetic construct
  REGION 1..9: note = Synthetic peptide
ALMGGFMKT

SEQ ID NO: 58 - protein, 9 aa, synthetic construct
  REGION 1..9: note = Synthetic peptide
  SITE 8: note = misc_feature - Xaa can be any naturally occurring amino acid
LLLHLPLXL

SEQ ID NO: 59 - protein, 9 aa, synthetic construct
  REGION 1..9: note = Synthetic peptide
TLQDKNLGL

SEQ ID NO: 60 - protein, 9 aa, synthetic construct
  REGION 1..9: note = Synthetic peptide
ILANLPPAL

SEQ ID NO: 61 - protein, 9 aa, synthetic construct
  REGION 1..9: note = Synthetic peptide
PLWDGMAGL

SEQ ID NO: 62 - protein, 9 aa, synthetic construct
  REGION 1..9: note = Synthetic peptide
GLDHQTHPL

SEQ ID NO: 63 - protein, 9 aa, synthetic construct
  REGION 1..9: note = Synthetic peptide
GMFLLPPQL

SEQ ID NO: 64 - protein, 9 aa, synthetic construct
  REGION 1..9: note = Synthetic peptide
RLADHLSFC

SEQ ID NO: 65 - protein, 9 aa, synthetic construct
  REGION 1..9: note = Synthetic peptide
RMRDQLPAL

SEQ ID NO: 66 - protein, 9 aa, synthetic construct
  REGION 1..9: note = Synthetic peptide
GLLHAEVAL

SEQ ID NO: 67 - protein, 9 aa, synthetic construct
  REGION 1..9: note = Synthetic peptide
SLQNCQVSV

SEQ ID NO: 68 - protein, 9 aa, synthetic construct
  REGION 1..9: note = Synthetic peptide
VISAFPSEV

SEQ ID NO: 69 - protein, 9 aa, synthetic construct
  REGION 1..9: note = Synthetic peptide
ALAIAALEL

SEQ ID NO: 70 - protein, 9 aa, synthetic construct
  REGION 1..9: note = Synthetic peptide
VLDGLDVLL

SEQ ID NO: 71 - protein, 9 aa, synthetic construct
  REGION 1..9: note = Synthetic peptide
ELFPPLFMA

SEQ ID NO: 72 - protein, 9 aa, synthetic construct
  REGION 1..9: note = Synthetic peptide
FLIVAEILI

SEQ ID NO: 73 - protein, 9 aa, synthetic construct
  REGION 1..9: note = Synthetic peptide
IVAEILISL

SEQ ID NO: 74 - protein, 9 aa, synthetic construct
  REGION 1..9: note = Synthetic peptide
KAVEGILAV

SEQ ID NO: 75 - protein, 9 aa, synthetic construct
  REGION 1..9: note = Synthetic peptide
YLPHLPQVL

SEQ ID NO: 76 - protein, 9 aa, synthetic construct
  REGION 1..9: note = Synthetic peptide
MLLDPMGGI

SEQ ID NO: 77 - protein, 9 aa, synthetic construct
  REGION 1..9: note = Synthetic peptide
RLLHLESFL

SEQ ID NO: 78 - protein, 9 aa, synthetic construct
  REGION 1..9: note = Synthetic peptide
YLAYILYFV

SEQ ID NO: 79 - protein, 9 aa, synthetic construct
  REGION 1..9: note = Synthetic peptide
LMTSSIMSV

SEQ ID NO: 80 - protein, 9 aa, synthetic construct
  REGION 1..9: note = Synthetic peptide
MLMKTVWQA

SEQ ID NO: 81 - protein, 9 aa, synthetic construct
  REGION 1..9: note = Synthetic peptide
SLQPEDMAL

SEQ ID NO: 82 - protein, 9 aa, synthetic construct
  REGION 1..9: note = Synthetic peptide
KILTYFPMV

SEQ ID NO: 83 - protein, 9 aa, synthetic construct
  REGION 1..9: note = Synthetic peptide
FLGTRVTRV

SEQ ID NO: 84 - protein, 9 aa, synthetic construct
  REGION 1..9: note = Synthetic peptide
SLMQSGSPV

SEQ ID NO: 85 - protein, 9 aa, synthetic construct
  REGION 1..9: note = Synthetic peptide
VLMWTMAHL

SEQ ID NO: 86 - protein, 9 aa, synthetic construct
  REGION 1..9: note = Synthetic peptide
LLGETKVYV

SEQ ID NO: 87 - protein, 9 aa, synthetic construct
  REGION 1..9: note = Synthetic peptide
KILTYFPMV

SEQ ID NO: 88 - protein, 9 aa, synthetic construct
  REGION 1..9: note = Synthetic peptide
SLLERGLEA

SEQ ID NO: 89 - protein, 9 aa, synthetic construct
  REGION 1..9: note = Synthetic peptide
VLSSLNVPL

SEQ ID NO: 90 - protein, 9 aa, synthetic construct
  REGION 1..9: note = Synthetic peptide
FLERKSIRV

SEQ ID NO: 91 - protein, 9 aa, synthetic construct
  REGION 1..9: note = Synthetic peptide
FVGSSTFYL

SEQ ID NO: 92 - protein, 9 aa, synthetic construct
  REGION 1..9: note = Synthetic peptide
FLYTGDFFL

SEQ ID NO: 93 - protein, 9 aa, synthetic construct
  REGION 1..9: note = Synthetic peptide
SVGPFALTV

SEQ ID NO: 94 - protein, 9 aa, synthetic construct
  REGION 1..9: note = Synthetic peptide
NLALPLPKV

SEQ ID NO: 95 - protein, 9 aa, synthetic construct
  REGION 1..9: note = Synthetic peptide
VLESGLYQV

SEQ ID NO: 96 - protein, 9 aa, synthetic construct
  REGION 1..9: note = Synthetic peptide
MLVAITVLI

SEQ ID NO: 97 - protein, 9 aa, synthetic construct
  REGION 1..9: note = Synthetic peptide
FMDDAKILF

SEQ ID NO: 98 - protein, 9 aa, synthetic construct
  REGION 1..9: note = Synthetic peptide
ALVHLPSQL

SEQ ID NO: 99 - protein, 9 aa, synthetic construct
  REGION 1..9: note = Synthetic peptide
ILTASITSI

SEQ ID NO: 100 - protein, 9 aa, synthetic construct
  REGION 1..9: note = Synthetic peptide
AMDGKELSL

SEQ ID NO: 101 - protein, 9 aa, synthetic construct
  REGION 1..9: note = Synthetic peptide
SLGWNISGV

SEQ ID NO: 102 - protein, 9 aa, synthetic construct
  REGION 1..9: note = Synthetic peptide
MISAFPNEV

SEQ ID NO: 103 - protein, 9 aa, synthetic construct
  REGION 1..9: note = Synthetic peptide
RLTHELPGI

SEQ ID NO: 104 - protein, 9 aa, synthetic construct
  REGION 1..9: note = Synthetic peptide
LLFSDGEKV

SEQ ID NO: 105 - protein, 9 aa, synthetic construct
  REGION 1..9: note = Synthetic peptide
RLNESTTFV

SEQ ID NO: 106 - protein, 9 aa, synthetic construct
  REGION 1..9: note = Synthetic peptide
KLEELKSFV

SEQ ID NO: 107 - protein, 9 aa, synthetic construct
  REGION 1..9: note = Synthetic peptide
SINEEIQTV

SEQ ID NO: 108 - protein, 9 aa, synthetic construct
  REGION 1..9: note = Synthetic peptide
RLHDGPLRA

SEQ ID NO: 109 - protein, 9 aa, synthetic construct
  REGION 1..9: note = Synthetic peptide
MISAFPNEV

SEQ ID NO: 110 - protein, 9 aa, synthetic construct
  REGION 1..9: note = Synthetic peptide
ILHTSVPFL

SEQ ID NO: 111 - protein, 9 aa, synthetic construct
  REGION 1..9: note = Synthetic peptide
YLENMVSGV

SEQ ID NO: 112 - protein, 9 aa, synthetic construct
  REGION 1..9: note = Synthetic peptide
QLLGRLESL

SEQ ID NO: 113 - protein, 9 aa, synthetic construct
  REGION 1..9: note = Synthetic peptide
RLLHLESFL

SEQ ID NO: 114 - protein, 9 aa, synthetic construct
  REGION 1..9: note = Synthetic peptide
ALLRQMEGI

SEQ ID NO: 115 - protein, 9 aa, synthetic construct
  REGION 1..9: note = Synthetic peptide
TLNKDFQEV

SEQ ID NO: 116 - protein, 9 aa, synthetic construct
  REGION 1..9: note = Synthetic peptide
IMEQGDLSV

SEQ ID NO: 117 - protein, 9 aa, synthetic construct
  REGION 1..9: note = Synthetic peptide
RLLHLESFL

SEQ ID NO: 118 - DNA, 1199 bp, synthetic construct
  misc_feature 1..1199: note = Synthetic polynucleotide
  source 1..1199: mol_type = other DNA
atgggacccccctcagcccctccctgcagattgcatgtcccctggaaggaggtcctgctcacagcctcacttctaaccttctggaacccacccaccactgccaagctcactattgaatccacgccgttcaatgtcgcagaggggaaggaggttcttctactcgcccacaacctgccccagaatcgtattggttacagctggtacaaaggcgaaagagtggatggcaacagtctaattgtaggatatgtaataggaactcaacaagctaccccagggcccgcatacagtggtcgagagacaatataccccaatgcatccctgctgatccagaacgtcacccagaatgacacaggattctataccctacaagtcataaagtcagatcttgtgaatgaagaagcaaccggacagttccatgtatacccggagctgcccaagccctccatctccagcaacaactccaaccccgtggaggacaaggatgctgtggccttcacctgtgaacctgaggttcagaacacaacctacctgtggtgggtaaatggtcagagcctcccggtcagtcccaggctgcagctgtccaatggcaacatgaccctcactctactcagcgtcaaaaggaacgatgcaggatcctatgaatgtgaaatacagaacccagcgagtgccaaccgcagtgacccagtcaccctgaatgtcctctattggaccagaccctgaattcttctagctcctccaatcccattttatcccatggaaccactaaaaacaaggtctgctctgctcctgaagccctatatgctggagatggacaactcaatgaaaatttaaagggaaaaccctcaggcctgaggtgtgtgccactcagagacttcacctaactagagacaggcaaactgcaaaccatggtgagaaattgacgacttcacactatggacagcttttcccaagatgtcaaaacaagactcctcatcatgataaggctcttacccccttttaatttgtccttgcttatgcctgcctctttcgcttggcaggatgatgctgtcattagtatttcacaagaagtagcttcagagggtaacttaacagagtatcagatctatcttgtcaatcccaacgttttacataaaataagagatcctttagtgcacccagtgactgacattagcagcatctttaacacagccgtgtgttca

SEQ ID NO: 119 - DNA, 822 bp, synthetic construct
  misc_feature 1..822: note = Synthetic polynucleotide
  source 1..822: mol_type = other DNA
atgaacccggtacctcagatggaaatgcagaaatcacccgtcttctgtgtcgctcacgctgggagctgtagaccggagctgttcctattcggacatcttggctcctccccaagagttctggagtctgagaagtcaaggatcggggtgctggcctattcagttcctggtaagggctgtcttcctggcttgcagttgaactacttcttgctgtgtcttcacaagcatgcccccatcctgtgccgataagaactccagaccccaaactcagctcatacacacacggaagagagaagcatctgaacatcaagaagagaagaagctgctggacatcagaaactgtgaaaggagaggagtttggctgagctccaggggaagactgcctgcacattctatccccttttcagttccccatcctgctgtcagccacatttaccactcaataaaatcttcacattcaccatccttcaagtccgtgtgacctcattcctcttgggcactggacaaggacccagttgcgggtgcagtaggctgtcacactgactctccactgagctgtttaacacttaagttgtctgtagacagcaaagctaaaacagcacactgtaacacatgccctctggggctctagaggctgtggacagcccctagacgctgctgtgggctggtaaggagtttattcctgctggtgcccaaaggcactcaccccagctcctgcacccactcacctacatcttccccctctttcaaggggtttgagcactgcaggctgagtaagcgagccagcgcttcacaagccccatggggtcaagggaacccatctca

SEQ ID NO: 120 - DNA, 3992 bp, synthetic construct
  misc_feature 1..3992: note = Synthetic polynucleotide
  source 1..3992: mol_type = other DNA
atggagctcctcccgccgctgcctcagtccttcctgttgctgctgctgttgcctgccaagcccgcggcgggcgaggactggcagtgcccgcgcaccccctacgcggcctctcgcgactttgacgtgaagtacgtggtgcccagcttctccgccggaggcctggtacaggccatggtgacctacgagggcgacagaaatgagagtgctgtgtttgtagccatacgcaatcgcctgcatgtgcttgggcctgacctgaagtctgtccagagcctggccacgggccctgctggagaccctggctgccagacgtgtgcagcctgtggcccaggaccccacggccctcccggtgacacagacacaaaggtgctggtgctggatcccgcgctgcctgcgctggtcagttgtggctccagcctgcagggccgctgcttcctgcatgacctagagccccaagggacagccgtgcatctggcagcgccagcctgcctcttctcagcccaccataaccggcccgatgactgccccgactgtgtggccagcccattgggcacccgtgtaactgtggttgagcaaggccaggcctcctatttctacgtggcatcctcactggacgcagccgtggctgccagcttcagcccacgctcagtgtctatcaggcgtctcaaggctgacgcctcgggattcgcaccgggctttgtggcgttgtcagtgctgcccaagcatcttgtctcctacagtattgaatacgtgcacagcttccacacgggagccttcgtatacttcctgactgtacagccggccagcgtgacagatgatcctagtgccctgcacacacgcctggcacggcttagcgccactgagccagagttgggtgactatcgggagctggtcctcgactgcagatttgctccaaaacgcaggcgccggggggccccagaaggcggacagccctaccctgtgctgcgggtggcccactccgctccagtgggtgcccaacttgccactgagctgagcatcgccgagggccaggaagtactatttggggtctttgtgactggcaaggatggtggtcctggcgtgggccccaactctgtcgtctgtgccttccccattgacctgctggacacactaattgatgagggtgtggagcgctgttgtgaatccccagtccatccaggcctccggcgaggcctcgacttcttccagtcgcccagtttttgccccaacccgcctggcctggaagccctcagccccaacaccagctgccgccacttccctctgctggtcagtagcagcttctcacgtgtggacctattcaatgggctgttgggaccagtacaggtcactgcattgtatgtgacacgccttgacaacgtcacagtggcacacatgggcacaatggatgggcgtatcctgcaggtggagctggtcaggtcactaaactacttgctgtatgtgtccaacttctcactgggtgacagtgggcagcccgtgcagcgggatgtcagtcgtcttggggaccacctactctttgcctctggggaccaggttttccaggtacctatccaaggccctggctgccgccacttcctgacctgtgggcgttgcctaagggcatggcatttcatgggctgtggctggtgtgggaacatgtgcggccagcagaaggagtgtcctggctcctggcaacaggaccactgcccacctaagcttactgagttccacccccacagtggacctctaaggggcagtacaaggctgaccctgtgtggctccaacttctaccttcacccttctggtctggtgcctgagggaacccatcaggtcactgtgggccaaagtccctgccggccactgcccaaggacagctcaaaactcagaccagtgccccggaaagactttgtagaggagtttgagtgtgaactggagcccttgggcacccaggcagtggggcctaccaacgtcagcctcaccgtgactaacatgccaccgggcaagcacttccgggtagacggcacctccgtgctgagaggcttctctttcatggagccagtgctgatagcagtgcaacccctctttggcccacgggcaggaggcacctgtctcactcttgaaggccagagtctgtctgtaggcaccagccgggctgtgctggtcaatgggactgagtgtctgctagcacgggtcagtgaggggcagcttttatgtgccacaccccctggggccacggtggccagtgtcccccttagcctgcaggtggggggtgcccaggtacctggttcctggaccttccagtacagagaagaccctgtcgtgctaagcatcagccccaactgtggctacatcaactcccacatcaccatctgtggccagcatctaacttcagcatggcacttagtgctgtcattccatgacgggcttagggcagtggaaagcaggtgtgagaggcagcttccagagcagcagctgtgccgccttcctgaatatgtggtccgagacccccagggatgggtggcagggaatctgagtgcccgaggggatggagctgctggctttacactgcctggctttcgcttcctacccccaccccatccacccagtgccaacctagttccactgaagcctgaggagcatgccattaagtttgagtatattgggctgggcgctgtggctgactgtgtgggtatcaacgtgaccgtgggtggtgagagctgccagcacgagttccggggggacatggttgtctgccccctgcccccatccctgcagcttggccaggatggtgccccattgcaggtctgcgtagatggtgaatgtcatatcctgggtagagtggtgcggccagggccagatggggtcccacagagcacgctccttggtatcctgctgcctttgctgctgcttgtggctgcactggcgactgcactggtcttcagctactggtggcggaggaagcagctagttcttcctcccaacctgaatgacctggcatccctggaccagactgctggagccacacccctgcctattctgtactcgggctctgactacagaagtggccttgcactccctgccattgatggtctggattccaccacttgtgtccatggagcatccttctccgatagtgaagatgaatcctgtgtgccactgctgcggaaagagtccatccagctaagggacctggactctgcgctcttggctgaggtcaaggatgtgctgattccccatgagcgggtggtcacccacagtgaccgagtcattggcaaaggccactttggagttgtctaccacggagaatacatagaccaggcccagaatcgaatccaatgtgccatcaagtcactaagtcgcatcacagagatgcagcaggtggaggccttcctgcgagaggggctgctcatgcgtggcctgaaccacccgaatgtgctggctctcattggtatcatgttgccacctgagggcctgccccatgtgctgctgccctatatgtgccacggtgacctgctccagttcatccgctcacctcagcggaaccccaccgtgaaggacctcatcagctttggcctgcaggtagcccgcagcatggagtacctggcagagcagaagtttgtgcacagggacctggctgcgcggaactgcatgctggacgagtcattcacagtcaaggtggctgactttggtttggcccgcgacatcctggacagggagtactatagtgttcaacagcatcgccacgctcgcctacctgtgaagtggatggcgctggagagcctgcagacctatagatttaccaccaagtctgatgtgtggtcatttggtgtgctgctgtgggaactgctgacacggggtgccccaccataccgccacattgacccttttgaccttacccacttcctggcccagggtcggcgcctgccccagcctgagtattgccctgattctctgaaagggactctcgctgggcctcaatttcctcatctgtgaactgg

SEQ ID NO: 121 - DNA, 3845 bp, synthetic construct
  misc_feature 1..3845: note = Synthetic polynucleotide
  source 1..3845: mol_type = other DNA
atggagctcctcccgccgctgcctcagtccttcctgttgctgctgctgttgcctgccaagcccgcggcgggcgaggactggcagtgcccgcgcaccccctacgcggcctctcgcgactttgacgtgaagtacgtggtgcccagcttctccgccggaggcctggtacaggccatggtgacctacgagggcgacagaaatgagagtgctgtgtttgtagccatacgcaatcgcctgcatgtgcttgggcctgacctgaagtctgtccagagcctggccacgggccctgctggagaccctggctgccagacgtgtgcagcctgtggcccaggaccccacggccctcccggtgacacagacacaaaggtgctggtgctggatcccgcgctgcctgcgctggtcagttgtggctccagcctgcagggccgctgcttcctgcatgacctagagccccaagggacagccgtgcatctggcagcgccagcctgcctcttctcagcccaccataaccggcccgatgactgccccgactgtgtggccagcccattgggcacccgtgtaactgtggttgagcaaggccaggcctcctatttctacgtggcatcctcactggacgcagccgtggctgccagcttcagcccacgctcagtgtctatcaggcgtctcaaggctgacgcctcgggattcgcaccgggctttgtggcgttgtcagtgctgcccaagcatcttgtctcctacagtattgaatacgtgcacagcttccacacgggagccttcgtatacttcctgactgtacagccggccagcgtgacagatgatcctagtgccctgcacacacgcctggcacggcttagcgccactgagccagagttgggtgactatcgggagctggtcctcgactgcagatttgctccaaaacgcaggcgccggggggccccagaaggcggacagccctaccctgtgctgcgggtggcccactccgctccagtgggtgcccaacttgccactgagctgagcatcgccgagggccaggaagtactatttggggtctttgtgactggcaaggatggtggtcctggcgtgggccccaactctgtcgtctgtgccttccccattgacctgctggacacactaattgatgagggtgtggagcgctgttgtgaatccccagtccatccaggcctccggcgaggcctcgacttcttccagtcgcccagtttttgccccaacccgcctggcctggaagccctcagccccaacaccagctgccgccacttccctctgctggtcagtagcagcttctcacgtgtggacctattcaatgggctgttgggaccagtacaggtcactgcattgtatgtgacacgccttgacaacgtcacagtggcacacatgggcacaatggatgggcgtatcctgcaggtggagctggtcaggtcactaaactacttgctgtatgtgtccaacttctcactgggtgacagtgggcagcccgtgcagcgggatgtcagtcgtcttggggaccacctactctttgcctctggggaccaggttttccaggtacctatccaaggccctggctgccgccacttcctgacctgtgggcgttgcctaagggcatggcatttcatgggctgtggctggtgtgggaacatgtgcggccagcagaaggagtgtcctggctcctggcaacaggaccactgcccacctaagcttactgagttccacccccacagtggacctctaaggggcagtacaaggctgaccctgtgtggctccaacttctaccttcacccttctggtctggtgcctgagggaacccatcaggtcactgtgggccaaagtccctgccggccactgcccaaggacagctcaaaactcagaccagtgccccggaaagactttgtagaggagtttgagtgtgaactggagcccttgggcacccaggcagtggggcctaccaacgtcagcctcaccgtgactaacatgccaccgggcaagcacttccgggtagacggcacctccgtgctgagaggcttctctttcatggagccagtgctgatagcagtgcaacccctctttggcccacgggcaggaggcacctgtctcactcttgaaggccagagtctgtctgtaggcaccagccgggctgtgctggtcaatgggactgagtgtctgctagcacgggtcagtgaggggcagcttttatgtgccacaccccctggggccacggtggccagtgtcccccttagcctgcaggtggggggtgcccaggtacctggttcctggaccttccagtacagagaagaccctgtcgtgctaagcatcagccccaactgtggctacatcaactcccacatcaccatctgtggccagcatctaacttcagcatggcacttagtgctgtcattccatgacgggcttagggcagtggaaagcaggtgtgagaggcagcttccagagcagcagctgtgccgccttcctgaatatgtggtccgagacccccagggatgggtggcagggaatctgagtgcccgaggggatggagctgctggctttacactgcctggctttcgcttcctacccccaccccatccacccagtgccaacctagttccactgaagcctgaggagcatgccattaagtttgaggtctgcgtagatggtgaatgtcatatcctgggtagagtggtgcggccagggccagatggggtcccacagagcacgctccttggtatcctgctgcctttgctgctgcttgtggctgcactggcgactgcactggtcttcagctactggtggcggaggaagcagctagttcttcctcccaacctgaatgacctggcatccctggaccagactgctggagccacacccctgcctattctgtactcgggctctgactacagaagtggccttgcactccctgccattgatggtctggattccaccacttgtgtccatggagcatccttctccgatagtgaagatgaatcctgtgtgccactgctgcggaaagagtccatccagctaagggacctggactctgcgctcttggctgaggtcaaggatgtgctgattccccatgagcgggtggtcacccacagtgaccgagtcattggcaaaggccactttggagttgtctaccacggagaatacatagaccaggcccagaatcgaatccaatgtgccatcaagtcactaagtcgcatcacagagatgcagcaggtggaggccttcctgcgagaggggctgctcatgcgtggcctgaaccacccgaatgtgctggctctcattggtatcatgttgccacctgagggcctgccccatgtgctgctgccctatatgtgccacggtgacctgctccagttcatccgctcacctcagcggaaccccaccgtgaaggacctcatcagctttggcctgcaggtagcccgcagcatggagtacctggcagagcagaagtttgtgcacagggacctggctgcgcggaactgcatgctggacgagtcattcacagtcaaggtggctgactttggtttggcccgcgacatcctggacagggagtactatagtgttcaacagcatcgccacgctcgcctacctgtgaagtggatggcgctggagagcctgcagacctatagatttaccaccaagtctgatgtgtggtcatttggtgtgctgctgtgggaactgctgacacggggtgccccaccataccgccacattgacccttttgaccttacccacttcctggcccagggtcggcgcctgccccagcctgagtattgccctgattctctgaaagggactctcgctgggcctcaatttcctcatctgtgaactgg

SEQ ID NO: 122 - DNA, 1221 bp, synthetic construct
  misc_feature 1..1221: note = Synthetic polynucleotide
  source 1..1221: mol_type = other DNA
atggagagaaaaataagcagaatccaccttgtttctgaacccagtataactcattttctacaagtatcttgggagaaaacactggaatctggttttgttattacacttactgatggtcattcagcatggactgggacagtttctgaatcagagatttcccaagaagctgatgacatggcaatggaaaaagggaaatatgttggtgaactgagaaaagcattgttgtcaggagcaggaccagctgatgtatacacgtttaatttttctaaagagtcttgttatttcttctttgagaaaaacctgaaagatgtctcattcagacttggttccttcaacctagagaaagttgaaaacccagctgaagtcattagagaacttatttgttattgcttggacaccattgcagaaaatcaagccaaaaatgagcacctgcagaaagaaaatgaaaggcttctgagagattggaatgatgttcaaggacgatttgaaaaatgtgtgagtgctaaggaagctttggagactgatctttataagcggtttattctggtgttgaatgagaagaaaacaaaaatcagaagtttgcataataaattattaaatgcagctcaagaacgagaaaaggacatcaaacaagaaggggaaactgcaatctgttctgaaatgactgctgaccgagatccagtctatgatgagagtactgatgaggaaagtgaaaaccaaactgatctctctgggttggcttcagctgctgtaagtaaagatgattccattatttcaagtcttgatgtcactgatattgcaccaagtagaaaaaggagacagcgaatgcaaagaaatcttgggacagaacctaaaatggctcctcaggagaatcagcttcaagaaaaggaaaaagggaggaagaaggagacttcagagaaagaggccgtgtgatggaagcaaaatcagagagaaaagatgctaagctgctgcctttgaataaggaggaacgtgagccaacagatccaagaactgaagctctaggcagtggaaaagccaaggaaactgatcttcccttcgagcctccggagggagtgtagccctgccaacacctttattttagccccataacagtcatttcagacttgtggcctccagaattttaagagaataaatttttattgtattaagccatcaagtttgtggtagtttgtggtaatttagccataagaaactaataca

SEQ ID NO: 123 - DNA, 1221 bp, synthetic construct; identical to SEQ ID NO: 122
  misc_feature 1..1221: note = Synthetic polynucleotide
  source 1..1221: mol_type = other DNA

SEQ ID NO: 124 - DNA, 1221 bp, synthetic construct; identical to SEQ ID NO: 122
  misc_feature 1..1221: note = Synthetic polynucleotide
  source 1..1221: mol_type = other DNA

SEQ ID NO: 125 - DNA, 1221 bp, synthetic construct; identical to SEQ ID NO: 122
  misc_feature 1..1221: note = Synthetic polynucleotide
  source 1..1221: mol_type = other DNA

SEQ ID NO: 126 - DNA, 1833 bp, synthetic construct
  misc_feature 1..1833: note = Synthetic polynucleotide
  source 1..1833: mol_type = other DNA
atgggagagagagttcgcatcaaatttggtgactttgacattgaagattctgattcttgtcactttaattacttgagaatttataatggaattggagtcagcagaactgaaataggaatccaacttacaagggctgtgaaggacctcttcaaggagaactacaaaccactgctcaatgaaataaaagaggacacaaatggaagaacattccatgctcatggataggaagaatcaatatcgtgaaaatggctatactgcccaaggtaatttatagattcaatgccatccccatcaagctaccaatgactttcttcacagaattggaaaaaactactttaaagttcatatggaaccaaaaaagagctggcattgccaagtcaatcctaagccaaaagaacaaagcgggaggcatcaggctacctgacttcaaactatactacaaggctacagtaaccaaaacagcatggtactgggaccaaaacagagatatagaccaatggaacagaacagagccctcagaaataataccacacatctacaaccatctgatctttgacaaacctgacaaaaacaagaaatggggaaaggattccctatttaataaatggttctgggaaaactggctagccatatgtaaaaagctgaaactggatcccttccttacaccttatgcaaaaactaattcaagatggattaaagacttaaatgttagacctaaaaccataaaaaccctagaagaaaacctaggcagtaccattcaggacataggcatgggcaaggacttcatgtctgaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaatctactcatcagacaaagggctaatattgagaatctacaaagaactcaaacaaatttacaagaaaaaaacaaccccatcaacaagtgggcaaatgatatgaacagacacttctcaaaagaagacatttatgcagccaaaagacacatgaaaaaatgctcatcatcactggccatcagagaaatgcaaatcaaaaccacaatgagataccatctcacaccagttagaatggtgatcattaaaaagtcaggaaataacaggtgctggagaggttgtggagaaataggaacacttttacactgttggtgggagtgtaaactagttcaaccattgtggaagacagtgtggcgattcctcagggatctagaactagaaataccatttgacccagccatcccattactgggtatatacccaaaggattataaatcatgctgctataaagacacatgcacacgtctgtttattgcggcactattcacaatagcaaagacttggaaccaacccagatgtccatcaatgatagactggattaagaaaatgtggcacatatacaccatggaatactatgcagccataaaaaatgatgagttcatgtcctttgtaaggacatggatgaagctggaaaccatcattctcagcaaactatcacaaggacaaaaaaccgaacaccgcatgttctcactcataggtgggaattgaacaatgagaacagttggacacaggaaggggaacatcacacaccggtgcctgtcatggggtggggggagggaggagggatagcattaggagatatacctaatgtaaatgacgagttaatgggtgcagcacaccagcgtgtcacatgtatacatatgtcacctgcacgttgtgcacatgtaccctagaacttaaagtataatacaaaa

SEQ ID NO: 127 - DNA, 2151 bp, synthetic construct
  misc_feature 1..2151: note = Synthetic polynucleotide
  source 1..2151: mol_type = other DNA
atggcgagccgggcggtggtgagagccaggcgctgcccgcagtgtccccaagtccgggccgcggccgccgcccccgcctgggccgcgctccccctctcccgctccctccctccctgctccaactcctcctccttctccatgcctctgttcctcctgctcttacttgtcctgctcctgctgctcgaggacgctggagcccagcaaggtgatggatgtggacacactgtactaggccctgagagtggaacccttacatccataaactacccacagacctatcccaacagcactgtttgtgaatgggagatccgtgtaaagatgggagagagagttcgcatcaaatttggtgactttgacattgaagattctgattcttgtcactttaattacttgagaatttataatggaattggagtcagcagaactgaaataggaatccaacttacaagggctgtgaaggacctcttcaaggagaactacaaaccactgctcaatgaaataaaagaggacacaaatggaagaacattccatgctcatggataggaagaatcaatatcgtgaaaatggctatactgcccaaggtaatttatagattcaatgccatccccatcaagctaccaatgactttcttcacagaattggaaaaaactactttaaagttcatatggaaccaaaaaagagctggcattgccaagtcaatcctaagccaaaagaacaaagcgggaggcatcaggctacctgacttcaaactatactacaaggctacagtaaccaaaacagcatggtactgggaccaaaacagagatatagaccaatggaacagaacagagccctcagaaataataccacacatctacaaccatctgatctttgacaaacctgacaaaaacaagaaatggggaaaggattccctatttaataaatggttctgggaaaactggctagccatatgtaaaaagctgaaactggatcccttccttacaccttatgcaaaaactaattcaagatggattaaagacttaaatgttagacctaaaaccataaaaaccctagaagaaaacctaggcagtaccattcaggacataggcatgggcaaggacttcatgtctgaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaatctactcatcagacaaagggctaatattgagaatctacaaagaactcaaacaaatttacaagaaaaaaacaaccccatcaacaagtgggcaaatgatatgaacagacacttctcaaaagaagacatttatgcagccaaaagacacatgaaaaaatgctcatcatcactggccatcagagaaatgcaaatcaaaaccacaatgagataccatctcacaccagttagaatggtgatcattaaaaagtcaggaaataacaggtgctggagaggttgtggagaaataggaacacttttacactgttggtgggagtgtaaactagttcaaccattgtggaagacagtgtggcgattcctcagggatctagaactagaaataccatttgacccagccatcccattactgggtatatacccaaaggattataaatcatgctgctataaagacacatgcacacgtctgtttattgcggcactattcacaatagcaaagacttggaaccaacccagatgtccatcaatgatagactggattaagaaaatgtggcacatatacaccatggaatactatgcagccataaaaaatgatgagttcatgtcctttgtaaggacatggatgaagctggaaaccatcattctcagcaaactatcacaaggacaaaaaaccgaacaccgcatgttctcactcataggtgggaattgaacaatgagaacagttggacacaggaaggggaacatcacacaccggtgcctgtcatggggtggggggagggaggagggatagcattaggagatatacctaatgtaaatgacgagttaatgggtgcagcacaccagcgtgtcacatgtatacatatgtcacctgcacgttgtgcacatgtaccctagaacttaaagtataatacaaaa

SEQ ID NO: 128 - DNA, 2151 bp, synthetic construct; identical to SEQ ID NO: 127
  misc_feature 1..2151: note = Synthetic polynucleotide
  source 1..2151: mol_type = other DNA

SEQ ID NO: 129 - DNA, 1239 bp, synthetic construct
  misc_feature 1..1239: note = Synthetic polynucleotide
  source 1..1239: mol_type = other DNA
atgaacacaagaccacaacattcagaaagaacctcgacaatggacagagtttatgaaattcctgaggagccaaatgtggatccggtttcatctctggaggaagatgtcatccgtggagccaacccccgatttacttttccatttagcatccttttctccacctttttgtactgtggggaggctgcatctgctttgtacatggttagaatctatcgaaagaatagtgaaacttactggatgacatacaccttttctttctttatgttttcatccattatggtccagttgaccctcatttttgtccacagagatctagccaaagataaaccgctatcattatttatgcatctaatcctcttgggacctgttatcagatgtttggaggccatgattaagtacctcacactgtggaagaaagaggagcaggaggagccctatgtcagcctcacccgaaagaagatgctaatagatggcgaggaggtgctgatagaatgggaggtgggccactccatccggaccctggctatgcaccgcaatgcctacaaacgtatgtcacagatccaagccttcctgggctcagtgccccagctgacctatcagctctatgtgagcctgatctctgcagaggttcccctgggtagagttgtgctaatggtattttccctggtatctgtcacctatggggccaccctttgcaatatgttggctatccagatcaagtacgatgactacaagattcgccttgggccactagaagtcctctgcatcaccatctggcggacattggagatcacttcccgcctcctgattctggtgctcttctcagccactttgaaattgaaggctgtgcccttcctagtgctcaacttcctgatcatcctctttgagccctggattaagttctggagaagtggtgcccagatgcccaataacattgagaaaaacttcagccgggtcggcactctggtggtcctgatttcagtcaccatcctctatgctggcatcaacttctcttgctggtcagctttgcagttgaggttggcagacagagatctcgtcgacaaagggcagaactggggacatatgggcctgcactatagtgtgaggtcctttgtacatggcaagtctttctgtctagaaccctaaagaagcctggctgttcccgtctcagcatacacatgttatctcatatgccaccttctcaaaaaggacttccctgatcactctatttaaaatagc

SEQ ID NO: 130 - DNA, 1200 bp, synthetic construct
  misc_feature 1..1200: note = Synthetic polynucleotide
  source 1..1200: mol_type = other DNA
atggacagagtttatgaaattcctgaggagccaaatgtggatccggtttcatctctggaggaagatgtcatccgtggagccaacccccgatttacttttccatttagcatccttttctccacctttttgtactgtggggaggctgcatctgctttgtacatggttagaatctatcgaaagaatagtgaaacttactggatgacatacaccttttctttctttatgttttcatccattatggtccagttgaccctcatttttgtccacagagatctagccaaagataaaccgctatcattatttatgcatctaatcctcttgggacctgttatcagatgtttggaggccatgattaagtacctcacactgtggaagaaagaggagcaggaggagccctatgtcagcctcacccgaaagaagatgctaatagatggcgaggaggtgctgatagaatgggaggtgggccactccatccggaccctggctatgcaccgcaatgcctacaaacgtatgtcacagatccaagccttcctgggctcagtgccccagctgacctatcagctctatgtgagcctgatctctgcagaggttcccctgggtagagttgtgctaatggtattttccctggtatctgtcacctatggggccaccctttgcaatatgttggctatccagatcaagtacgatgactacaagattcgccttgggccactagaagtcctctgcatcaccatctggcggacattggagatcacttcccgcctcctgattctggtgctcttctcagccactttgaaattgaaggctgtgcccttcctagtgctcaacttcctgatcatcctctttgagccctggattaagttctggagaagtggtgcccagatgcccaataacattgagaaaaacttcagccgggtcggcactctggtggtcctgatttcagtcaccatcctctatgctggcatcaacttctcttgctggtcagctttgcagttgaggttggcagacagagatctcgtcgacaaagggcagaactggggacatatgggcctgcactatagtgtgaggtcctttgtacatggcaagtctttctgtctagaaccctaaagaagcctggctgttcccgtctcagcatacacatgttatctcatatgccaccttctcaaaaaggacttccctgatcactctatttaaaatagc

SEQ ID NO: 131 - DNA, 776 bp, synthetic construct
  misc_feature 1..776: note = Synthetic polynucleotide
  source 1..776: mol_type = other DNA
atgaacacaagaccacaacattcagaaagaacctcgacaatggacagagtttatgaaattcctgaggagccaaatgtggatccggtttcatctctggaggaagatgtcatccgtggagccaacccccgatttacttttccatttagcatccttttctccacctttttgtactgtggggaggctgcatctgctttgtacatggttagaatctatcgaaagaatagtgaaacttactggatgacatacaccttttctttctttatgttttcatccattatggtccagttgaccctcatttttgtccacagagatctagccaaagataaaccgctatcattatttatgcatctaatcctcttgggacctgttatcagatgtttggaggccatgattaagtacctcacactgtggaagaaagaggagcaggaggagccctatgtcagcctcacccgaaagaagatgctaatagatggcgaggaggtgctgatagaatgggaggtgggccactccatccggaccctggctatgcaccgcaatgcctacaaacgtatgtcacagatccaagccttcctgggctcagtgccccagctgacctatcagctctatgtgagcctgatctctgcagaggttcccctgggtagaggtcctttgtacatggcaagtctttctgtctagaaccctaaagaagcctggctgttcccgtctcagcatacacatgttatctcatatgccaccttctcaaaaaggacttccctgatcactctatttaaaatagc

SEQ ID NO: 132 - DNA, 737 bp, synthetic construct
  misc_feature 1..737: note = Synthetic polynucleotide
  source 1..737: mol_type = other DNA
atggacagagtttatgaaattcctgaggagccaaatgtggatccggtttcatctctggaggaagatgtcatccgtggagccaacccccgatttacttttccatttagcatccttttctccacctttttgtactgtggggaggctgcatctgctttgtacatggttagaatctatcgaaagaatagtgaaacttactggatgacatacaccttttctttctttatgttttcatccattatggtccagttgaccctcatttttgtccacagagatctagccaaagataaaccgctatcattatttatgcatctaatcctcttgggacctgttatcagatgtttggaggccatgattaagtacctcacactgtggaagaaagaggagcaggaggagccctatgtcagcctcacccgaaagaagatgctaatagatggcgaggaggtgctgatagaatgggaggtgggccactccatccggaccctggctatgcaccgcaatgcctacaaacgtatgtcacagatccaagccttcctgggctcagtgccccagctgacctatcagctctatgtgagcctgatctctgcagaggttcccctgggtagaggtcctttgtacatggcaagtctttctgtctagaaccctaaagaagcctggctgttcccgtctcagcatacacatgttatctcatatgccaccttctcaaaaaggacttccctgatcactctatttaaaatagc

SEQ ID NO: 133 - DNA, 1834 bp, synthetic construct
  misc_feature 1..1834: note = Synthetic polynucleotide
  source 1..1834: mol_type = other DNA
atggagacgtttatacccattgatttgacaactgaaaatcaagagatggacaaggaggaaaccaagacaaaaccaagacttttaagatatgaagagaaaaaatatgaagatgtgaaaccattagagactcaaccagctgaaatagcagaaaaggaaacattggaatataaaacagttagaacattctctgaatctttgaagtcagagaaaacagaagattaccttagagaaagtataattcaacaacatatggtttctccagagccagcttcccttaaggagaaagggaagtcaaggagaaaaaaggatcaaactcatgcttgtccaaatgttaggaaagccaggcctgtgtcctatgatagaacagaaccaaaagatgatgatgtgataagaaatattattaggctacgagaaaagcttggttggcaaactatattaccgcagcacagtttgaaatacggaagctccaaaattgcaattcagaagattactttaaagaaacctttggaagatgatggagaatttgtttattgccttcctcggaaaagtcctaaatccctttacaatccatatgatcttcaggtagtatcggctcatactgctaaacattgcaaagaattttgggttattactgcttcatttatctcaaaggttattaatatagttggtagtgtaaaggaagtagaactcatacctactttggaatggctatcagaaagaagacattactatttattacggcaattcaagatattttctgatttccggaagtcagggaccccgaacggagggaccggccgaagccatggcagaagaacgtggattgtgaagatttcatgaacatttattagttccccaaattaatacttttataatttcttacacctgtctttactgcagtctccgaacataaattgtgaagatttcatggatacttatcacaataaatacccttgtgatttcctatgcctgtctttactttaatctcttaatcccgtcatcttcgtaagctgaggaggatgtatgtcacctcaggaccctgtgttgattgcgttaactgcacagattgtgtgtagagcatgtgtgtttgaacaatatgaaatctgggcaccttgaaagaagaacaggataacagcaatgttcagggaacaagagagataaccttaaattctgaccactgatgagctggaacagagccatatttctctttcaaaagcaaatgggagaaatatctctgaattctttttctcagcaaggaacatccctgagaaagagaatgcgtccctgagggtaggcctctgaaatggccgcttcggggggcggctgtattttatggtcaaagctgtagggatgaaataagccccagtcccgtaacgctcccaggcttattaggacgaggaaattcccgcctaataaattttggtgagaccggttgtctgctctcaaaccctgtcttctgataagatgttatcagtgacaatgcgtgcccgaaacttcattggcaattttaatttcgccccggtcctgtggtcctgtgatgttgccctgcctccatttgccttgtgatatcttattaccttgtgaagcatgtgatctctgtgacccacaccctattcgtacactccctccccttttgaaaatcactaataaaaacttgctggttttaccgctcgggggcatgatggaacctgccgacatgtgatgtctgccccggacacccagctttaaaatttctctcttttgtatgctgtccctttatttctcagactggccgacacttagggaatatagaaaagaacctacgtgaaatattgggggtgaattttgcccgata

SEQ ID NO: 134 - DNA, 1834 bp, synthetic construct; identical to SEQ ID NO: 133
  misc_feature 1..1834: note = Synthetic polynucleotide
  source 1..1834: mol_type = other DNA

SEQ ID NO: 135 - DNA, 1765 bp, synthetic construct
  misc_feature 1..1765: note = Synthetic polynucleotide
  source 1..1765: mol_type = other DNA
atggagacgtttatacccattgatttgacaactgaaaatcaagagatggacaaggaggaaaccaagacaaaaccaagacttttaagatatgaagagaaaaaatatgaagatgtgaaaccattagagactcaaccagctgaaatagcagaaaaggaaacattggaatataaaacagttagaacattctctgaatctttgaagtcagagaaaacagaagattaccttagagaaagtataattcaacaacatatggtttctccagagccagcttcccttaaggagaaagggaagtcaaggagaaaaaaggatcaaactcatgcttgtccaaatgttaggaaagccaggcctgtgtcctatgatagaacagaaccaaaagatgatgatgtgataagaaatattattaggctacgagaaaagcttggttggcaaactatattaccgcagcacagtttgaaatacggaagctccaaaattgcaattcagaagattactttaaagaaacctttggaagatgatggagaatttgtttattgccttcctcggaaaagtcctaaatccctttacaatccatatgatcttcaggttattaatatagttggtagtgtaaaggaagtagaactcatacctactttggaatggctatcagaaagaagacattactatttattacggcaattcaagatattttctgatttccggaagtcagggaccccgaacggagggaccggccgaagccatggcagaagaacgtggattgtgaagatttcatgaacatttattagttccccaaattaatacttttataatttcttacacctgtctttactgcagtctccgaacataaattgtgaagatttcatggatacttatcacaataaatacccttgtgatttcctatgcctgtctttactttaatctcttaatcccgtcatcttcgtaagctgaggaggatgtatgtcacctcaggaccctgtgttgattgcgttaactgcacagattgtgtgtagagcatgtgtgtttgaacaatatgaaatctgggcaccttgaaagaagaacaggataacagcaatgttcagggaacaagagagataaccttaaattctgaccactgatgagctggaacagagccatatttctctttcaaaagcaaatgggagaaatatctctgaattctttttctcagcaaggaacatccctgagaaagagaatgcgtccctgagggtaggcctctgaaatggccgcttcggggggcggctgtattttatggtcaaagctgtagggatgaaataagccccagtcccgtaacgctcccaggcttattaggacgaggaaattcccgcctaataaattttggtgagaccggttgtctgctctcaaaccctgtcttctgataagatgttatcagtgacaatgcgtgcccgaaacttcattggcaattttaatttcgccccggtcctgtggtcctgtgatgttgccctgcctccatttgccttgtgatatcttattaccttgtgaagcatgtgatctctgtgacccacaccctattcgtacactccctccccttttgaaaatcactaataaaaacttgctggttttaccgctcgggggcatgatggaacctgccgacatgtgatgtctgccccggacacccagctttaaaatttctctcttttgtatgctgtccctttatttctcagactggccgacacttagggaatatagaaaagaacctacgtgaaatattgggggtgaattttgcccgata

SEQ ID NO: 136 - DNA, 1834 bp, synthetic construct; identical to SEQ ID NO: 133
  misc_feature 1..1834: note = Synthetic polynucleotide
  source 1..1834: mol_type = other DNA

SEQ ID NO: 137 - DNA, 645 bp, synthetic construct
  misc_feature 1..645: note = Synthetic polynucleotide
  source 1..645: mol_type = other DNA
atgggctgctgcaccggacgctgctcgctcatctgcctctgcgcgctgcagttggtctcagcattagagaggcagatctttgacttccttggtttccagtgggcgcctattcttggaaattttctacacataatagttgtcatattgggtttgtttgggaccattcagtacagacctcgatacataatggtgtatacagtgtggactgccctctgggtcacctggaatgtgttcattatctgcttttatttggaagtaggtggactctcaaaggaaaccaacaatcaggcctcccacatagatcaaggaattgaaacttaccagatcacttcatctggacaatgagatactagacaccttacccatcatgagtgcctaagcgaccacctgctattgggttaccagctcctcttccatatccctccctaattcctgttttcccacacatgattacatttctttccagctatacaaactcttaattttagtacattagggagatggatttgagactgacctcccttctccacagctgcaacaaccaattaaaggcttcttccctggcaatacttgttcgtctcagtgattggctttctgtgcagcaagcaacaggacctagaccaaacccctggcattgtgataaca

SEQ ID NO: 138 - DNA, 645 bp, synthetic construct; identical to SEQ ID NO: 137
  misc_feature 1..645: note = Synthetic polynucleotide
  source 1..645: mol_type = other DNA

SEQ ID NO: 139 - DNA, 980 bp, synthetic construct
  misc_feature 1..980: note = Synthetic polynucleotide
  source 1..980: mol_type = other DNA
atgattccaattgaatgggtttgcagaagaatagcaactggttcttttctcaaaagaaatcctggtgtcaaggaaggatataagttttacccacctaaagtggagttgtttttcaaggatgatgccaataatgacccacagtggtctgaggaacagctgattgctgcaaaattttgctttgctggacttcttataggccagactgaagtggatatcatgagtcatgctacacaggctatatttgaaatactggagaaatcctggttgccccagaattgtacactggttgatatgaagattgaatttggtgttgatgtaaccaccaaagaaattgttcttgctgatgttattgacaatgattcctggagactctggccatcaggagatcgaagccaacagaaagacaaacagtcttatcgggacctcaaagaagtaactcctgaagggctccaaatggtaaagaaaaactttgagtgggttgcagagagagtagagttgcttttgaaatcagaaagtcagtgcagggttgtagtgttgatgggctctacttctgatcttggtcactgtgaaaaaatcaagaaggcctgtggaaattttggcattccatgtgaacttcgagtaacatctgcgcataaaggaccagatgaaactctgaggattaaagctgagtatgaaggggatggcattcctactgtatttgtggcagtggcaggcagaagtaatggtttgggaccagtgatgtctgggaacactgcatatccagttatcagctgtcctcccctcacaccagactggggagttcaggatgtgtggtcttctcttcgactacccagtggcatggtggtgagcatctgtaatcccagctactcagaggctgaggtaggagaatcgcttgaacctgggaggcagaggtgagtcaagattgtaccaatggattccaaactgggcaacagagtgagactcggtctcaaaataaaaaa

SEQ ID NO: 140 - DNA, 1256 bp, synthetic construct
  misc_feature 1..1256: note = Synthetic polynucleotide
  source 1..1256: mol_type = other DNA
atggcgacagctgaggtactgaacattggtaaaaaattatatgagggtaaaacaaaagaagtctacgaattgttagacagtccaggaaaagtcctcctgcagtccaaggaccagattacagcaggaaatgcagctagaaaaaaccacctggaaggaaaagctgcaatctcaaataaaatcaccagttgtatttttcagttattacaggaagcaggtattaaaactgccttcaccagaaaatgtggggagacagctttcattgcaccgcagtgtgaaatgattccaattgaatgggtttgcagaagaatagcaactggttcttttctcaaaagaaatcctggtgtcaaggaaggatataagttttacccacctaaagtggagttgtttttcaaggatgatgccaataatgacccacagtggtctgaggaacagctgattgctgcaaaattttgctttgctggacttcttataggccagactgaagtggatatcatgagtcatgctacacaggctatatttgaaatactggagaaatcctggttgccccagaattgtacactggttgatatgaagattgaatttggtgttgatgtaaccaccaaagaaattgttcttgctgatgttattgacaatgattcctggagactctggccatcaggagatcgaagccaacagaaagacaaacagtcttatcgggacctcaaagaagtaactcctgaagggctccaaatggtaaagaaaaactttgagtgggttgcagagagagtagagttgcttttgaaatcagaaagtcagtgcagggttgtagtgttgatgggctctacttctgatcttggtcactgtgaaaaaatcaagaaggcctgtggaaattttggcattccatgtgaacttcgagtaacatctgcgcataaaggaccagatgaaactctgaggattaaagctgagtatgaaggggatggcattcctactgtatttgtggcagtggcaggcagaagtaatggtttgggaccagtgatgtctgggaacactgcatatccagttatcagctgtcctcccctcacaccagactggggagttcaggatgtgtggtcttctcttcgactacccagtggcatggtggtgagcatctgtaatcccagctactcagaggctgaggtaggagaatcgcttgaacctgggaggcagaggtgagtcaagattgtaccaatggattccaaactgggcaacagagtgagactcggtctcaaaataaaaaa

SEQ ID NO: 141 - DNA, 1256 bp, synthetic construct; identical to SEQ ID NO: 140
  misc_feature 1..1256: note = Synthetic polynucleotide
  source 1..1256: mol_type = other DNA

SEQ ID NO: 142 - DNA, 1277 bp, synthetic construct
  misc_feature 1..1277: note = Synthetic polynucleotide
  source 1..1277: mol_type = other DNA
atggcgacagctgaggtactgaacattggtaaaaaattatatgagggtaaaacaaaagaagtctacgaattgttagacagtccaggaaaagtcctcctgcagtccaaggaccagattacagcaggaaatgcagctagaaaaaaccacctggaaggaaaagctgcaatctcaaataaaatcaccagttgtatttttcagttattacaggaagcagttacctcatataagtcaaatcgtattaaaactgccttcaccagaaaatgtggggagacagctttcattgcaccgcagtgtgaaatgattccaattgaatgggtttgcagaagaatagcaactggttcttttctcaaaagaaatcctggtgtcaaggaaggatataagttttacccacctaaagtggagttgtttttcaaggatgatgccaataatgacccacagtggtctgaggaacagctgattgctgcaaaattttgctttgctggacttcttataggccagactgaagtggatatcatgagtcatgctacacaggctatatttgaaatactggagaaatcctggttgccccagaattgtacactggttgatatgaagattgaatttggtgttgatgtaaccaccaaagaaattgttcttgctgatgttattgacaatgattcctggagactctggccatcaggagatcgaagccaacagaaagacaaacagtcttatcgggacctcaaagaagtaactcctgaagggctccaaatggtaaagaaaaactttgagtgggttgcagagagagtagagttgcttttgaaatcagaaagtcagtgcagggttgtagtgttgatgggctctacttctgatcttggtcactgtgaaaaaatcaagaaggcctgtggaaattttggcattccatgtgaacttcgagtaacatctgcgcataaaggaccagatgaaactctgaggattaaagctgagtatgaaggggatggcattcctactgtatttgtggcagtggcaggcagaagtaatggtttgggaccagtgatgtctgggaacactgcatatccagttatcagctgtcctcccctcacaccagactggggagttcaggatgtgtggtcttctcttcgactacccagtggcatggtggtgagcatctgtaatcccagctactcagaggctgaggtaggagaatcgcttgaacctgggaggcagaggtgagtcaagattgtaccaatggattccaaactgggcaacagagtgagactcggtctcaaaataaaaaa

SEQ ID NO: 143 - DNA, 1256 bp, synthetic construct; identical to SEQ ID NO: 140
  misc_feature 1..1256: note = Synthetic polynucleotide
  source 1..1256: mol_type = other DNA

SEQ ID NO: 144 - DNA, 128 bp, synthetic construct
  misc_feature 1..128: note = Synthetic polynucleotide
  source 1..128: mol_type = other DNA
atgctcaggtgtgacctacacatgtgacttcacctcagttttgtgatccgtaaaatggacaaattcgaagctacttcacagtgctgttgagaggattaaatgaaacaatgcttgtaaagctctttgca

SEQ ID NO: 145 - DNA, 690 bp, synthetic construct
  misc_feature 1..690: note = Synthetic polynucleotide
  source 1..690: mol_type = other DNA
atggaggagccgcagcgcgcccgctcgcacacagtcaccaccaccgccagctccttcgcagagaacttctccaccagcagcagcagcttcgcctacgaccgggagttcctccgcaccctgcccggcttcctcatcgtggccgagatcctgatttccctgcctataaccgaccccctacaccggtctgctctcagcacaacagccagagatatcctggtaagatgtgtcatgatattccacttcccattgcatttggagtgagagagccagtctgttcagtttcagtctgcaagaccccatgggttcctcccttacctctctgaccttatatcctgcgctccactcctgggtgagctgctctggcccccttgctgcttttgtgacacagcaagcatgctccagctctaggtgtttgtattttctcttctccctgcctagaacccactttctccaggtcttatttcagcacctcctttccctgaacattctgtgtaataagttaacccttatctccttagcctgcctagtatttttccatagcatttgttaccatctgatgtatgtactgtttttttggtctgatgcttccactagaacatgagttatgtgagagtagaaactgtatttttcattgctgtatccctagtacttaaattgcacataacacgcactaaataaatgttgaaagaa

SEQ ID NO: 146 - DNA, 690 bp, synthetic construct; identical to SEQ ID NO: 145
  misc_feature 1..690: note = Synthetic polynucleotide
  source 1..690: mol_type = other DNA

SEQ ID NO: 147 - DNA, 301 bp, synthetic construct
  misc_feature 1..301: note = Synthetic polynucleotide
  source 1..301: mol_type = other DNA
ggcgacgagtcagtatttcgacttcgcgcagggcggcggcccgcagtacaggcccgccatgaccagcccgtgagaaagtgcaaccccctgctcacacccccttgccgcgtccttcccggcggcatgagaaccatcagatcgcgttgaattattttgctgaccccgtgtctccctggactatcgcgcagcaccctcctggaggacgggactttggtctggttattccccgctgctgtgacagcgcccatgacagcagctggtccccactagcacccaggaagtatttatccaatgactcaat

SEQ ID NO: 148 - DNA, 303 bp, synthetic construct
  misc_feature 1..303: note = Synthetic polynucleotide
  source 1..303: mol_type = other DNA
atggcgacgagtcagtatttcgacttcgcgcagggcggcggcccgcagtacaggcccgccatgaccagcccgtgagaaagtgcaaccccctgctcacacccccttgccgcgtccttcccggcggcatgagaaccatcagatcgcgttgaattattttgctgaccccgtgtctccctggactatcgcgcagcaccctcctggaggacgggactttggtctggttattccccgctgctgtgacagcgcccatgacagcagctggtccccactagcacccaggaagtatttatccaatgactcaat

SEQ ID NO: 149 - DNA, 303 bp, synthetic construct; identical to SEQ ID NO: 148
  misc_feature 1..303: note = Synthetic polynucleotide
  source 1..303: mol_type = other DNA

SEQ ID NO: 150 - DNA, 303 bp, synthetic construct; identical to SEQ ID NO: 148
  misc_feature 1..303: note = Synthetic polynucleotide
  source 1..303: mol_type = other DNA

SEQ ID NO: 151 - DNA, 303 bp, synthetic construct; identical to SEQ ID NO: 148
  misc_feature 1..303: note = Synthetic polynucleotide
  source 1..303: mol_type = other DNA

SEQ ID NO: 152 - DNA, 803 bp, synthetic construct
  misc_feature 1..803: note = Synthetic polynucleotide
  source 1..803: mol_type = other DNA
atggctccctgggcggaggccgagcactcggcgctgaacccgctgcgcgcggtgtggctcacgctgaccgccgccttcctgctgaccctactgctgcagctcctgccgcccggcctgctcccgggctgcgcgatcttccaggacctgatccgctatgggaaaaccaagtgtggggagccgtcgcgccccgccgcctgccgagcctttgatgtccccaagagatatttttcccacttttatatcatctcagtgctgtggaatggcttcctgctttggtgccttactcaatctctgttcctgggagcaccttttccaagctggcttcatggtttgctcagaattctcggggcggcacagttccagggaggggagctggcactgtctgcattcttagtgctagtatttctgtggctgcacagcttacgaagactcttcgagtgcctctacgtcagtgtcttctccaatgtcatgattcacgtcgtgcagtactgttttggacttgtctattatgtccttgttggcctaactgtgctgagccaagtgccaatggatggcaggaatgccagtcctccatccttctgctgggaacttggatgctagagctcttgcagtcacactgggccatgaagataaaggtcaccccctaggaatgatagagcagaaagctggaaggaacctgggtccctgatctctgtggagccactgaactgcctctaatgaaggaaaacatttctctcatttatgctgcatgttcttttcgattttatgttatatttagtggagtataatcctaatttgataca

SEQ ID NO: 153 - DNA, 1094 bp, synthetic construct
  misc_feature 1..1094: note = Synthetic polynucleotide
  source 1..1094: mol_type = other DNA
atggcaccgtggggcaagcggctggctggcgtgcgcggggtgctgcttgacatctcgggcgtgctgtacgacagcggcgcgggcggcggcacggccatcgccggctcggtggaggcggtggccagactgaagcgttcccggctgaaggtgaggttctgcaccaacgagtcgcagaagtcccgggcagagctggtggggcagcttcagaggctgggatttgacatctctgagcaggaggtgaccgccccggcaccagctgcctgccagatcctgaaggagcaaggcctgcgaccatacctgctcatccatgacggagtccgctcagaatttgatcagatcgacacatccaacccaaactgtgtggtaattgcagacgcaggagaaagcttttcttatcaaaacatgaataacgccttccaggtgctcatggagctggaaaaacctgtgctcatatcactgggaaaagggcgttactacaaggagacctctggcctgatgctggacgttggtccctacatgaaggcgcttgagtatgcctgtggcatcaaagccgaggtggtggggaagccttctcctgagtttttcaagtctgccctgcaagcgataggagtggaagcccaccaggccgtcatgattggggacgatatcgtgggcgacgtcggcggtgcccagcggtgtggaatgagagcgctgcaggtgcgcaccgggaagttcagatcctgcagaaaaaagaaacaaatttgatactcacaatgacttggatggactcccagtgaaaaaagcctatcccaaaaggttatgtactttctgattccatgtatagaacatcctcaaaatgacaaaattctatcatgcaaaacagatactgttggatggggtggggcggggcaggagggcagtgggcgtggctataaagagcagcctgaggggtcctggtggtgatggaaagcttctttatttcactgtatcaatgtcaattgttgactttgatattgttctatagttttgcaatatattactgttaagagaaactgagtcagtggcgttcttacaactgcatgtgaatctccaattagccccaaattaaaagttta

SEQ ID NO: 154 - DNA, 423 bp, synthetic construct
  misc_feature 1..423: note = Synthetic polynucleotide
  source 1..423: mol_type = other DNA
atgtactcggggaaccgcagcggcggccacggctactgggacggcggcggggccgcgggcgctgaggggccggcgccggcggggacactgagccccgcgcccctcttcagccccggcacctacgagcgcctggcgctgctgctgggctccattgggctgctgggcgtcggcaacaacctgctggtgctcgtcctctactacaagttccagcggctccgcactcccactcacctcctcctggtcaacatcagcctcagcgacctgctggtgtccctcttcggggtcacctttaccttcgtgtcctgcctgaggaacggctgggtgtgggacaccgtgggctgcgtgtgggacgggtttagcggcagcctcttcgcacagtgactgaaacatcacaagcaataagtaatgactaaatgaatgaat

SEQ ID NO: 155 - DNA, 423 bp, synthetic construct; identical to SEQ ID NO: 154
  misc_feature 1..423: note = Synthetic polynucleotide
  source 1..423: mol_type = other DNA

SEQ ID NO: 156 - DNA, 1736 bp, synthetic construct
  misc_feature 1..1736: note = Synthetic polynucleotide
  source 1..1736: mol_type = other DNA
atggcgcagtgggaaatgctgcagaatcttgacagcccctttcaggatcagctgcaccagctttactcgcacagcctcctgcctgtggacattcgacagtacttggctgtctggattgaagaccagaactggcaggaagctgcacttgggagtgatgattccaaggctaccatgctattcttccacttcttggatcagctgaactatgagtgtggccgttgcagccaggacccagagtccttgttgctgcagcacaatttgcggaaattctgccgggacattcagcccttttcccaggatcctacccagttggctgagatgatctttaacctccttctggaagaaaaaagaattttgatccaggctcagagggcccaattggaacaaggagagccagttctcgaaacacctgtggagagccagcaacatgagattgaatcccggatcctggatttaagggctatgatggagaagctggtaaaatccatcagccaactgaaagaccagcaggatgtcttctgcttccgatataagatccaggccaaagggaagacaccctctctggacccccatcagaccaaagagcagaagattctgcaggaaactctcaatgaactggacaaaaggagaaaggaggtgctggatgcctccaaagcactgctaggccgattaactaccctaatcgagctactgctgccaaagttggaggagtggaaggcccagcagcaaaaagcctgcatcagagctcccattgaccacgggttggaacagctggagacatggttcacagctggagcaaagctgttgtttcacctgaggcagctgctgaaggagctgaagggactgagttgcctggttagctatcaggatgaccctctgaccaaaggggtggacctacgcaacgcccaggtcacagagttgctacagcgtctgctccacagagcctttgtggtagaaacccagccctgcatgccccaaactccccatcgacccctcatcctcaagactggcagcaagttcaccgtccgaacaaggctgctggtgagactccaggaaggcaatgagtcactgactgtggaagtctccattgacaggaatcctcctcaattacaaggcttccggaagttcaacattctgacttcaaaccagaaaactttgacccccgagaaggggcagagtcagggtttgatttgggactttggttacctgactctggtggagcaacgttcaggtggttcaggaaagggcagcaataaggggccactaggtgtgacagaggaactgcacatcatcagcttcacggtcaaatatacctaccagggtctgaagcaggagctgaaaacggacaccctccctgtggtgattatttccaacatgaaccagctctcaattgcctgggcttcagttctctggttcaatttgctcagcccaaaccttcagaaccagcagttcttctccaacccccccaaggccccctggagcttgctgggccctgctctcagttggcagttctcctcctatgttggccgaggcctcaactcagaccagctgagcatgctgagaaacaagctgttcgggcagaactgtaggactgaggatccattattgtcctgggctgacttcactaagcgagagagccctcctggcaagttaccattctggacatggctggacaaaattctggagttggtacatgaccacctgaaggatctctggaatgatggaaaaaaaaaaaa

SEQ ID NO: 157 - DNA, 1724 bp, synthetic construct
  misc_feature 1..1724: note = Synthetic polynucleotide
  source 1..1724: mol_type = other DNA
atggcgcagtgggaaatgctgcagaatcttgacagcccctttcaggatcagctgcaccagctttactcgcacagcctcctgcctgtggacattcgacagtacttggctgtctggattgaagaccagaactggcaggaagctgcacttgggagtgatgattccaaggctaccatgctattcttccacttcttggatcagctgaactatgagtgtggccgttgcagccaggacccagagtccttgttgctgcagcacaatttgcggaaattctgccgggacattcaggatcctacccagttggctgagatgatctttaacctccttctggaagaaaaaagaattttgatccaggctcagagggcccaattggaacaaggagagccagttctcgaaacacctgtggagagccagcaacatgagattgaatcccggatcctggatttaagggctatgatggagaagctggtaaaatccatcagccaactgaaagaccagcaggatgtcttctgcttccgatataagatccaggccaaagggaagacaccctctctggacccccatcagaccaaagagcagaagattctgcaggaaactctcaatgaactggacaaaaggagaaaggaggtgctggatgcctccaaagcactgctaggccgattaactaccctaatcgagctactgctgccaaagttggaggagtggaaggcccagcagcaaaaagcctgcatcagagctcccattgaccacgggttggaacagctggagacatggttcacagctggagcaaagctgttgtttcacctgaggcagctgctgaaggagctgaagggactgagttgcctggttagctatcaggatgaccctctgaccaaaggggtggacctacgcaacgcccaggtcacagagttgctacagcgtctgctccacagagcctttgtggtagaaacccagccctgcatgccccaaactccccatcgacccctcatcctcaagactggcagcaagttcaccgtccgaacaaggctgctggtgagactccaggaaggcaatgagtcactgactgtggaagtctccattgacaggaatcctcctcaattacaaggcttccggaagttcaacattctgacttcaaaccagaaaactttgacccccgagaaggggcagagtcagggtttgatttgggactttggttacctgactctggtggagcaacgttcaggtggttcaggaaagggcagcaataaggggccactaggtgtgacagaggaactgcacatcatcagcttcacggtcaaatatacctaccagggtctgaagcaggagctgaaaacggacaccctccctgtggtgattatttccaacatgaaccagctctcaattgcctgggcttcagttctctggttcaatttgctcagcccaaaccttcagaaccagcagttcttctccaacccccccaaggccccctggagcttgctgggccctgctctcagttggcagttctcctcctatgttggccgaggcctcaactcagaccagctgagcatgctgagaaacaagctgttcgggcagaactgtaggactgaggatccattattgtcctgggctgacttcactaagcgagagagccctcctggcaagttaccattctggacatggctggacaaaattctggagttggtacatgaccacctgaaggatctctggaatgatggaaaaaaaaaaaa

SEQ ID NO: 158 - DNA, 3825 bp, synthetic construct
  misc_feature 1..3825: note = Synthetic polynucleotide
  source 1..3825: mol_type = other DNA
atggagtgggtgctcgcggaagcgctgctctcgcagagccgggacccccgggccctgcttggggcgctgtgccaaggggaggcatccgcggagcgcgtggagacgctgcgcttccttctgcagcggctcgaggacgaggaggcgcgcggcagcgggggcgcaggcgcgctcccggaggcggcgcgcgaggtggctgcagggtacctcgtgccactgctgcggagcctgcgcggacgccccgcgggcggcccggaccccagtctgcagcctcgccaccgccggcgcgtgctgagggcggcgggcgcggccctgcgctcgtgcgtccgcctggccgggcgtccgcagctggcggccgcgctggctgaggaggcgctgcgcgatctgctcgccgggtggcgcgcgcctggcgccgaggctgccgtggaagtgctagcagccgtcgggccatgtttgcggccccgcgaggacgggccgctactggagcgcgtggcggggaccgccgtcgccctggcgctgggcgggggcggggacggggatgaggccgggcctgccgaggacgcggcggcgctggtggccgggcgactgctgccagtgctggtccaatgtggcggggcggcgctgcgggccgtgtggggcgggctggccgcgcctggggcgtccctggggtccggccgcgtagaggagaagctgctggtcctgagcgccctggccgagaagctgttgcccgagcccggcggcgaccgcgcccgcggcgcgcgcgaggcgggcccggacgcccggcgctgctggcgcttctggaggacggtgcaggcggggctgggccaggcggacgccctgacgcgcaagcgagcgcgctacctgctgcagagggcggtggaggtgtcggcggagctgggggccgactgcacctgcgggccccaggaaggaaacggcccaagtctgttttggtggtctgagaggaaaaaagatgagcttctaaagttttgggaaaattatattttaattatggagactttagaaggaaatcagatacatgttataaagccagttttaccaaagctaaacaatctgtttgaatatgcggtgtcagaggaaaatggatgttggctctttcacccatcctggcatatgtgtatttataaaagaatgtttgaaagtgaaaacaaaatcctgtccaaagaaggtgttatccattttttggagctgtatgaaacaaagattcttccattttcaccagaattttctgagtttattattggaccattaatggatgcgctttcagagagctctctgtatagcaggtccccaggccagccaataggaagctgttctccattgggactgaaattacagaagtttttagtcacttatatttctcttcttccagaagaaataaagagtagcttcctattgaagtttattcggaagatgacaagtaggcattggtgtgctgttcccattttgtttctatctaaggctttggcaaatgtcccaagacataaggccctgggtatagatgggcttcttgctctcagggatgttattcattgcactatgatcacacatcagattctcctgagaggggcagcccaatgctaccttcttcaaacagctatgaatttgctagatgtggagaaagtgtcactttctgatgtctcaacttttctcatgtctctgagacaagaggaatccttaggacgaggaacttcattgtggacagagctgtgtgactggctacgtgttaatgaaagctattttaagccatcccctacgtgtagctccattggacttcacaagacatctttaaatgcttatgtaaagagcattgttcaagagtatgttaagtcatctgcttgggaaacaggagaaaactgctttatgcctgattggtttgaagccaagcttgtttctctgatggtcttgctggctgtggatgtggaaggaatgaagactcagtatagcggaaagcagagaacagagaatgtattgcggatattcttagaccctcttctggatgtgcttatgaagtttagtaccaatgcctacatgcccttgctgaagactgacagatgcctccagctgctgttgaagctgttgaacacatgcaggttgaaaggttccagtgcccaagatgatgaggtgtctactgttcttcagaactttttcatgtctactacagagagcatttctgaatttattctcagaagacttactatgaatgagctaaatagtgtttcagatctggatcgttgccatttatacctgatggtgttaactgagcttataaatctgcatttgaaggttgggtggaaaaggggtaaccctatctggagagttatttctcttttgaaaaatgcatccattcagcatcttcaagagatggacagtggacaggagccaacagttggaagtcagattcagagagtagtgagcatggctgccttggccatggtgtgtgaggccatagaccagaagcctgagctgcagctggactctctccatgctgggcccctggaaagcttcctttcctctcttcagctcaatcagacgctgcagaagccccacgcagaggagcagagcagttatgctcaccccttggagtgcagcagtgttttggaagaatcgtcatcttcccaaggatggggaaaaatagttgcacaatatattcatgatcaatgggtgtgcctctctttcctgttgaaaaaatatcacacccttataccaaccacagggagtgaaattctggaaccgtttctacctgccgttcagatgccaataaggactttgcagtctgcactagaagccctcacagttctttcttctgatcaagttttaccagtgttccattgcttgaaagtgttggttcccaagcttctgacttcctctgaatcactctgcatagagtcttttgacatggcgtggaaaattatatcttctttaagcaacactcagctgatattctgggctaatttaaaagcttttgttcagtttgtttttgataacaaagttcttaccattgctgccaaaatcaagggccaggcatatttcaaaataaaagagattatgtacaagataattgaaatgtctgctataaagactggagtcttcaatacactgataagttactgctgtcagtcttggatagtgtctgcttcaaatgtgtcccaaggatctttatcaagtgctaaaaattatagcgaacttatccttgaggcttgtatatttggaactgtgtttaggcgtgatcaaagacttgttcaggatgtacagaccttcatagaaaaccttggacatgactgtgcggcaaatattgttatggaaaatactaagagagaagaccattatgtgagaatttgtgctgtcaaattcctgtgtttattagatggctccaatatgtcccacaagttgtttattgaggatcttgcaatcaagctattagataaagatgaattagtgtccaagtccaaaaaacgctactatgtgaattctctacagcacagagtgaaaaaccgagtgtggcagactctgctggtacttttccctagacttgaccagaatttcttgaatggaattattgacaggattttccaggctggtttcaccaacaatcaagcatccataaaatattttatagaatggattattatattgattcttcataaattccctcaatttcttccaaagttctgggattgtttttcttatggtgaagaaaatcttaaaacaagcatttgtacgtttttagcagttttatcacatttagacattattactcaaaatattccagaaaagtgtgtatcagccagatggcagtgtgttacagtt

SEQ ID NO: 159 - DNA, 572 bp, synthetic construct
  misc_feature 1..572: note = Synthetic polynucleotide
  source 1..572: mol_type = other DNA
atggctgctggctgcctgctggccttgactctgacacttttccaatctttgctcatcggcccctcgtcggaggagccgttcccttcggccgtcactatcaaatcatgggtggataagatgcaagaagaccttgtcacactggcaaaaacagcaagtggagtcaatcagcttgttgatatttatgagaaatatcaagatttgtatactgtggaaccaaataatgcacgccagctggtagaaattgcagccagggatattgagaaacttctgagcaacagatctaaagccctggtggtctcagtgtgaagatcaaaatagcctgcttgacgatgttgtttaaatcagacacccacccctattgttattctgaatgagagacacctacctgtattatcttcagagcaatgatcacagatcggtcatgattcaagtttttgtttgtttcattgtctcctaactggtaaaatccatacgcgcccatttcagttcatatttatcttcatacctgttgggcctaacatcgttcctgatatatagtgggtgttctataaatatttactgaatgaataagt

SEQ ID NO: 160 - DNA, 572 bp, synthetic construct; identical to SEQ ID NO: 159
  misc_feature 1..572: note = Synthetic polynucleotide
  source 1..572: mol_type = other DNA

SEQ ID NO: 161 - DNA, 572 bp, synthetic construct; identical to SEQ ID NO: 159
  misc_feature 1..572: note = Synthetic polynucleotide
  source 1..572: mol_type = other DNA

SEQ ID NO: 162 - DNA, 118 bp, synthetic construct
  misc_feature 1..118: note = Synthetic polynucleotide
  source 1..118: mol_type = other DNA
ctcactttcggcggagggaccaaggtggagatcaaacgaagtggaatctatttctccacctccttgaatctagactgacattttgccttgccgtgagcaatagaagtggtagcagaag

SEQ ID NO: 163 - DNA, 610 bp, synthetic construct
  misc_feature 1..610: note = Synthetic polynucleotide
  source 1..610: mol_type = other DNA
atggcaaatatgaatagtgattctaggcatcttggcacctctgaggtagatcatgaaagagatcctggacctatgaatatccagtttgagccatcggatctaagatccaaaagccgcctgccttggcctcccaaagtgccgagattgcagcctctgcccggccgccaccccgtctgggaagtgaggagcgtctctgcctggccgcccatcgtctgggatgtgaggagcccctctgcctggctgcccagtctggaaagtgaggagcgtctctgccccgccgccatcccatctgggaagtgaggagcgcctcttcccggccaccatcacatctaggaagtgaggagcgtctctgccccgctgcccatcgtctgggatgtggggagcgcctctgccccgccgcctcgtctgggatgtgaggagcgcctctgcccggccgccaccccgtctgggaggtgaggagcgtctctgcccggccgccccgtctgagaagagaggagaccctccgcccggcagccgccccgtatgagaagtgaggagcctctccacccggcagccaccccgtctgggaagtgaggagcgtctccgcccggcagccaccccgtccgggagg

SEQ ID NO: 164 - DNA, 610 bp, synthetic construct; identical to SEQ ID NO: 163
  misc_feature 1..610: note = Synthetic polynucleotide
  source 1..610: mol_type = other DNA

SEQ ID NO: 165 - DNA, 610 bp, synthetic construct; identical to SEQ ID NO: 163
  misc_feature 1..610: note = Synthetic polynucleotide
  source 1..610: mol_type = other DNA

SEQ ID NO: 166 - DNA, 610 bp, synthetic construct; identical to SEQ ID NO: 163
  misc_feature 1..610: note = Synthetic polynucleotide
  source 1..610: mol_type = other DNA

SEQ ID NO: 167 - DNA, 610 bp, synthetic construct; identical to SEQ ID NO: 163
  misc_feature 1..610: note = Synthetic polynucleotide
  source 1..610: mol_type = other DNA

SEQ ID NO: 168 - DNA, 610 bp, synthetic construct; identical to SEQ ID NO: 163
  misc_feature 1..610: note = Synthetic polynucleotide
  source 1..610: mol_type = other DNA

SEQ ID NO: 169 - DNA, 610 bp, synthetic construct; identical to SEQ ID NO: 163
  misc_feature 1..610: note = Synthetic polynucleotide
  source 1..610: mol_type = other DNA

SEQ ID NO: 170 - DNA, 610 bp, synthetic construct; identical to SEQ ID NO: 163
  misc_feature 1..610: note = Synthetic polynucleotide
  source 1..610: mol_type = other DNA

SEQ ID NO: 171 - DNA, 610 bp, synthetic construct; identical to SEQ ID NO: 163
  misc_feature 1..610: note = Synthetic polynucleotide
  source 1..610: mol_type = other DNA

SEQ ID NO: 172 - DNA, 610 bp, synthetic construct; identical to SEQ ID NO: 163
  misc_feature 1..610: note = Synthetic polynucleotide
  source 1..610: mol_type = other DNA

SEQ ID NO: 173 - DNA, 103 bp, synthetic construct
  misc_feature 1..103: note = Synthetic polynucleotide
  source 1..103: mol_type = other DNA
atgatgtcacagtcatctggatcaggagatgggaatgatgatgaggctactacctctaaagacggtggcctactgaacatcagtcacacagcatggtaatatg

SEQ ID NO: 174 - DNA, 681 bp, synthetic construct
  misc_feature 1..681: note = Synthetic polynucleotide
  source 1..681: mol_type = other DNA
atggagccggccgcgggcatccagcgccgcagctcccaggggcccaccgtcccgccgccgccccggggccacgcgccaccggctgccgcccccggcccggccccgctgagctccccggtgcgcgagccgccccagctggaggaggagcggcaggtgcggatcagcgagagcggccagttcagcgacgggctggaggaccgaggcttactagaaagcagcacccgcctgaaacctcacgaagcccagaactacaggaagaaggcattgtgggtgtcctggttctccatcattgtcaccctggccctcgcggtggctgcctttactgtctccgttatgaggtacagcgcctctgcttttgggtttgcatttgatgccatcctggacgtcctgtcatcggcgattgtcctgtggcgttacagcaacgcggccgctgtgcactctgcccatagggagtacatagcctgtgtcatcttgggggtgatattccttctgtcatccatatgtatagtggtcaaagccatccatgacctctcaactaggctgctcccagaagtggacgatttcctgttcagtgtctccattttaagtgggattctttgcagcatcctggccgtgttgaagttcatgctggggaaggttctgaccagtagagcactcataacagatgggatgatgatgata

SEQ ID NO: 175 - DNA, 1520 bp, synthetic construct
  misc_feature 1..1520: note = Synthetic polynucleotide
  source 1..1520: mol_type = other DNA
atgccgatggatttgattttagttgtgtggttctgtgtgtgcactgccaggacagcagaagatatgaagccacccgtgttatcgctgatatggagaactagagttctgaagtctctgcttcagcaatcccttcagggagtggtgggctttgggatggaccctgaccttcagatggatatcgtcaccgagcttgaccttgtgaacaccacccttggagttgctcaggtgtctggaatgcacaatgccagcaaagcatttttatttcaagacatagaaagagagatccatgcagctcctcatgtgagtgagaaattaattcagctgttccggaacaagagtgaattcaccattttggccactgtacagcagaagccatccacttcaggagtgatactgtccattcgagaactggagcacagctattttgaactggagagcagtggcctgagggatgagattcggtatcactacatacacaatgggaagccaaggacagaggcacttccttaccgcatggcagatggacaatggcacaaggttgcactgtcagttagcgcctctcatctcctgctccatgtcgactgtaacaggatttatgagcgtgtgatagaccctccagataccaaccttcccccaggaatcaatttatggcttggccagcgcaaccaaaagcatggcttattcaaagggatcatccaagatgggaagatcatctttatgccgaatggatatataacacagtgtccaaatctaaatcacacttgcccaacctgcagtgatttcttaagcctggtgcaaggaataatggatttacaagagcttttggccaagatgactgcaaaactaaattatgcagagacaagacttagtcaattggaaaactgtcattgtgagaagacttgtcaagtgagtggactgctctatcgagatcaagactcttgggtagatggtgaccattgcaggaactgcacttgcaaaagtggtgccgtggaatgccgaaggatgtcctgtccccctctcaattgctccccagactccctcccagtgcacattgctggccagtgctgtaaggtctgccgaccaaaatgtatctatggaggaaaagttcttgcagaaggccagcggattttaaccaagagctgtcgggaatgccgaggtggagttttagtaaaaattacagaaatgtgtcctcctttgaactgctcagaaaaggatcacattcttcctgagaatcagtgctgccgtgtctgtagaggtcataacttttgtgcagaaggacctaaatgtggtgaaaactcagagtgcaaaaactggaatacaaaagctacttgtgagtgcaagagtggttacatctctgtccagggagactctgcctactgtgaaggggaaggagggagtgctcctggcatctgatgggtagaggccaccaatgctgctgaacattctacaagcacaagagaagctcccaacaacaacaaatgatctgatctcaaatcccaatactgctgtggttgagacac

SEQ ID NO: 176 - DNA, 1436 bp, synthetic construct
  misc_feature 1..1436: note = Synthetic polynucleotide
  source 1..1436: mol_type = other DNA
atgccgatggatttgattttagttgtgtggttctgtgtgtgcactgccaggacagtggtgggctttgggatggaccctgaccttcagatggatatcgtcaccgagcttgaccttgtgaacaccacccttggagttgctcaggtgtctggaatgcacaatgccagcaaagcatttttatttcaagacatagaaagagagatccatgcagctcctcatgtgagtgagaaattaattcagctgttccggaacaagagtgaattcaccattttggccactgtacagcagaagccatccacttcaggagtgatactgtccattcgagaactggagcacagctattttgaactggagagcagtggcctgagggatgagattcggtatcactacatacacaatgggaagccaaggacagaggcacttccttaccgcatggcagatggacaatggcacaaggttgcactgtcagttagcgcctctcatctcctgctccatgtcgactgtaacaggatttatgagcgtgtgatagaccctccagataccaaccttcccccaggaatcaatttatggcttggccagcgcaaccaaaagcatggcttattcaaagggatcatccaagatgggaagatcatctttatgccgaatggatatataacacagtgtccaaatctaaatcacacttgcccaacctgcagtgatttcttaagcctggtgcaaggaataatggatttacaagagcttttggccaagatgactgcaaaactaaattatgcagagacaagacttagtcaattggaaaactgtcattgtgagaagacttgtcaagtgagtggactgctctatcgagatcaagactcttgggtagatggtgaccattgcaggaactgcacttgcaaaagtggtgccgtggaatgccgaaggatgtcctgtccccctctcaattgctccccagactccctcccagtgcacattgctggccagtgctgtaaggtctgccgaccaaaatgtatctatggaggaaaagttcttgcagaaggccagcggattttaaccaagagctgtcgggaatgccgaggtggagttttagtaaaaattacagaaatgtgtcctcctttgaactgctcagaaaaggatcacattcttcctgagaatcagtgctgccgtgtctgtagaggtcataacttttgtgcagaaggacctaaatgtggtgaaaactcagagtgcaaaaactggaatacaaaagctacttgtgagtgcaagagtggttacatctctgtccagggagactctgcctactgtgaaggggaaggagggagtgctcctggcatctgatgggtagaggccaccaatgctgctgaacattctacaagcacaagagaagctcccaacaacaacaaatgatctgatctcaaatcccaatactgctgtggttgagacac

SEQ ID NO: 177 - DNA, 1265 bp, synthetic construct
  misc_feature 1..1265: note = Synthetic polynucleotide
  source 1..1265: mol_type = other DNA
atgccgatggatttgattttagttgtgtggttctgtgtgtgcactgccaggacagtggtgggctttgggatggaccctgaccttcagatggatatcgtcaccgagcttgaccttgtgaacaccacccttggagttgctcaggtgtctggaatgcacaatgccagcaaagcatttttatttcaagacatagaaagagagatccatgcagctcctcatgtgagtgagaaattaattcagctgttccggaacaagagtgaattcaccattttggccactgtacagcagaagccatccacttcaggagtgatactgtccattcgagaactggagcacaggatttatgagcgtgtgatagaccctccagataccaaccttcccccaggaatcaatttatggcttggccagcgcaaccaaaagcatggcttattcaaagggatcatccaagatgggaagatcatctttatgccgaatggatatataacacagtgtccaaatctaaatcacacttgcccaacctgcagtgatttcttaagcctggtgcaaggaataatggatttacaagagcttttggccaagatgactgcaaaactaaattatgcagagacaagacttagtcaattggaaaactgtcattgtgagaagacttgtcaagtgagtggactgctctatcgagatcaagactcttgggtagatggtgaccattgcaggaactgcacttgcaaaagtggtgccgtggaatgccgaaggatgtcctgtccccctctcaattgctccccagactccctcccagtgcacattgctggccagtgctgtaaggtctgccgaccaaaatgtatctatggaggaaaagttcttgcagaaggccagcggattttaaccaagagctgtcgggaatgccgaggtggagttttagtaaaaattacagaaatgtgtcctcctttgaactgctcagaaaaggatcacattcttcctgagaatcagtgctgccgtgtctgtagaggtcataacttttgtgcagaaggacctaaatgtggtgaaaactcagagtgcaaaaactggaatacaaaagctacttgtgagtgcaagagtggttacatctctgtccagggagactctgcctactgtgaaggggaaggagggagtgctcctggcatctgatgggtagaggccaccaatgctgctgaacattctacaagcacaagagaagctcccaacaacaacaaatgatctgatctcaaatcccaatactgctgtggttgagacac

SEQ ID NO: 178 - DNA, 1436 bp, synthetic construct; identical to SEQ ID NO: 176
  misc_feature 1..1436: note = Synthetic polynucleotide
  source 1..1436: mol_type = other DNA

SEQ ID NO: 179 - DNA, 423 bp, synthetic construct
  misc_feature 1..423: note = Synthetic polynucleotide
  source 1..423: mol_type = other DNA
atgagtatcaatgggaaattacaagatgggtcaatggaaatagacgctgggaacaacttggagacctttaaaatgggaagtggagctgaagaagcaattgcagttaatgatttccagaatggacatggatgaagctggaaaccatcattctcagcaaactatcgcaaggacaaaaaagcaaacaccgcatgttctcactcataggtgggaattgaacaatgagaacacatggatacaggaaggggaacgtcacacaccaggaactgctgtggggtggggggagggatagcatgaggagatatacctaatgctaaatgacgagttaatgggtgcagctcaccaacatggcacatgtatacatatgtaacaaacctgcacattgtgcacatgtacccaaaaacttaaagtataataataataaaa

SEQ ID NO: 180 - DNA, 657 bp, synthetic construct
  misc_feature 1..657: note = Synthetic polynucleotide
  source 1..657: mol_type = other DNA
atgacagagaactccgacaaagttcccattgccctggtgggacctgatgacgtggaattctgcagccccccggcgtacgctacgctgacggtgaagccctccagccccgcgcggctgctcaaggtgggagccgtggtcctcatttcgggagctgtgctgctgctctttggggccatcggggccttctacttctggaaggggagcgacagtcacatttacaatgtccattacaccatgagtatcaatgggaaattacaagatgggtcaatggaaatagacgctgggaacaacttggagacctttaaaatgggaagtggagctgaagaagcaattgcagttaatgatttccagaatggacatggatgaagctggaaaccatcattctcagcaaactatcgcaaggacaaaaaagcaaacaccgcatgttctcactcataggtgggaattgaacaatgagaacacatggatacaggaaggggaacgtcacacaccaggaactgctgtggggtggggggagggatagcatgaggagatatacctaatgctaaatgacgagttaatgggtgcagctcaccaacatggcacatgtatacatatgtaacaaacctgcacattgtgcacatgtacccaaaaacttaaagtataataataataaaa

SEQ ID NO: 181 - DNA, 657 bp, synthetic construct; identical to SEQ ID NO: 180
  misc_feature 1..657: note = Synthetic polynucleotide
  source 1..657: mol_type = other DNA

SEQ ID NO: 182 - DNA, 1313 bp, synthetic construct
  misc_feature 1..1313: note = Synthetic polynucleotide
  source 1..1313: mol_type = other DNA
atgtttccggtagcccctaaaccccaggattccagtcaaccatcagacagactcatgactgaaaaacagcaggaagaagcagaatgggaaagcataaatgtgctattgatgatgcatggcttaaaacctttgtctctagtcaaaagaacagatctcaaagatctcatcatttttgacaaacagtcatcacaaaggatgagacagaatttgaaattgttggtggaagaaacatcatgtcaacagaacatgatacaggagcttatagaaactaatcaacagcttagaaatgaacttcagctagagcaaagccgagcagccaatcaagaacaacgagctaatgacttggaacaaattatggaaagtgtgaaatccaaaattggtgaattggaggatgaatcactaagtagggcttgccaccaacagaataaaataaaagatcttcaaaaggagcagaaaactttacaggacaagaacttgggactcactgaatggcgggagtgaaaggagctgtaacacgttcctggccgactcgccgggctgtgcgtggtgacaaagacaaactgcgtgagtgaagagtggtgacctttctaggggcccagacctcaggatttctgagccagaggtgctgtcacatcataggcctcccaccctccactggcacctggtggctgcgccatgcaatgggaagcagctgtggggccaggccagcccaggagccactggccagagcagggtggtgggactgaaacagctgtaacacaaatgggctgaaacatgtgccacctgaaacacatcccccgacttgctgcgctgcgggtgacaaggagagaagagttgtgactcttctgggatcccaaacctcagggctcccagagccagggctctgacacactctaacaccctctttgggcctctgtggttcctggcatctctgagctttcaggcgcccctgcattccccttgtccaggcattggtgcccacagcggaagctgcttgcagtacatctggtccagccacagtctcacatggagccagtgcctgtgctggtggctggagctgcctgcctcactgcaacagccagtgtgcctggctgtgcacatagccagaccccacatttgctaactcacacacccctcactgctctgcacctggcttgcccttagcaggcatggggtctgggctggtagcacaagctgagtgcagcctgccaggccgagtgggcagaataagcccagcaggtgtgagcaaaactcaagcagaggtaccactggccacagaggtttctggctggtgaagcgacacactgaggatc

SEQ ID NO: 183 - DNA, 1253 bp, synthetic construct
  misc_feature 1..1253: note = Synthetic polynucleotide
  source 1..1253: mol_type = other DNA
atgactgagcaggaagaagcagaatgggaaagcataaatgtgctattgatgatgcatggcttaaaacctttgtctctagtcaaaagaacagatctcaaagatctcatcatttttgacaaacagtcatcacaaaggatgagacagaatttgaaattgttggtggaagaaacatcatgtcaacagaacatgatacaggagcttatagaaactaatcaacagcttagaaatgaacttcagctagagcaaagccgagcagccaatcaagaacaacgagctaatgacttggaacaaattatggaaagtgtgaaatccaaaattggtgaattggaggatgaatcactaagtagggcttgccaccaacagaataaaataaaagatcttcaaaaggagcagaaaactttacaggacaagaacttgggactcactgaatggcgggagtgaaaggagctgtaacacgttcctggccgactcgccgggctgtgcgtggtgacaaagacaaactgcgtgagtgaagagtggtgacctttctaggggcccagacctcaggatttctgagccagaggtgctgtcacatcataggcctcccaccctccactggcacctggtggctgcgccatgcaatgggaagcagctgtggggccaggccagcccaggagccactggccagagcagggtggtgggactgaaacagctgtaacacaaatgggctgaaacatgtgccacctgaaacacatcccccgacttgctgcgctgcgggtgacaaggagagaagagttgtgactcttctgggatcccaaacctcagggctcccagagccagggctctgacacactctaacaccctctttgggcctctgtggttcctggcatctctgagctttcaggcgcccctgcattccccttgtccaggcattggtgcccacagcggaagctgcttgcagtacatctggtccagccacagtctcacatggagccagtgcctgtgctggtggctggagctgcctgcctcactgcaacagccagtgtgcctggctgtgcacatagccagaccccacatttgctaactcacacacccctcactgctctgcacctggcttgcccttagcaggcatggggtctgggctggtagcacaagctgagtgcagcctgccaggccgagtgggcagaataagcccagcaggtgtgagcaaaactcaagcagaggtaccactggccacagaggtttctggctggtgaagcgacacactgaggatc

SEQ ID NO: 184 - DNA, 1313 bp, synthetic construct; identical to SEQ ID NO: 182
  misc_feature 1..1313: note = Synthetic polynucleotide
  source 1..1313: mol_type = other DNA

SEQ ID NO: 185 - DNA, 1259 bp, synthetic construct
  misc_feature 1..1259: note = Synthetic polynucleotide
  source 1..1259: mol_type = other DNA
atgactgaaaaacagcaggaagaagcagaatgggaaagcataaatgtgctattgatgatgcatggcttaaaacctttgtctctagtcaaaagaacagatctcaaagatctcatcatttttgacaaacagtcatcacaaaggatgagacagaatttgaaattgttggtggaagaaacatcatgtcaacagaacatgatacaggagcttatagaaactaatcaacagcttagaaatgaacttcagctagagcaaagccgagcagccaatcaagaacaacgagctaatgacttggaacaaattatggaaagtgtgaaatccaaaattggtgaattggaggatgaatcactaagtagggcttgccaccaacagaataaaataaaagatcttcaaaaggagcagaaaactttacaggacaagaacttgggactcactgaatggcgggagtgaaaggagctgtaacacgttcctggccgactcgccgggctgtgcgtggtgacaaagacaaactgcgtgagtgaagagtggtgacctttctaggggcccagacctcaggatttctgagccagaggtgctgtcacatcataggcctcccaccctccactggcacctggtggctgcgccatgcaatgggaagcagctgtggggccaggccagcccaggagccactggccagagcagggtggtgggactgaaacagctgtaacacaaatgggctgaaacatgtgccacctgaaacacatcccccgacttgctgcgctgcgggtgacaaggagagaagagttgtgactcttctgggatcccaaacctcagggctcccagagccagggctctgacacactctaacaccctctttgggcctctgtggttcctggcatctctgagctttcaggcgcccctgcattccccttgtccaggcattggtgcccacagcggaagctgcttgcagtacatctggtccagccacagtctcacatggagccagtgcctgtgctggtggctggagctgcctgcctcactgcaacagccagtgtgcctggctgtgcacatagccagaccccacatttgctaactcacacacccctcactgctctgcacctggcttgcccttagcaggcatggggtctgggctggtagcacaagctgagtgcagcctgccaggccgagtgggcagaataagcccagcaggtgtgagcaaaactcaagcagaggtaccactggccacagaggtttctggctggtgaagcgacacactgaggatc

SEQ ID NO: 186 - DNA, 1313 bp, synthetic construct; identical to SEQ ID NO: 182
  misc_feature 1..1313: note = Synthetic polynucleotide
  source 1..1313: mol_type = other DNA

SEQ ID NO: 187 - DNA, 1250 bp, synthetic construct
  misc_feature 1..1250: note = Synthetic polynucleotide
  source 1..1250: mol_type = other DNA
atgactgaggaagaagcagaatgggaaagcataaatgtgctattgatgatgcatggcttaaaacctttgtctctagtcaaaagaacagatctcaaagatctcatcatttttgacaaacagtcatcacaaaggatgagacagaatttgaaattgttggtggaagaaacatcatgtcaacagaacatgatacaggagcttatagaaactaatcaacagcttagaaatgaacttcagctagagcaaagccgagcagccaatcaagaacaacgagctaatgacttggaacaaattatggaaagtgtgaaatccaaaattggtgaattggaggatgaatcactaagtagggcttgccaccaacagaataaaataaaagatcttcaaaaggagcagaaaactttacaggacaagaacttgggactcactgaatggcgggagtgaaaggagctgtaacacgttcctggccgactcgccgggctgtgcgtggtgacaaagacaaactgcgtgagtgaagagtggtgacctttctaggggcccagacctcaggatttctgagccagaggtgctgtcacatcataggcctcccaccctccactggcacctggtggctgcgccatgcaatgggaagcagctgtggggccaggccagcccaggagccactggccagagcagggtggtgggactgaaacagctgtaacacaaatgggctgaaacatgtgccacctgaaacacatcccccgacttgctgcgctgcgggtgacaaggagagaagagttgtgactcttctgggatcccaaacctcagggctcccagagccagggctctgacacactctaacaccctctttgggcctctgtggttcctggcatctctgagctttcaggcgcccctgcattccccttgtccaggcattggtgcccacagcggaagctgcttgcagtacatctggtccagccacagtctcacatggagccagtgcctgtgctggtggctggagctgcctgcctcactgcaacagccagtgtgcctggctgtgcacatagccagaccccacatttgctaactcacacacccctcactgctctgcacctggcttgcccttagcaggcatggggtctgggctggtagcacaagctgagtgcagcctgccaggccgagtgggcagaataagcccagcaggtgtgagcaaaactcaagcagaggtaccactggccacagaggtttctggctggtgaagcgacacactgaggatc

SEQ ID NO: 188 - DNA, 1253 bp, synthetic construct; identical to SEQ ID NO: 183
  misc_feature 1..1253: note = Synthetic polynucleotide
  source 1..1253: mol_type = other DNA

SEQ ID NO: 189 - DNA, 1313 bp, synthetic construct; identical to SEQ ID NO: 182
  misc_feature 1..1313: note = Synthetic polynucleotide
  source 1..1313: mol_type = other DNA

SEQ ID NO: 190 - DNA, 298 bp, synthetic construct
  misc_feature 1..298: note = Synthetic polynucleotide
  source 1..298: mol_type = other DNA
atgcctgagatcagagtcacgcccttgggggccggccaggacgtgggccgaagctgcatcctggtctccattgcgggcaagaatgtcatgctggactgtggaatgcacatgggcttcaatgacgaccgacgcttccctgacttctcctacatcacccagaacggccgcctaacagacttcctggactgtgtgatcattagactttgagactgaaagttccagggagacagttttgtgtttgctcattactgactcttcggtactcgggatgaggcctggcgcacagcaggcgaatgaa

SEQ ID NO: 191 - DNA, 316 bp, synthetic construct
  misc_feature 1..316: note = Synthetic polynucleotide
  source 1..316: mol_type = other DNA
atgtgtggtgctggctttggacacttcgagtggctggcagggggaggggccggccaggacgtgggccgaagctgcatcctggtctccattgcgggcaagaatgtcatgctggactgtggaatgcacatgggcttcaatgacgaccgacgcttccctgacttctcctacatcacccagaacggccgcctaacagacttcctggactgtgtgatcattagactttgagactgaaagttccagggagacagttttgtgtttgctcattactgactcttcggtactcgggatgaggcctggcgcacagcaggcgaatgaa

SEQ ID NO: 192 - DNA, 298 bp, synthetic construct; identical to SEQ ID NO: 190
  misc_feature 1..298: note = Synthetic polynucleotide
  source 1..298: mol_type = other DNA

SEQ ID NO: 193 - DNA, 211 bp, synthetic construct
  misc_feature 1..211: note = Synthetic polynucleotide
  source 1..211: mol_type = other DNA
atgctggactgtggaatgcacatgggcttcaatgacgaccgacgcttccctgacttctcctacatcacccagaacggccgcctaacagacttcctggactgtgtgatcattagactttgagactgaaagttccagggagacagttttgtgtttgctcattactgactcttcggtactcgggatgaggcctggcgcacagcaggcgaatgaa

SEQ ID NO: 194 - DNA, 298 bp, synthetic construct; identical to SEQ ID NO: 190
  misc_feature 1..298: note = Synthetic polynucleotide
  source 1..298: mol_type = other DNA

SEQ ID NO: 195 - DNA, 298 bp, synthetic construct; identical to SEQ ID NO: 190
  misc_feature 1..298: note = Synthetic polynucleotide
  source 1..298: mol_type = other DNA

SEQ ID NO: 196 - DNA, 298 bp, synthetic construct; identical to SEQ ID NO: 190
  misc_feature 1..298: note = Synthetic polynucleotide
  source 1..298: mol_type = other DNA

SEQ ID NO: 197 - DNA, 316 bp, synthetic construct; identical to SEQ ID NO: 191
  misc_feature 1..316: note = Synthetic polynucleotide
  source 1..316: mol_type = other DNA

SEQ ID NO: 198 - DNA, 439 bp, synthetic construct
  misc_feature 1..439: note = Synthetic polynucleotide
  source 1..439: mol_type = other DNA
atgcctgagatcagagtcacgcccttgggtgcctgccctgtgctgtcctggaacctggtccttccaccgggcagggggtcgagggcaccttccagcacagacaccaggacgggattccatgtcctcccccatggcgtgagcgcttcctcggagggtgccccccgccccggggccggccaggacgtgggccgaagctgcatcctggtctccattgcgggcaagaatgtcatgctggactgtggaatgcacatgggcttcaatgacgaccgacgcttccctgacttctcctacatcacccagaacggccgcctaacagacttcctggactgtgtgatcattagactttgagactgaaagttccagggagacagttttgtgtttgctcattactgactcttcggtactcgggatgaggcctggcgcacagcaggcgaatgaa

SEQ ID NO: 199 - DNA, 301 bp, synthetic construct
  misc_feature 1..301: note = Synthetic polynucleotide
  source 1..301: mol_type = other DNA
atgcctgagatcagagtcacgcccttggtaggggccggccaggacgtgggccgaagctgcatcctggtctccattgcgggcaagaatgtcatgctggactgtggaatgcacatgggcttcaatgacgaccgacgcttccctgacttctcctacatcacccagaacggccgcctaacagacttcctggactgtgtgatcattagactttgagactgaaagttccagggagacagttttgtgtttgctcattactgactcttcggtactcgggatgaggcctggcgcacagcaggcgaatgaa

SEQ ID NO: 200 - DNA, 478 bp, synthetic construct
  misc_feature 1..478: note = Synthetic polynucleotide
  source 1..478: mol_type = other DNA
atgcctgagatcagagtcacgcccttgggtgcctgccctgtgctgtcctggaacctggtccttccaccgggcagggggtcgagggcaccttccagcacagacaccaggacgggattccatgtcctcccccatggccccctcggctgtggccccgtcatcctgatgtgtggtgctggctttggacacttcgagtggctggcagggggaggggccggccaggacgtgggccgaagctgcatcctggtctccattgcgggcaagaatgtcatgctggactgtggaatgcacatgggcttcaatgacgaccgacgcttccctgacttctcctacatcacccagaacggccgcctaacagacttcctggactgtgtgatcattagactttgagactgaaagttccagggagacagttttgtgtttgctcattactgactcttcggtactcgggatgaggcctggcgcacagcaggcgaatgaa

SEQ ID NO: 201 - DNA, 381 bp, synthetic construct
  misc_feature 1..381: note = Synthetic polynucleotide
  source 1..381: mol_type = other DNA
atggagccggccgcgggcatccagcgccgcagctcccaggggcccaccgtcccgccgccgccccggggccacgcgccaccggctgccgcccccggcccggccccgctgagctccccggtgcgcgagccgccccagctggaggaggagcggcaggtgcggatcagcgagagcggccagttcagcgacgggctggaggaccgaggcttactagaaagcagcacccgcctgaaacctcacgaagcccagaactacaggaagaaggcattgtgggtgtcctggttctccatcattgtcaccctggccctcgcggtggctgcctttacctttcctgcagtccaggtggctatggaaaacttctggcaggtgaaatgtgagtagagg

SEQ ID NO: 202 - DNA, 729 bp, synthetic construct
  misc_feature 1..729: note = Synthetic polynucleotide
  source 1..729: mol_type = other DNA
atgcctgagcctcccaccccctccgttggctcctgtgctgcccgagcctcccggatgagcgccgccccctgctccagggcgcccagtcccatcgaccacccaagggctgaggagtgcgggcgcgcggcgcgggactggcaggcagctccacctgcagccccggtgagggatccactgggtgaagccagctgggctcctgagtctggtgaggacatggagaacctttatgtccagctcaagttgcagtccgtaggcacttgctttaaccgtgaagaattaccttcagtacttcagctgagcttcttccatgctccactaaaccatttcttgcatcacagtggagagtcgaagaattccatctcttggaatcactttcaagcagatgtctagcttggattcagccaatgggattcaataaagagagatttaaaagtcagaagaaaacaagaattccagtacagctgtagcaagatgcgcaggcatttggcagacatgacgttggcagcagcatccaagtgagttcctgtgaatcacccgctttgagaattcaagcaactagtgccattgcaggtggctttctcacattcttgaatttttagatctctgaggctagttaacaatctctttgacatatacaaatgcaactttacaagggagaaaaaagcatccaattctctgcattgattttttttcctactcaaaataaattcttagaatgctttaggtttt

SEQ ID NO: 203 - DNA, 729 bp, synthetic construct; identical to SEQ ID NO: 202
  misc_feature 1..729: note = Synthetic polynucleotide
  source 1..729: mol_type = other DNA

SEQ ID NO: 204 - DNA, 500 bp, synthetic construct
  misc_feature 1..500: note = Synthetic polynucleotide
  source 1..500: mol_type = other DNA
atggccttgggattaaagtgcttccgcatggtccaccctacctttcgcaattatcttgcagcctctatcagacccgtttcagaagttacactgaagacagtgcatgaaagacaacatggccataggcaatacatggcctattcagctgtaccagtccgccattttgctaccaagaaagccaaaggatcccttgacaagattgctgtggtaactgctgacgggaagcttgctttaaaccagattagccagatctccatgaagtcgccacagctgattttggtgaatatggccagcttcccagagtgtacagctgcagctatcaaggctataagagaaagtggaatgaatctgaacccagaagtggaagggacgctaattcgggtacccattccccaaatgtgagtgctttgagaggagagaggaagagctttgtcagttttgttcattgctgtattcctaggccctcaaacagagcctagcatgtagtaagtatgcaataa

SEQ ID NO: 205 - DNA, 656 bp, synthetic construct
  misc_feature 1..656: note = Synthetic polynucleotide
  source 1..656: mol_type = other DNA
atggccttgggattaaagtgcttccgcatggtccaccctacctttcgcaattatcttgcagcctctatcagacccgtttcagaagttacactgaagacagtgcatgaaagacaacatggccataggcaatacatggcctattcagctgtaccagtccgccattttgctaccaagaaagccaaagccaaagggaaaggacagtcccaaaccagagtgaatattaatgctgccttggttgaggatataatcaacttggaagaggtgaatgaagaaatgaagtctgtgatagaagctctcaaggataatttcaataagactctcaatataaggacctcaccaggatcccttgacaagattgctgtggtaactgctgacgggaagcttgctttaaaccagattagccagatctccatgaagtcgccacagctgattttggtgaatatggccagcttcccagagtgtacagctgcagctatcaaggctataagagaaagtggaatgaatctgaacccagaagtggaagggacgctaattcgggtacccattccccaaatgtgagtgctttgagaggagagaggaagagctttgtcagttttgttcattgctgtattcctaggccctcaaacagagcctagcatgtagtaagtatgcaataa

SEQ ID NO: 206 - DNA, 656 bp, synthetic construct; identical to SEQ ID NO: 205
  misc_feature 1..656: note = Synthetic polynucleotide
  source 1..656: mol_type = other DNA

SEQ ID NO: 207 - DNA, 524 bp, synthetic construct
  misc_feature 1..524: note = Synthetic polynucleotide
  source 1..524: mol_type = other DNA
atggcctattcagctgtaccagtccgccattttgctaccaagaaagccaaagccaaagggaaaggacagtcccaaaccagagtgaatattaatgctgccttggttgaggatataatcaacttggaagaggtgaatgaagaaatgaagtctgtgatagaagctctcaaggataatttcaataagactctcaatataaggacctcaccaggatcccttgacaagattgctgtggtaactgctgacgggaagcttgctttaaaccagattagccagatctccatgaagtcgccacagctgattttggtgaatatggccagcttcccagagtgtacagctgcagctatcaaggctataagagaaagtggaatgaatctgaacccagaagtggaagggacgctaattcgggtacccattccccaaatgtgagtgctttgagaggagagaggaagagctttgtcagttttgttcattgctgtattcctaggccctcaaacagagcctagcatgtagtaagtatgcaataa

SEQ ID NO: 208 - DNA, 656 bp, synthetic construct; identical to SEQ ID NO: 205
  misc_feature 1..656: note = Synthetic polynucleotide
  source 1..656: mol_type = other DNA

SEQ ID NO: 209 - DNA, 1363 bp, synthetic construct
  misc_feature 1..1363: note = Synthetic polynucleotide
  source 1..1363: mol_type = other DNA
atggagtggccggcgcggctctgcgggctgtgggcgctgctgctctgcgccggcggcgggggcgggggcgggggcgccgcgcctacggaaactcagccacctgtgacaaatttgagtgtctctgttgaaaacctctgcacagtaatatggacatggaatccacccgagggagccagctcaaattgtagtctatggtattttagtcattttggcgacaaacaagataagaaaatagctccggaaactcgtcgttcaatagaagtacccctgaatgagaggatttgtctgcaagtggggtcccagtgtagcaccaatgagagtgagaagcctagcattttggttgaaaaatgcatctcacccccagaaggtgatcctgagtctgctgtgactgagcttcaatgcatttggcacaacctgagctacatgaagtgttcttggctccctggaaggaataccagtcccgacactaactatactctctactattggcacagaagcctggaaaaaattcatcaatgtgaaaacatctttagagaaggccaatactttggttgttcctttgatctgaccaaagtgaaggattccagttttgaacaacacagtgtccaaataatggtcaaggataatgcaggaaaaattaaaccatccttcaatatagtgcctttaacttcccgtgtgaaacctgatcctccacatattaaaaacctctccttccacaatgatgacctatatgtgcaatgggagaatccacagaattttattagcagatgcctattttatgaagtagaagtcaataacagccaaactgagacacataatgttttctacgtccaagaggctaaatgtgagaatccagaatttgagagaaatgtggagaatacatcttgtttcatggtccctggtgttcttcctgatactttgaacacagtcagaataagagtcaaaacaaataagttatgctatgaggatgacaaactctggagtaattggagccaagaaatgagtataggatttttgcagatataatcaagtgaggatgaggtcatgctggattaaagtggacagttaatctaatgactagtatccttataaaaagagaagccacacagagacacacagacacacagggaagaaagccatgtgaagatggaggcagagattgcagagatgcagctacaaccaaggaacaacaaggattcccaggagctaccagaagctaggaagaggcaaagagggattcttctctagagccctcagagggagcatagccctgctgacaccttcattttggatttctagcctccaaaactgtgagataatacatttctgttgttgtaagccattcagtttgtggtaatttgct

SEQ ID NO: 210 - DNA, 2370 bp, synthetic construct
  misc_feature 1..2370: note = Synthetic polynucleotide
  source 1..2370: mol_type = other DNA
atgatgcagggaaacacatgtcacagaatgtcgttccacccgggacgagggtgtccccgaggacgaggaggacatggagccagaccctcagcaccatcctttaggccccaaaatctgaggctgcttcaccctcagcagcctcctgtgcaatatcaatatgaacctccaagtgccccttccaccactttctcaaactctccagcccccaattttctccctccacgaccagactttgtacccttccccccacccatgcctccgtcagcgcaaggccctcttcccccctgcccaatcaggccgcctttccccaaccaccagatgaggcaccccttcccagttcctccttgttttcctcccatgccaccaccaatgccttgtcctaataaccccccagtccctggggcacctcctggacaaggcactttccccttcatgatgccccctccctccatgcctcatcccccgccccctccagtcatgccgcagcaggttaattatcagtaccctccgggctattctcaccacaacttcccacctcccagttttaatagtttccagaacaaccctagttctttcctgcccagtgctaataacagcagtagtcctcatttcagacatctccctccatacccactcccaaaggctcccagtgagagaaggtccccagaaaggctgaaacactatgatgaccacaggcaccgagatcacagtcatgggcgaggtgagaggcatcggtccctggatcggcgggagcgaggccgcagtcccgacaggagaagacaagacagccggtacagatctgattatgaccgagggagaacaccatctcgccaccgcagctacgaacggagcagagagcgagaacgggagagacacaggcatcgagacaaccgaagatcaccatctctggaaaggtcctacaaaaaagagtataagagatctggaaggagttacggtttatcggttgttcctgaacctgctggatgcacaccagaattacctggggagattattaaaaatacagattcttgggccccacccctggagattgtgaatcatcgctccccaagtagggagaagaagagagctcgttgggaggaagaaaaagaccgttggagtgacaaccagagttctggcaaagacaagaactatacctcaatcaaggaaaaagagcccgaggagaccatgcctgacaagaatgaggaggaagaagaagaacttcttaagcctgtgtggattcgatgcactcattcagaaaactactactccagtgaccccatggatcaggtgggagattctacagtggttggaacgagtaggcttcgtgacttatatgacaaatttgaggaggagttggggagcaggcaagaaaaggccaaagctgctcggcctccgtgggaacctccaaagacgaagctcgatgaagatttagagagttccagtgaatccgagtgtgagtctgatgaggacagcacctgttctagcagctcagactctgaagtttttgacgttattgcagaaatcaaacgcaaaaaggcccaccctgaccgacttcatgatgaactttggtacaacgatccaggccagatgaatgatggaccactctgcaaatgcagcgcaaaggcaagacgcacaggaattaggcacagcatttatcctggagaagaggccatcaagccctgtcgtcctatgaccaacaatgctggcagacttttccactaccggatcacagtctccccgcctacgaactttttaactgacaggccaactgttatagaatacgatgatcacgagtatatctttgaaggattttctatgtttgcacatgcccccctgaccaatattgccttttgaaatgaacctcctcgatgtttcctcagatactttaccctcaacctgtgtgaaactagactcgtcatcttccctgcatattgaatttgaggtactaaggggacaccctcctgaattaagtgacctagttggtcacttacgccagaaacccagaaatgatcctcaattctttcttcactcttcctcccacatcagaatggtcactgtatatttcagtaatatctcctgtgtttaaaatttttctcttcctttccagtcttcccttcatttggctcctggactattgcattagacttcagtctggtcttctttgttcccttacaagccattcccacactgtttccacagtgtctcatctgaaatgtaaatgatgataatctgtaacttaaagtacttgaatgatttctcgttgccatatatccataagccctgaccttaacatggtttgtaagggctacataatagagttcatattttcctctctagatcatctggcatctctctctctccacgcacttc

SEQ ID NO: 211 - DNA, 2370 bp, synthetic construct; identical to SEQ ID NO: 210
  misc_feature 1..2370: note = Synthetic polynucleotide
  source 1..2370: mol_type = other DNA

SEQ ID NO: 212 - DNA, 2259 bp, synthetic construct
  misc_feature 1..2259: note = Synthetic polynucleotide
  source 1..2259: mol_type = other DNA
atgatgcagggaaacacatgtcacagaatgtcgttccacccgggacgagggtgtccccgaggacgaggaggacatggagccagaccctcagcaccatcctttaggccccaaaatctgaggctgcttcaccctcagcagcctcctgtgcaatatcaatatgaacctccaagtgccccttccaccactttctcaaactctccagcccccaattttctccctccacgaccagactttgtacccttccccccacccatgcctccgtcagcgcaaggccctcttcccccctgcccaatcaggccgcctttccccaaccaccagatgaggcaccccttcccagttcctccttgttttcctcccatgccaccaccaatgccttgtcctaataaccccccagtccctggggcacctcctggacaaggcactttccccttcatgatgccccctccctccatgcctcatcccccgccccctccagtcatgccgcagcaggttaattatcagtaccctccgggctattctcaccacaacttcccacctcccagttttaatagtttccagaacaaccctagttctttcctgcccagtgctaataacagcagtagtcctcatttcagacatctccctccatacccactcccaaaggctcccagtgagagaaggtccccagaaaggctgaaacactatgatgaccacaggcaccgagatcacagtcatgggcgaggtgagaggcatcggtccctggatcggcgggagcgaggccgcagtcccgacaggagaagacaagacagccggtacagatctgattatgaccgagggagaacaccatctcgccaccgcagctacgaacggagcagagagcgagaacgggagagacacaggcatcgagacaaccgaagatcaccatctctggaaaggtcctacaaaaaagagtataagagatctggaagtcgctccccaagtagggagaagaagagagctcgttgggaggaagaaaaagaccgttggagtgacaaccagagttctggcaaagacaagaactatacctcaatcaaggaaaaagagcccgaggagaccatgcctgacaagaatgaggaggaagaagaagaacttcttaagcctgtgtggattcgatgcactcattcagaaaactactactccagtgaccccatggatcaggtgggagattctacagtggttggaacgagtaggcttcgtgacttatatgacaaatttgaggaggagttggggagcaggcaagaaaaggccaaagctgctcggcctccgtgggaacctccaaagacgaagctcgatgaagatttagagagttccagtgaatccgagtgtgagtctgatgaggacagcacctgttctagcagctcagactctgaagtttttgacgttattgcagaaatcaaacgcaaaaaggcccaccctgaccgacttcatgatgaactttggtacaacgatccaggccagatgaatgatggaccactctgcaaatgcagcgcaaaggcaagacgcacaggaattaggcacagcatttatcctggagaagaggccatcaagccctgtcgtcctatgaccaacaatgctggcagacttttccactaccggatcacagtctccccgcctacgaactttttaactgacaggccaactgttatagaatacgatgatcacgagtatatctttgaaggattttctatgtttgcacatgcccccctgaccaatattgccttttgaaatgaacctcctcgatgtttcctcagatactttaccctcaacctgtgtgaaactagactcgtcatcttccctgcatattgaatttgaggtactaaggggacaccctcctgaattaagtgacctagttggtcacttacgccagaaacccagaaatgatcctcaattctttcttcactcttcctcccacatcagaatggtcactgtatatttcagtaatatctcctgtgtttaaaatttttctcttcctttccagtcttcccttcatttggctcctggactattgcattagacttcagtctggtcttctttgttcccttacaagccattcccacactgtttccacagtgtctcatctgaaatgtaaatgatgataatctgtaacttaaagtacttgaatgatttctcgttgccatatatccataagccctgaccttaacatggtttgtaagggctacataatagagttcatattttcctctctagatcatctggcatctctctctctccacgcacttc

SEQ ID NO: 213 - DNA, 2259 bp, synthetic construct; identical to SEQ ID NO: 212
  misc_feature 1..2259: note = Synthetic polynucleotide
  source 1..2259: mol_type = other DNA

SEQ ID NO: 214 - DNA, 3525 bp, synthetic construct
  misc_feature 1..3525: note = Synthetic polynucleotide
  source 1..3525: mol_type = other DNA
atggacatgagggtccccgctcagctcctggggctcctgctgctctggttcccaggtgccaggtgtgacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaagactcagtggcaggtaggcccctttgcgaatgggagacggcataaacctcacctgggtgttcttttggttcccttagtcaaaatcatgaacaaagttgccaactttgaaaaaggcgttttgcaacagtagccttggaatctgttcaacaaggcctggcccagtcacttctctaagatttttacagcctgctaaccagatggaagtccaggtatccacaacctctatgcatactcagtggagcgtatagcaacagaaaactatcaatgagtgcaccagcctctcaatcttaggacacataagttgcctgaatcagccactgaatgtgtttatattgaatggcaactccttgcttgctattaggcactgatggagactgaacatgttaaggcttcagcaccatgtgtgactgtgacactggtcccttagctgtccattctcacttagatacttacaaacaccattagtaaaactgaacaatctgaacagagccatgttatcaaatggaaatggcacattcttgatcaggtttagtcaggaccccacaggatctgtggctccatgaacaaatggggagcttgctagaagggaccaaataacttgtaggtgataatttggctctttatttgcccatgtggagcccaagattcagagatttccatatggcaggagtcactgaaggctgagcaaaatgctaactgacagatccactaggtgtggccaccattcagccagtggatggccacttttttaactgaaacttaacatgggctttctacccagtgggcaaaactacattcagtggtaatggccatgcaggctgtcccaacaacgcaccatgccacatatccactaaatcctcggccattgtcaacagccttgccatctgttcaggaaaatggcaactgagagactggactattaaagaatccccagtgtgaaggaaaggactatggccacagctttccacctgcaggaaaaagaaatatgatgctgaatttgatgctgggactacctaggtaacccttgagtgcaatttatgtcatatttttggatactccatgagacttctcactcacaaaggagcatctttcactgcccaagcaacgtgacaataggcacactctcatggaacacgatgaactttccatgcaccctgcatccacaggccaatgatcctagtgaatgctagatcagtggaatcacacagcaatatgcagaaaggacatctacaaagtctgttaatggggtggtatcccatctgactagagaaatatgtacattaaagatcctgggccacaaaaagggaaatagtgcatgttgagaaacacagagctgggtggaagtaaaggtaggccaggcagacacttatattagtctggacctgtgaaagctatttcagtgttcctaaccattccttttctttttttcctttagaatacatgctctggggtggtttgcaatctaggccattacaatgccccagacaggccccctaactctaataggaggattatgtttcctctgggtgcttcctttctacaagatcccacagtgatggataacaagactaagaaatatcacggagctaggggccctcttctggtgccagggacatcttatcctccctttagtgttggtgatattatgaaatatgtccagtttttacagggcagaatctcccttcctggagtggacaatcaggactgaaatatctggatcaagtgacaaaggcaatggattgttcacagagcaaggacagccagaccgcattcctacaccaacacggcccaacccttgtagatgggtaggggacacctgagaccctgggatgggtgagagacgatgcattaacctgtgaggctgcattttgacaagaatgaggcagcaaaggcctagaagcacaatgtctttgttagcttcttttaggtcaccagggtgatctttcaaaatagtgaatctcccattcttgacctcattctgtcattaactagaggttccctttcattctaccaagggtaaattacaccaacattcctaatactaaggtgtacatcaaaaggacccaagcactggcccacaaagtgagaatctgacacctgccacatgggaggaaactggaggacccctgtttaacttaattgcctctggcgaatgtcatgaccacaattaaaaaaaacattggtggactaatattttgatgcaccatacttttttgattgcatagatgagaaacatcccaatggcaatgataaaaacaaggactggactaatgctagccctctgtctacagacaatattgtatgagcaaaactttgctcatgcaactctactatcagtgagacttggctaatgaacgcaccaataccagcataaccatgacagagtgattgaagaaaaatgggaaaaggggggctgtatgcacccaagggctacatctttctctgtaagcggtttgggagtgaccaaaatgcaggatatgtgatgccatctctggatatctgtggaatagtgagatcctgcatgttgggcatgctggggttgtctctggatattgctccttggaattaggtaaatcatagagcctgaagcccaaagctgtacctcagacttactagggacctaccagaaggtacaacagatgataggtttatgtcttttatgatatttttggtactatgtataggagtcagtgctcatgaaaaaaagtgaaatgataaggaacttgtccctgaccatggcagatattgctcctcctccatagccactgccttggtaacccagcagacatcccttaactccatcgggatggatgtttaagataacagtgttgctctagacctttaaaaaatcccaactgggaggaatgtatacaatttccaataccccctgctatacctggataaacacctcaggtatcctagaaattcaagtagaggagatctggaaacaagctcataattgcagaaaatggattctgcagattcagaaaatcccacctgaaggattcttctttcacccctttagcaacttcttctgtggatcatgggatcctgggctacataactgcttcaggtgggcctgatcattctgcctctggtagtagttttcattggcccagtgaaatcttttctggctctgtctcaatgatgttgctttgagattgtgtcagtcaaggtgcttcatccgtctgacaagacacacctgtgcctccagttcacggtggttggtaggcgtataaaatggaatagctttctacggaggatgtctgtgttggggg

SEQ ID NO: 215 - DNA, 775 bp, synthetic construct
  misc_feature 1..775: note = Synthetic polynucleotide
  source 1..775: mol_type = other DNA
atgagggaacctatatacatgcactcgacaatggtctttttaccctgggagctccacacaaagaagggccctagtcctccagagcagtttatggctgtcaaattatctgattccagaatcgccctgaaatctggctatggaaaatatcttggtataaattcagatgaacttgttgggcattcagatgcaattggaccaagagaacaatgggaaccagtctttcaaaatgggaaaatggctttgttggcctcaaatagctgctttattagatgcaatgaagcaggggacatagaagcaaaaagtaaaacagcaggagaagaagaaatgatcaagattagatcctgtgctgaaaaagaaaccaagaaaaaagatgacattccagaagaagacaaaggaaatgtaaaacaatgtgaaatcaattatgtaaagaaatttcagagcttccaagaccacaaacttaaaataagtaaagaagagagtaaaattcttaaaaaggctcagaaagatggatttttgcatgagacgcttctggacagatttggctaccatgttctttttgtgcctattttaacagagtctcagtcatagcctgccttcatctctgaagggaccaggcgacccatggagtgcctcggcagcctcgtcattgcatgcaatcttcacagacaagatctcactgcaaccacgtttctacaggagcacaggtgtgacattatactgatgacatcattctcagagaaaattcattttacatactaaggacacacagatacaa

SEQ ID NO: 216 - DNA, 775 bp, synthetic construct; identical to SEQ ID NO: 215
  misc_feature 1..775: note = Synthetic polynucleotide
  source 1..775: mol_type = other DNA

SEQ ID NO: 217 - DNA, 2153 bp, synthetic construct
  misc_feature 1..2153: note = Synthetic polynucleotide
  source 1..2153: mol_type = other DNA
atgcggccatggactggttcctggcgttggattatgctcattctttttgcctgggggaccttgctgttttatataggtggtcacttggtacgagataatgaccatcctgatcactctagccgagaactgtccaagattctggcaaagcttgaacgcttaaaacaacagaatgaagacttgaggcgaatggccgaatctctccggataccagaaggccctattgatcaggggccagctataggaagagtacgcgttttagaagagcagcttgttaaggccaaagaacagattgaaaattacaagaaacagaccagaaatggtctggggaaggatcatgaaatcctgaggaggaggattgaaaatggagctaaagagctctggtttttcctacagagtgaattgaagaaattaaagaacttagaaggaaatgaactccaaagacatgcagatgaatttcttttggatttaggacatcatgaaaggtctataatgacggatctatactacctcagtcagacagatggagcaggtgattggcgggaaaaagaggccaaagatctgacagaactggttcagcggagaataacatatcttcagggtctccctctccctctctttccacggtctccctctgatgctgagccgaagctggactgtactgctgccatctcggctcactgcaacctccctgcctgattctcctgcctcagcctgccgagtgcctgcgattgcaggcgcgcgccgccacgcctgactggttttcgtatttttttggtggagacggggtttcgctgtgttggccgggctggtctccagctcctaaccgcgagtgatccgccagcctcggcctcctgaggtgcctggattgcagacggagtctcgttcactcagtgctcagtggtgcccaggctggagtgcagtggcgtgatctcggctcgctacaacctccacctcccagccgcctgccttggcctcccaaagtgccgagattgcagcctctgcctggccgccaccccgtctgggatgtgaggagcccctctgcctggctgcccagtctggaaagtgaggagcgtctctgcccagccgccatcccatctaggaagtgaggagcgcctcttcccggccaccatcccatctaggaagtgaggagcgtctctgcccggccgcccatcgtctgagatgtggggagcgcctctgccccgccgccccgtctgggatgtgaggagcgcctctgcccggccacgaccccgtctgggaggtgaggagcgtctctgcccggctgccccatctgagaagtgaggagaccctctgccaggcagccgccccgtctgagaagtgaggagcccctccgcccggcagccaccccgtctgagaagtgaggagcgtctccgcccggcagccaccctgtccgggagggaggtggggggtcagcccccactcggccagctgccctgtccaggagggaggtgggggtcagcccccgcccggccagctgccccgtccgggagggaggtggggggtcagcccctgcccggctagccgccccatccgggaggtgaggggcgcctctgcccggccaccgctactgggaagtgaggagcccctctgcccggccaccacccggtctgggaggtgtacccaacagctcattgagaacgggccatgatgacaatggcggttttgtggaatagaaaggggggaaaggtggggaaaagattgagaaatcggatggttgccgtgtctgtgtagaaagaagtagacatgggagacttttcattttgttctgtactaagaaaaattcttctgccttgggatcctgttgatctatgaccttacccccaaccctgtgctctctgaaacatgtgctgtgtccactcagcgttaaatggattaagggcggtgcaagatgtgctttgttaaacagatgcttgaaggcaacatgctcgttaagagtcatcaccactccctaatctcaagtatccagggacacaaacactgcggaaggctgcagggtcctctgcctaggaaaaccagagacctttgttcacttgtttatctgtggaccttccctccactattgtcctatgaccctgccaaatccccctctgcgagaaacacccaagaatgatcaattaaaaaaaaaaaaaaaaaaa

SEQ ID NO: 218 - DNA, 2153 bp, synthetic construct; identical to SEQ ID NO: 217
  misc_feature 1..2153: note = Synthetic polynucleotide
  source 1..2153: mol_type = other DNA

SEQ ID NO: 219 - DNA, 2153 bp, synthetic construct; identical to SEQ ID NO: 217
  misc_feature 1..2153: note = Synthetic polynucleotide
  source 1..2153: mol_type = other DNA

SEQ ID NO: 220 - DNA, 2153 bp, synthetic construct; identical to SEQ ID NO: 217
  misc_feature 1..2153: note = Synthetic polynucleotide
  source 1..2153: mol_type = other DNA

SEQ ID NO: 221 - DNA, 1766 bp, synthetic construct
  misc_feature 1..1766: note = Synthetic polynucleotide
  source 1..1766: mol_type = other DNA
atggcaattactgtctcattagtgaacaataaaagaaaaattgttgtattagcacaacctactactgtgaagaggaaaagaattaccccatacaagtctataatgacggatctatactacctcagtcagacagatggagcaggtgattggcgggaaaaagaggccaaagatctgacagaactggttcagcggagaataacatatcttcagggtctccctctccctctctttccacggtctccctctgatgctgagccgaagctggactgtactgctgccatctcggctcactgcaacctccctgcctgattctcctgcctcagcctgccgagtgcctgcgattgcaggcgcgcgccgccacgcctgactggttttcgtatttttttggtggagacggggtttcgctgtgttggccgggctggtctccagctcctaaccgcgagtgatccgccagcctcggcctcctgaggtgcctggattgcagacggagtctcgttcactcagtgctcagtggtgcccaggctggagtgcagtggcgtgatctcggctcgctacaacctccacctcccagccgcctgccttggcctcccaaagtgccgagattgcagcctctgcctggccgccaccccgtctgggatgtgaggagcccctctgcctggctgcccagtctggaaagtgaggagcgtctctgcccagccgccatcccatctaggaagtgaggagcgcctcttcccggccaccatcccatctaggaagtgaggagcgtctctgcccggccgcccatcgtctgagatgtggggagcgcctctgccccgccgccccgtctgggatgtgaggagcgcctctgcccggccacgaccccgtctgggaggtgaggagcgtctctgcccggctgccccatctgagaagtgaggagaccctctgccaggcagccgccccgtctgagaagtgaggagcccctccgcccggcagccaccccgtctgagaagtgaggagcgtctccgcccggcagccaccctgtccgggagggaggtggggggtcagcccccactcggccagctgccctgtccaggagggaggtgggggtcagcccccgcccggccagctgccccgtccgggagggaggtggggggtcagcccctgcccggctagccgccccatccgggaggtgaggggcgcctctgcccggccaccgctactgggaagtgaggagcccctctgcccggccaccacccggtctgggaggtgtacccaacagctcattgagaacgggccatgatgacaatggcggttttgtggaatagaaaggggggaaaggtggggaaaagattgagaaatcggatggttgccgtgtctgtgtagaaagaagtagacatgggagacttttcattttgttctgtactaagaaaaattcttctgccttgggatcctgttgatctatgaccttacccccaaccctgtgctctctgaaacatgtgctgtgtccactcagcgttaaatggattaagggcggtgcaagatgtgctttgttaaacagatgcttgaaggcaacatgctcgttaagagtcatcaccactccctaatctcaagtatccagggacacaaacactgcggaaggctgcagggtcctctgcctaggaaaaccagagacctttgttcacttgtttatctgtggaccttccctccactattgtcctatgaccctgccaaatccccctctgcgagaaacacccaagaatgatcaattaaaaaaaaaaaaaaaaaaa

SEQ ID NO: 222 - DNA, 1664 bp, synthetic construct
  misc_feature 1..1664: note = Synthetic polynucleotide
  source 1..1664: mol_type = other DNA
atgacggatctatactacctcagtcagacagatggagcaggtgattggcgggaaaaagaggccaaagatctgacagaactggttcagcggagaataacatatcttcagggtctccctctccctctctttccacggtctccctctgatgctgagccgaagctggactgtactgctgccatctcggctcactgcaacctccctgcctgattctcctgcctcagcctgccgagtgcctgcgattgcaggcgcgcgccgccacgcctgactggttttcgtatttttttggtggagacggggtttcgctgtgttggccgggctggtctccagctcctaaccgcgagtgatccgccagcctcggcctcctgaggtgcctggattgcagacggagtctcgttcactcagtgctcagtggtgcccaggctggagtgcagtggcgtgatctcggctcgctacaacctccacctcccagccgcctgccttggcctcccaaagtgccgagattgcagcctctgcctggccgccaccccgtctgggatgtgaggagcccctctgcctggctgcccagtctggaaagtgaggagcgtctctgcccagccgccatcccatctaggaagtgaggagcgcctcttcccggccaccatcccatctaggaagtgaggagcgtctctgcccggccgcccatcgtctgagatgtggggagcgcctctgccccgccgccccgtctgggatgtgaggagcgcctctgcccggccacgaccccgtctgggaggtgaggagcgtctctgcccggctgccccatctgagaagtgaggagaccctctgccaggcagccgccccgtctgagaagtgaggagcccctccgcccggcagccaccccgtctgagaagtgaggagcgtctccgcccggcagccaccctgtccgggagggaggtggggggtcagcccccactcggccagctgccctgtccaggagggaggtgggggtcagcccccgcccggccagctgccccgtccgggagggaggtggggggtcagcccctgcccggctagccgccccatccgggaggtgaggggcgcctctgcccggccaccgctactgggaagtgaggagcccctctgcccggccaccacccggtctgggaggtgtacccaacagctcattgagaacgggccatgatgacaatggcggttttgtggaatagaaaggggggaaaggtggggaaaagattgagaaatcggatggttgccgtgtctgtgtagaaagaagtagacatgggagacttttcattttgttctgtactaagaaaaattcttctgccttgggatcctgttgatctatgaccttacccccaaccctgtgctctctgaaacatgtgctgtgtccactcagcgttaaatggattaagggcggtgcaagatgtgctttgttaaacagatgcttgaaggcaacatgctcgttaagagtcatcaccactccctaatctcaagtatccagggacacaaacactgcggaaggctgcagggtcctctgcctaggaaaaccagagacctttgttcacttgtttatctgtggaccttccctccactattgtcctatgaccctgccaaatccccctctgcgagaaacacccaagaatgatcaattaaaaaaaaaaaaaaaaaaa

SEQ ID NO: 223 - DNA, 91 bp, synthetic construct
  misc_feature 1..91: note = Synthetic polynucleotide
  source 1..91: mol_type = other DNA
atgaaggctccgaccgtgtggccccaggcaggtggcatccactctgcagtgtcagtaccttgctatccctgtaaaacggaggtaacgctac

SEQ ID NO: 224 - DNA, 1049 bp, synthetic construct
  misc_feature 1..1049: note = Synthetic polynucleotide
  source 1..1049: mol_type = other DNA
atggcttcatcattcctgcccgcgggggccatcaccggcgacagcggtggagagctgagctcaggggacgactccggggaggtggagttcccccatagccctgagatcgaggagaccagttgcctggccgagctgtttgagaaggctgccgcgcacctgcaaggcctgattcaggtggccagcagggagcagctcttgtacctgtatgccaggtacaaacaggtcaaagttggaaattgtaatactcctaaaccaagcttctttgattttgaaggaaagcaaaaatgggaagcttggaaagcacttggtgattcaagccccagccaagcaatgcaggaatatatcgcagtagttaaaaaactagatccaggttggaatcctcagataccagagaagaaaggaaaagaagcaaatacaggttttggtgggccagttattagttctctatatcatgaagaaaccatcagggaagaagacaaaaatatatttgattactgcagggaaaacaacattgaccatataaccaaagccatcaaatcgaaaaatgtggatgtgaatgtgaaagatgaagagggtagggctctacttcactgggcctgtgatcgaggacataaggaactagtcacagtgttgctgcaacatagagctgacattaactgtcaggacaatgaaggccaaacagctctacattatgcaacaaaatcctaggactcaacctaacaaaaggcacgtaaaaccttcatagaaaaaaatagaatttttaaaagacatttttaaaggacctaagtagaaggagaaataatctacgttaatgaataggaagactcgatttcataaagatcatttctgccaagtcaaactacaaattcagagaattttcataagaattccagcagatactttgtggaatttaacaagctttgccctaaaattcatatggaagataaaggagccaggaatatctaaggcaatttgaagaaaaacaagaaagaaggacttgttcttccaaatatcaagatgttatcttacagctataataatgaaggcag

SEQ ID NO: 225 - DNA, 499 bp, synthetic construct
  misc_feature 1..499: note = Synthetic polynucleotide
  source 1..499: mol_type = other DNA
atggtgtcttgtgaaaggagggcaagcaaaagtgtaggacaaattttgctttgggattttggttacacctgcagactatcccacagaaggaggaacagcactgaaatcctttctcgcaatcttcctgcattgtacacagaaaattgaaactgggcctcttccttatgccttatacaaaaattaactcaagatggattaaaggcttaactgtaaaactccagactataaaaactctagaagaaaatctgggcaataccattcaggacataggcattggcaaagatttcatgacaaaatcaccaaaagcaattgcaacaaaagcaaaaattgacaaatggcatctaattaaactaaagagcttctgtacagcaaaatagactatcatcagagtgaacagacaacctacaaaatgggagaaaatgtttgcaatctatccacctgacaaacgtctagtatccagagtctacaaggaacttaaatttataagaaaaaacaaaca

SEQ ID NO: 226 - DNA, 1416 bp, synthetic construct
  misc_feature 1..1416: note = Synthetic polynucleotide
  source 1..1416: mol_type = other DNA
atggacatgagggtccctgctcagctcctgggactcctgctgctctggctcccagataccagatgtgacatccagatgacccagtctccatcctccctgtctgcatctgtaggagacagagtcaccatcacttgccgggcgagtcagggcattagcaattatttagcctggtatcagcagaaaccagggaaagttcctaagctcctgatctatgctgcatccactttgcaatcaggggtcccatctcggttcagtggcagtggatctgggacagatttcactctcaccatcagcagcctgcagcctgaagatatggcactttatgagaagatggacacagtgatcagcaatgggcaagacagctattggagaagtggcaagacagcgatcagtgagagaggatgagacggtgatcagcgctacagcgatcaaagctacagtgtctgtgtgtctgtgtgactttatgctgagttgttaacattgcagagctattaacactagccaaaggctgttttaagaaccatcatctttcctgacaggtgttggagctctggggatgggcaagaggccacagagccactgcttcatgcaggccagccgctccgtgctccagttcccccataggagcccaacccatccgagctgggaagcctggagagatcttcatgcaggccccatgtcagacactgcttggccccattttggctcctgcacacctgtaagtgtcccatctatccacctgcctatatagatgatccaggaaataaggcctttggctagatagtccatttgaattcccccatagcacacctgactacatcctcattgttctttctcttagtcatttctcctctaatgccattttatttatccatcagccattttattttattttctgccccgatatatgtgtttgctttgcagttttttctttgggtccctgctaattatgtttgtgcaattgtttaaggcaggacacttggatgtaagaattctcctgttctgttgactctaagaagccagagtcacattgttttatggccccaaccaggcctttggggctcattgttggccaccccactgaggctccaggattttctgcactggtcagcccctggatactccagggtttcctggcatttggtgtggggacactcataggctgttacttgggtattctgggttttcagcatttggtattttgggccactatctggatgctccagagttttcacccttgacattcctccttggattgtgcattggaggcttgccctacaggaatcttggtttgccttttcttgttttctgccctaaagttatcgttttccattacggcattttgttttcttattgtcaccttacttacactttttcttctacactttacttaataaaaatattgcttaaatccca

SEQ ID NO: 227 - DNA, 1027 bp, synthetic construct
  misc_feature 1..1027: note = Synthetic polynucleotide
  source 1..1027: mol_type = other DNA
atggctgaagataaagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgttgagggagaagacttgcaacaagaagatggacccacaggagaaccacaacaagaggatgatgagtttcttatggcgactgatgtagatgatagatttgagaccctggaacctgaagtatctcatgaagaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagggttgattcaactgatctggctggccaggcaggtgtccccttcatccctctccactccatgtgcatccctcccaaagctgcatgctcagttgacgagcatgaccgtccccgatacaggaggaccagtcttcagtcaagggtatatgagtagcacccctgctggaacctccaaacaagatc

SEQ ID NO: 228 - DNA, 1114 bp, synthetic construct
  misc_feature 1..1114: note = Synthetic polynucleotide
  source 1..1114: mol_type = other DNA
atggcccagcgtaagaatgccaagagcagcggcaacagcagcagcagcggctccggcagcggtagcacgagtgcgggcagcagcagccccggggcccggagagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgttgagggagaagacttgcaacaagaagatggacccacaggagaaccacaacaagaggatgatgagtttcttatggcgactgatgtagatgatagatttgagaccctggaacctgaagtatctcatgaagaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagggttgattcaactgatctggctggccaggcaggtgtccccttcatccctctccactccatgtgcatccctcccaaagctgcatgctcagttgacgagcatgaccgtccccgatacaggaggaccagtcttcagtcaagggtatatgagtagcacccctgctggaacctccaaacaagatc

SEQ ID NO: 229 - DNA, 553 bp, synthetic construct
  misc_feature 1..553: note = Synthetic polynucleotide
  source 1..553: mol_type = other DNA
atggcgactgatgtagatgatagatttgagaccctggaacctgaagtatctcatgaagaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagggttgattcaactgatctggctggccaggcaggtgtccccttcatccctctccactccatgtgcatccctcccaaagctgcatgctcagttgacgagcatgaccgtccccgatacaggaggaccagtcttcagtcaagggtatatgagtagcacccctgctggaacctccaaacaagatc

SEQ ID NO: 230 - DNA, 1114 bp, synthetic construct; identical to SEQ ID NO: 228
  misc_feature 1..1114: note = Synthetic polynucleotide
  source 1..1114: mol_type = other DNA

SEQ ID NO: 231 - DNA, 1156 bp, synthetic construct
  misc_feature 1..1156: note = Synthetic polynucleotide
  source 1..1156: mol_type = other DNA
atggcccagcgtaagaatgccaagagcagcggcaacagcagcagcagcggctccggcagcggtagcacgagtgcgggcagcagcagccccggggcccggagagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctagccaaagcaaaggacttccgttataacttatcagaggtgcttcaaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgttgagggagaagacttgcaacaagaagatggacccacaggagaaccacaacaagaggatgatgagtttcttatggcgactgatgtagatgatagatttgagaccctggaacctgaagtatctcatgaagaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagggttgattcaactgatctggctggccaggcaggtgtccccttcatccctctccactccatgtgcatccctcccaaagctgcatgctcagttgacgagcatgaccgtccccgatacaggaggaccagtcttcagtcaagggtatatgagtagcacccctgctggaacctccaaacaagatc

SEQ ID NO: 232 - DNA, 985 bp, synthetic construct
  misc_feature 1..985: note = Synthetic polynucleotide
  source 1..985: mol_type = other DNA
atggcccagcgtaagaatgccaagagcagcggcaacagcagcagcagcggctccggcagcggtagcacgagtgcgggcagcagcagccccggggcccggagagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagggttgattcaactgatctggctggccaggcaggtgtccccttcatccctctccactccatgtgcatccctcccaaagctgcatgctcagttgacgagcatgaccgtccccgatacaggaggaccagtcttcagtcaagggtatatgagtagcacccctgctggaacctccaaacaagatc

SEQ ID NO: 233 - DNA, 1069 bp, synthetic construct
  misc_feature 1..1069: note = Synthetic polynucleotide
  source 1..1069: mol_type = other DNA
atggctgaagataaagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctagccaaagcaaaggacttccgttataacttatcagaggtgcttcaaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgttgagggagaagacttgcaacaagaagatggacccacaggagaaccacaacaagaggatgatgagtttcttatggcgactgatgtagatgatagatttgagaccctggaacctgaagtatctcatgaagaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagggttgattcaactgatctggctggccaggcaggtgtccccttcatccctctccactccatgtgcatccctcccaaagctgcatgctcagttgacgagcatgaccgtccccgatacaggaggaccagtcttcagtcaagggtatatgagtagcacccctgctggaacctccaaacaagatc

SEQ ID NO: 234 - DNA, 1072 bp, synthetic construct
  misc_feature 1..1072: note = Synthetic polynucleotide
  source 1..1072: mol_type = other DNA
atggctgaagataaagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctagccaaagcaaaggacttccgttataacttatcagaggtgcttcaaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgttgagggagaagacttgcaacaagaagatggacccacaggagaaccacaacaagaggatgatgagtttcttatggcgactgatgtagatgatagatttgagaccctggaacctgaagtatctcatgaagaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagggttgattcaactgatctggctggccaggcaggtgtccccttcatccctctccactccatgtgcatccctcccaaagctgcatgctcagttgacgagcatgaccgtccccgatacaggaggaccagtcttcagtcaagggtatatgagtagcacccctgctggaacctccaaacaagatc

SEQ ID NO: 235 - DNA, 1072 bp, synthetic construct; identical to SEQ ID NO: 234
  misc_feature 1..1072: note = Synthetic polynucleotide
  source 1..1072: mol_type = other DNA

SEQ ID NO: 236 - DNA, 943 bp, synthetic construct
  misc_feature 1..943: note = Synthetic polynucleotide
  source 1..943: mol_type = other DNA
atggctgaagataaagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctagccaaagcaaaggacttccgttataacttatcagaggtgcttcaaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagggttgattcaactgatctggctggccaggcaggtgtccccttcatccctctccactccatgtgcatccctcccaaagctgcatgctcagttgacgagcatgaccgtccccgatacaggaggaccagtcttcagtcaagggtatatgagtagcacccctgctggaacctccaaacaagatc

SEQ ID NO: 237 - DNA, 459 bp, synthetic construct
  misc_feature 1..459: note = Synthetic polynucleotide
  source 1..459: mol_type = other DNA
atggccaactgggtgttctgtaatcgctgcttccagccgccccacaggacgtcgtgcttcagcctcaccaactgcgggcacgtgtactgcgacgcctgcctcggcaaaggtaaaaagaatgaatgcttgatttgtaaagctccttgtcgtacagttttgctttcaaagcatgcgcagtggctcacacctgtaatcccagcactttgggaggctgaggcaggcggatcatgaggtcaggagatcgagaccatcctggctaacatggtaaaaccccgtctctactaaaaatacaaaaaattagctgggcatggtggcacacgcctgtagtcccagctacttgggaggctgaggcaggaaaatcacttgaacccaggagacagaggctgtggtgagctgagatcacaccactgcactccagcctgggcgacagagcaagactcagtctaaaaaaaaaaaaaa

SEQ ID NO: 238 - DNA, 459 bp, synthetic construct; identical to SEQ ID NO: 237
  misc_feature 1..459: note = Synthetic polynucleotide
  source 1..459: mol_type = other DNA

SEQ ID NO: 239 - DNA, 459 bp, synthetic construct; identical to SEQ ID NO: 237
  misc_feature 1..459: note = Synthetic polynucleotide
  source 1..459: mol_type = other DNA

SEQ ID NO: 240 - DNA, 459 bp, synthetic construct; identical to SEQ ID NO: 237
  misc_feature 1..459: note = Synthetic polynucleotide
  source 1..459: mol_type = other DNA

SEQ ID NO: 241 - DNA, 459 bp, synthetic construct; identical to SEQ ID NO: 237
  misc_feature 1..459: note = Synthetic polynucleotide
  source 1..459: mol_type = other DNA

SEQ ID NO: 242 - DNA, 3321 bp, synthetic construct
  misc_feature 1..3321: note = Synthetic polynucleotide
  source 1..3321: mol_type = other DNA
atgcgggtgtctcacaccttccctgtcgtagactgcacggccgcttgctgtgacctgtccagctgtgacctggcctggtggttcgagggccgctgctacctggtgagctgcccccacaaagagaactgtgagcccaagaagatgggccccatcaggtcttatctcacttttgtgctccggcctgttcagaggcctgcacagctgctggactatggggacatgatgctgaacaggggctccccctcggggatctggggggactcacctgaggatatcagaaaggacttgacctttctaggcaaagattggggcctagaggagatgtctgagtactcagatgactaccgggagctggagaaggacctcttgcaacccagtggcaagcaggagcccagagggagtgccgagtacacggactggggcctactgccgggcagcgagggggccttcaactcctctgttggagacagtcctgcggtgccagcggagacgcagcaggaccctgagctccattacctgaatgagtcggcttcaacccctgccccaaaactccctgagagaagtgtgttgcttcccttgccgactactccatcttcaggagaggtgttggagaaagaaaaggcttctcagctccaggaacaatccagcaacagctctggaaaagaggttctaatgccttcccatagtcttcctccggcaagcctggagctcagctcagtcaccgtggagaaaagcccagtgctcacagtcaccccggggagtacagagcacagcatcccaacacctcccactagcgcagccccctctgagtccaccccatctgagctacccatatctcctaccactgctcccaggacagtgaaagaacttacggtatcggctggagataacctaattataactttacccgacaatgaagttgaactgaaggcctttgttgcgccagcgccacctgtagaaacaacctacaactatgaatggaatttaataagccaccccacagactaccaaggtgaaataaaacaaggacacaagcaaactcttaacctctctcaattgtccgtcggactttatgtcttcaaagtcactgtttctagtgaaaacgcctttggagaaggatttgtcaatgtcactgttaagcctgccagaagagtcaacctgccacctgtagcagttgtttctccccaactgcaagagctcactttgcctttgacgtcagccctcattgatggcagccaaagtacagatgatactgaaatagtgagttatcattgggaagaaataaacgggcccttcatagaagagaagacttcagttgactctcccgtcttacgcttgtctaaccttgatcctggtaactatagtttcaggttgactgttacagactcggacggagccactaactctacaactgcagccctaatagtgaacaatgctgtggactacccaccagttgctaatgcaggaccaaatcacaccataactttgccccaaaactccatcactttgaatggaaaccagagcagtgacgatcaccagattgtcctctatgagtggtccctgggtcctgggagtgagggcaaacatgtggtcatgcagggagtacagacgccataccttcatttatctgcaatgcaggaaggagattatacatttcagctgaaggtgacagattcttcaaggcaacagtctactgctgtggtgactgtgattgtccagcctgaaaacaatagacctccagtggctgtggccggccctgataaagagctgatcttcccagtggaaagtgctaccctggatgggagcagcagcagcgatgaccacggcattgtcttctaccactgggagcacgtcagaggccccagtgcagtggagatggaaaatattgacaaagcaatagccactgtgactggtctccaggtggggacctaccacttccgtttgacagtgaaagaccagcagggactgagcagcacgtccaccctcactgtggctgtgaagaaggaaaataatagtcctcccagagcccgggctggtggcagacatgttcttgtgcttcccaataattccattactttggatggttcaaggtctactgatgaccaaagaattgtgtcctatctgtggatccgggatggccagagtccagcagctggagatgtcatcgatggctctgaccacagtgtggctctgcagcttacgaatctggtggagggggtgtacactttccacttgcgagtcaccgacagtcagggggcctcggacacagacactgccactgtggaagtgcagccagaccctaggaagagtggcctggtggagctgaccctgcaggttggtgttgggcagctgacagagcagcggaaggacacccttgtgaggcagctggctgtgctgctgaacgtgctggactcggacattaaggtccagaagattcgggcccactcggatctcagcaccgtgattgtgttttatgtacagagcaggccgcctttcaaggttctcaaagctgctgaagtggcccgaaatctgcacatgcggctctcaaaggagaaggctgacttcttgcttttcaaggtcttgagggttgatacagcaggttgccttctgaagtgttctggccatggtcactgcgaccccctcacaaagcgctgcatttgctctcacttatggatggagaaccttatacagcgttatatctgggatggagagagcaactgtgagtggagtatattctatgtgacagtgttggcttttactcttattgtgctaacaggaggtttcacttggctttgcatctgctgctgcaaaagacaaaaaaggactaaaatcaggaaaaaaacaaagtacaccatcctggataacatggatgaacaggaaagaatggaactgaggcccaaatatgagacaggagacagccaagagtccctggcgaaaccccacctccaagcctaaaacagcctgaaggctgaaaaactggactgctggtccccagtgaaggccctgccctttcccagctgattctccctaagtaatgtccacctgcgcactggggaaagaggatggagccacaggaagttcgtgtcatttgcagtggggaggagcctggcctcttcagtttctgtgtggtaacctgggattcaatctgtgaggcaggaggttgttggcaagaccccctctctatttgctgagagtttttgtttcctttttgaccaataaattccatttttctcacccctctatgtttccgtgagcctaatctttcctggtagtgtgacaagagcctggttttagctgaactaaggagaaagttctgcaaca

SEQ ID NO: 243 - DNA, 3429 bp, synthetic construct
  misc_feature 1..3429: note = Synthetic polynucleotide
  source 1..3429: mol_type = other DNA
atgactagactgggctggccgagcccatgttgtgcccgtaagcagtgcagcgaggggaggacatattccaatgcagtcatttcacctaacttggaaaccaccagaatcatgcgggtgtctcacaccttccctgtcgtagactgcacggccgcttgctgtgacctgtccagctgtgacctggcctggtggttcgagggccgctgctacctggtgagctgcccccacaaagagaactgtgagcccaagaagatgggccccatcaggtcttatctcacttttgtgctccggcctgttcagaggcctgcacagctgctggactatggggacatgatgctgaacaggggctccccctcggggatctggggggactcacctgaggatatcagaaaggacttgacctttctaggcaaagattggggcctagaggagatgtctgagtactcagatgactaccgggagctggagaaggacctcttgcaacccagtggcaagcaggagcccagagggagtgccgagtacacggactggggcctactgccgggcagcgagggggccttcaactcctctgttggagacagtcctgcggtgccagcggagacgcagcaggaccctgagctccattacctgaatgagtcggcttcaacccctgccccaaaactccctgagagaagtgtgttgcttcccttgccgactactccatcttcaggagaggtgttggagaaagaaaaggcttctcagctccaggaacaatccagcaacagctctggaaaagaggttctaatgccttcccatagtcttcctccggcaagcctggagctcagctcagtcaccgtggagaaaagcccagtgctcacagtcaccccggggagtacagagcacagcatcccaacacctcccactagcgcagccccctctgagtccaccccatctgagctacccatatctcctaccactgctcccaggacagtgaaagaacttacggtatcggctggagataacctaattataactttacccgacaatgaagttgaactgaaggcctttgttgcgccagcgccacctgtagaaacaacctacaactatgaatggaatttaataagccaccccacagactaccaaggtgaaataaaacaaggacacaagcaaactcttaacctctctcaattgtccgtcggactttatgtcttcaaagtcactgtttctagtgaaaacgcctttggagaaggatttgtcaatgtcactgttaagcctgccagaagagtcaacctgccacctgtagcagttgtttctccccaactgcaagagctcactttgcctttgacgtcagccctcattgatggcagccaaagtacagatgatactgaaatagtgagttatcattgggaagaaataaacgggcccttcatagaagagaagacttcagttgactctcccgtcttacgcttgtctaaccttgatcctggtaactatagtttcaggttgactgttacagactcggacggagccactaactctacaactgcagccctaatagtgaacaatgctgtggactacccaccagttgctaatgcaggaccaaatcacaccataactttgccccaaaactccatcactttgaatggaaaccagagcagtgacgatcaccagattgtcctctatgagtggtccctgggtcctgggagtgagggcaaacatgtggtcatgcagggagtacagacgccataccttcatttatctgcaatgcaggaaggagattatacatttcagctgaaggtgacagattcttcaaggcaacagtctactgctgtggtgactgtgattgtccagcctgaaaacaatagacctccagtggctgtggccggccctgataaagagctgatcttcccagtggaaagtgctaccctggatgggagcagcagcagcgatgaccacggcattgtcttctaccactgggagcacgtcagaggccccagtgcagtggagatggaaaatattgacaaagcaatagccactgtgactggtctccaggtggggacctaccacttccgtttgacagtgaaagaccagcagggactgagcagcacgtccaccctcactgtggctgtgaagaaggaaaataatagtcctcccagagcccgggctggtggcagacatgttcttgtgcttcccaataattccattactttggatggttcaaggtctactgatgaccaaagaattgtgtcctatctgtggatccgggatggccagagtccagcagctggagatgtcatcgatggctctgaccacagtgtggctctgcagcttacgaatctggtggagggggtgtacactttccacttgcgagtcaccgacagtcagggggcctcggacacagacactgccactgtggaagtgcagccagaccctaggaagagtggcctggtggagctgaccctgcaggttggtgttgggcagctgacagagcagcggaaggacacccttgtgaggcagctggctgtgctgctgaacgtgctggactcggacattaaggtccagaagattcgggcccactcggatctcagcaccgtgattgtgttttatgtacagagcaggccgcctttcaaggttctcaaagctgctgaagtggcccgaaatctgcacatgcggctctcaaaggagaaggctgacttcttgcttttcaaggtcttgagggttgatacagcaggttgccttctgaagtgttctggccatggtcactgcgaccccctcacaaagcgctgcatttgctctcacttatggatggagaaccttatacagcgttatatctgggatggagagagcaactgtgagtggagtatattctatgtgacagtgttggcttttactcttattgtgctaacaggaggtttcacttggctttgcatctgctgctgcaaaagacaaaaaaggactaaaatcaggaaaaaaacaaagtacaccatcctggataacatggatgaacaggaaagaatggaactgaggcccaaatatgagacaggagacagccaagagtccctggcgaaaccccacctccaagcctaaaacagcctgaaggctgaaaaactggactgctggtccccagtgaaggccctgccctttcccagctgattctccctaagtaatgtccacctgcgcactggggaaagaggatggagccacaggaagttcgtgtcatttgcagtggggaggagcctggcctcttcagtttctgtgtggtaacctgggattcaatctgtgaggcaggaggttgttggcaagaccccctctctatttgctgagagtttttgtttcctttttgaccaataaattccatttttctcacccctctatgtttccgtgagcctaatctttcctggtagtgtgacaagagcctggttttagctgaactaaggagaaagttctgcaaca

SEQ ID NO: 244 - DNA, 3456 bp, synthetic construct
  misc_feature 1..3456: note = Synthetic polynucleotide
  source 1..3456: mol_type = other DNA
atggcgccccccacaggtgtgctctcttcattgctgctgctggtgacaattgcaggttgtgcccgtaagcagtgcagcgaggggaggacatattccaatgcagtcatttcacctaacttggaaaccaccagaatcatgcgggtgtctcacaccttccctgtcgtagactgcacggccgcttgctgtgacctgtccagctgtgacctggcctggtggttcgagggccgctgctacctggtgagctgcccccacaaagagaactgtgagcccaagaagatgggccccatcaggtcttatctcacttttgtgctccggcctgttcagaggcctgcacagctgctggactatggggacatgatgctgaacaggggctccccctcggggatctggggggactcacctgaggatatcagaaaggacttgacctttctaggcaaagattggggcctagaggagatgtctgagtactcagatgactaccgggagctggagaaggacctcttgcaacccagtggcaagcaggagcccagagggagtgccgagtacacggactggggcctactgccgggcagcgagggggccttcaactcctctgttggagacagtcctgcggtgccagcggagacgcagcaggaccctgagctccattacctgaatgagtcggcttcaacccctgccccaaaactccctgagagaagtgtgttgcttcccttgccgactactccatcttcaggagaggtgttggagaaagaaaaggcttctcagctccaggaacaatccagcaacagctctggaaaagaggttctaatgccttcccatagtcttcctccggcaagcctggagctcagctcagtcaccgtggagaaaagcccagtgctcacagtcaccccggggagtacagagcacagcatcccaacacctcccactagcgcagccccctctgagtccaccccatctgagctacccatatctcctaccactgctcccaggacagtgaaagaacttacggtatcggctggagataacctaattataactttacccgacaatgaagttgaactgaaggcctttgttgcgccagcgccacctgtagaaacaacctacaactatgaatggaatttaataagccaccccacagactaccaaggtgaaataaaacaaggacacaagcaaactcttaacctctctcaattgtccgtcggactttatgtcttcaaagtcactgtttctagtgaaaacgcctttggagaaggatttgtcaatgtcactgttaagcctgccagaagagtcaacctgccacctgtagcagttgtttctccccaactgcaagagctcactttgcctttgacgtcagccctcattgatggcagccaaagtacagatgatactgaaatagtgagttatcattgggaagaaataaacgggcccttcatagaagagaagacttcagttgactctcccgtcttacgcttgtctaaccttgatcctggtaactatagtttcaggttgactgttacagactcggacggagccactaactctacaactgcagccctaatagtgaacaatgctgtggactacccaccagttgctaatgcaggaccaaatcacaccataactttgccccaaaactccatcactttgaatggaaaccagagcagtgacgatcaccagattgtcctctatgagtggtccctgggtcctgggagtgagggcaaacatgtggtcatgcagggagtacagacgccataccttcatttatctgcaatgcaggaaggagattatacatttcagctgaaggtgacagattcttcaaggcaacagtctactgctgtggtgactgtgattgtccagcctgaaaacaatagacctccagtggctgtggccggccctgataaagagctgatcttcccagtggaaagtgctaccctggatgggagcagcagcagcgatgaccacggcattgtcttctaccactgggagcacgtcagaggccccagtgcagtggagatggaaaatattgacaaagcaatagccactgtgactggtctccaggtggggacctaccacttccgtttgacagtgaaagaccagcagggactgagcagcacgtccaccctcactgtggctgtgaagaaggaaaataatagtcctcccagagcccgggctggtggcagacatgttcttgtgcttcccaataattccattactttggatggttcaaggtctactgatgaccaaagaattgtgtcctatctgtggatccgggatggccagagtccagcagctggagatgtcatcgatggctctgaccacagtgtggctctgcagcttacgaatctggtggagggggtgtacactttccacttgcgagtcaccgacagtcagggggcctcggacacagacactgccactgtggaagtgcagccagaccctaggaagagtggcctggtggagctgaccctgcaggttggtgttgggcagctgacagagcagcggaaggacacccttgtgaggcagctggctgtgctgctgaacgtgctggactcggacattaaggtccagaagattcgggcccactcggatctcagcaccgtgattgtgttttatgtacagagcaggccgcctttcaaggttctcaaagctgctgaagtggcccgaaatctgcacatgcggctctcaaaggagaaggctgacttcttgcttttcaaggtcttgagggttgatacagcaggttgccttctgaagtgttctggccatggtcactgcgaccccctcacaaagcgctgcatttgctctcacttatggatggagaaccttatacagcgttatatctgggatggagagagcaactgtgagtggagtatattctatgtgacagtgttggcttttactcttattgtgctaacaggaggtttcacttggctttgcatctgctgctgcaaaagacaaaaaaggactaaaatcaggaaaaaaacaaagtacaccatcctggataacatggatgaacaggaaagaatggaactgaggcccaaatatgagacaggagacagccaagagtccctggcgaaaccccacctccaagcctaaaacagcctgaaggctgaaaaactggactgctggtccccagtgaaggccctgccctttcccagctgattctccctaagtaatgtccacctgcgcactggggaaagaggatggagccacaggaagttcgtgtcatttgcagtggggaggagcctggcctcttcagtttctgtgtggtaacctgggattcaatctgtgaggcaggaggttgttggcaagaccccctctctatttgctgagagtttttgtttcctttttgaccaataaattccatttttctcacccctctatgtttccgtgagcctaatctttcctggtagtgtgacaagagcctggttttagctgaactaaggagaaagttctgcaaca

SEQ ID NO: 245 - DNA, 3456 bp, synthetic construct; identical to SEQ ID NO: 244
  misc_feature 1..3456: note = Synthetic polynucleotide
  source 1..3456: mol_type = other DNA

SEQ ID NO: 246 - DNA, 327 bp, synthetic construct
  misc_feature 1..327: note = Synthetic polynucleotide
  source 1..327: mol_type = other DNA
cagcggccagatcggcttcatgctgtgcagcaagaacccggccaggtgcggtgtctcatgcctgtaattccagcattttgggagaccaaggtgggcggatcacttgaggtcaggagtacaagaccagcctgaccaacatggagaaaccccatcactactcaaaatacaaaaaaaaaaaaaattagccgggcgtggtggcgcgtacctgaggctgaggcaggagaatcacttgaacctgggagacagaggttgcagtgagctgagatgacgccactgcactccagcgtggcaacagtgagactccgtctcaaaaaaaaaaaaaaaaaa

SEQ ID NO: 247 - DNA, 1052 bp, synthetic construct
  misc_feature 1..1052: note = Synthetic polynucleotide
  source 1..1052: mol_type = other DNA
atggagcccggccccgacggccccgccgcctccggccccgccgccatccgcgagggctggttccgcgagacctgcagcctgtggcccggccaggccctgtcactgcaggtggagcagctgctccaccaccggcgctcgcgctaccaggacatcctcgtcttccgcagtaagacctatggcaacgtgctggtgttggacggtgtcatccagtgcacggagagagacgagttctcctaccaggagatgatcgccaacctgcctctctgcagccaccccaacccgcgaaaggtgctgatcatcgggggcggagatggaggtgtcctgcgggaggtggtgaagcacccctccgtggagtccgtggtccagtgtgagatcgacgaggatgtcatccaagtctccaagaagttcctgccaggcatggccattggctactctagctcgaagctgaccctacatgtgggtgacggttttgagttcatgaaacagaatcaggatgccttcgacgtgatcatcactgactcctcagaccccatgggccccgccgaaagtctcttcaaggagtcctattaccagctcatgaagacagccctcaaggaagatggtgtcctctgctgccagggcgagtgccagtggctgcacctggacctcatcaaggagatgcggcagttctgccagtccctgttccccgtggtggcctatgcctactgcaccatccccacctaccccagcggccagatcggcttcatgctgtgcagcaagaacccggccaggtgcggtgtctcatgcctgtaattccagcattttgggagaccaaggtgggcggatcacttgaggtcaggagtacaagaccagcctgaccaacatggagaaaccccatcactactcaaaatacaaaaaaaaaaaaaattagccgggcgtggtggcgcgtacctgaggctgaggcaggagaatcacttgaacctgggagacagaggttgcagtgagctgagatgacgccactgcactccagcgtggcaacagtgagactccgtctcaaaaaaaaaaaaaaaaaa

SEQ ID NO: 248 - DNA, 3220 bp, synthetic construct
  misc_feature 1..3220: note = Synthetic polynucleotide
  source 1..3220: mol_type = other DNA
atgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacagggccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgactgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagacgacaccttcctcccagtgcctggtgagtggcttgtctggaaacagtcctgctcctcaacctcctcgacccactcagcagcagccagtctccagtgtccaagccaga

SEQ ID NO: 249 - DNA, 609 bp, synthetic construct
  misc_feature 1..609: note = Synthetic polynucleotide
  source 1..609: mol_type = other DNA
ctggcgaggcagaggcaagcgaccagcagcagaagatcatacccaggccacgtgcagccggccacagcaagggacagagcagaatgggctgatatagatccggtgccgcagaatgatggccccaatcccgtggtccagatcatttatagtgacaaatttagagatgtttatgattacttccgagctgtcctgcagcgtgatgaaagaagtgaacgagcttttaagctaacccgggatgctattgagttaaatgcagccaattatacagtgtggcatttccggagagttcttttgaagtcacttcagaaggatctacatgaggaaatgaactacatcactgcaataattgaggagcagcccaaaaactatcaagtttgaaattagccgggtgtggtggcgtgcctgtaatcccagctactcaaggagcgtgcctgtaatcccagctactcaaggagcgtgcctgtaatcccagctactcaggaggctgtcaggataatcacttgaacctgggaggtggaggtttcggtgagctgagattgcaccactgcactccagcctgggggaccgagtgagactctgtctcaaaaaaaataaaaaataaaaaataaa

SEQ ID NO: 250 - DNA, 738 bp, synthetic construct
  misc_feature 1..738: note = Synthetic polynucleotide
  source 1..738: mol_type = other DNA
atggcggccaccgagggggtcggggaggctgcgcaagggggcgagcccgggcagccggcgcaacccccgccccagccgcacccaccgccgccccagcagcagcacaaggaagagatggcggccgaggctggggaagccgtggcgtcccccatggacgacgggtttgtgagcctggactcgccctcctatgtcctgtacagggacagagcagaatgggctgatatagatccggtgccgcagaatgatggccccaatcccgtggtccagatcatttatagtgacaaatttagagatgtttatgattacttccgagctgtcctgcagcgtgatgaaagaagtgaacgagcttttaagctaacccgggatgctattgagttaaatgcagccaattatacagtgtggcatttccggagagttcttttgaagtcacttcagaaggatctacatgaggaaatgaactacatcactgcaataattgaggagcagcccaaaaactatcaagtttgaaattagccgggtgtggtggcgtgcctgtaatcccagctactcaaggagcgtgcctgtaatcccagctactcaaggagcgtgcctgtaatcccagctactcaggaggctgtcaggataatcacttgaacctgggaggtggaggtttcggtgagctgagattgcaccactgcactccagcctgggggaccgagtgagactctgtctcaaaaaaaataaaaaataaaaaataaa

SEQ ID NO: 251 - DNA, 537 bp, synthetic construct
  misc_feature 1..537: note = Synthetic polynucleotide
  source 1..537: mol_type = other DNA
atggcggccaccgagggggtcggggaggctgcgcaagggggcgagcccgggcagccggcgcaacccccgccccagccgcacccaccgccgccccagcagcagcacaaggaagagatggcggccgaggctggggaagccgtggcgtcccccatggacgacgggtttgtgagcctggactcgccctcctatgtcctgtacaggcatttccggagagttcttttgaagtcacttcagaaggatctacatgaggaaatgaactacatcactgcaataattgaggagcagcccaaaaactatcaagtttgaaattagccgggtgtggtggcgtgcctgtaatcccagctactcaaggagcgtgcctgtaatcccagctactcaaggagcgtgcctgtaatcccagctactcaggaggctgtcaggataatcacttgaacctgggaggtggaggtttcggtgagctgagattgcaccactgcactccagcctgggggaccgagtgagactctgtctcaaaaaaaataaaaaataaaaaataaa

SEQ ID NO: 252 - DNA, 537 bp, synthetic construct; identical to SEQ ID NO: 251
  misc_feature 1..537: note = Synthetic polynucleotide
  source 1..537: mol_type = other DNA

SEQ ID NO: 253 - DNA, 684 bp, synthetic construct
  misc_feature 1..684: note = Synthetic polynucleotide
  source 1..684: mol_type = other DNA
ggggtcggggaggctgcgcaagggggcgagcccgggcagccggcgcaacccccgccccagccgcacccaccgccgccccagcagcagcacaaggaagagatggcggccgaggctggggaagccgtggcgtcccccatggacgacggggacagagcagaatgggctgatatagatccggtgccgcagaatgatggccccaatcccgtggtccagatcatttatagtgacaaatttagagatgtttatgattacttccgagctgtcctgcagcgtgatgaaagaagtgaacgagcttttaagctaacccgggatgctattgagttaaatgcagccaattatacagtgtggcatttccggagagttcttttgaagtcacttcagaaggatctacatgaggaaatgaactacatcactgcaataattgaggagcagcccaaaaactatcaagtttgaaattagccgggtgtggtggcgtgcctgtaatcccagctactcaaggagcgtgcctgtaatcccagctactcaaggagcgtgcctgtaatcccagctactcaggaggctgtcaggataatcacttgaacctgggaggtggaggtttcggtgagctgagattgcaccactgcactccagcctgggggaccgagtgagactctgtctcaaaaaaaataaaaaataaaaaataaa

SEQ ID NO: 254 - DNA, 552 bp, synthetic construct
  misc_feature 1..552: note = Synthetic polynucleotide
  source 1..552: mol_type = other DNA
atgtctgttttcagggacagagcagaatgggctgatatagatccggtgccgcagaatgatggccccaatcccgtggtccagatcatttatagtgacaaatttagagatgtttatgattacttccgagctgtcctgcagcgtgatgaaagaagtgaacgagcttttaagctaacccgggatgctattgagttaaatgcagccaattatacagtgtggcatttccggagagttcttttgaagtcacttcagaaggatctacatgaggaaatgaactacatcactgcaataattgaggagcagcccaaaaactatcaagtttgaaattagccgggtgtggtggcgtgcctgtaatcccagctactcaaggagcgtgcctgtaatcccagctactcaaggagcgtgcctgtaatcccagctactcaggaggctgtcaggataatcacttgaacctgggaggtggaggtttcggtgagctgagattgcaccactgcactccagcctgggggaccgagtgagactctgtctcaaaaaaaataaaaaataaaaaataaa

SEQ ID NO: 255 - DNA, 285 bp, synthetic construct
  misc_feature 1..285: note = Synthetic polynucleotide
  source 1..285: mol_type = other DNA
atgaactacatcactgcaataattgaggagcagcccaaaaactatcaagtttgaaattagccgggtgtggtggcgtgcctgtaatcccagctactcaaggagcgtgcctgtaatcccagctactcaaggagcgtgcctgtaatcccagctactcaggaggctgtcaggataatcacttgaacctgggaggtggaggtttcggtgagctgagattgcaccactgcactccagcctgggggaccgagtgagactctgtctcaaaaaaaataaaaaataaaaaataaa

SEQ ID NO: 256 - DNA, 285 bp, synthetic construct; identical to SEQ ID NO: 255
  misc_feature 1..285: note = Synthetic polynucleotide
  source 1..285: mol_type = other DNA

SEQ ID NO: 257 - DNA, 82 bp, synthetic construct
  misc_feature 1..82: note = Synthetic polynucleotide
  source 1..82: mol_type = other DNA
atggagggttgaaccatatgaaattgccagtattcaactgcttggacttagcaaaatgtcagtttcatatggttaaccctaa

SEQ ID NO: 258 - DNA, 102 bp, synthetic construct
  misc_feature 1..102: note = Synthetic polynucleotide
  source 1..102: mol_type = other DNA
atgggtggattattttctcgatggagggttgaaccatatgaaattgccagtattcaactgcttggacttagcaaaatgtcagtttcatatggttaaccctaa

SEQ ID NO: 259 - DNA, 102 bp, synthetic construct; identical to SEQ ID NO: 258
  misc_feature 1..102: note = Synthetic polynucleotide
  source 1..102: mol_type = other DNA

SEQ ID NO: 260 - DNA, 102 bp, synthetic construct; identical to SEQ ID NO: 258
  misc_feature 1..102: note = Synthetic polynucleotide
  source 1..102: mol_type = other DNA

SEQ ID NO: 261 - DNA, 763 bp, synthetic construct
  misc_feature 1..763: note = Synthetic polynucleotide
  source 1..763: mol_type = other DNA
atgccttttgctcccgttgcccaggctagagtgcaatggcacgatttccgttcactgcaacatctgcttcccgcgttcaagcgattctcctgcctcagccttgggagtagttgggattacagtgttaaaagatcactgaagttggatggtctgttagaagaaaattcatttgatccttcaaaaatcacaaggaagaaaagtgttataacttattctccaacaactggaacttgtcaaatgagtctatttgcttctcccacaagttctgaagagcaaaagcacagaaatggactatcaaatgggctatgctggaaaccttgactaacaccatgaaacccacataaagtgccactagtgatgctggaagtgctcccaatgagcagagaaaaatcatgacattacaagaaaaagatgaattacttgatatgtactgtagattaaggtctgcagctgtagttcctcaccatttctgacagttcatcttgtaaacagatgacaagcttatggtattaatactttacaatactgtaaatattttatcttccttatgattttcttaataacttttttctctagctttattgtaagaatacacaatataatacatataacacacgaaatatgtattaattgactttgtggcatctggtcaacagtaggctattggtagttaagtttttggggagtcaagagttatacttggatttttgactacatgggggatttggcactcctaaccctcgagttcctcaagggtcagttg

SEQ ID NO: 262 - DNA, 646 bp, synthetic construct
  misc_feature 1..646: note = Synthetic polynucleotide
  source 1..646: mol_type = other DNA
atgcctgttaaaagatcactgaagttggatggtctgttagaagaaaattcatttgatccttcaaaaatcacaaggaagaaaagtgttataacttattctccaacaactggaacttgtcaaatgagtctatttgcttctcccacaagttctgaagagcaaaagcacagaaatggactatcaaatgggctatgctggaaaccttgactaacaccatgaaacccacataaagtgccactagtgatgctggaagtgctcccaatgagcagagaaaaatcatgacattacaagaaaaagatgaattacttgatatgtactgtagattaaggtctgcagctgtagttcctcaccatttctgacagttcatcttgtaaacagatgacaagcttatggtattaatactttacaatactgtaaatattttatcttccttatgattttcttaataacttttttctctagctttattgtaagaatacacaatataatacatataacacacgaaatatgtattaattgactttgtggcatctggtcaacagtaggctattggtagttaagtttttggggagtcaagagttatacttggatttttgactacatgggggatttggcactcctaaccctcgagttcctcaagggtcagttg

SEQ ID NO: 263 - DNA, 646 bp, synthetic construct; identical to SEQ ID NO: 262
  misc_feature 1..646: note = Synthetic polynucleotide
  source 1..646: mol_type = other DNA

SEQ ID NO: 264 - DNA, 646 bp, synthetic construct; identical to SEQ ID NO: 262
  misc_feature 1..646: note = Synthetic polynucleotide
  source 1..646: mol_type = other DNA

SEQ ID NO: 265 - DNA, 258 bp, synthetic construct
  misc_feature 1..258: note = Synthetic polynucleotide
  source 1..258: mol_type = other DNA
atggacgtgttcctcatgatccggcgccacaagaccaccatcttcacggacgccaaggagtccagcacggtgttcgaactgaagcgcatcgtcgagggcatcctcaagcggcctcctgacgagcagcggctgtacaaggatgaccaactcttggatgatggcaagacactgggcgagtgtggcttcaccagtcaaacagcacggccacaggccccagccacagtggggctggccttccgggcagaggtttgctgtgac

SEQ ID NO: 266 - DNA, 258 bp, synthetic construct; identical to SEQ ID NO: 265
  misc_feature 1..258: note = Synthetic polynucleotide
  source 1..258: mol_type = other DNA

SEQ ID NO: 267 - DNA, 243 bp, synthetic construct
  misc_feature 1..243: note = Synthetic polynucleotide
  source 1..243: mol_type = other DNA
atgatccggcgccacaagaccaccatcttcacggacgccaaggagtccagcacggtgttcgaactgaagcgcatcgtcgagggcatcctcaagcggcctcctgacgagcagcggctgtacaaggatgaccaactcttggatgatggcaagacactgggcgagtgtggcttcaccagtcaaacagcacggccacaggccccagccacagtggggctggccttccgggcagaggtttgctgtgac

SEQ ID NO: 268 - DNA, 324 bp, synthetic construct
  misc_feature 1..324: note = Synthetic polynucleotide
  source 1..324: mol_type = other DNA
gacgtgttcctcatgatccggcgccacaagaccaccatcttcacggacgccaaggagtccagcacggtgttcgaactgaagcgcatcgtcgagggcatcctcaagcggcctcctgacgagcagcggctgtacaagttgctggtcagaagtctttgggacttgccccatgtagggcctctcccaagatcctgcttctctcctcaggatgaccaactcttggatgatggcaagacactgggcgagtgtggcttcaccagtcaaacagcacggccacaggccccagccacagtggggctggccttccgggcagaggtttgctgtgac

SEQ ID NO: 269 - DNA, 728 bp, synthetic construct
  misc_feature 1..728: note = Synthetic polynucleotide
  source 1..728: mol_type = other DNA
atgatgctacactcagctttgggtctctgcctcttactcgtcacagtttcttccaaccttgccattgcaataaaaaaggaaaagaggcctcctcagacactctcaagaggatggggagatgacatcacttgggtacaaacttatgaagaaggtctcttttatgctcaaaaaagtaagaagccattaatggttattcatcacctggaggattgtcaatactctcaagcactaaagaaagtatttgcccaaaatgaagaaatacaagaaatggctcagaataagttcatcatgctaaaccttatgcatgaaaccactgataagaatttatcacctgatgggcaatatgtgcctagaatcatgtttgtagacccttctttaacagttagagctgacatagctggaagatactctaacagattgtacacatatgagcctcgggatttacccctataaatttggatacagagacatgcatacagaaggaatgccatgtgagcaggaagcagagtgtgatcgtgcagcagaagccaaggaatgctcaaggttgtcagcaaacacactggatgacaggcacggaaaagattctccttcacagccctcggaaggaaccaaccctgccaacaccttgatctcagatctctaccctccagatctgtgagacaataaattgactgtttaagccactcaatgtgtggtgctttttatgacagctctagcaaaccaataca

SEQ ID NO: 270 - DNA, 728 bp, synthetic construct; identical to SEQ ID NO: 269
  misc_feature 1..728: note = Synthetic polynucleotide
  source 1..728: mol_type = other DNA

SEQ ID NO: 271 - DNA, 663 bp, synthetic construct
  misc_feature 1..663: note = Synthetic polynucleotide
  source 1..663: mol_type = other DNA
aaacatccagaatacatttccaacaagagcactggccaagtcaggatggggagatgacatcacttgggtacaaacttatgaagaaggtctcttttatgctcaaaaaagtaagaagccattaatggttattcatcacctggaggattgtcaatactctcaagcactaaagaaagtatttgcccaaaatgaagaaatacaagaaatggctcagaataagttcatcatgctaaaccttatgcatgaaaccactgataagaatttatcacctgatgggcaatatgtgcctagaatcatgtttgtagacccttctttaacagttagagctgacatagctggaagatactctaacagattgtacacatatgagcctcgggatttacccctataaatttggatacagagacatgcatacagaaggaatgccatgtgagcaggaagcagagtgtgatcgtgcagcagaagccaaggaatgctcaaggttgtcagcaaacacactggatgacaggcacggaaaagattctccttcacagccctcggaaggaaccaaccctgccaacaccttgatctcagatctctaccctccagatctgtgagacaataaattgactgtttaagccactcaatgtgtggtgctttttatgacagctctagcaaaccaataca

SEQ ID NO: 272 - DNA, 1682 bp, synthetic construct
  misc_feature 1..1682: note = Synthetic polynucleotide
  source 1..1682: mol_type = other DNA
atggccgagagcatcataattcgtgtccagtccccggatggagtgaagcggatcacagcaacaaagagagaaacagcagcaacatttttgaaaaaggttgcaaaggagtttggcttccaaaataatggcttctcggtttacatcaatagaaacaagaccggagagataacagcctcctccaacaaatccctcaacttgctaaaaatcaagcatggcgatttgttgttcctgtttccctcgagccttgctgggccctcatctgaaatggagacgtcagttccaccgggcttcaaagtctttggcgctcccaacgtggtggaggatgagattgatcagtacctcagcaaacaggacgggaagatttacagaagccgagacccacagctatgccgccacggccctttggggaaatgcgtgcactgcgtccctctagagccattcgatgaggactatctaaaccatctcgagcctcccgtgaagcacatgtccttccacgcctacatccggaagctgactggaggggctgacaaggggaagtttgttgccctggagaacatcagctgcaagattaagtcagggtgcgaggggcacctcccgtggccgaatggcatctgtactaagtgccagccgagcgccatcacgctgaacagacagaagtacaggcatgtggacaatatcatgtttgagaatcacaccgtcgctgaccgctttcttgacttctggagaaagacagggaaccagcattttgggtacttatacggacggtacacggagcacaaagacattccccttggcatcagggctgaagtggctgcgatttatgagccacctcagattggtacacagaacagcttggagcttcttgaggatccaaaagctgaagtggtcgatgaaattgctgccaaacttggcctgcggaaggttggctggatatttacagacctcgtctcagaagatacccgaaagggtaccgtccgctacagtcgaaataaggacacctatttcctaagttcagaagagtgcatcactgcaggagacttccagaacaagcatcccaacatgtgccggctctctccagacggacattttggatccaagtttgttactgcagtggctacaggtggtcctgacaaccaagtccactttgaagggtaccaggtgtccaatcagtgtatggcactggtccgtgatgagtgtttgctgccatgcaaggacgccccggagcttggctacgccaaggagtctagcagtgagcagtacgtgcctgatgtgttttataaggacgtagacaagtttggcaacgagatcacccagctggcccggcccctgcctgtggagtatctcatcatagacatcacaacaactttccccaaggatccagtttacactttttctatttcgcaaaatccatttcctattgaaaaccgggatgtattgggtgagacacaggacttccatagcttggccacctatttgtctcagaatacctcatctgtgttcttggataccatctcagatttccacctcttgctgttcctggtcaccaatgaagttatgcctctgcaggacagcatcagcttgctgctggaggccgtgcggaccagaaatgaggagctcgcccagacatggaagaggtctgagcagtgggccaccatcgagcagctgtgcaatctcggcttact

SEQ ID NO: 273 - DNA, 1199 bp, synthetic construct
  misc_feature 1..1199: note = Synthetic polynucleotide
  source 1..1199: mol_type = other DNA
atgtccttccacgcctacatccggaagctgactggaggggctgacaaggggaagtttgttgccctggagaacatcagctgcaagattaagtcagggtgcgaggggcacctcccgtggccgaatggcatctgtactaagtgccagccgagcgccatcacgctgaacagacagaagtacaggcatgtggacaatatcatgtttgagaatcacaccgtcgctgaccgctttcttgacttctggagaaagacagggaaccagcattttgggtacttatacggacggtacacggagcacaaagacattccccttggcatcagggctgaagtggctgcgatttatgagccacctcagattggtacacagaacagcttggagcttcttgaggatccaaaagctgaagtggtcgatgaaattgctgccaaacttggcctgcggaaggttggctggatatttacagacctcgtctcagaagatacccgaaagggtaccgtccgctacagtcgaaataaggacacctatttcctaagttcagaagagtgcatcactgcaggagacttccagaacaagcatcccaacatgtgccggctctctccagacggacattttggatccaagtttgttactgcagtggctacaggtggtcctgacaaccaagtccactttgaagggtaccaggtgtccaatcagtgtatggcactggtccgtgatgagtgtttgctgccatgcaaggacgccccggagcttggctacgccaaggagtctagcagtgagcagtacgtgcctgatgtgttttataaggacgtagacaagtttggcaacgagatcacccagctggcccggcccctgcctgtggagtatctcatcatagacatcacaacaactttccccaaggatccagtttacactttttctatttcgcaaaatccatttcctattgaaaaccgggatgtattgggtgagacacaggacttccatagcttggccacctatttgtctcagaatacctcatctgtgttcttggataccatctcagatttccacctcttgctgttcctggtcaccaatgaagttatgcctctgcaggacagcatcagcttgctgctggaggccgtgcggaccagaaatgaggagctcgcccagacatggaagaggtctgagcagtgggccaccatcgagcagctgtgcaatctcggcttact

SEQ ID NO: 274 - DNA, 76 bp, synthetic construct
  misc_feature 1..76: note = Synthetic polynucleotide
  source 1..76: mol_type = other DNA
atgaggagctcgcccagacatggaagaggtctgagcagtgggccaccatcgagcagctgtgcaatctcggcttact

SEQ ID NO: 275 - DNA, 76 bp, synthetic construct; identical to SEQ ID NO: 274
  misc_feature 1..76: note = Synthetic polynucleotide
  source 1..76: mol_type = other DNA

SEQ ID NO: 276 - DNA, 1682 bp, synthetic construct; identical to SEQ ID NO: 272
  misc_feature 1..1682: note = Synthetic polynucleotide
  source 1..1682: mol_type = other DNA

SEQ ID NO: 277 - DNA, 282 bp, synthetic construct
  misc_feature 1..282: note = Synthetic polynucleotide
  source 1..282: mol_type = other DNA
gcaaaatccatttcctattgaaaaccgggatgtattgggtgagacacaggacttccatagcttggccacctatttgtctcagaatacctcatctgtgttcttggataccatctcagatttccacctcttgctgttcctggtcaccaatgaagttatgcctctgcaggacagcatcagcttgctgctggaggccgtgcggaccagaaatgaggagctcgcccagacatggaagaggtctgagcagtgggccaccatcgagcagctgtgcaatctcggcttact

SEQ ID NO: 278 - DNA, 386 bp, synthetic construct
  misc_feature 1..386: note = Synthetic polynucleotide
  source 1..386: mol_type = other DNA
ggcaacgagatcacccagctggcccggcccctgcctgtggagtatctcatcatagacatcacaacaactttccccaaggatccagtttacactttttctatttcgcaaaatccatttcctattgaaaaccgggatgtattgggtgagacacaggacttccatagcttggccacctatttgtctcagaatacctcatctgtgttcttggataccatctcagatttccacctcttgctgttcctggtcaccaatgaagttatgcctctgcaggacagcatcagcttgctgctggaggccgtgcggaccagaaatgaggagctcgcccagacatggaagaggtctgagcagtgggccaccatcgagcagctgtgcaatctcggcttact

SEQ ID NO: 279 - DNA, 423 bp, synthetic construct
  misc_feature 1..423: note = Synthetic polynucleotide
  source 1..423: mol_type = other DNA
tttacactttttctatttcgcaaaatccatttcctattgaaaaccgggatgtattgggtgagacacagacagagtctcactctatcacccaggctggagtgcagtggtgcgatcttggctcactacaacctccacctcctgggttcaagcgattcttctgcttcagcctcctgagtagctgggattataggacttccatagcttggccacctatttgtctcagaatacctcatctgtgttcttggataccatctcagatttccacctcttgctgttcctggtcaccaatgaagttatgcctctgcaggacagcatcagcttgctgctggaggccgtgcggaccagaaatgaggagctcgcccagacatggaagaggtctgagcagtgggccaccatcgagcagctgtgcaatctcggcttact

SEQ ID NO: 280 - DNA, 320 bp, synthetic construct
  misc_feature 1..320: note = Synthetic polynucleotide
  source 1..320: mol_type = other DNA
actttccccaaggatccagtttacactttttctatttcgcaaaatccatttcctattgaaaaccgggatgtattgggtgagacacaggacttccatagcttggccacctatttgtctcagaatacctcatctgtgttcttggataccatctcagatttccacctcttgctgttcctggtcaccaatgaagttatgcctctgcaggacagcatcagcttgctgctggaggccgtgcggaccagaaatgaggagctcgcccagacatggaagaggtctgagcagtgggccaccatcgagcagctgtgcaatctcggcttact

SEQ ID NO: 281 - DNA, 1209 bp, synthetic construct
  misc_feature 1..1209: note = Synthetic polynucleotide
  source 1..1209: mol_type = other DNA
atgatccccaccttcacggctctgctctgcctcgggctgagtctgggccccaggacccacatgcaggcagggcccctccccaaacccaccctctgggctgagccaggctctgtgatcagctgggggaactctgtgaccatctggtgtcaggggaccctggaggctcgggagtaccgtctggataaagaggaaagcccagcaccctgggacagacagaacccactggagcccaagaacaaggccagattctccatcccatccatgacagaggactatgcagggagataccgctgttactatcgcagccctgtaggctggtcacagcccagtgaccccctggagctggtgatgacaggagcctacagtaaacccaccctttcagccctgccgagtcctcttgtgacctcaggaaagagcgtgaccctgctgtgtcagtcacggagcccaatggacactttccttctgatcaaggagcgggcagcccatcccctactgcatctgagatcagagcacggagctcagcagcaccaggctgaattccccatgagtcctgtgacctcagtgcacggggggacctacaggtgcttcagctcacacggcttctcccactacctgctgtcacaccccagtgaccccctggagctcatagtctcaggatccttggaggatcccaggccctcacccacaaggtccgtctcaacagctgcaggccctgaggaccagcccctcatgcctacagggtcagtcccccacagtggtctgagaaggcactgggaggtactgatcggggtcttggtggtctccatcctgcttctctccctcctcctcttcctcctcctccaacactggcgtcagggaaaacacaggacattggcccagagacaggctgatttccaacgtcctccaggggctgccgagccagagcccaaggacgggggcctacagaggaggtccagcccagctgctgacgtccagggagaaaacttctcaggtgctgccgtgaagaacacacagcctgaggacggggtggaaatggacactcggcatcgtcacggtggacccctccttgtccagcacgctgcctcctgcctgctgggacctcactctctcctgctgtcctgggacctcatgggcctcctcccgggtccccttcctgctcctcatcctctgtttggccatctggttgttagagagctccccaggcctcag

SEQ ID NO: 282 - DNA, 1206 bp, synthetic construct
  misc_feature 1..1206: note = Synthetic polynucleotide
  source 1..1206: mol_type = other DNA
atgatccccaccttcacggctctgctctgcctcgggctgagtctgggccccaggacccacatgcaggcagggcccctccccaaacccaccctctgggctgagccaggctctgtgatcagctgggggaactctgtgaccatctggtgtcaggggaccctggaggctcgggagtaccgtctggataaagaggaaagcccagcaccctgggacagacagaacccactggagcccaagaacaaggccagattctccatcccatccatgacagaggactatgcagggagataccgctgttactatcgcagccctgtaggctggtcacagcccagtgaccccctggagctggtgatgacaggagcctacagtaaacccaccctttcagccctgccgagtcctcttgtgacctcaggaaagagcgtgaccctgctgtgtcagtcacggagcccaatggacactttccttctgatcaaggagcgggcagcccatcccctactgcatctgagatcagagcacggagctcagcagcaccaggctgaattccccatgagtcctgtgacctcagtgcacggggggacctacaggtgcttcagctcacacggcttctcccactacctgctgtcacaccccagtgaccccctggagctcatagtctcaggatccttggaggatcccaggccctcacccacaaggtccgtctcaacagctgcaggccctgaggaccagcccctcatgcctacagggtcagtcccccacagtggtctgagaaggcactgggaggtactgatcggggtcttggtggtctccatcctgcttctctccctcctcctcttcctcctcctccaacactggcgtcagggaaaacacaggacattggcccagagacaggctgatttccaacgtcctccaggggctgccgagccagagcccaaggacgggggcctacagaggaggtccagcccagctgctgacgtccagggagaaaacttctgtgctgccgtgaagaacacacagcctgaggacggggtggaaatggacactcggcatcgtcacggtggacccctccttgtccagcacgctgcctcctgcctgctgggacctcactctctcctgctgtcctgggacctcatgggcctcctcccgggtccccttcctgctcctcatcctctgtttggccatctggttgttagagagctccccaggcctcag

SEQ ID NO: 283 - DNA, 1206 bp, synthetic construct; identical to SEQ ID NO: 282
  misc_feature 1..1206: note = Synthetic polynucleotide
  source 1..1206: mol_type = other DNA

SEQ ID NO: 284 - DNA, 1206 bp, synthetic construct; identical to SEQ ID NO: 282
  misc_feature 1..1206: note = Synthetic polynucleotide
  source 1..1206: mol_type = other DNA

SEQ ID NO: 285 - DNA, 1206 bp, synthetic construct; identical to SEQ ID NO: 282
  misc_feature 1..1206: note = Synthetic polynucleotide
  source 1..1206: mol_type = other DNA

SEQ ID NO: 286 - DNA, 1203 bp, synthetic construct
  misc_feature 1..1203: note = Synthetic polynucleotide
  source 1..1203: mol_type = other DNA
atgatccccaccttcacggctctgctctgcctcgggctgagtctgggccccaggacccacatgcaggcagggcccctccccaaacccaccctctgggctgagccaggctctgtgatcagctgggggaactctgtgaccatctggtgtcaggggaccctggaggctcgggagtaccgtctggataaagaggaaagcccagcaccctgggacagacagaacccactggagcccaagaacaaggccagattctccatcccatccatgacagaggactatgcagggagataccgctgttactatcgcagccctgtaggctggtcacagcccagtgaccccctggagctggtgatgacaggagcctacagtaaacccaccctttcagccctgccgagtcctcttgtgacctcaggaaagagcgtgaccctgctgtgtcagtcacggagcccaatggacactttccttctgatcaaggagcgggcagcccatcccctactgcatctgagatcagagcacggagctcagcagcaccaggctgaattccccatgagtcctgtgacctcagtgcacggggggacctacaggtgcttcagctcacacggcttctcccactacctgctgtcacaccccagtgaccccctggagctcatagtctcaggatccttggaggatcccaggccctcacccacaaggtccgtctcaacagctggccctgaggaccagcccctcatgcctacagggtcagtcccccacagtggtctgagaaggcactgggaggtactgatcggggtcttggtggtctccatcctgcttctctccctcctcctcttcctcctcctccaacactggcgtcagggaaaacacaggacattggcccagagacaggctgatttccaacgtcctccaggggctgccgagccagagcccaaggacgggggcctacagaggaggtccagcccagctgctgacgtccagggagaaaacttctgtgctgccgtgaagaacacacagcctgaggacggggtggaaatggacactcggcatcgtcacggtggacccctccttgtccagcacgctgcctcctgcctgctgggacctcactctctcctgctgtcctgggacctcatgggcctcctcccgggtccccttcctgctcctcatcctctgtttggccatctggttgttagagagctccccaggcctcag

SEQ ID NO: 287 - DNA, 529 bp, synthetic construct
  misc_feature 1..529: note = Synthetic polynucleotide
  source 1..529: mol_type = other DNA
gacaccacagagcagctgccggacctctgcgtgaacctgcttctggctctcaacctgcacctgccagctgctgaccagaatgtcatcatggctgccctgagcaaacacgccaatgtcaagatcttctccgagaagctgttgttgctcctgaacagaggggatgaccctgtgcgcatcttcaaacatgagccacagccaccacactctgtcctcaagttcctgcaggacgtgtttggcagcccggccacagctgccatcttctaccacacagacatgatggctctcattgacatcactgtgcggcacatcgcagacctgtcaccaggagacaagatgcggatctccccttggtcattcaaggcactgctcaggcatcttatgcaagaaggcgtcccaggttgcgaaggtgactcagacgcctcctttgggactccaacacccttccccggcagagcccctgcctgtctgcctccgtggtgtcaggttttgtgccctctactcactagattgtggacacagaaagcgctgg

SEQ ID NO: 288 - DNA, 2161 bp, synthetic construct
  misc_feature 1..2161: note = Synthetic polynucleotide
  source 1..2161: mol_type = other DNA
atgtaccgcgcgctgtacgcgttccgctcggcggagcccaacgcgctggcgttcgccgcgggcgagaccttcctggtgctagagcgaagcagcgcgcactggtggctggccgcgcgggcgcgcagtggtgagacgggctacgtgccgccagcctacctgcgccgcctgcagggcctggagcaggatgtcctccaggccattgaccgggccatcgaggctgtacacaacacagccatgcgggatggtggcaagtacagcctggaacagcgtggagtcctccagaagctgatccaccaccggaaagagaccctgtcacgcagaggcccttcagcctccagtgttgcagttatgacctcatcaaccagtgaccaccacttggatgctgctgcagccaggcagcccaatggggtgtgtcgagctgggttcgagcggcagcacagcctacccagttctgagcatcttggggcagatggaggcctctaccagatcccacttccatcttcccagatcccaccacagcctcgccgagcagcacccaccacaccgcccccaccagtgaagcgccgagaccgcgaggccctgatggcctctgggagtggtggccacaacaccatgccctccgggggtaactctgtgtccagcggctcctcagtcagcagcacctccctggacacgctctataccagctccagcccatctgaaccaggctccagctgctcacccacacccccacctgtgccccgccgaggcacccacaccaccgtgtcccaagtccagccccctccctccaaggcatcagcacctgaaccccctgcagaagaagaagtggcaactggtacaacctcagcctctgatgacctggaagccctgggtacactgagcctggggaccacagaggagaaggcagcagctgaggcggctgtgcccaggaccattggggccgagctgatggagctggtgcggagaaacactggcctgagccacgaattatgccgggtggccatcggcatcatagtgggtcacatccaggcctcggtgccggccagctcaccagtcatggagcaggtcctcctctcactcgtagagggcaaggacctcagcatggccctgccctcagggcaggtctgccacgaccagcagaggctggaggtgatctttgcagacctggctcgccggaaggacgacgcccagcagcgcagttgggcactatatgaggatgagggtgtcatccgctgctacctagaggagctgctgcatattctgactgatgcagaccctgaagtttgcaagaaaatgtgcaagagaaacgagttcgagtctgtcctggccttggtggcctattaccaaatggaacaccgagcatcactgcggctgctgctcctcaagtgctttggcgccatgtgcagcctggatgcagccatcatctccacgcttgtgtcatccgtgctgcctgtagagctggcgagggacatgcagacagacacgcaggaccaccagaaactctgttactctgccctcatcctggccatggtcttctccatgggagaggcagtgccctatgcacactatgagcacctgggcacgcctttcgcccagttcctactgaacatcgtcgaggatgggctgcccttggacaccacagagcagctgccggacctctgcgtgaacctgcttctggctctcaacctgcacctgccagctgctgaccagaatgtcatcatggctgccctgagcaaacacgccaatgtcaagatcttctccgagaagctgttgttgctcctgaacagaggggatgaccctgtgcgcatcttcaaacatgagccacagccaccacactctgtcctcaagttcctgcaggacgtgtttggcagcccggccacagctgccatcttctaccacacagacatgatggctctcattgacatcactgtgcggcacatcgcagacctgtcaccaggagacaagatgcggatctccccttggtcattcaaggcactgctcaggcatcttatgcaagaaggcgtcccaggttgcgaaggtgactcagacgcctcctttgggactccaacacccttccccggcagagcccctgcctgtctgcctccgtggtgtcaggttttgtgccctctactcactagattgtggacacagaaagcgctgg

SEQ ID NO: 289 - DNA, 2140 bp, synthetic construct
  misc_feature 1..2140: note = Synthetic polynucleotide
  source 1..2140: mol_type = other DNA
atgtaccgcgcgctgtacgcgttccgctcggcggagcccaacgcgctggcgttcgccgcgggcgagaccttcctggtgctagagcgaagcagcgcgcactggtggctggccgcgcgggcgcgcagtggtgagacgggctacgtgccgccagcctacctgcgccgcctgcagggcctggagcaggatgtcctccaggccattgaccgggccatcgaggctgtacacaacacagccatgcgggatggtggcaagtacagcctggaacagcgtggagtcctccagaagctgatccaccaccggaaagagaccctgtcacgcagaggcccttcagcctccagtgttgcagttatgacctcatcaaccagtgaccaccacttggatgctgctgcagccaggcagcccaatggggtgtgtcgagctgggttcgagcggcagcacagcctacccagttctgagcatcttggggcagatggaggcctctaccagatcccaccacagcctcgccgagcagcacccaccacaccgcccccaccagtgaagcgccgagaccgcgaggccctgatggcctctgggagtggtggccacaacaccatgccctccgggggtaactctgtgtccagcggctcctcagtcagcagcacctccctggacacgctctataccagctccagcccatctgaaccaggctccagctgctcacccacacccccacctgtgccccgccgaggcacccacaccaccgtgtcccaagtccagccccctccctccaaggcatcagcacctgaaccccctgcagaagaagaagtggcaactggtacaacctcagcctctgatgacctggaagccctgggtacactgagcctggggaccacagaggagaaggcagcagctgaggcggctgtgcccaggaccattggggccgagctgatggagctggtgcggagaaacactggcctgagccacgaattatgccgggtggccatcggcatcatagtgggtcacatccaggcctcggtgccggccagctcaccagtcatggagcaggtcctcctctcactcgtagagggcaaggacctcagcatggccctgccctcagggcaggtctgccacgaccagcagaggctggaggtgatctttgcagacctggctcgccggaaggacgacgcccagcagcgcagttgggcactatatgaggatgagggtgtcatccgctgctacctagaggagctgctgcatattctgactgatgcagaccctgaagtttgcaagaaaatgtgcaagagaaacgagttcgagtctgtcctggccttggtggcctattaccaaatggaacaccgagcatcactgcggctgctgctcctcaagtgctttggcgccatgtgcagcctggatgcagccatcatctccacgcttgtgtcatccgtgctgcctgtagagctggcgagggacatgcagacagacacgcaggaccaccagaaactctgttactctgccctcatcctggccatggtcttctccatgggagaggcagtgccctatgcacactatgagcacctgggcacgcctttcgcccagttcctactgaacatcgtcgaggatgggctgcccttggacaccacagagcagctgccggacctctgcgtgaacctgcttctggctctcaacctgcacctgccagctgctgaccagaatgtcatcatggctgccctgagcaaacacgccaatgtcaagatcttctccgagaagctgttgttgctcctgaacagaggggatgaccctgtgcgcatcttcaaacatgagccacagccaccacactctgtcctcaagttcctgcaggacgtgtttggcagcccggccacagctgccatcttctaccacacagacatgatggctctcattgacatcactgtgcggcacatcgcagacctgtcaccaggagacaagatgcggatctccccttggtcattcaaggcactgctcaggcatcttatgcaagaaggcgtcccaggttgcgaaggtgactcagacgcctcctttgggactccaacacccttccccggcagagcccctgcctgtctgcctccgtggtgtcaggttttgtgccctctactcactagattgtggacacagaaagcgctgg

SEQ ID NO: 290 - DNA, 2161 bp, synthetic construct; identical to SEQ ID NO: 288
  misc_feature 1..2161: note = Synthetic polynucleotide
  source 1..2161: mol_type = other DNA

SEQ ID NO: 291 - DNA, 55 bp, synthetic construct
  misc_feature 1..55: note = Synthetic polynucleotide
  source 1..55: mol_type = other DNA
atggcgtgcttgttggagaccccaatccgcatgagcgtcctttcgtttttttaaa

SEQ ID NO: 292 - DNA, 55 bp, synthetic construct; identical to SEQ ID NO: 291
  misc_feature 1..55: note = Synthetic polynucleotide
  source 1..55: mol_type = other DNA

SEQ ID NO: 293 - DNA, 55 bp, synthetic construct; identical to SEQ ID NO: 291
  misc_feature 1..55: note = Synthetic polynucleotide
  source 1..55: mol_type = other DNA

SEQ ID NO: 294 - DNA, 55 bp, synthetic construct; identical to SEQ ID NO: 291
  misc_feature 1..55: note = Synthetic polynucleotide
  source 1..55: mol_type = other DNA

SEQ ID NO: 295 - DNA, 55 bp, synthetic construct; identical to SEQ ID NO: 291
  misc_feature 1..55: note = Synthetic polynucleotide
  source 1..55: mol_type = other DNA

SEQ ID NO: 296 - DNA, 55 bp, synthetic construct; identical to SEQ ID NO: 291
  misc_feature 1..55: note = Synthetic polynucleotide
  source 1..55: mol_type = other DNA

SEQ ID NO: 297 - DNA, 55 bp, synthetic construct; identical to SEQ ID NO: 291
  misc_feature 1..55: note = Synthetic polynucleotide
  source 1..55: mol_type = other DNA

SEQ ID NO: 298 - DNA, 25 bp, synthetic construct
  misc_feature 1..25: note = Synthetic polynucleotide
  source 1..25: mol_type = other DNA
atgagcgtcctttcgtttttttaaa

SEQ ID NO: 299 - DNA, 377 bp, synthetic construct
  misc_feature 1..377: note = Synthetic polynucleotide
  source 1..377: mol_type = other DNA
atggctgtagctgcagtaaaatgggtgatgtcaaagagaactatcttgaaacatttatttccagtccaaaatggagctttatattgtgtttgtcataaatctacgtattctcctctaccagatgactataattgcaacgtagagcttgctctgacttctgatggcaggacaatagtatgctaccacccttctgtggacattccatatgaacacacaaaacatactggatgttttctggctatctcccatcactaaaatgtaagcttgatgaggacagggccttgtgtgtttttttcccctgcttggtcttcagcacctggaataacgctttgaacttggtaggtgcacaataaatatttttctattaagtgaatgaa

SEQ ID NO: 300 - DNA, 377 bp, synthetic construct
  misc_feature 1..377: note = Synthetic polynucleotide
  source 1..377: mol_type = other DNA
atgggtgatgtcaaagagaactatcttgaaacatttatttccagtccaaaattcgggcgtacatgtgcagatggagctttatattgtgtttgtcataaatctacgtattctcctctaccagatgactataattgcaacgtagagcttgctctgacttctgatggcaggacaatagtatgctaccacccttctgtggacattccatatgaacacacaaaacatactggatgttttctggctatctcccatcactaaaatgtaagcttgatgaggacagggccttgtgtgtttttttcccctgcttggtcttcagcacctggaataacgctttgaacttggtaggtgcacaataaatatttttctattaagtgaatgaa

SEQ ID NO: 301 - DNA, 377 bp, synthetic construct; identical to SEQ ID NO: 299
  misc_feature 1..377: note = Synthetic polynucleotide
  source 1..377: mol_type = other DNA

SEQ ID NO: 302 - DNA, 377 bp, synthetic construct; identical to SEQ ID NO: 299
  misc_feature 1..377: note = Synthetic polynucleotide
  source 1..377: mol_type = other DNA

SEQ ID NO: 303 - DNA, 377 bp, synthetic construct; identical to SEQ ID NO: 299
  misc_feature 1..377: note = Synthetic polynucleotide
  source 1..377: mol_type = other DNA

SEQ ID NO: 304 - DNA, 377 bp, synthetic construct; identical to SEQ ID NO: 299
  misc_feature 1..377: note = Synthetic polynucleotide
  source 1..377: mol_type = other DNA

SEQ ID NO: 305 - DNA, 377 bp, synthetic construct; identical to SEQ ID NO: 299
  misc_feature 1..377: note = Synthetic polynucleotide
  source 1..377: mol_type = other DNA

SEQ ID NO: 306 - DNA, 1055 bp, synthetic construct
  misc_feature 1..1055: note = Synthetic polynucleotide
  source 1..1055: mol_type = other DNA
atggtgccgcatgccatcttggcacgggggagggacgtgtgcaggcggaatggactcctcatcctgtctgtgctgtctgtcatcgtgggctgcctcctcggcttcttcttgaggacccggcgcctctcaccacaggaaattagttacttccagttccctggagagctcctgatgaggatgctgaagatgatgatcctgccactggtggtctccagcttgatgtccggacttgcctccctggatgccaagacctctagccgcctgggcgtcctcaccgtggcgtactacctgtggaccaccttcatggctgtcatcgtgggcatcttcatggtctccatcatccacccaggcagcgcggcccagaaggagaccacggagcagagtgggaagcccatcatgagctcagccgatgccctgttggacctcatccggaacatgttcccagccaacctagtagaagccacattcaaacagtaccgcaccaagaccaccccagttgtcaagtcccccaaggtggcaccagaggaggcccctcctcggcggatcctcatctacggggtccaggaggagaatggctcccatgtgcagaacttcgccctggacctgaccccgccgcccgaggtcgtttacaagtcagagccgggcaccagcgatggcatgaatgtgctgggcatcgtcttcttctctgccaccatgggcatcatgctgggccgcatgggtgacagcggggcccccctggtcagcttctgccagtgcctcaatgagtcggtcatgaagatcgtggcggtggctgtgtggtatttccccttcggcattgtgttcctcattgcgggtaagatcctggagatggacgaccccagggccgtcggcaagaagctgggcttctactcagtcaccgtggtgtgcgggctggtgctccacgggctctttatcctgcccctgctctacttcttcatcaccaagaagaatcccatcgtcttcatccgtggcatcctgcaggctctgctcatcgcgctggccacctcctccaggaagaaccaagtgagagcactgca

SEQ ID NO: 307 - DNA, 1072 bp, synthetic construct
  misc_feature 1..1072: note = Synthetic polynucleotide
  source 1..1072: mol_type = other DNA
atggagccttcatctcttgagctgccggctgacacagtgcagcgcattgcggctgaactcaaatgccacccaacggatgagagggtggctctccacctagatgaggaagataagctgaggcacttcagggagtgcttttatattcccaaaatacaggatctgcctccagttgatttatcattagtgaataaagatgaaaatgccatctatttcttgggaaattctcttggccttcaaccaaaaatggttaaaacatatcttgaagaagaactagataagtgggccaaaatagcagcctatggtcatgaagtggggaagcgtccttggattacaggagatgagagtattgtaggccttatgaaggacattgtaggagccaatgagaaagaaatagccctaatgaatgctttgactgtaaatttacatcttctaatgttatcattttttaagcctacgccaaaacgatataaaattcttctagaagccaaagccttcccttctgatcattatgctattgagtcacaactacaacttcacggacttaacattgaagaaagtatgcggatgataaagccaagagagggggaagaaaccttaagaatagaggatatccttgaagtaattgagaaggaaggagactcaattgcagtgatcctgttcagtggggtgcatttttacactggacagcactttaatattcctgccatcacaaaagctggacaagcgaagggttgttatgttggctttgatctagcacatgcagttggaaatgttgaactctacttacatgactggggagttgattttgcctgctggtgttcctacaagtatttaaatgcaggagcaggaggaattgctggtgccttcattcatgaaaagcatgcccatacgattaaacctgcatgttcctgcctcccccttcaccctctgccatggttgtaagtttcctgaggccttcccagtcatgcttcctgcacagcctgcaaaaccatgaacaaattaaacctcttttctttataaattacccagtctcaggcagttgtttgtagcagtgagagaatggactaataca

SEQ ID NO: 308 - DNA, 1072 bp, synthetic construct; identical to SEQ ID NO: 307
  misc_feature 1..1072: note = Synthetic polynucleotide
  source 1..1072: mol_type = other DNA

SEQ ID NO: 309 - DNA, 1072 bp, synthetic construct; identical to SEQ ID NO: 307
  misc_feature 1..1072: note = Synthetic polynucleotide
  source 1..1072: mol_type = other DNA

SEQ ID NO: 310 - DNA, 196 bp, synthetic construct
  misc_feature 1..196: note = Synthetic polynucleotide
  source 1..196: mol_type = other DNA
atgggcgctgcccactccgcgtctgaggaggtgcgggagctcgagggcaagaccggctttgcagctacccaggaggccaaggtgggaggatctctggagcccaggaggtggaggctgcagtgagctgagatgccgaggtcgtgccagtgtactccagcctgagtgatggaagtgaaaccctgccacagaaaacaaa

SEQ ID NO: 311 - DNA, 196 bp, synthetic construct; identical to SEQ ID NO: 310
  misc_feature 1..196: note = Synthetic polynucleotide
  source 1..196: mol_type = other DNA

SEQ ID NO: 312 - DNA, 196 bp, synthetic construct; identical to SEQ ID NO: 310
  misc_feature 1..196: note = Synthetic polynucleotide
  source 1..196: mol_type = other DNA

SEQ ID NO: 313 - DNA, 196 bp, synthetic construct; identical to SEQ ID NO: 310
  misc_feature 1..196: note = Synthetic polynucleotide
  source 1..196: mol_type = other DNA

SEQ ID NO: 314 - DNA, 355 bp, synthetic construct
  misc_feature 1..355: note = Synthetic polynucleotide
  source 1..355: mol_type = other DNA
atgaggccccgctccggccccacgcggaacccgcggctccgagccttcgccggcgtcccgacccgaggccggacccgaggccagtcccgccgctgcgcagccgaagccagtgcggggcctgagagggacgcgcgccccggggcccccgccgcgggcaccatgggcgctgcccactccgcgtctgaggaggtgcgggagctcgagggcaagaccggctttgcagctacccaggaggccaaggtgggaggatctctggagcccaggaggtggaggctgcagtgagctgagatgccgaggtcgtgccagtgtactccagcctgagtgatggaagtgaaaccctgccacagaaaacaaa

SEQ ID NO: 315 - DNA, 225 bp, synthetic construct
  misc_feature 1..225: note = Synthetic polynucleotide
  source 1..225: mol_type = other DNA
atgcgtgcgcccattccagagcctaagcctggagacctgattgagatttttcgccctttctacagacactgggccatctatgttggcgatggatatgtggttcatctggcccctccaacgtcttctcagtagcatgggaattgcttgagggcaggcctgctgtccagatcacgtcactgacttcagcaccttggacaaggcccggcacccagtagggcctcagta

SEQ ID NO: 316 - DNA, 225 bp, synthetic construct; identical to SEQ ID NO: 315
  misc_feature 1..225: note = Synthetic polynucleotide
  source 1..225: mol_type = other DNA

SEQ ID NO: 317 - DNA, 516 bp, synthetic construct
  misc_feature 1..516: note = Synthetic polynucleotide
  source 1..516: mol_type = other DNA
atggggccgctacctgtgtgcctgccaatcatgctgctcctgctactgccgtcgctgctgctgctgctgcttctacctggccccgggtccggcgaggcctccaggatattacgtgtgcaccggcgtgggatcctggaactggcaggaactgtgggttgtgttggtccccgaacccccatcgcctatatgaaatatggttgcttttgtggcttgggaggccatggccagccccgcgatgccattgactggtgctgccatggccacgactgttgttacactcgagctgaggaggccggctgcagccccaagacagagcgctactcctggcagtgcgtcaatcagagcgtcctgtgcggtgggtgcttttaattccagctactaagaaggctgaggcaggagaattgcttgaatccaggaggtggaggttgcagtgagccgagactgcaccattgcactccagcctgggcgacagcgtgggactctgtctcaaaaacaacaacaacaacaaaaagaaaa

SEQ ID NO: 318 - DNA, 516 bp, synthetic construct; identical to SEQ ID NO: 317
  misc_feature 1..516: note = Synthetic polynucleotide
  source 1..516: mol_type = other DNA

SEQ ID NO: 319 - DNA, 890 bp, synthetic construct
  misc_feature 1..890: note = Synthetic polynucleotide
  source 1..890: mol_type = other DNA
atggaaagcagaaaagacatcacaaaccaagaagaaatttggaaaatgaagcctaggagaaatttagaagacaacgattatttgcaaacagcccatgctgatgaatttgactgcccttcagaacttcagcacgcacaggaactctttccacagtggcacttgccaattaaaatagctgctgttatggcatctctgacttttctttacactcttctgagggaagtaattcaccctttagcaacttcccatcaacaatatttttataaaattccaatcctggtcatcaacaaagtcttgccaatggtttccatcactctcttggcattggtttacctaccaggtgtgatagcagcaattgtccaagttcataatggaaccaagtataagaagtttccacattggttggataagtggatgttaacaagaaagcagtttgggcttctcagtttgttttttgctgtactgcatgcaatttatactctgtcttacgcaatgaggcgatcctacagatacaagttgctaaactgggcatatcaacaggtccaacaaaataaagaagatgcctggattgagcatgatgtttggagaatggagatttatgtgtctctgggaattgtgggactggcaatactggctctgttggctgtgacatctattccatctgtgagtgactctttgacatggagagaatttcactatattcagggctggtgtgagttgcagtttcttctccttgcaaaacatctgaagaaaatctcagtgttcctggtaagcatgcctgcttaatgacttgcggtgtcctggtcagtgcggtaatgcatcacgttatatttttcatctttctttcctcaattccacctttgctttcactctcactgccctgggcttgc

SEQ ID NO: 320 - DNA, 947 bp, synthetic construct
  misc_feature 1..947: note = Synthetic polynucleotide
  source 1..947: mol_type = other DNA
atggaaagcagaaaagacatcacaaaccaagaagaaatttggaaaatgaagcctaggagaaatttagaagacaacgattatttgcatgaggacacgggagagaccagcatgctaaaaagacctgtgcttttgcatttgcagcaaacagcccatgctgatgaatttgactgcccttcagaacttcagcacgcacaggaactctttccacagtggcacttgccaattaaaatagctgctgttatggcatctctgacttttctttacactcttctgagggaagtaattcaccctttagcaacttcccatcaacaatatttttataaaattccaatcctggtcatcaacaaagtcttgccaatggtttccatcactctcttggcattggtttacctaccaggtgtgatagcagcaattgtccaagttcataatggaaccaagtataagaagtttccacattggttggataagtggatgttaacaagaaagcagtttgggcttctcagtttgttttttgctgtactgcatgcaatttatactctgtcttacgcaatgaggcgatcctacagatacaagttgctaaactgggcatatcaacaggtccaacaaaataaagaagatgcctggattgagcatgatgtttggagaatggagatttatgtgtctctgggaattgtgggactggcaatactggctctgttggctgtgacatctattccatctgtgagtgactctttgacatggagagaatttcactatattcagggctggtgtgagttgcagtttcttctccttgcaaaacatctgaagaaaatctcagtgttcctggtaagcatgcctgcttaatgacttgcggtgtcctggtcagtgcggtaatgcatcacgttatatttttcatctttctttcctcaattccacctttgctttcactctcactgccctgggcttgc

SEQ ID NO: 321 - DNA, 947 bp, synthetic construct; identical to SEQ ID NO: 320
  misc_feature 1..947: note = Synthetic polynucleotide
  source 1..947: mol_type = other DNA

SEQ ID NO: 322 - DNA, 503 bp, synthetic construct
  misc_feature 1..503: note = Synthetic polynucleotide
  source 1..503: mol_type = other DNA
atggcggcggcgatgaccttctgccggctgctgaaccggtgtggcgaggcggcgcggagcctgcccctgggcgccaggtgtttcggggtgcgggtctcgccgaccggggagaaggtcacgcacactggccaggtttatgatgataaagactacaggagaattcggtttgtaggtcgtcagaaagagcctgctctacgtgaagatgatgaggatgaagacctttatgacgatccacttccacttaatgaaaagtcagttcattttctcttccttgtgatttccttcattgcattttcttcctctagcttactttattataagaatccaatatataatacttgtaacatgcaaaatatatgttaatcgaccatttatgttattggcaaacattctggtcagcatcaggctatgagtaaattgtgggggagtcaaaaataatatgcagattttcaattgtgttgggggtggttcccccaacccctgagttgttcaaggattaactg

SEQ ID NO: 323 - DNA, 503 bp, synthetic construct; identical to SEQ ID NO: 322
  misc_feature 1..503: note = Synthetic polynucleotide
  source 1..503: mol_type = other DNA

SEQ ID NO: 324 - DNA, 637 bp, synthetic construct
  misc_feature 1..637: note = Synthetic polynucleotide
  source 1..637: mol_type = other DNA
gaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaatacagaacctgtgatgctttcacctatactggctgtggagggaatgacaataactttgttagcagggaggattgcaaacgtgcatgtgcaaaagggttgaggccaattgtggcatcttgaagacactcaggcagcctatggagaaacgcctttgataaggaatagaagcttgccagcagccactcgagtgagcttaggagtgggttcaccagcaccagtgaagctttgagataactgatgccctggctgacccgttgactgtaatctgatgagagatgctgaaccaaaaccatccaggtgagccactcctagattcctgacactcaaaaactgtgtgagatgagaaatgattgttattttaagatgctaaattctgagataatttgttatgggggcaaaatgtaactcatata

SEQ ID NO: 325 - DNA, 950 bp, synthetic construct
  misc_feature 1..950: note = Synthetic polynucleotide
  source 1..950: mol_type = other DNA
atggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaattccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaagggttgaggccaattgtggcatcttgaagacactcaggcagcctatggagaaacgcctttgataaggaatagaagcttgccagcagccactcgagtgagcttaggagtgggttcaccagcaccagtgaagctttgagataactgatgccctggctgacccgttgactgtaatctgatgagagatgctgaaccaaaaccatccaggtgagccactcctagattcctgacactcaaaaactgtgtgagatgagaaatgattgttattttaagatgctaaattctgagataatttgttatgggggcaaaatgtaactcatata

SEQ ID NO: 326 - DNA, 1324 bp, synthetic construct
  misc_feature 1..1324: note = Synthetic polynucleotide
  source 1..1324: mol_type = other DNA
cttccaccaagggcccatcggtcttccccctggcgccctgctccaggagcacctctgggggcacagcggccctgggctgcctggtcaaggactacttcccagaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacacctgcaacgtgaatcacaagcccagcaacaccaaggtggacaagagagttgagctcaaaaccccacttggtgacacaactcacacatgcccacggtgcccagagcccaaatcttgtgacacacctcccccgtgcccacggtgcccagagcccaaatcttgtgacacacctcccccatgcccacggtgcccagagcccaaatcttgtgacacacctcccccgtgcccaaggtgcccagcacctgaactcctgggaggaccgtcagtcttcctcttccccccaaaacccaaggatacccttatgatttcccggacccctgaggtcacgtgcgtggtggtggacgtgagccacgaagaccccgaggtccagttcaagtggtacgtggacggcgtggaggtgcataatgccaagacaaagccgcgggaggagcagtacaacagcacgttccgtgtggtcagcgtcctcaccgtcctgcaccaggactggctgaacggcaaggagtacaagtgcaaggtctccaacaaagccctcccagcccccatcgagaaaaccatctccaaaaccaaaggacagccccgagaaccacaggtgtacaccctgcccccatcccgggaggagatgaccaagaaccaggtcagcctgacctgcctggtcaaaggcttctaccccagcgacatcgccgtggagtgggagagcagcgggcagccggagaacaactacaacaccacgcctcccatgctggactccgacggctccttcttcctctacagcaagctcaccgtggacaagagcaggtggcagcaggggaacatcttctcatgctccgtgatgcatgaggctctgcacaaccgcttcacgcagaagagcctctccctgtctccgggtaaatgacagagacggccggcaaagcccagcagcagggagagagcctgggacagagtctcccatgacacagaggtgccagccccaccgaggcctccatcccagatgcccggcctccagaaccaggacggaataaacgtctgttgtttaagccacgcagtctggggtgctgtgttgccagggccacagttaacggatac

SEQ ID NO: 327 - DNA, 1606 bp, synthetic construct
  misc_feature 1..1606: note = Synthetic polynucleotide
  source 1..1606: mol_type = other DNA
atgctaaggaggttggacaaaatcaggttcagaggtcacaagagagatgacttcctcgatctagcggagtctccaaatgcctcggacaccgaatgcagcgacgaaatccccctgaaggtaccgcggacctcgccccgggacagcgaggagctgagggaccctgctggtccagggaccctcatcatggccacaggagtccaggactttaaccggacagagtttgatcgactgaatgagatcaaaggtcacctggaaattgccttattggaaaaacatttcttacaggaggagctccggaagctgcgagaagaaaccaacgcggagatgctgcggcaggagctggaccgcgagcggcagcggcggatggagctggagcagaaggtgcaggaggtgctgaaggccagaaccgaggagcagatggctcagcagcccccaaaagggcaggcccaggccagcaatggagcagagcgccggagccaggggctgtcctcgcgcctgcagaagtggttctacgagcggtttggggagtacgtggaggacttccggttccagcccgaggagaacactgtggagacagaggaacccctgagcgcccgcaggttaactgaaaatatgagacggctcaagcgcggtgccaagccggtcactaactttgtgaagaacctctctgccttatccgactggtactccgtctacacgtctgccattgccttcaccgtgtacatgaatgccgtgtggcatggctgggccatcccattgttcttatttctagcaattctgaggttatccctcaattacctcatcgccagggggtggcggatacagtggagcatcgtgcccgaagtgtctgagcccgtggaacctccaaaggaagacctgactgtgtctgagaagttccagctggtgctggacgtcgcccagaaagcccagaaccttttcgggaagatggctgacatcctggagaagatcaagaacttgttcatgtgggtccagccggagatcacacagaagctgtatgtggcgctctgggctgccttcctggcctcctgcttcttcccctaccgcctggtggggcttgccgtgggactctatgctggtatcaagttcttcctcattgatttcatctttaaacgctgcccgaggctgcgcgccaagtacgacacgccctatatcatctggaggagtctccccaccgacccgcagctcaaggagcgctccagcgccgcagtctcacgcaggctgcagacgacctcgtcacggagctacgtacccagcgcaccggccggcctgggtaaagaggaggacgccggtcgcttccacagcaccaagaagggcaatttccacgagatcttcaatctgacagaaaacgagcgtccgctggcggtgtgcgagaatggctggcgctgctgcctcatcaacagggaccggaagatgcccacggactacatcaggaacggggtgctctacgtcacggagaattacttgtgcttcgaaagctccaaatctgggtcctcaaagaggaacaaagtcatcaagctagtggacatcacggacatccagaaggtaaatcatcatcataggagtgtggaagctgctggtacaaaat

SEQ ID NO: 328 - DNA, 1606 bp, synthetic construct; identical to SEQ ID NO: 327
  misc_feature 1..1606: note = Synthetic polynucleotide
  source 1..1606: mol_type = other DNA

SEQ ID NO: 329 - DNA, 175 bp, synthetic construct
  misc_feature 1..175: note = Synthetic polynucleotide
  source 1..175: mol_type = other DNA
atgcccacggactacatcaggaacggggtgctctacgtcacggagaattacttgtgcttcgaaagctccaaatctgggtcctcaaagaggaacaaagtcatcaagctagtggacatcacggacatccagaaggtaaatcatcatcataggagtgtggaagctgctggtacaaaat

SEQ ID NO: 330 - DNA, 3628 bp, synthetic construct
  misc_feature 1..3628: note = Synthetic polynucleotide
  source 1..3628: mol_type = other DNA
atgctggtgggccagggcgcggggccgctggggcccgcggtggtcaccgccgcggtggtgctgctgctgagcggcgtggggccggcgcacggctcggaggacatcgtggtgggctgcggtggcttcgtcaagtcggacgtggagatcaactactctctcatcgagataaagctgtacaccaagcatgggactttgaaataccagacagactgtgcccctaataatggttactttatgatccctttgtatgataagggggatttcattctgaagattgagcctcccctagggtggagttttgagccgacgaccgtggagctccatgtggatggagtcagtgacatctgcacaaagggtggggacatcaactttgtcttcactgggttctctgtgaatggcaaggtcctcagcaaagggcagcccctgggtcctgcgggagttcaggtgtctctgagaaacactgggaccgaagcaaagatccagtccacagttacacagcctggcggaaagtttgcattttttaaagttctgcctggagattatgaaatcctcgcaactcatccaacctgggcgttgaaagaggcaagcaccacagtgcgtgtaaccaactccaatgccaatgcggccagtcccctcatagttgctggctacaatgtgtctggctctgtccgaagtgatggggagcccatgaaaggcgtgaagtttcttctcttttcttctttagtaactaaagaggatgtcctgggctgcaatgtctcaccagtgcctgggttccagccccaagacgagagtctggtgtatttgtgctacacggtctccagagaagatggctcgttctctttctattccttgccaagtgggggctacactgtgattccgttctatcgaggggagaggattacctttgatgtggcgccttccagacttgacttcacagtggagcatgacagcttgaaaatcgagcccgtgttccacgtcatgggattctccgtcaccgggagggtcttgaacggacccgaaggagatggtgttccagaagcagtagtcaccctgaataaccaaatcaaagttaaaacaaaagctgatggctcattccgccttgagaacataaccacagggacatacaccatccatgctcagaaagagcacctctactttgaaacggtcaccatcaaaattgcaccaaacacacctcagctggctgacattgttgcaacagggttcagtgtctgtggtcagatatcaatcattcgcttccccgacaccgtcaagcagatgaataaatacaaagttgtcctgtcatctcaagacaaggacaagtctttggtcaccgtggagacagatgctcatggatcattttgttttaaagcaaacccagggacttacaaagtgcaggtgatggttcctgaggcagaaaccagagcagggctgacgttgaaaccccagacatttcctcttactgtgaccgacaggcctgtgatggatgtggcctttgtacagttcttggcatcagtttctgggaaagtctcttgtttggacacctgtggtgacttgctggtgactctacagtccctgagccgccagggtgagaagcggagcctccagctctccggcaaggtcaacgccatgactttcacctttgacaacgtgctccctggaaaatacaaaataagcatcatgcatgaggattggtgctggaagaacaagagcctggaggtggaagtgctggaggatgacgtgtctgcagttgagttcaggcagacgggctacatgctgagatgttccctgtctcacgccatcactctggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctacacctatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggtgaagaaagaatgaccaagcctcctgtgcaggagatggtagatgagttacaaggccccttctcgtatgatttctcttactgggcgcggtctggagagaaaatcactgttacaccgtcatctaaagagctgctcttttatcccccttcaatggaagccgttgtcagtggagaaagctgcccagggaagctgatcgagatccacgggaaggcaggcctgtttttagaaggccagatccaccccgagttggaaggagtcgagattgtcatcagtgaaaagggggcaagttcaccgctgatcacagtctttactgatgacaaaggtgcctacagtgttggccccctgcacagtgacctggagtacacggtgacctcacagaaggagggctatgttctgactgcagtggaaggaaccatcggagacttcaaggcctatgccctggcaggcgtaagctttgagataaaagctgaggatgaccagcccctcccgggagtcctcttatccctgagtggtggcctgtttcgttccaacctcttgacccaggacaacggcattctgacattctcaaacctgagccctggccagtattacttcaaacccatgatgaaggagttccggtttgagccatcctcacagatgatcgaggtgcaggaaggccagaacctgaagatcaccatcacggggtaccgaaccgcttacagttgctatggcacagtgtcttccttaaacggagagcccgaacaaggggttgccatggaagcggtgggccagaacgactgcagcatttacggagaagacaccgtgacagacgaagagggcaagttcagattacgtggattgctgccgggatgtgtgtaccacgttcagctcaaggcagaaggcaacgaccacattgagcgggcgctcccccaccatagggtgattgaggttgggaataatgacatcgatgatgtaaacatcatagttttccggcagattaatcaatttgatttaagtggaaatgtgatcacttcctctgaataccttcctacgttatgggtcaagctttacaaaagcgaaaacctcgacaatccaatccagacagtttcccttggccagtccctgttcttccatttccccccactgctcagagatggcgagaactatgttgtgcttctggactccacactccccagatcccagtatgactacatcttgcctcaagtttctttcaccgcagtgggctaccataaacacatcaccttgatttttaatcccacggaaatagggaggacccaggagcacgcaaatgactccacagggatgcaggacaaccacctggagcctgatttgtttgacaaataaattgcaaggaaaaaaaaaccaacaacagatggacagaatacctgtgggttaaaagaaacttaacttatcgcttaattcattgcaatatgtggcccttact

SEQ ID NO: 331 - DNA, 3628 bp, synthetic construct; identical to SEQ ID NO: 330
  misc_feature 1..3628: note = Synthetic polynucleotide
  source 1..3628: mol_type = other DNA

SEQ ID NO: 332 - DNA, 3127 bp, synthetic construct
  misc_feature 1..3127: note = Synthetic polynucleotide
  source 1..3127: mol_type = other DNA
atggcaaggtttgcattttttaaagttctgcctggagattatgaaatcctcgcaactcatccaacctgggcgttgaaagaggcaagcaccacagtgcgtgtaaccaactccaatgccaatgcggccagtcccctcatagttgctggctacaatgtgtctggctctgtccgaagtgatggggagcccatgaaaggcgtgaagtttcttctcttttcttctttagtaactaaagaggatgtcctgggctgcaatgtctcaccagtgcctgggttccagccccaagacgagagtctggtgtatttgtgctacacggtctccagagaagatggctcgttctctttctattccttgccaagtgggggctacactgtgattccgttctatcgaggggagaggattacctttgatgtggcgccttccagacttgacttcacagtggagcatgacagcttgaaaatcgagcccgtgttccacgtcatgggattctccgtcaccgggagggtcttgaacggacccgaaggagatggtgttccagaagcagtagtcaccctgaataaccaaatcaaagttaaaacaaaagctgatggctcattccgccttgagaacataaccacagggacatacaccatccatgctcagaaagagcacctctactttgaaacggtcaccatcaaaattgcaccaaacacacctcagctggctgacattgttgcaacagggttcagtgtctgtggtcagatatcaatcattcgcttccccgacaccgtcaagcagatgaataaatacaaagttgtcctgtcatctcaagacaaggacaagtctttggtcaccgtggagacagatgctcatggatcattttgttttaaagcaaacccagggacttacaaagtgcaggtgatggttcctgaggcagaaaccagagcagggctgacgttgaaaccccagacatttcctcttactgtgaccgacaggcctgtgatggatgtggcctttgtacagttcttggcatcagtttctgggaaagtctcttgtttggacacctgtggtgacttgctggtgactctacagtccctgagccgccagggtgagaagcggagcctccagctctccggcaaggtcaacgccatgactttcacctttgacaacgtgctccctggaaaatacaaaataagcatcatgcatgaggattggtgctggaagaacaagagcctggaggtggaagtgctggaggatgacgtgtctgcagttgagttcaggcagacgggctacatgctgagatgttccctgtctcacgccatcactctggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctacacctatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggtgaagaaagaatgaccaagcctcctgtgcaggagatggtagatgagttacaaggccccttctcgtatgatttctcttactgggcgcggtctggagagaaaatcactgttacaccgtcatctaaagagctgctcttttatcccccttcaatggaagccgttgtcagtggagaaagctgcccagggaagctgatcgagatccacgggaaggcaggcctgtttttagaaggccagatccaccccgagttggaaggagtcgagattgtcatcagtgaaaagggggcaagttcaccgctgatcacagtctttactgatgacaaaggtgcctacagtgttggccccctgcacagtgacctggagtacacggtgacctcacagaaggagggctatgttctgactgcagtggaaggaaccatcggagacttcaaggcctatgccctggcaggcgtaagctttgagataaaagctgaggatgaccagcccctcccgggagtcctcttatccctgagtggtggcctgtttcgttccaacctcttgacccaggacaacggcattctgacattctcaaacctgagccctggccagtattacttcaaacccatgatgaaggagttccggtttgagccatcctcacagatgatcgaggtgcaggaaggccagaacctgaagatcaccatcacggggtaccgaaccgcttacagttgctatggcacagtgtcttccttaaacggagagcccgaacaaggggttgccatggaagcggtgggccagaacgactgcagcatttacggagaagacaccgtgacagacgaagagggcaagttcagattacgtggattgctgccgggatgtgtgtaccacgttcagctcaaggcagaaggcaacgaccacattgagcgggcgctcccccaccatagggtgattgaggttgggaataatgacatcgatgatgtaaacatcatagttttccggcagattaatcaatttgatttaagtggaaatgtgatcacttcctctgaataccttcctacgttatgggtcaagctttacaaaagcgaaaacctcgacaatccaatccagacagtttcccttggccagtccctgttcttccatttccccccactgctcagagatggcgagaactatgttgtgcttctggactccacactccccagatcccagtatgactacatcttgcctcaagtttctttcaccgcagtgggctaccataaacacatcaccttgatttttaatcccacggaaatagggaggacccaggagcacgcaaatgactccacagggatgcaggacaaccacctggagcctgatttgtttgacaaataaattgcaaggaaaaaaaaaccaacaacagatggacagaatacctgtgggttaaaagaaacttaacttatcgcttaattcattgcaatatgtggcccttact

SEQ ID NO: 333 - DNA, 819 bp, synthetic construct
  misc_feature 1..819: note = Synthetic polynucleotide
  source 1..819: mol_type = other DNA
atggaaagcagaaaagacatcacaaaccaagaagaaatttggaaaatgaagcctaggagaaatttagaagacaacgattatttgcaaacagcccatgctgatgaatttgactgcccttcagaacttcagcacgcacaggaactctttccacagtggcacttgccaattaaaatagctgctgttatggcatctctgacttttctttacactcttctgagggaagtaattcaccctttagcaacttcccatcaacaatatttttataaaattccaatcctggtcatcaacaaagtcttgccaatggtttccatcactctcttggcattggtttacctaccaggtgtgatagcagcaattgtccaagttcataatggaaccaagtataagaagtttccacattggttggataagtggatgttaacaagaaagcagtttgggcttctcagtttgttttttgctgtactgcatgcaatttatactctgtcttacgcaatgaggcgatcctacagatacaagttgctaaactgggcatatcaacaggtccaacaaaataaagaagatgcctggattgagcatgatgtttggagaatggagatttatgtgtctctgggaattgtgggactggcaatactggctctgttggctgtgacatctattccatctgtgagtgactctttgacatggagagaatttcactatattcagaacatagctgacaaattaacttcagtaaaactcaacttggatcatatgttttcttttctcaaaatcttccctaaatgggtcctcacacttaaaaggtaagtccttagtccttac

SEQ ID NO: 334 - DNA, 876 bp, synthetic construct
  misc_feature 1..876: note = Synthetic polynucleotide
  source 1..876: mol_type = other DNA
atggaaagcagaaaagacatcacaaaccaagaagaaatttggaaaatgaagcctaggagaaatttagaagacaacgattatttgcatgaggacacgggagagaccagcatgctaaaaagacctgtgcttttgcatttgcagcaaacagcccatgctgatgaatttgactgcccttcagaacttcagcacgcacaggaactctttccacagtggcacttgccaattaaaatagctgctgttatggcatctctgacttttctttacactcttctgagggaagtaattcaccctttagcaacttcccatcaacaatatttttataaaattccaatcctggtcatcaacaaagtcttgccaatggtttccatcactctcttggcattggtttacctaccaggtgtgatagcagcaattgtccaagttcataatggaaccaagtataagaagtttccacattggttggataagtggatgttaacaagaaagcagtttgggcttctcagtttgttttttgctgtactgcatgcaatttatactctgtcttacgcaatgaggcgatcctacagatacaagttgctaaactgggcatatcaacaggtccaacaaaataaagaagatgcctggattgagcatgatgtttggagaatggagatttatgtgtctctgggaattgtgggactggcaatactggctctgttggctgtgacatctattccatctgtgagtgactctttgacatggagagaatttcactatattcagaacatagctgacaaattaacttcagtaaaactcaacttggatcatatgttttcttttctcaaaatcttccctaaatgggtcctcacacttaaaaggtaagtccttagtccttac

SEQ ID NO: 335 - DNA, 876 bp, synthetic construct; identical to SEQ ID NO: 334
  misc_feature 1..876: note = Synthetic polynucleotide
  source 1..876: mol_type = other DNA

SEQ ID NO: 336 - DNA, 137 bp, synthetic construct
  misc_feature 1..137: note = Synthetic polynucleotide
  source 1..137: mol_type = other DNA
atggtgcgtgcgggcgccgtgggggctcatctccccgcgtccggcttggatatcttcggggacctgaagaagatgaacaagcgccagctttcgtgtcacctgggaatgtgtctgaagtgcagtcctcaggcatcgcc

SEQ ID NO: 337 - DNA, 137 bp, synthetic construct; identical to SEQ ID NO: 336
  misc_feature 1..137: note = Synthetic polynucleotide
  source 1..137: mol_type = other DNA

SEQ ID NO: 338 - DNA, 137 bp, synthetic construct; identical to SEQ ID NO: 336
  misc_feature 1..137: note = Synthetic polynucleotide
  source 1..137: mol_type = other DNA

SEQ ID NO: 339 - DNA, 451 bp, synthetic construct
  misc_feature 1..451: note = Synthetic polynucleotide
  source 1..451: mol_type = other DNA
atggcgccatcgcccaggaccggcagccggcaagatgcgaccgccctgcccagcatgtcctcaactttctgggcgttcatgatcctggccagcctgctcatcgcctactgcaatggaattagttaagatgtggtcacacgagagttggataggccctaaatccagtgcccggtgtccttagaagatgcagagagaccctgagaccacccagaggaagacgccctgtggaaacggaggtggagatgggggtgacgggcctgctagccgaggagccgctgggtggccagccacgctggaagctggaggccacatgtttcccctggagctcccagaaggaactggccctgccaacactttgtggacttctggcccagaactgtgtgaagataattccactgtgtgagatgccgggtttgtgggattttgttatgccgacacaggccactaacac

SEQ ID NO: 340 - DNA, 451 bp, synthetic construct; identical to SEQ ID NO: 339
  misc_feature 1..451: note = Synthetic polynucleotide
  source 1..451: mol_type = other DNA

SEQ ID NO: 341 - DNA, 3093 bp, synthetic construct
  misc_feature 1..3093: note = Synthetic polynucleotide
  source 1..3093: mol_type = other DNA
atggagctgatgtttgcagagtgggaggacggagagcgcttctcattcgaggattcggaccgttttgaggaggattcactctgttccttcatctccgaggccgagagcctctgccagaactggcggggatggcgcaaacagtcagcggggcccaattcccccactggcggcggtggcggaggtggcagtggcggtaccagaatgcgagatggactggtgatcccattggtggagctgtcagcaaagcaggtggcatttcatatcccatttgaagtggtggagaaagtttacccaccagtgcctgagcagctacagctccgaattgctttttggagcttccctgagaatgaagaggacattcggctgtattcgtgcctggccaatggcagtgcggatgagtttcagcgaggggatcagctcttccgcatgcgggctgtgaaggacccattgcagatagggttccacctgagtgctacagtggtgccacctcagatggtccctcctaaaggggcctacaacgtggctgtgatgtttgaccgctgccgggtcacttcctgcagctgtacctgtggggctggggccaaatggtgcacccacgtcgtggcactctgtctcttccgcatccacaacgcttctgcagtctgcctgcgagccccagtctcagagtccctgtcccggctacagagggaccagctgcaaaagtttgctcagtacctcatcagtgagctccctcagcagatcctccccacagctcagcgtctcctggacgaactcctgtcttcccagtcaacagccatcaatacagtgtgtggagctccggaccccacagcagggccctcagcatcggaccagagtacttggtatctggatgaatcgacactcactgacaacatcaaaaagacactgcacaagttctgtggcccctcccctgtggtcttcagtgatgtgaactccatgtatctgtcttccacggagccgccagccgctgctgaatgggcatgtctgctgcgccctctgaggggccgtgagccagagggcgtctggaacctgctaagcattgtgcgggagatgttcaagcggagggacagcaatgctgcccccttgttggaaatcctcactgaccagtgcctcacctatgaacagataacaggttggtggtatagcgtacgtacctcagcctcacacagcagtgccagtgggcacacgggccgtagcaacgggcagtcagaggtggcagcccatgcctgtgccagcatgtgtgacgagatggtcacactgtggaggctggccgtgctggaccctgcactcagcccccagcggcgccgggaactgtgtacgcagctgcggcagtggcaactgaaggtgattgagaacgtcaagcggggccaacacaagaagacgctggagcggctcttccccggcttccggccagcggtggaggcctgctacttcaactgggaagaggcctacccacttcctggtgtcacctacagcggcactgacaggaagctggcactgtgctgggcccgggccctgccctctcggccaggtgcctcccgctctgggggcctggaggaatcccgggaccggccccgaccccttcctactgagccagctgtgcggcccaaggagcctgggaccaagcgaaagggcttgggtgagggggtcccctcatcacagcggggtccccgccgcctctcagctgaagggggagataaagctctacataagatgggtccaggtgggggcaaagccaaggcactgggtggggctggcagtgggagcaagggctcagcaggtggcggaagcaagcgacggctgagcagcgaagacagctccctggagccagacctggccgagatgagcctggatgacagcagcctggccctgggcgcagaggccagcaccttcgggggattccctgagagccctccaccctgtcctctccacggtggctcccgaggcccttccactttccttcctgagcccccagatacttatgaagaagatggtggtgtgtacttctcggaagggcctgagcctcccacagcctctgttggcccccctggcctactgcctggggatgtctgtacccaggacgacctcccttctacagatgagagtggcaatgggcttcccaaaaccaaagaggcagcccctgcagttggagaggaggatgatgactaccaggcgtactatctgaatgcccaggatggggctgggggcgaggaagagaaggccgagggcggggctggggaggagcacgacctgtttgctgggctgaagccactggaacaggagagtcgcatggaggtactgtttgcctgtgctgaggccctgcatgcgcatggctatagcagtgaggcctcccgtctcactgtggagcttgcccaggatctgctagccaacccacccgacctcaaggtagagccgccccctgccaagggcaagaagaacaaggtatccacgagccgtcagacctgggtggctaccaacaccctgagcaaggcggccttcctgttgacagtgctaagtgagcgtccagagcaccacaacctggccttccgagttggcatgtttgccttggagctacagaggcctccagcttctaccaaggccttggaggtgaagctggcataccaggagtctgaggtggctgccctgctcaagaagatccctctgggtccaagtgagatgagtaccatgcggtgccgggcagaggaacttcgggaggggacactctgtgactatcggcctgtgttgcctctcatgctggccagtttcatctttgacgttctctgtgctccagtggtttctcccacaggttcccggcccccaagtcgcaactggaacagcgagacacctggggatgaggagcttggatttgaagcagcagttgctgccttgggcatgaagacaacagtgagcgaggcagaacatcccctcttatgtgaaggcacacgtcgggagaagggtgacctggcattagcactaatgatcacttacaaggacgaccaggccaagcttaagaagcctgggcaacagagcgagaccctgtctcttaaaaaaaaaagaagaagaagaaaaaaagaa

SEQ ID NO: 342 - DNA, 2979 bp, synthetic construct
  misc_feature 1..2979: note = Synthetic polynucleotide
  source 1..2979: mol_type = other DNA
atggagctgatgtttgcagagtgggaggacggagagcgcttctcattcgaggattcggaccgttttgaggaggattcactctgttccttcatctccgaggccgagagcctctgccagaactggcggggatggcgcaaacagtcagcggggcccaattcccccactggcggcggtggcggaggtggcagtggcggtaccagaatgcgagatggactggtgatcccattggtggagctgtcagcaaagcaggtggcatttcatatcccatttgaagtggtggagaaagtttacccaccagtgcctgagcagctacagctccgaattgctttttggagcttccctgagaatgaagaggacattcggctgtattcgtgcctggccaatggcagtgcggatgagtttcagcgaggggatcagctcttccgcatgcgggctgtgaaggacccattgcagatagggttccacctgagtgctacagtggtgccacctcagatggtccctcctaaaggggcctacaacgtggctgtgatgtttgaccgctgccgggtcacttcctgcagctgtacctgtggggctggggccaaatggtgcacccacgtcgtggcactctgtctcttccgcatccacaacgcttctgcagtctgcctgcgagccccagtctcagagtccctgtcccggctacagagggaccagctgcaaaagtttgctcagtacctcatcagtgagctccctcagcagatcctccccacagctcagcgtctcctggacgaactcctgtcttcccagtcaacagccatcaatacagtgtgtggagctccggaccccacagcagggccctcagcatcggaccagagtacttggtatctggatgaatcgacactcactgacaacatcaaaaagacactgcacaagttctgtggcccctcccctgtggtcttcagtgatgtgaactccatgtatctgtcttccacggagccgccagccgctgctgaatgggcatgtctgctgcgccctctgaggggccgtgagccagagggcgtctggaacctgctaagcattgtgcgggagatgttcaagcggagggacagcaatgctgcccccttgttggaaatcctcactgaccagtgcctcacctatgaacagataacaggttggtggtatagcgtacgtacctcagcctcacacagcagtgccagtgggcacacgggccgtagcaacgggcagtcagaggtggcagcccatgcctgtgccagcatgtgtgacgagatggtcacactgtggaggctggccgtgctggaccctgcactcagcccccagcggcgccgggaactgtgtacgcagctgcggcagtggcaactgaaggtgattgagaacgtcaagcggggccaacacaagaagacgctggagcggctcttccccggcttccggccagcggtggaggcctgctacttcaactgggaagaggcctacccacttcctggtgtcacctacagcggcactgacaggaagctggcactgtgctgggcccgggccctgccctctcggccaggtgcctcccgctctgggggcctggaggaatcccgggaccggccccgaccccttcctactgagccagctgtgcggcccaaggagcctgggaccaagcgaaagggcttgggtgagggggtcccctcatcacagcggggtccccgccgcctctcagctgaagggggagataaagctctacataagatgggtccaggtgggggcaaagccaaggcactgggtggggctggcagtgggagcaagggctcagcaggtggcggaagcaagcgacggctgagcagcgaagacagctccctggagccagacctggccgagatgagcctggatgacagcagcctggccctgggcgcagaggccagcaccttcgggggattccctgagagccctccaccctgtcctctccacgcctctgttggcccccctggcctactgcctggggatgtctgtacccaggacgacctcccttctacagatgagagtggcaatgggcttcccaaaaccaaagaggcagcccctgcagttggagaggaggatgatgactaccaggcgtactatctgaatgcccaggatggggctgggggcgaggaagagaaggccgagggcggggctggggaggagcacgacctgtttgctgggctgaagccactggaacaggagagtcgcatggaggtactgtttgcctgtgctgaggccctgcatgcgcatggctatagcagtgaggcctcccgtctcactgtggagcttgcccaggatctgctagccaacccacccgacctcaaggtagagccgccccctgccaagggcaagaagaacaaggtatccacgagccgtcagacctgggtggctaccaacaccctgagcaaggcggccttcctgttgacagtgctaagtgagcgtccagagcaccacaacctggccttccgagttggcatgtttgccttggagctacagaggcctccagcttctaccaaggccttggaggtgaagctggcataccaggagtctgaggtggctgccctgctcaagaagatccctctgggtccaagtgagatgagtaccatgcggtgccgggcagaggaacttcgggaggggacactctgtgactatcggcctgtgttgcctctcatgctggccagtttcatctttgacgttctctgtgctccaggttcccggcccccaagtcgcaactggaacagcgagacacctggggatgaggagcttggatttgaagcagcagttgctgccttgggcatgaagacaacagtgagcgaggcagaacatcccctcttatgtgaaggcacacgtcgggagaagggtgacctggcattagcactaatgatcacttacaaggacgaccaggccaagcttaagaagcctgggcaacagagcgagaccctgtctcttaaaaaaaaaagaagaagaagaaaaaaagaa

SEQ ID NO: 343 - DNA, 3078 bp, synthetic construct
  misc_feature 1..3078: note = Synthetic polynucleotide
  source 1..3078: mol_type = other DNA
atggagctgatgtttgcagagtgggaggacggagagcgcttctcattcgaggattcggaccgttttgaggaggattcactctgttccttcatctccgaggccgagagcctctgccagaactggcggggatggcgcaaacagtcagcggggcccaattcccccactggcggcggtggcggaggtggcagtggcggtaccagaatgcgagatggactggtgatcccattggtggagctgtcagcaaagcaggtggcatttcatatcccatttgaagtggtggagaaagtttacccaccagtgcctgagcagctacagctccgaattgctttttggagcttccctgagaatgaagaggacattcggctgtattcgtgcctggccaatggcagtgcggatgagtttcagcgaggggatcagctcttccgcatgcgggctgtgaaggacccattgcagatagggttccacctgagtgctacagtggtgccacctcagatggtccctcctaaaggggcctacaacgtggctgtgatgtttgaccgctgccgggtcacttcctgcagctgtacctgtggggctggggccaaatggtgcacccacgtcgtggcactctgtctcttccgcatccacaacgcttctgcagtctgcctgcgagccccagtctcagagtccctgtcccggctacagagggaccagctgcaaaagtttgctcagtacctcatcagtgagctccctcagcagatcctccccacagctcagcgtctcctggacgaactcctgtcttcccagtcaacagccatcaatacagtgtgtggagctccggaccccacagcagggccctcagcatcggaccagagtacttggtatctggatgaatcgacactcactgacaacatcaaaaagacactgcacaagttctgtggcccctcccctgtggtcttcagtgatgtgaactccatgtatctgtcttccacggagccgccagccgctgctgaatgggcatgtctgctgcgccctctgaggggccgtgagccagagggcgtctggaacctgctaagcattgtgcgggagatgttcaagcggagggacagcaatgctgcccccttgttggaaatcctcactgaccagtgcctcacctatgaacagataacaggttggtggtatagcgtacgtacctcagcctcacacagcagtgccagtgggcacacgggccgtagcaacgggcagtcagaggtggcagcccatgcctgtgccagcatgtgtgacgagatggtcacactgtggaggctggccgtgctggaccctgcactcagcccccagcggcgccgggaactgtgtacgcagctgcggcagtggcaactgaaggtgattgagaacgtcaagcggggccaacacaagaagacgctggagcggctcttccccggcttccggccagcggtggaggcctgctacttcaactgggaagaggcctacccacttcctggtgtcacctacagcggcactgacaggaagctggcactgtgctgggcccgggccctgccctctcggccaggtgcctcccgctctgggggcctggaggaatcccgggaccggccccgaccccttcctactgagccagctgtgcggcccaaggagcctgggaccaagcgaaagggcttgggtgagggggtcccctcatcacagcggggtccccgccgcctctcagctgaagggggagataaagctctacataagatgggtccaggtgggggcaaagccaaggcactgggtggggctggcagtgggagcaagggctcagcaggtggcggaagcaagcgacggctgagcagcgaagacagctccctggagccagacctggccgagatgagcctggatgacagcagcctggccctgggcgcagaggccagcaccttcgggggattccctgagagccctccaccctgtcctctccacggtggctcccgaggcccttccactttccttcctgagcccccagatacttatgaagaagatggtggtgtgtacttctcggaagggcctgagcctcccacagcctctgttggcccccctggcctactgcctggggatgtctgtacccaggacgacctcccttctacagatgagagtggcaatgggcttcccaaaaccaaagaggcagcccctgcagttggagaggaggatgatgactaccaggcgtactatctgaatgcccaggatggggctgggggcgaggaagagaaggccgagggcggggctggggaggagcacgacctgtttgctgggctgaagccactggaacaggagagtcgcatggaggtactgtttgcctgtgctgaggccctgcatgcgcatggctatagcagtgaggcctcccgtctcactgtggagcttgcccaggatctgctagccaacccacccgacctcaaggtagagccgccccctgccaagggcaagaagaacaaggtatccacgagccgtcagacctgggtggctaccaacaccctgagcaaggcggccttcctgttgacagtgctaagtgagcgtccagagcaccacaacctggccttccgagttggcatgtttgccttggagctacagaggcctccagcttctaccaaggccttggaggtgaagctggcataccaggagtctgaggtggctgccctgctcaagaagatccctctgggtccaagtgagatgagtaccatgcggtgccgggcagaggaacttcgggaggggacactctgtgactatcggcctgtgttgcctctcatgctggccagtttcatctttgacgttctctgtgctccaggttcccggcccccaagtcgcaactggaacagcgagacacctggggatgaggagcttggatttgaagcagcagttgctgccttgggcatgaagacaacagtgagcgaggcagaacatcccctcttatgtgaaggcacacgtcgggagaagggtgacctggcattagcactaatgatcacttacaaggacgaccaggccaagcttaagaagcctgggcaacagagcgagaccctgtctcttaaaaaaaaaagaagaagaagaaaaaaagaa

SEQ ID NO: 344 - DNA, 3093 bp, synthetic construct; identical to SEQ ID NO: 341
  misc_feature 1..3093: note = Synthetic polynucleotide
  source 1..3093: mol_type = other DNA

SEQ ID NO: 345 - DNA, 3078 bp, synthetic construct; identical to SEQ ID NO: 343
  misc_feature 1..3078: note = Synthetic polynucleotide
  source 1..3078: mol_type = other DNA

SEQ ID NO: 346 - DNA, 3072 bp, synthetic construct
  misc_feature 1..3072: note = Synthetic polynucleotide
  source 1..3072: mol_type = other DNA
atggagctgatgtttgcagagtgggaggacggagagcgcttctcattcgaggattcggaccgttttgaggaggattcactctgttccttcatctccgaggccgagagcctctgccagaactggcggggatggcgcaaacagtcagcggggcccaattcccccactggcggcggtggcggaggtggcagtggcggtaccagaatgcgagatggactggtgatcccattggtggagctgtcagcaaagcaggtggcatttcatatcccatttgaagtggtggagaaagtttacccaccagtgcctgagcagctacagctccgaattgctttttggagcttccctgagaatgaagaggacattcggctgtattcgtgcctggccaatggcagtgcggatgagtttcagcgaggggatcagctcttccgcatgcgggctgtgaaggacccattgcagatagggttccacctgagtgctacagtggtgccacctcagatggtccctcctaaaggggcctacaacgtggctgtgatgtttgaccgctgccgggtcacttcctgcagctgtacctgtggggctggggccaaatggtgcacccacgtcgtggcactctgtctcttccgcatccacaacgcttctgcagtctgcctgcgagccccagtctcagagtccctgtcccggctacagagggaccagctgcaaaagtttgctcagtacctcatcagtgagctccctcagcagatcctccccacagctcagcgtctcctggacgaactcctgtcttcccagtcaacagccatcaatacagtgtgtggagctccggaccccacagcagggccctcagcatcggaccagagtacttggtatctggatgaatcgacactcactgacaacatcaaaaagacactgcacaagttctgtggcccctcccctgtggtcttcagtgatgtgaactccatgtatctgtcttccacggagccgccagccgctgctgaatgggcatgtctgctgcgccctctgaggggccgtgagccagagggcgtctggaacctgctaagcattgtgcgggagatgttcaagcggagggacagcaatgctgcccccttgttggaaatcctcactgaccagtgcctcacctatgaacagataacaggttggtggtatagcgtacgtacctcagcctcacacagcagtgccagtgggcacacgggccgtagcaacgggcagtcagaggtggcagcccatgcctgtgccagcatgtgtgacgagatggtcacactgtggaggctggccgtgctggaccctgcactcagcccccagcggcgccgggaactgtgtacgcagctgcggcagtggcaactgaaggtgattgagaacgtcaagcggggccaacacaagaagacgctggagcggctcttccccggcttccggccagcggtggaggcctgctacttcaactgggaagaggcctacccacttcctggtgtcacctacagcggcactgacaggaagctggcactgtgctgggcccgggccctgccctctcggccaggtgcctcccgctctgggggcctggaggaatcccgggaccggccccgaccccttcctactgagccagctgtgcggcccaaggagcctgggaccaagcgaaagggcttgggtgagggggtcccctcatcacagcggggtccccgccgcctctcagctgaagggggagataaagctctacataagatgggtccaggtgggggcaaagccaaggcactgggtggggctggcagtgggagcaagggctcagcaggtggcggaagcaagcgacggctgagcagcgaagacagctccctggagccagacctggccgagatgagcctggatgacagcagcctggccctgggcgcagaggccagcaccttcgggggattccctgagagccctccaccctgtcctctccacggtggctcccgaggcccttccactttccttcctgagcccccagatacttatgaagaagatggtggtgtgtacttctcggaagggcctgagcctcccacagcctctgttggcccccctggcctactgcctggggatgtctgtacccaggacgacctcccttctacagatgagagtggcaatgggcttcccaaaaccaaagaggcagcccctgcagttggagaggaggatgatgactaccaggcgtactatctgaatgcccaggatggggctgggggcgaggaagagaaggccgagggcggggctggggaggagcacgacctgtttgctgggctgaagccactggaacaggagagtcgcatggaggtactgtttgcctgtgctgaggccctgcatgcgcatggctatagcagtgaggcctcccgtctcactgtggagcttgcccaggatctgctagccaacccacccgacctcaagggcaagaagaacaaggtatccacgagccgtcagacctgggtggctaccaacaccctgagcaaggcggccttcctgttgacagtgctaagtgagcgtccagagcaccacaacctggccttccgagttggcatgtttgccttggagctacagaggcctccagcttctaccaaggccttggaggtgaagctggcataccaggagtctgaggtggctgccctgctcaagaagatccctctgggtccaagtgagatgagtaccatgcggtgccgggcagaggaacttcgggaggggacactctgtgactatcggcctgtgttgcctctcatgctggccagtttcatctttgacgttctctgtgctccagtggtttctcccacaggttcccggcccccaagtcgcaactggaacagcgagacacctggggatgaggagcttggatttgaagcagcagttgctgccttgggcatgaagacaacagtgagcgaggcagaacatcccctcttatgtgaaggcacacgtcgggagaagggtgacctggcattagcactaatgatcacttacaaggacgaccaggccaagcttaagaagcctgggcaacagagcgagaccctgtctcttaaaaaaaaaagaagaagaagaaaaaaagaa

SEQ ID NO: 347 - DNA, 1935 bp, synthetic construct
  misc_feature 1..1935: note = Synthetic polynucleotide
  source 1..1935: mol_type = other DNA
ataacaggttggtggtatagcgtacgtacctcagcctcacacagcagtgccagtgggcacacgggccgtagcaacgggcagtcagaggtggcagcccatgcctgtgccagcatgtgtgacgagatggtcacactgtggaggctggccgtgctggaccctgcactcagcccccagcggcgccgggaactgtgtacgcagctgcggcagtggcaactgaaggtgattgagaacgtcaagcggggccaacacaagaagacgctggagcggctcttccccggcttccggccagcggtggaggcctgctacttcaactgggaagaggcctacccacttcctggtgtcacctacagcggcactgacaggaagctggcactgtgctgggcccgggccctgccctctcggccaggtgcctcccgctctgggggcctggaggaatcccgggaccggccccgaccccttcctactgagccagctgtgcggcccaaggagcctgggaccaagcgaaagggcttgggtgagggggtcccctcatcacagcggggtccccgccgcctctcagctgaagggggagataaagctctacataagatgggtccaggtgggggcaaagccaaggcactgggtggggctggcagtgggagcaagggctcagcaggtggcggaagcaagcgacggctgagcagcgaagacagctccctggagccagacctggccgagatgagcctggatgacagcagcctggccctgggcgcagaggccagcaccttcgggggattccctgagagccctccaccctgtcctctccacggtggctcccgaggcccttccactttccttcctgagcccccagatacttatgaagaagatggtggtgtgtacttctcggaagggcctgagcctcccacagcctctgttggcccccctggcctactgcctggggatgtctgtacccaggacgacctcccttctacagatgagagtggcaatgggcttcccaaaaccaaagaggcagcccctgcagttggagaggaggatgatgactaccaggcgtactatctgaatgcccaggatggggctgggggcgaggaagagaaggccgagggcggggctggggaggagcacgacctgtttgctgggctgaagccactggaacaggagagtcgcatggaggtactgtttgcctgtgctgaggccctgcatgcgcatggctatagcagtgaggcctcccgtctcactgtggagcttgcccaggatctgctagccaacccacccgacctcaaggtagagccgccccctgccaagggcaagaagaacaaggtatccacgagccgtcagacctgggtggctaccaacaccctgagcaaggcggccttcctgttgacagtgctaagtgagcgtccagagcaccacaacctggccttccgagttggcatgtttgccttggagctacagaggcctccagcttctaccaaggccttggaggtgaagctggcataccaggagtctgaggtggctgccctgctcaagaagatccctctgggtccaagtgagatgagtaccatgcggtgccgggcagaggaacttcgggaggggacactctgtgactatcggcctgtgttgcctctcatgctggccagtttcatctttgacgttctctgtgctccaggttcccggcccccaagtcgcaactggaacagcgagacacctggggatgaggagcttggatttgaagcagcagttgctgccttgggcatgaagacaacagtgagcgaggcagaacatcccctcttatgtgaaggcacacgtcgggagaagggtgacctggcattagcactaatgatcacttacaaggacgaccaggccaagcttaagaagcctgggcaacagagcgagaccctgtctcttaaaaaaaaaagaagaagaagaaaaaaagaa

SEQ ID NO: 348 - DNA, 1096 bp, synthetic construct
  misc_feature 1..1096: note = Synthetic polynucleotide
  source 1..1096: mol_type = other DNA
tgagcccccagatacttatgaagaagatggtggtgtgtacttctcggaagggcctgagcctcccacagcctctgttggcccccctggcctactgcctggggatgtctgtacccaggacgacctcccttctacagatgagagtggcaatgggcttcccaaaaccaaagaggcagcccctgcagttggagaggaggatgatgactaccaggcgtactatctgaatgcccaggatggggctgggggcgaggaagagaaggccgagggcggggctggggaggagcacgacctgtttgctgggctgaagccactggaacaggagagtcgcatggaggtactgtttgcctgtgctgaggccctgcatgcgcatggctatagcagtgaggcctcccgtctcactgtggagcttgcccaggatctgctagccaacccacccgacctcaaggtagagccgccccctgccaagggcaagaagaacaaggtatccacgagccgtcagacctgggtggctaccaacaccctgagcaaggcggccttcctgttgacagtgctaagtgagcgtccagagcaccacaacctggccttccgagttggcatgtttgccttggagctacagaggcctccagcttctaccaaggccttggaggtgaagctggcataccaggagtctgaggtggctgccctgctcaagaagatccctctgggtccaagtgagatgagtaccatgcggtgccgggcagaggaacttcgggaggggacactctgtgactatcggcctgtgttgcctctcatgctggccagtttcatctttgacgttctctgtgctccaggttcccggcccccaagtcgcaactggaacagcgagacacctggggatgaggagcttggatttgaagcagcagttgctgccttgggcatgaagacaacagtgagcgaggcagaacatcccctcttatgtgaaggcacacgtcgggagaagggtgacctggcattagcactaatgatcacttacaaggacgaccaggccaagcttaagaagcctgggcaacagagcgagaccctgtctcttaaaaaaaaaagaagaagaagaaaaaaagaa

SEQ ID NO: 349 - DNA, 902 bp, synthetic construct
  misc_feature 1..902: note = Synthetic polynucleotide
  source 1..902: mol_type = other DNA
cgtactatctgaatgcccaggatggggctgggggcgaggaagagaaggccgagggcggggctggggaggagcacgacctgtttgctgggctgaagccactggaacaggagagtcgcatggaggtactgtttgcctgtgctgaggccctgcatgcgcatggctatagcagtgaggcctcccgtctcactgtggagcttgcccaggatctgctagccaacccacccgacctcaaggtagagccgccccctgccaagggcaagaagaacaaggtatccacgagccgtcagacctgggtggctaccaacaccctgagcaaggcggccttcctgttgacagtgctaagtgagcgtccagagcaccacaacctggccttccgagttggcatgtttgccttggagctacagaggcctccagcttctaccaaggccttggaggtgaagctggcataccaggagtctgaggtggctgccctgctcaagaagatccctctgggtccaagtgagatgagtaccatgcggtgccgggcagaggaacttcgggaggggacactctgtgactatcggcctgtgttgcctctcatgctggccagtttcatctttgacgttctctgtgctccagtggtttctcccacaggttcccggcccccaagtcgcaactggaacagcgagacacctggggatgaggagcttggatttgaagcagcagttgctgccttgggcatgaagacaacagtgagcgaggcagaacatcccctcttatgtgaaggcacacgtcgggagaagggtgacctggcattagcactaatgatcacttacaaggacgaccaggccaagcttaagaagcctgggcaacagagcgagaccctgtctcttaaaaaaaaaagaagaagaagaaaaaaagaa

SEQ ID NO: 350 - DNA, 874 bp, synthetic construct
  misc_feature 1..874: note = Synthetic polynucleotide
  source 1..874: mol_type = other DNA
tgggggcgaggaagagaaggccgagggcggggctggggaggagcacgacctgtttgctgggctgaagccactggaacaggagagtcgcatggaggtactgtttgcctgtgctgaggccctgcatgcgcatggctatagcagtgaggcctcccgtctcactgtggagcttgcccaggatctgctagccaacccacccgacctcaaggtagagccgccccctgccaagggcaagaagaacaaggtatccacgagccgtcagacctgggtggctaccaacaccctgagcaaggcggccttcctgttgacagtgctaagtgagcgtccagagcaccacaacctggccttccgagttggcatgtttgccttggagctacagaggcctccagcttctaccaaggccttggaggtgaagctggcataccaggagtctgaggtggctgccctgctcaagaagatccctctgggtccaagtgagatgagtaccatgcggtgccgggcagaggaacttcgggaggggacactctgtgactatcggcctgtgttgcctctcatgctggccagtttcatctttgacgttctctgtgctccagtggtttctcccacaggttcccggcccccaagtcgcaactggaacagcgagacacctggggatgaggagcttggatttgaagcagcagttgctgccttgggcatgaagacaacagtgagcgaggcagaacatcccctcttatgtgaaggcacacgtcgggagaagggtgacctggcattagcactaatgatcacttacaaggacgaccaggccaagcttaagaagcctgggcaacagagcgagaccctgtctcttaaaaaaaaaagaagaagaagaaaaaaagaa

SEQ ID NO: 351 - DNA, 163 bp, synthetic construct
  misc_feature 1..163: note = Synthetic polynucleotide
  source 1..163: mol_type = other DNA
atgccgggcatggcagcgtgtgcctgtagtcccagctactcaggaggctgaggcagaagaatttcttgaacccgggaggcagaggctgcagtgagccgagatcgcactactgcactccggcctgggcgacagagcaagactccatctccaaaaaaaaaagaaa

SEQ ID NO: 352 - DNA, 163 bp, synthetic construct; identical to SEQ ID NO: 351
  misc_feature 1..163: note = Synthetic polynucleotide
  source 1..163: mol_type = other DNA

SEQ ID NO: 353 - DNA, 163 bp, synthetic construct; identical to SEQ ID NO: 351
  misc_feature 1..163: note = Synthetic polynucleotide
  source 1..163: mol_type = other DNA

SEQ ID NO: 354 - DNA, 163 bp, synthetic construct; identical to SEQ ID NO: 351
  misc_feature 1..163: note = Synthetic polynucleotide
  source 1..163: mol_type = other DNA

SEQ ID NO: 355 - DNA, 222 bp, synthetic construct
  misc_feature 1..222: note = Synthetic polynucleotide
  source 1..222: mol_type = other DNA
gatccccggccgcggggccaggaagtcggagtttgagccccggaggcagagcggctgccatgccgggcatggcagcgtgtgcctgtagtcccagctactcaggaggctgaggcagaagaatttcttgaacccgggaggcagaggctgcagtgagccgagatcgcactactgcactccggcctgggcgacagagcaagactccatctccaaaaaaaaaagaaa

SEQ ID NO: 356 - DNA, 552 bp, synthetic construct
  misc_feature 1..552: note = Synthetic polynucleotide
  source 1..552: mol_type = other DNA
atggcttccagtaacactgtgttgatgcggttggtagcctccgcatattctattgctcaaaaggcaggaatgatagtcagacgtgttattgctgaaggagacctgggtattgtggagaagacctgtgcaacagacctgcagaccaaagctgaccgattggcacagatgagcatatgttcttcattggcccggaaattccccaaactcacaattataggggaagaggatctgccttctgaggaagtggatcaagagctgattgaagacagtcagtgggaagaaatactgaagcaaccatgcccatcgcagtacagtgctattaaagaagaagatctcgtggtctgggttgatcctctggatggaaccaaggaatataccgaaggtcttcttgacaatgtaacagttcttattggaattgcttatgaaggaaaagccatagcaggagttattaaccagccatattacaactatgaggtgttgataccaagcgcacttcctaacaaacataccacctgcctcagagtctgcttcccagggaacccaacctgcgac

SEQ ID NO: 357 - DNA, 552 bp, synthetic construct; identical to SEQ ID NO: 356
  misc_feature 1..552: note = Synthetic polynucleotide
  source 1..552: mol_type = other DNA

SEQ ID NO: 358 - DNA, 552 bp, synthetic construct; identical to SEQ ID NO: 356
  misc_feature 1..552: note = Synthetic polynucleotide
  source 1..552: mol_type = other DNA

SEQ ID NO: 359 - DNA, 387 bp, synthetic construct
  misc_feature 1..387: note = Synthetic polynucleotide
  source 1..387: mol_type = other DNA
atgagcatatgttcttcattggcccggaaattccccaaactcacaattataggggaagaggatctgccttctgaggaagtggatcaagagctgattgaagacagtcagtgggaagaaatactgaagcaaccatgcccatcgcagtacagtgctattaaagaagaagatctcgtggtctgggttgatcctctggatggaaccaaggaatataccgaaggtcttcttgacaatgtaacagttcttattggaattgcttatgaaggaaaagccatagcaggagttattaaccagccatattacaactatgaggtgttgataccaagcgcacttcctaacaaacataccacctgcctcagagtctgcttcccagggaacccaacctgcgac

SEQ ID NO: 360 - DNA, 444 bp, synthetic construct
  misc_feature 1..444: note = Synthetic polynucleotide
  source 1..444: mol_type = other DNA
atggcttccagtaacactgtgttgatgcggttggtagcctccgcatattctattgctcaaaaggcaggaatgatagtcagacgtgttattgctgaaggagacctgggtattgtggagaagacctgtgcaacagacctgcagaccaaagctgaccgattggcacagatgagcatatgttcttcattggcccggaaattccccaaactcacaattataggggaagagctcgtggtctgggttgatcctctggatggaaccaaggaatataccgaaggtcttcttgacaatgtaacagttcttattggaattgcttatgaaggaaaagccatagcaggagttattaaccagccatattacaactatgaggtgttgataccaagcgcacttcctaacaaacataccacctgcctcagagtctgcttcccagggaacccaacctgcgac

SEQ ID NO: 361 - DNA, 444 bp, synthetic construct; identical to SEQ ID NO: 360
  misc_feature 1..444: note = Synthetic polynucleotide
  source 1..444: mol_type = other DNA

SEQ ID NO: 362 - DNA, 444 bp, synthetic construct; identical to SEQ ID NO: 360
  misc_feature 1..444: note = Synthetic polynucleotide
  source 1..444: mol_type = other DNA

SEQ ID NO: 363 - DNA, 387 bp, synthetic construct; identical to SEQ ID NO: 359
  misc_feature 1..387: note = Synthetic polynucleotide
  source 1..387: mol_type = other DNA

SEQ ID NO: 364 - DNA, 431 bp, synthetic construct
  misc_feature 1..431: note = Synthetic polynucleotide
  source 1..431: mol_type = other DNA
gcttccaccaagggcccatcggtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgtccccaaatcttgctctctttggaaaaagcacagatcacagactgttcctgtggttttgtgtttctttttcctgggctctggcaaaataaacctctgacttgattgagagctgcctcagatgctttttggtttaca

SEQ ID NO: 365 - DNA, 739 bp, synthetic construct
  misc_feature 1..739: note = Synthetic polynucleotide
  source 1..739: mol_type = other DNA
atggtgccgcatgccatcttggcacgggggagggacgtgtgcaggcggaatggactcctcatcctgtctgtgctgtctgtcatcgtgggctgcctcctcggcttcttcttgaggacccggcgcctctcaccacaggaaattagttacttccagttccctggagagctcctgatgaggatgctgaagatgatgatcctgccactggtggtctccagcttgatgtccggacttgcctccctggatgccaagacctctagccgcctgggcgtcctcaccgtggcgtactacctgtggaccaccttcatggctgtcatcgtgggcatcttcatggtctccatcatccacccaggcagcgcggcccagaaggagaccacggagcagagtgggaagcccatcatgagctcagccgatgccctgttggacctcatccggaacatgttcccagccaacctagtagaagccacattcaaacagtaccgcaccaagaccaccccagttgtcaagtcccccaaggtggcaccagaggaggcccctcctcggcggatcctcatctacggggtccaggaggagaatggctcccatgtgcagaacttcgccctggacctgaccccgccgcccgaggtcgtttacaagtcagagccgggcaccagcgatggcatgaatgtgctgggcatcgtcttcttctctgccaccatggatgggtcccaaattatacaagcttcagaccccacaaagcctg

SEQ ID NO: 366 - DNA, 865 bp, synthetic construct
  misc_feature 1..865: note = Synthetic polynucleotide
  source 1..865: mol_type = other DNA
atgccgcggctcctccgcttgtccctgctgtggcttggactcctgctggttcggttttctcgtgaactgagcgacatcagcagtgccaggaagctgtgcggcaggtacttggtgaaagaaatagaaaaactctgcggccatgccaactggagccagttccgtttcgaggaggaaacccctttctcacggttgattgcacaggcctcggagaaggtcgaagcctacagcccataccagttcgaaagcccgcaaaccgcttccccggcccggggaagaggcacaaacccagtgtctacttcttgggaagaagcagtaaacagttgggaaatgcagtcactacctgagtataaggataaaaagggatattcaccccttgtgtgaacttgccactcccccatcaaatctggacaggcttctgacccttacaaccagtaggacatggcagaagttatactgtgcagctaccaaggctaaatcataaaagatttatgctgagacacactcacttttaattctctactcaccactatgaaaggtgaccaccctgaagccaccatattgtgaggaaatccaggccacatgtacatgctccagttaacagcccagctaacatcccagtcaagagccagcatcaactacccatcatgtgagtgaagacacctccagatgattccagtcctttgccttcaagtcacccctggctggcaattcttcccaactcatgtcctagtagccattgtggagcaaaaacaaagtcatccctggtgtgccctgtctcaattactgacccatggtatctgtgagcctaataaagtagttgttttaaatcactaagttttgggtagtttctgttacacagcaatag

SEQ ID NO: 367 - DNA, 719 bp, synthetic construct
  misc_feature 1..719: note = Synthetic polynucleotide
  source 1..719: mol_type = other DNA
atgtcaggacacaaatgcagttatccctgggacttacaggatcgatatgctcaagataagtcagttgtaaataagatgcaacagaaatattgggagacgaagcaggcctttattaaagccacagggaagaaggaagatgaacatgttgttgcctctgacgcggacctggatgccaagctagagctgtttcattcaattcagagaacctgtctggacttatcgaaagcaattgtactctatcaaaagaggatatgtttcttgtctcaagaagaaaacgaactgggaaaatttcttcgatcccaaggtttccaagataaaaccagagcaggaaagatgatgcaagcgacaggaaaggccctctgcttttcttcccagcaaaggttggccttacgaaatcctttgtgtcgatttcaccaagaagtggagacttttcggcatcgggccatctcagatacttggctgacggtgaaccgcatggaacagtgcaggacggaatatagaggagcactattatggatgaaggacgtgtctcaggagcttgatccagacctctacaagcaaatggagaagttcaggaaggtacaaacacaagtgcgccttgcaaaaaaaaactttgacaaattgaagatggatgtttgtcaaaaagtggatcttcttggagcgagcagatgcaatctcttgtctcacatgctagcaacataccagcctctgagttcctt

SEQ ID NO: 368 - DNA, 719 bp, synthetic construct; identical to SEQ ID NO: 367
  misc_feature 1..719: note = Synthetic polynucleotide
  source 1..719: mol_type = other DNA

SEQ ID NO: 369 - DNA, 716 bp, synthetic construct
  misc_feature 1..716: note = Synthetic polynucleotide
  source 1..716: mol_type = other DNA
atgtcaggacacaaatgttatccctgggacttacaggatcgatatgctcaagataagtcagttgtaaataagatgcaacagaaatattgggagacgaagcaggcctttattaaagccacagggaagaaggaagatgaacatgttgttgcctctgacgcggacctggatgccaagctagagctgtttcattcaattcagagaacctgtctggacttatcgaaagcaattgtactctatcaaaagaggatatgtttcttgtctcaagaagaaaacgaactgggaaaatttcttcgatcccaaggtttccaagataaaaccagagcaggaaagatgatgcaagcgacaggaaaggccctctgcttttcttcccagcaaaggttggccttacgaaatcctttgtgtcgatttcaccaagaagtggagacttttcggcatcgggccatctcagatacttggctgacggtgaaccgcatggaacagtgcaggacggaatatagaggagcactattatggatgaaggacgtgtctcaggagcttgatccagacctctacaagcaaatggagaagttcaggaaggtacaaacacaagtgcgccttgcaaaaaaaaactttgacaaattgaagatggatgtttgtcaaaaagtggatcttcttggagcgagcagatgcaatctcttgtctcacatgctagcaacataccagcctctgagttcctt

SEQ ID NO: 370 - DNA, 719 bp, synthetic construct; identical to SEQ ID NO: 367
  misc_feature 1..719: note = Synthetic polynucleotide
  source 1..719: mol_type = other DNA

SEQ ID NO: 371 - DNA, 719 bp, synthetic construct; identical to SEQ ID NO: 367
  misc_feature 1..719: note = Synthetic polynucleotide
  source 1..719: mol_type = other DNA

SEQ ID NO: 372 - DNA, 683 bp, synthetic construct
  misc_feature 1..683: note = Synthetic polynucleotide
  source 1..683: mol_type = other DNA
atggatcgatatgctcaagataagtcagttgtaaataagatgcaacagaaatattgggagacgaagcaggcctttattaaagccacagggaagaaggaagatgaacatgttgttgcctctgacgcggacctggatgccaagctagagctgtttcattcaattcagagaacctgtctggacttatcgaaagcaattgtactctatcaaaagaggatatgtttcttgtctcaagaagaaaacgaactgggaaaatttcttcgatcccaaggtttccaagataaaaccagagcaggaaagatgatgcaagcgacaggaaaggccctctgcttttcttcccagcaaaggttggccttacgaaatcctttgtgtcgatttcaccaagaagtggagacttttcggcatcgggccatctcagatacttggctgacggtgaaccgcatggaacagtgcaggacggaatatagaggagcactattatggatgaaggacgtgtctcaggagcttgatccagacctctacaagcaaatggagaagttcaggaaggtacaaacacaagtgcgccttgcaaaaaaaaactttgacaaattgaagatggatgtttgtcaaaaagtggatcttcttggagcgagcagatgcaatctcttgtctcacatgctagcaacataccagcctctgagttcctt

SEQ ID NO: 373 - DNA, 719 bp, synthetic construct; identical to SEQ ID NO: 367
  misc_feature 1..719: note = Synthetic polynucleotide
  source 1..719: mol_type = other DNA

SEQ ID NO: 374 - DNA, 719 bp, synthetic construct; identical to SEQ ID NO: 367
  misc_feature 1..719: note = Synthetic polynucleotide
  source 1..719: mol_type = other DNA

SEQ ID NO: 375 - DNA, 683 bp, synthetic construct; identical to SEQ ID NO: 372
  misc_feature 1..683: note = Synthetic polynucleotide
  source 1..683: mol_type = other DNA

SEQ ID NO: 376 - DNA, 5853 bp, synthetic construct
  misc_feature 1..5853: note = Synthetic polynucleotide
  source 1..5853: mol_type = other DNA
atggccacaggaggaggtccctttgaagatggcatgaatgatcaggatttaccaaactggagtaatgagaatgttgatgacaggctcaacaatatggattggggtgcccaacagaagaaagcaaatagatcatcagaaaagaataagaaaaagtttggtgtagaaagtgataaaagagtaaccaatgatatttctccggagtcgtcaccaggagttggaaggcgaagaacaaagactccacatacgttcccacacagtagatacatgagtcagatgtctgtcccagagcaggcagaattagagaaactgaaacagcggataaacttcagtgatttagatcagagaagcattggaagtgattcccaaggtagagcaacagctgctaacaacaaacgtcagcttagtgaaaaccgaaagcccttcaactttttgcctatgcagattaatactaacaagagcaaagatgcatctacaaaccccccaaacagagaaacgattggatcagcacagtgtaaagagttgtttgcttctgctttaagtaatgacctcttgcaaaactgtcaggtgtctgaagaagatgggaggggagaacctgcaatggagagcagccagattgtaagcaggcttgttcaaattcgcgattatattactaaagctagttccatgcgggaagatcttgtagagaaaaatgagagatctgctaatgttgagcgccttactcatctaatagatcaccttaaagaacaagagaagtcatatatgaaatttcttaaaaaaatccttgccagagatcctcagcaggagcctatggaagagatagaaaatttgaagaaacaacatgatttattaaaaagaatgttacaacagcaggagcaactaagagctctacagggacggcaggctgcacttctagctctgcaacataaagcagagcaagctattgcagtgatggatgattctgttgttgcagaaactgcaggtagcttatctggcgtcagtatcacatctgaactaaatgaagaattgaatgacttaattcagcgttttcataatcagcttcgtgattctcagcctccagctgttccagacaatagaagacaggcagaaagtctttcattaactagggaggtttcccagagcaggaaaccatcagcttcagaacgtttacctgatgagaaagtcgaactttttagcaaaatgagagtgctacaggaaaagaaacaaaaaatggacaaattgcttggagaacttcatacacttcgagatcagcatcttaacaattcatcatcctctccacaaaggagtgtcgatcagagaagtacttcagctccctctgcttctgtaggcttggcaccggttgtcaatggagaatccaatagcctcacatcatctgttccttatcctactgcttctctagtatctcagaatgagagtgaaaacgaaggccacctcaatccatctgaaaaactccagaagttaaatgaagttcgaaagagattgaatgagctaagagaattagttcattattatgaacaaacgtcagacatgatgacagatgctgtgaatgaaaacaggaaagatgaagaaactgaagagtcagaatatgattctgagcatgaaaattccgagcctgttactaacattcgaaatccacaagtagcttccacttggaatgaagtaaatagtcatagtaatgcacagtgtgtttctaataatagagatgggcgaacagttaattctaattgtgaaattaacaacagatctgctgccaacataagggctctaaacatgcctccttctttagattgtcgatataatagagaaggggaacaggagattcatgttgcacaaggtgaagatgatgaggaggaggaggaagaagcagaagaggagggagtcagtggagcttcattatctagtcacaggagcagtctggttgatgagcatccagaagatgctgaatttgaacagaagatcaaccgacttatggctgcaaaacagaaacttagacagttacaagatcttgttgctatggtacaggatgatgatgcagctcaaggagttatctctgccagtgcatcaaatttggatgatttctacccagcagaagaagacaccaagcaaaattcaaataacactagaggaaatgccaataaaacacagaaagatactggagtaaatgaaaaggcaagagagaaattttatgaggctaaactacagcagcaacagagagagctaaaacaattgcaggaagaaagaaagaaactgattgacattcaggagaaaattcaagcattgcaaacggcatgccctgacttacagctgtcagctgctagtgtgggtaactgtcccaccaaaaaatatatgccagctgttacttcaaccccaactgttaatcaacacgagaccagtacaagcaaatctgtttttgagcctgaagattcttcaatagtagataatgagttgtggtcagaaatgagaagacatgaaatgttgagggaggagctgcgacagagaagaaagcagcttgaagctctgatggctgaacatcagaggaggcaaggtctagctgaaactgcatctccagtggctgtgtcattgagaagtgatggatctgagaacctatgtactcctcagcaaagtagaacagaaaaaacgatggcaacttggggagggtctacccagtgtgcactagatgaagaaggagatgaagacggttacctttctgaaggaattgttcggacagatgaagaggaggaagaagagcaagatgccagttccaatgataacttttctgtgtgtccttctaacagtgtgaatcataactcctacaatggaaaggaaactaaaaataggtggaagaacaattgccctttttcggcagatgaaaattatcgtcctttagccaagacaaggcaacagaatatcagcatgcaacggcaagaaaaccttcgttgggtgtcagagctctcttacgtagaagagaaagaacaatggcaagaacaaatcaatcagctaaagaaacagcttgattttagtgtcagtatttgtcagactttgatgcaagaccagcagactctatcttgtctgctacaaactcttctcacgggtccttacagtgttatgcccagcaatgttgcatctcctcaagtacacttcataatgcaccagttgaaccagtgctatactcagctaacatggcaacagaataatgttcagaggttgaaacaaatgctaaatgaacttatgcgccagcaaaatcagcatccagaaaaacctggaggcaaggaaagaggcagtagtgcatcgcaccctccttctcccagtttattttgtcctttcagctttccaacacagcctgtaaatctcttcaatatacctggatttactaacttttcatcatttgcaccaggtatgaatttcagccctttatttccttctaattttggagatttttctcagaatatctctacacccagtgaacagcagcaacccttagcccagaattcttcaggaaaaacagaatatatggcttttccaaaaccttttgaaagcagttcctctattggagcagagaaaccaaggaataaaaaactgcctgaagaggaggtggaaagcagtaggacaccatggttatatgaacaagaaggtgaagtagagaaaccatttatcaagactggattttcagtgtctgtagaaaaatctacaagtagtaaccgcaaaaatcaattagatacaaacggaagaagacgccagtttgatgaagaatcactggaaagctttagcagtatgcctgatccagtagatccaacaacagtgactaaaacattcaagacaagaaaagcgtctgcacaggccagcctggcatctaaagataaaactcccaagtcaaaaagtaagaagaggaattctactcagctgaaaagcagagttaaaaacatcaggtatgaaagtgccagtatgtctagcacatgtgaaccttgcaaaagtaggaacagacattcagcccagactgaagagcctgttcaagcaaaagtattcagcagaaagaatcatgagcaactggaaaaaataataaaatgtaataggtctacagaaatatcttcagaaactgggagtgatttttccatgtttgaagctttgcgagatactatttattctgaagtagctacattaatttctcaaaatgaatctcgtccacattttcttattgaactcttccatgagctgcagctactaaacacagactacttgagacagagggctttatatgcattgcaggacatagtatccagacatatttctgagagccatgaaaaaggagaaaatgtaaagtcagtaaactctggtacttggatagcatcaaactcagaacttactcctagtgagagccttgctactactgatgatgaaacttttgagaagaactttgaaagagaaacccataaaataagtgagcaaaatgatgctgataatgctagtgtcctgtctgtatcatcaaattttgagccttttgcaacagatgatctaggtaacaccgtgattcacttagatcaagcattagccagaatgagagaatatgagcgtatgaagactgaggctgaaagtaactcaaatatgagatgcacctgcaggattattgaggatggagatggtgctggtgcaggtactacagttaataatttagaagaaactcccgttattgaaaatcgtagttcacaacaacctgtaagtgaagtttctaccatcccatgtcctagaattgatactcagcagctggaccggcaaattaaagcaattatgaaagaagtcattccttttttgaaggagcacatggatgaagtatgctcctcgcagcttctaacttcagtaaggcgcatggttttgacccttacccagcaaaatgatgagagcaaagagtttgtaaagttctttcataaacaacttggaagtatattacaggattcactggcaaaatttgctggcagaaaactgaaagactgtggagaagatcttcttgtagagatatctgaagtgttgttcaatgaattggctttctttaagcttatgcaagatttggataataatagtataactgttaaacagagatgcaaaaggaaaatagaagcaactggagtgatacaatcttgtgccaaagaggctaaaaggattcttgaagatcatggctcacctgctggagagattgatgatgaagacaaagacaaggatgaaactgaaacagttaagcagactcaaacatctgaggtgtatgatggtcccaaaaatgtaagatctgatatttctgatcaagaggaagatgaagaaagtgaaggatgtccagtgtctattaatttgtctaaagctgaaactcaggctttaactaattatggaagtggagaagatgaaaatgaggatgaagaaatggaagaatttgaagaaggccctgtggatgtccagacttccctccaggctaacactgaagctactgaagaaaatgaacatgatgaacaggtcctacaacgtgactttaaaaagacagcagaaagcaaaaatgtcccattggaacgagaagccactagtaaaaatgaccaaaataactgtcctgtgaaaccctgttacctcaatatcttggaagatgagcaacctttaaatagtgctgcccataaggagtcacctcctactgttgattcaactcaacagcctaaccctttgccgttacgtttacctgaaatggaacccttagtgcctagagtcaaagaagttaaatctgctcaggaaactcctgaaagctctctggctggaagtcctgatactgaatctccagtgttagtgaatgactatatttgtctttta

SEQ ID NO: 377 - DNA, 5829 bp, synthetic construct
  misc_feature 1..5829: note = Synthetic polynucleotide
  source 1..5829: mol_type = other DNA
atggccacaggaggaggtccctttgaagatggcatgaatgatcaggatttaccaaactggagtaatgagaatgttgatgacaggctcaacaatatggattggggtgcccaacagaagaaagcaaatagatcatcagaaaagaataagaaaaagtttggtgtagaaagtgataaaagagtaaccaatgatatttctccggagtcgtcaccaggagttggaaggcgaagaacaaagactccacatacgttcccacacagtagatacatgagtcagatgtctgtcccagagcaggcagaattagagaaactgaaacagcggataaacttcagtgatttagatcagagaagcattggaagtgattcccaaggtagagcaacagctgctaacaacaaacgtcagcttagtgaaaaccgaaagcccttcaactttttgcctatgcagattaatactaacaagagcaaagatgcatctacaaaccccccaaacagagaaacgattggatcagcacagtgtaaagagttgtttgcttctgctttaagtaatgacctcttgcaaaactgtcaggtgtctgaagaagatgggaggggagaacctgcaatggagagcagccagattgtaagcaggcttgttcaaattcgcgattatattactaaagctagttccatgcgggaagatcttgtagagaaaaatgagagatctgctaatgttgagcgccttactcatctaatagatcaccttaaagaacaagagaagtcatatatgaaatttcttaaaaaaatccttgccagagatcctcagcaggagcctatggaagagatagaaaatttgaagaaacaacatgatttattaaaaagaatgttacaacagcaggagcaactaagagctctacagggacggcaggctgcacttctagctctgcaacataaagcagagcaagctattgcagtgatggatgattctgttgttgcagaaactgcaggtagcttatctggcgtcagtatcacatctgaactaaatgaagaattgaatgacttaattcagcgttttcataatcagcttcgtgattctcagcctccagctgttccagacaatagaagacaggcagaaagtctttcattaactagggaggtttcccagagcaggaaaccatcagcttcagaacgtttacctgatgagaaagtcgaactttttagcaaaatgagagtgctacaggaaaagaaacaaaaaatggacaaattgcttggagaacttcatacacttcgagatcagcatcttaacaattcatcatcctctccacaaaggagtgtcgatcagagaagtacttcagctccctctgcttctgtaggcttggcaccggttgtcaatggagaatccaatagcctcacatcatctgttccttatcctactgcttctctagtatctcagaatgagagtgaaaacgaaggccacctcaatccatctgaaaaactccagaagttaaatgaagttcgaaagagattgaatgagctaagagaattagttcattattatgaacaaacgtcagacatgatgacagatgctgtgaatgaaaacaggaaagatgaagaaactgaagagtcagaatatgattctgagcatgaaaattccgagcctgttactaacattcgaaatccacaagtagcttccacttggaatgaagtaaatagtcatagtaatgcacagtgtgtttctaataatagagatgggcgaacagttaattctaattgtgaaattaacaacagatctgctgccaacataagggctctaaacatgcctccttctttagattgtcgatataatagagaaggggaacaggagattcatgttgcacaaggtgaagatgatgaggaggaggaggaagaagcagaagaggagggagtcagtggagcttcattatctagtcacaggagcagtctggttgatgagcatccagaagatgctgaatttgaacagaagatcaaccgacttatggctgcaaaacagaaacttagacagttacaagatcttgttgctatggtacaggatgatgatgcagctcaaggagttatctctgccagtgcatcaaatttggatgatttctacccagcagaagaagacaccaagcaaaattcaaataacactagaggaaatgccaataaaacacagaaagatactggagtaaatgaaaaggcaagagagaaattttatgaggctaaactacagcagcaacagagagagctaaaacaattgcaggaagaaagaaagaaactgattgacattcaggagaaaattcaagcattgcaaacggcatgccctgacttacagctgtcagctgctagtgtgggtaactgtcccaccaaaaaatatatgccagctgttacttcaaccccaactgttaatcaacacgagaccagtacaagcaaatctgtttttgagcctgaagattcttcaatagtagataatgagttgtggtcagaaatgagaagacatgaaatgttgagggaggagctgcgacagagaagaaagcagcttgaagctctgatggctgaacatcagaggaggcaaggtctagctgaaactgcatctccagtggctgtgtcattgagaagtgatggatctgagaacctatgtactcctcagcaaagtagaacagaaaaaacgatggcaacttggggagggtctacccagtgtgcactagatgaagaaggagatgaagacggttacctttctgaaggaattgttcggacagatgaagaggaggaagaagagcaagatgccagttccaatgataacttttctgtgtgtccttctaacagtgtgaatcataactcctacaatggaaaggaaactaaaaataggtggaagaacaattgccctttttcggcagatgaaaattatcgtcctttagccaagacaaggcaacagaatatcagcatgcaacggcaagaaaaccttcgttgggtgtcagagctctcttacgtagaagagaaagaacaatggcaagaacaaatcaatcagctaaagaaacagcttgattttagtgtcagtatttgtcagactttgatgcaagaccagcagactctatcttgtctgctacaaactcttctcacgggtccttacagtgttatgcccagcaatgttgcatctcctcaagtacacttcataatgcaccagttgaaccagtgctatactcagctaacatggcaacagaataatgttcagaggttgaaacaaatgctaaatgaacttatgcgccagcaaaatcagcatccagaaaaacctggaggcaaggaaagaggcagtagtgcatcgcaccctccttctcccagtttattttgtcctttcagctttccaacacagcctgtaaatctcttcaatatacctggatttactaacttttcatcatttgcaccaggtatgaatttcagccctttatttccttctaattttggagatttttctcagaatatctctacacccagtgaacagcagcaacccttagcccagaattcttcaggaaaaacagaatatatggcttttccaaaaccttttgaaagcagttcctctattggagcagagaaaccaaggaataaaaaactgcctgaagaggaggtggaaagcagtaggacaccatggttatatgaacaagaaggtgaagtagagaaaccatttatcaagactggattttcagtgtctgtagaaaaatctacaagtagtaaccgcaaaaatcaattagatacaaacggaagaagacgccagtttgatgaagaatcactggaaagctttagcagtatgcctgatccagtagatccaacaacagtgactaaaacattcaagacaagaaaagcgtctgcacaggccagcctggcatctaaagataaaactcccaagtcaaaaagtaagaagaggaattctactcagctgaaaagcagagttaaaaacatcaggtatgaaagtgccagtatgtctagcacatgtgaaccttgcaaaagtaggaacagacattcagcccagactgaagagcctgttcaagcaaaagtattcagcagaaagaatcatgagcaactggaaaaaataataaaatgtaataggtctacagaaatatcttcagaaactgggagtgatttttccatgtttgaagctttgcgagatactatttattctgaagtagctacattaatttctcaaaatgaatctcgtccacattttcttattgaactcttccatgagctgcagctactaaacacagactacttgagacagagggctttatatgcattgcaggacatagtatccagacatatttctgagagccatgaaaaaggagaaaatgtaaagtcagtaaactctggtacttggatagcatcaaactcagaacttactcctagtgagagccttgctactactgatgatgaaacttttgagaagaactttgaaagagaaacccataaaataagtgagcaaaatgatgctgataatgctagtgtcctgtctgtatcatcaaattttgagccttttgcaacagatgatctaggtaacaccgtgattcacttagatcaagcattagccagaatgagagaatatgagcgtatgaagactgaggctgaaagtaactcaaatatgagatgcacctgcaggattattgaggatggagatggtgctggtgcagaaactcccgttattgaaaatcgtagttcacaacaacctgtaagtgaagtttctaccatcccatgtcctagaattgatactcagcagctggaccggcaaattaaagcaattatgaaagaagtcattccttttttgaaggagcacatggatgaagtatgctcctcgcagcttctaacttcagtaaggcgcatggttttgacccttacccagcaaaatgatgagagcaaagagtttgtaaagttctttcataaacaacttggaagtatattacaggattcactggcaaaatttgctggcagaaaactgaaagactgtggagaagatcttcttgtagagatatctgaagtgttgttcaatgaattggctttctttaagcttatgcaagatttggataataatagtataactgttaaacagagatgcaaaaggaaaatagaagcaactggagtgatacaatcttgtgccaaagaggctaaaaggattcttgaagatcatggctcacctgctggagagattgatgatgaagacaaagacaaggatgaaactgaaacagttaagcagactcaaacatctgaggtgtatgatggtcccaaaaatgtaagatctgatatttctgatcaagaggaagatgaagaaagtgaaggatgtccagtgtctattaatttgtctaaagctgaaactcaggctttaactaattatggaagtggagaagatgaaaatgaggatgaagaaatggaagaatttgaagaaggccctgtggatgtccagacttccctccaggctaacactgaagctactgaagaaaatgaacatgatgaacaggtcctacaacgtgactttaaaaagacagcagaaagcaaaaatgtcccattggaacgagaagccactagtaaaaatgaccaaaataactgtcctgtgaaaccctgttacctcaatatcttggaagatgagcaacctttaaatagtgctgcccataaggagtcacctcctactgttgattcaactcaacagcctaaccctttgccgttacgtttacctgaaatggaacccttagtgcctagagtcaaagaagttaaatctgctcaggaaactcctgaaagctctctggctggaagtcctgatactgaatctccagtgttagtgaatgactatatttgtctttta

SEQ ID NO: 378 - DNA, 1950 bp, synthetic construct
  misc_feature 1..1950: note = Synthetic polynucleotide
  source 1..1950: mol_type = other DNA
atgtctagcacatgtgaaccttgcaaaagtaggaacagacattcagcccagactgaagagcctgttcaagcaaaagtattcagcagaaagaatcatgagcaactggaaaaaataataaaatgtaataggtctacagaaatatcttcagcacatgctaggagaatactacagcagtctaacagaaatgcatgcaatgaagcgccagaaactgggagtgatttttccatgtttgaagctttgcgagatactatttattctgaagtagctacattaatttctcaaaatgaatctcgtccacattttcttattgaactcttccatgagctgcagctactaaacacagactacttgagacagagggctttatatgcattgcaggacatagtatccagacatatttctgagagccatgaaaaaggagaaaatgtaaagtcagtaaactctggtacttggatagcatcaaactcagaacttactcctagtgagagccttgctactactgatgatgaaacttttgagaagaactttgaaagagaaacccataaaataagtgagcaaaatgatgctgataatgctagtgtcctgtctgtatcatcaaattttgagccttttgcaacagatgatctaggtaacaccgtgattcacttagatcaagcattagccagaatgagagaatatgagcgtatgaagactgaggctgaaagtaactcaaatatgagatgcacctgcaggattattgaggatggagatggtgctggtgcaggtactacagttaataatttagaagaaactcccgttattgaaaatcgtagttcacaacaacctgtaagtgaagtttctaccatcccatgtcctagaattgatactcagcagctggaccggcaaattaaagcaattatgaaagaagtcattccttttttgaaggagcacatggatgaagtatgctcctcgcagcttctaacttcagtaaggcgcatggttttgacccttacccagcaaaatgatgagagcaaagagtttgtaaagttctttcataaacaacttggaagtatattacaggattcactggcaaaatttgctggcagaaaactgaaagactgtggagaagatcttcttgtagagatatctgaagtgttgttcaatgaattggctttctttaagcttatgcaagatttggataataatagtataactgttaaacagagatgcaaaaggaaaatagaagcaactggagtgatacaatcttgtgccaaagaggctaaaaggattcttgaagatcatggctcacctgctggagagattgatgatgaagacaaagacaaggatgaaactgaaacagttaagcagactcaaacatctgaggtgtatgatggtcccaaaaatgtaagatctgatatttctgatcaagaggaagatgaagaaagtgaaggatgtccagtgtctattaatttgtctaaagctgaaactcaggctttaactaattatggaagtggagaagatgaaaatgaggatgaagaaatggaagaatttgaagaaggccctgtggatgtccagacttccctccaggctaacactgaagctactgaagaaaatgaacatgatgaacaggtcctacaacgtgactttaaaaagacagcagaaagcaaaaatgtcccattggaacgagaagccactagtaaaaatgaccaaaataactgtcctgtgaaaccctgttacctcaatatcttggaagatgagcaacctttaaatagtgctgcccataaggagtcacctcctactgttgattcaactcaacagcctaaccctttgccgttacgtttacctgaaatggaacccttagtgcctagagtcaaagaagttaaatctgctcaggaaactcctgaaagctctctggctggaagtcctgatactgaatctccagtgttagtgaatgactatatttgtctttta

SEQ ID NO: 379 - DNA, 2072 bp, synthetic construct
  misc_feature 1..2072: note = Synthetic polynucleotide
  source 1..2072: mol_type = other DNA
gaaaagcgtctgcacaggccagcctggcatctaaagataaaactcccaagtcaaaaagtaagaagaggaattctactcagctgaaaagcagagttaaaaacatcaggtatgaaagtgccagtatgtctagcacatgtgaaccttgcaaaagtaggaacagacattcagcccagactgaagagcctgttcaagcaaaagtattcagcagaaagaatcatgagcaactggaaaaaataataaaatgtaataggtctacagaaatatcttcagcacatgctaggagaatactacagcagtctaacagaaatgcatgcaatgaagcgccagaaactgggagtgatttttccatgtttgaagctttgcgagatactatttattctgaagtagctacattaatttctcaaaatgaatctcgtccacattttcttattgaactcttccatgagctgcagctactaaacacagactacttgagacagagggctttatatgcattgcaggacatagtatccagacatatttctgagagccatgaaaaaggagaaaatgtaaagtcagtaaactctggtacttggatagcatcaaactcagaacttactcctagtgagagccttgctactactgatgatgaaacttttgagaagaactttgaaagagaaacccataaaataagtgagcaaaatgatgctgataatgctagtgtcctgtctgtatcatcaaattttgagccttttgcaacagatgatctaggtaacaccgtgattcacttagatcaagcattagccagaatgagagaatatgagcgtatgaagactgaggctgaaagtaactcaaatatgagatgcacctgcaggattattgaggatggagatggtgctggtgcaggtactacagttaataatttagaagaaactcccgttattgaaaatcgtagttcacaacaacctgtaagtgaagtttctaccatcccatgtcctagaattgatactcagcagctggaccggcaaattaaagcaattatgaaagaagtcattccttttttgaaggagcacatggatgaagtatgctcctcgcagcttctaacttcagtaaggcgcatggttttgacccttacccagcaaaatgatgagagcaaagagtttgtaaagttctttcataaacaacttggaagtatattacaggattcactggcaaaatttgctggcagaaaactgaaagactgtggagaagatcttcttgtagagatatctgaagtgttgttcaatgaattggctttctttaagcttatgcaagatttggataataatagtataactgttaaacagagatgcaaaaggaaaatagaagcaactggagtgatacaatcttgtgccaaagaggctaaaaggattcttgaagatcatggctcacctgctggagagattgatgatgaagacaaagacaaggatgaaactgaaacagttaagcagactcaaacatctgaggtgtatgatggtcccaaaaatgtaagatctgatatttctgatcaagaggaagatgaagaaagtgaaggatgtccagtgtctattaatttgtctaaagctgaaactcaggctttaactaattatggaagtggagaagatgaaaatgaggatgaagaaatggaagaatttgaagaaggccctgtggatgtccagacttccctccaggctaacactgaagctactgaagaaaatgaacatgatgaacaggtcctacaacgtgactttaaaaagacagcagaaagcaaaaatgtcccattggaacgagaagccactagtaaaaatgaccaaaataactgtcctgtgaaaccctgttacctcaatatcttggaagatgagcaacctttaaatagtgctgcccataaggagtcacctcctactgttgattcaactcaacagcctaaccctttgccgttacgtttacctgaaatggaacccttagtgcctagagtcaaagaagttaaatctgctcaggaaactcctgaaagctctctggctggaagtcctgatactgaatctccagtgttagtgaatgactatatttgtctttta

SEQ ID NO: 380 - DNA, 390 bp, synthetic construct
  misc_feature 1..390: note = Synthetic polynucleotide
  source 1..390: mol_type = other DNA
atgaatagggtcaacgacccacttatttttataagagatattaagcccggactgaaaaacttaaatgtcgtctttattgtcctggagataggacgcgtgaccaaaaccaaagacggccatgaagtgagatcgtgcaaagtagcagataaaacgggcagcatcactatttccgtgtgggatgagatcggaggtcttatacagccaggggatattattcggttgaccagagggtatgcatccatgtggaaaggatgtctgacactttatactggaaggggtggtgaacttcaaaaaattggggaatccacagtgatcgatcaaaagagggactgaatgggagtgggtgaatggatcggtgcaaatccattaccactgctggagaaaccaccc

SEQ ID NO: 381 - DNA, 390 bp, synthetic construct; identical to SEQ ID NO: 380
  misc_feature 1..390: note = Synthetic polynucleotide
  source 1..390: mol_type = other DNA

SEQ ID NO: 382 - DNA, 390 bp, synthetic construct; identical to SEQ ID NO: 380
  misc_feature 1..390: note = Synthetic polynucleotide
  source 1..390: mol_type = other DNA

SEQ ID NO: 383 - DNA, 299 bp, synthetic construct
  misc_feature 1..299: note = Synthetic polynucleotide
  source 1..299: mol_type = other DNA
gacgcgtgaccaaaaccaaagacggccatgaagtgagatcgtgcaaagtagcagataaaacgggcagcatcactatttccgtgtgggatgagatcggaggtcttatacagccaggggatattattcggttgaccagagggtatgcatccatgtggaaaggatgtctgacactttatactggaaggggtggtgaacttcaaaaaattggggaatccacagtgatcgatcaaaagagggactgaatgggagtgggtgaatggatcggtgcaaatccattaccactgctggagaaaccaccc

SEQ ID NO: 384 - DNA, 150 bp, synthetic construct
  misc_feature 1..150: note = Synthetic polynucleotide
  source 1..150: mol_type = other DNA
atgtggaaaggatgtctgacactttatactggaaggggtggtgaacttcaaaaaattggggaatccacagtgatcgatcaaaagagggactgaatgggagtgggtgaatggatcggtgcaaatccattaccactgctggagaaaccaccc

SEQ ID NO: 385 - DNA, 150 bp, synthetic construct; identical to SEQ ID NO: 384
  misc_feature 1..150: note = Synthetic polynucleotide
  source 1..150: mol_type = other DNA

SEQ ID NO: 386 - DNA, 150 bp, synthetic construct; identical to SEQ ID NO: 384
  misc_feature 1..150: note = Synthetic polynucleotide
  source 1..150: mol_type = other DNA

SEQ ID NO: 387 - DNA, 445 bp, synthetic construct
  misc_feature 1..445: note = Synthetic polynucleotide
  source 1..445: mol_type = other DNA
atggacccccttggggacacgctgcggcgactgcgggaggccttccacgcggggcgcacgcggccagctgagttccgggctgcgcagctccaaggcctgggccgcttcctgcaagaaaacaagcagcttctgcacgacgcactggcccaggacctgcacaagtcagccttcgagtcggaggtgtctgaggttgccatcagccagggcgaggtcaccctggccctcaggaaccgggcctggatgaaggacgagcgtgtgcccaagaacctggccacgcagctggactccgccttcatccggaaggagccctttggcctggtcctcatcattgcgccctggaactatccgctgaacctgacgctggtgcccctcgtgggagccctcgctgcaggttctgcatctgaaagtgggtgaggctgatgcctgccctgcaggtgtgtggaga

SEQ ID NO: 388 - DNA, 445 bp, synthetic construct; identical to SEQ ID NO: 387
  misc_feature 1..445: note = Synthetic polynucleotide
  source 1..445: mol_type = other DNA

SEQ ID NO: 389 - DNA, 445 bp, synthetic construct; identical to SEQ ID NO: 387
  misc_feature 1..445: note = Synthetic polynucleotide
  source 1..445: mol_type = other DNA

SEQ ID NO: 390 - DNA, 337 bp, synthetic construct
  misc_feature 1..337: note = Synthetic polynucleotide
  source 1..337: mol_type = other DNA
atggacccccttggggacacgctgcggcgactgcgggaggccttccacgcggggcgcacgcggccagctgagttccgggctgcgcagctccaaggcctgggccgcttcctgcaagaaaacaagcagcttctgcacgacgcactggcccaggacctgcacaaggccacgcagctggactccgccttcatccggaaggagccctttggcctggtcctcatcattgcgccctggaactatccgctgaacctgacgctggtgcccctcgtgggagccctcgctgcaggttctgcatctgaaagtgggtgaggctgatgcctgccctgcaggtgtgtggaga

SEQ ID NO: 391 - DNA, 910 bp, synthetic construct
  misc_feature 1..910: note = Synthetic polynucleotide
  source 1..910: mol_type = other DNA
atggctgaagataaagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgttgagggagaagacttgcaacaagaagatggacccacaggagaaccacaacaagaggatgatgagtttcttatggcgactgatgtagatgatagatttgagaccctggaacctgaagtatctcatgaagaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccaggaggaccagtcttcagtcaagggtatatgagtagcacccctgctggaacctccaaacaagatc

SEQ ID NO: 392 - DNA, 997 bp, synthetic construct
  misc_feature 1..997: note = Synthetic polynucleotide
  source 1..997: mol_type = other DNA
atggcccagcgtaagaatgccaagagcagcggcaacagcagcagcagcggctccggcagcggtagcacgagtgcgggcagcagcagccccggggcccggagagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgttgagggagaagacttgcaacaagaagatggacccacaggagaaccacaacaagaggatgatgagtttcttatggcgactgatgtagatgatagatttgagaccctggaacctgaagtatctcatgaagaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccaggaggaccagtcttcagtcaagggtatatgagtagcacccctgctggaacctccaaacaagatc

SEQ ID NO: 393 - DNA, 436 bp, synthetic construct
  misc_feature 1..436: note = Synthetic polynucleotide
  source 1..436: mol_type = other DNA
atggcgactgatgtagatgatagatttgagaccctggaacctgaagtatctcatgaagaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccaggaggaccagtcttcagtcaagggtatatgagtagcacccctgctggaacctccaaacaagatc

SEQ ID NO: 394 - DNA, 997 bp, synthetic construct; identical to SEQ ID NO: 392
  misc_feature 1..997: note = Synthetic polynucleotide
  source 1..997: mol_type = other DNA

SEQ ID NO: 395 - DNA, 1039 bp, synthetic construct
  misc_feature 1..1039: note = Synthetic polynucleotide
  source 1..1039: mol_type = other DNA
atggcccagcgtaagaatgccaagagcagcggcaacagcagcagcagcggctccggcagcggtagcacgagtgcgggcagcagcagccccggggcccggagagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctagccaaagcaaaggacttccgttataacttatcagaggtgcttcaaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgttgagggagaagacttgcaacaagaagatggacccacaggagaaccacaacaagaggatgatgagtttcttatggcgactgatgtagatgatagatttgagaccctggaacctgaagtatctcatgaagaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccaggaggaccagtcttcagtcaagggtatatgagtagcacccctgctggaacctccaaacaagatc

SEQ ID NO: 396 - DNA, 868 bp, synthetic construct
  misc_feature 1..868: note = Synthetic polynucleotide
  source 1..868: mol_type = other DNA
atggcccagcgtaagaatgccaagagcagcggcaacagcagcagcagcggctccggcagcggtagcacgagtgcgggcagcagcagccccggggcccggagagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccaggaggaccagtcttcagtcaagggtatatgagtagcacccctgctggaacctccaaacaagatc

SEQ ID NO: 397 - DNA, 952 bp, synthetic construct
  misc_feature 1..952: note = Synthetic polynucleotide
  source 1..952: mol_type = other DNA
atggctgaagataaagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctagccaaagcaaaggacttccgttataacttatcagaggtgcttcaaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgttgagggagaagacttgcaacaagaagatggacccacaggagaaccacaacaagaggatgatgagtttcttatggcgactgatgtagatgatagatttgagaccctggaacctgaagtatctcatgaagaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccaggaggaccagtcttcagtcaagggtatatgagtagcacccctgctggaacctccaaacaagatc

SEQ ID NO: 398 - DNA, 955 bp, synthetic construct
  misc_feature 1..955: note = Synthetic polynucleotide
  source 1..955: mol_type = other DNA
atggctgaagataaagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctagccaaagcaaaggacttccgttataacttatcagaggtgcttcaaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgttgagggagaagacttgcaacaagaagatggacccacaggagaaccacaacaagaggatgatgagtttcttatggcgactgatgtagatgatagatttgagaccctggaacctgaagtatctcatgaagaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccaggaggaccagtcttcagtcaagggtatatgagtagcacccctgctggaacctccaaacaagatc

SEQ ID NO: 399 - DNA, 955 bp, synthetic construct; identical to SEQ ID NO: 398
  misc_feature 1..955: note = Synthetic polynucleotide
  source 1..955: mol_type = other DNA

SEQ ID NO: 400 - DNA, 826 bp, synthetic construct
  misc_feature 1..826: note = Synthetic polynucleotide
  source 1..826: mol_type = other DNA
atggctgaagataaagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctagccaaagcaaaggacttccgttataacttatcagaggtgcttcaaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccaggaggaccagtcttcagtcaagggtatatgagtagcacccctgctggaacctccaaacaagatc

SEQ ID NO: 401 - DNA, 586 bp, synthetic construct
  misc_feature 1..586: note = Synthetic polynucleotide
  source 1..586: mol_type = other DNA
atggacgtgactgaccattatgaggacgttaggaagatttatgatgatttcttgaagaacagtaatatgttagatctgattgatgtttatcaaaaatgtagggctttgacttctaattgtgaaaattataacacagtatctcctagtcaactactggattttctgtctggcaaacagtatgcagtaggtgatgaaactgatctttctataccaacatcaccaacaagtaaatacaaccgtgataatgaaaaggccctcccagtcctgaagagataactgagagtctagcaccttttaataggaagcatttgccatctattgtttctaagggtggccacctatgagacgtcatctacataataagaaccttggtcttcacaatcccatatcttaaaccagagactcctttctactgattccaggtctttagataataattctttcaaccaattgcttgccaatcagaaaatctttgaatctacctatgacctataagccccatttcaaggtgtcccacctttccaggctgaaccaatctttacctcacatgtactgattgatgtcttatgtctctctaaaacatata

SEQ ID NO: 402 - DNA, 829 bp, synthetic construct
  misc_feature 1..829: note = Synthetic polynucleotide
  source 1..829: mol_type = other DNA
atggctgtgtttaatcagaagtctgtctcggatatgattaaagagtttcgaaaaaattggcgtgctctttgtaactctgagagaactactctatgtggtgcagactccatgctcttggcattgcagctttctatggcggagaacaacaaacagcacagtggagaatttacagtctctctcagtgatgttttattgacatggaaatacttgctccatgagaaattgaacttaccagttgaaaacatggacgtgactgaccattatgaggacgttaggaagatttatgatgatttcttgaagaacagtaatatgttagatctgattgatgtttatcaaaaatgtagggctttgacttctaattgtgaaaattataacacagtatctcctagtcaactactggattttctgtctggcaaacagtatgcagtaggtgatgaaactgatctttctataccaacatcaccaacaagtaaatacaaccgtgataatgaaaaggccctcccagtcctgaagagataactgagagtctagcaccttttaataggaagcatttgccatctattgtttctaagggtggccacctatgagacgtcatctacataataagaaccttggtcttcacaatcccatatcttaaaccagagactcctttctactgattccaggtctttagataataattctttcaaccaattgcttgccaatcagaaaatctttgaatctacctatgacctataagccccatttcaaggtgtcccacctttccaggctgaaccaatctttacctcacatgtactgattgatgtcttatgtctctctaaaacatata

SEQ ID NO: 403 - DNA, 1060 bp, synthetic construct
  misc_feature 1..1060: note = Synthetic polynucleotide
  source 1..1060: mol_type = other DNA
atggctgtgtttaatcagaagtctgtctcggatatgattaaagagtttcgaaaaaattggcgtgctctttgtaactctgagagaactactctatgtggtgcagactccatgctcttggcattgcagctttctatggcggagaacaacaaacagcacagtggagaatttacagtctctctcagtgatgttttattgacatggaaatacttgctccatgagaaattgaacttaccagttgaaaacatggacgtgactgaccattatgaggacgttaggaagatttatgatgatttcttgaagaacagtaatatgttagatctgattgatgtttatcaaaaatgtagggctttgacttctaattgtgaaaattataacacagtatctcctgggtcaactatacagccaccttcagaaagaggaagcttgctgctgtctaggccagatctcttggctcctggggaagatccaccagtgtcagcctcattgactctggagcggcagaagggagagtccctcttagcatggagctggtccctaaacttcagattgcctgggattcccatcacggtccagaagaagagacgagacctgaagaagctggcagctgtcatgcggcaaagtcaactactggattttctgtctggcaaacagtatgcagtaggtgatgaaactgatctttctataccaacatcaccaacaagtaaatacaaccgtgataatgaaaaggccctcccagtcctgaagagataactgagagtctagcaccttttaataggaagcatttgccatctattgtttctaagggtggccacctatgagacgtcatctacataataagaaccttggtcttcacaatcccatatcttaaaccagagactcctttctactgattccaggtctttagataataattctttcaaccaattgcttgccaatcagaaaatctttgaatctacctatgacctataagccccatttcaaggtgtcccacctttccaggctgaaccaatctttacctcacatgtactgattgatgtcttatgtctctctaaaacatata

SEQ ID NO: 404 - DNA, 829 bp, synthetic construct; identical to SEQ ID NO: 402
  misc_feature 1..829: note = Synthetic polynucleotide
  source 1..829: mol_type = other DNA

SEQ ID NO: 405 - DNA, 586 bp, synthetic construct; identical to SEQ ID NO: 401
  misc_feature 1..586: note = Synthetic polynucleotide
  source 1..586: mol_type = other DNA

SEQ ID NO: 406 - DNA, 730 bp, synthetic construct
  misc_feature 1..730: note = Synthetic polynucleotide
  source 1..730: mol_type = other DNA
gcagactccatgctcttggcattgcagctttctatggcggagaacaacaaacagcacagtggagaatttacagtctctctcagtgatgttttattgacatggaaatacttgctccatgagaaattgaacttaccagttgaaaacatggacgtgactgaccattatgaggacgttaggaagatttatgatgatttcttgaagaacagtaatatgttagatctgattgatgtttatcaaaaatgtagggctttgacttctaattgtgaaaattataacacagtatctcctagtcaactactggattttctgtctggcaaacagtatgcagtaggtgatgaaactgatctttctataccaacatcaccaacaagtaaatacaaccgtgataatgaaaaggccctcccagtcctgaagagataactgagagtctagcaccttttaataggaagcatttgccatctattgtttctaagggtggccacctatgagacgtcatctacataataagaaccttggtcttcacaatcccatatcttaaaccagagactcctttctactgattccaggtctttagataataattctttcaaccaattgcttgccaatcagaaaatctttgaatctacctatgacctataagccccatttcaaggtgtcccacctttccaggctgaaccaatctttacctcacatgtactgattgatgtcttatgtctctctaaaacatata

SEQ ID NO: 407 - DNA, 730 bp, synthetic construct; identical to SEQ ID NO: 406
  misc_feature 1..730: note = Synthetic polynucleotide
  source 1..730: mol_type = other DNA

SEQ ID NO: 408 - DNA, 496 bp, synthetic construct
  misc_feature 1..496: note = Synthetic polynucleotide
  source 1..496: mol_type = other DNA
gcagactccatgctcttggcattgcagctttctatggcggagaacaacaaacagagtcaactactggattttctgtctggcaaacagtatgcagtaggtgatgaaactgatctttctataccaacatcaccaacaagtaaatacaaccgtgataatgaaaaggccctcccagtcctgaagagataactgagagtctagcaccttttaataggaagcatttgccatctattgtttctaagggtggccacctatgagacgtcatctacataataagaaccttggtcttcacaatcccatatcttaaaccagagactcctttctactgattccaggtctttagataataattctttcaaccaattgcttgccaatcagaaaatctttgaatctacctatgacctataagccccatttcaaggtgtcccacctttccaggctgaaccaatctttacctcacatgtactgattgatgtcttatgtctctctaaaacatata

SEQ ID NO: 409 - DNA, 441 bp, synthetic construct
  misc_feature 1..441: note = Synthetic polynucleotide
  source 1..441: mol_type = other DNA
atgcccgccggccgccggggccccgccgcccaatccgcgcggcggccgccgccgttgctgcccctgctgctgctgctctgcgtcctcggggcgccgcgagccggatcaggagcccacacagctgtgatcagtccccaggatcccacgcttctcatcggctcctccctgctggccacctgctcagtgcacggagacccaccaggagccaccgccgagggcctctactggaccctcaacgggcgccgcctgccccctgagctctcccgtgtactcaacgcctccaccttggctctggccctggccaacctcaatgggtccaggcagcggtcgggggacaacctcgtgtgccacgcccgtgacggcagcatcctggctggctcctgcctctatgttggcccctgggggacagagcgagactttgcctcgaaaaaagaaaaagaa

SEQ ID NO: 410 - DNA, 392 bp, synthetic construct
  misc_feature 1..392: note = Synthetic polynucleotide
  source 1..392: mol_type = other DNA
atgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagaa

SEQ ID NO: 411 - DNA, 392 bp, synthetic construct; identical to SEQ ID NO: 410
  misc_feature 1..392: note = Synthetic polynucleotide
  source 1..392: mol_type = other DNA

SEQ ID NO: 412 - DNA, 392 bp, synthetic construct; identical to SEQ ID NO: 410
  misc_feature 1..392: note = Synthetic polynucleotide
  source 1..392: mol_type = other DNA

SEQ ID NO: 413 - DNA, 392 bp, synthetic construct; identical to SEQ ID NO: 410
  misc_feature 1..392: note = Synthetic polynucleotide
  source 1..392: mol_type = other DNA

SEQ ID NO: 414 - DNA, 721 bp, synthetic construct
  misc_feature 1..721: note = Synthetic polynucleotide
  source 1..721: mol_type = other DNA
atggccgacgacgacgtgctgttcgaggatgtgtacgagctgtgcgaggtgatcggaaagggtcccttcagtgttgtacgacgatgtatcaacagagaaactgggcaacaatttgctgtaaaaattgttgatgtagccaagttcacatcaagtccagggttaagtacagaagatctaaagcgggaagccagtatctgtcatatgctgaaacatccacacattgtagagttattggagacatatagctcagatggaatgctttacatggttttcgaatttatggatggagcagatctgtgttttgaaatcgtaaagcgagctgacgctggttttgtgtacagtgaagctgtagccagccattatatgagacagatactggaagctctacgctactgccatgataataacataattcacagggatgtgaaggcgcggtggctcatgcctgtaatcccagcactttgggaggctgaggcaggtggatcaccctgaggtcaggagttcgagaccagcctggccaacatatgaaaccccgtctctactaaaaatccaaaaagtagccgggcgtggtggcatgcgcctgtaatcccagctactcgggaggctgagacaggagaatcacttgaacgtgggaggtggaggttgcagtgagccaagatcaggccactgcactccagcctgggcaataagagtgaaactctgtctcaaaaaaaaaaaagaa

SEQ ID NO: 415 - DNA, 721 bp, synthetic construct; identical to SEQ ID NO: 414
  misc_feature 1..721: note = Synthetic polynucleotide
  source 1..721: mol_type = other DNA

SEQ ID NO: 416 - DNA, 721 bp, synthetic construct; identical to SEQ ID NO: 414
  misc_feature 1..721: note = Synthetic polynucleotide
  source 1..721: mol_type = other DNA

SEQ ID NO: 417 - DNA, 721 bp, synthetic construct; identical to SEQ ID NO: 414
  misc_feature 1..721: note = Synthetic polynucleotide
  source 1..721: mol_type = other DNA

SEQ ID NO: 418 - DNA, 721 bp, synthetic construct; identical to SEQ ID NO: 414
  misc_feature 1..721: note = Synthetic polynucleotide
  source 1..721: mol_type = other DNA

SEQ ID NO: 419 - DNA, 721 bp, synthetic construct; identical to SEQ ID NO: 414
  misc_feature 1..721: note = Synthetic polynucleotide
  source 1..721: mol_type = other DNA

SEQ ID NO: 420 - DNA, 721 bp, synthetic construct; identical to SEQ ID NO: 414
  misc_feature 1..721: note = Synthetic polynucleotide
  source 1..721: mol_type = other DNA

SEQ ID NO: 421 - DNA, 721 bp, synthetic construct; identical to SEQ ID NO: 414
  misc_feature 1..721: note = Synthetic polynucleotide
  source 1..721: mol_type = other DNA

SEQ ID NO: 422 - DNA, 1332 bp, synthetic construct
  misc_feature 1..1332: note = Synthetic polynucleotide
  source 1..1332: mol_type = other DNA
atggattcgaaataccagtgtgtgaagctgaatgatggtcacttcatgcctgtcctgggatttggcacctatgcgcctgcagaggttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgtgccacatgggaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggaaatacatttcataagtctacagctaccatggtgacttgtctgaagaacctgggaaaagaaaattgaaaatcttctgaaaaagatttactattctagatgccattaaaaacattcatgattcgtgacaggagggcaaaacatttacttgaacaggagtttgaaagaagtgaattcaaccctcctggatgacttggaggaatgcaagatttcagtggagaaagtaattgcagatgtggtggaaatagcaagacaactagaattcaaattggagcttgcaagttactgaatgcttgcaatctcatgatgtaattttaacaaaggagaagtgtttcttatggatgagcaagaaaagtggtttggtgaaatggatttcatttcttaggaaaccgttgtaaacactgttggaaaggcagcgaaggattcagaatattacagaagcatagttgataaggccatgacagtgtttgagagaattctctctaat

SEQ ID NO: 423 - DNA, 1254 bp, synthetic construct
  misc_feature 1..1254: note = Synthetic polynucleotide
  source 1..1254: mol_type = other DNA
atggattcgaaataccagtgtgtgaagctgaatgatggtcacttcatgcctgtcctgggatttggcacctatgcgcctgcagaggttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggaaatacatttcataagtctacagctaccatggtgacttgtctgaagaacctgggaaaagaaaattgaaaatcttctgaaaaagatttactattctagatgccattaaaaacattcatgattcgtgacaggagggcaaaacatttacttgaacaggagtttgaaagaagtgaattcaaccctcctggatgacttggaggaatgcaagatttcagtggagaaagtaattgcagatgtggtggaaatagcaagacaactagaattcaaattggagcttgcaagttactgaatgcttgcaatctcatgatgtaattttaacaaaggagaagtgtttcttatggatgagcaagaaaagtggtttggtgaaatggatttcatttcttaggaaaccgttgtaaacactgttggaaaggcagcgaaggattcagaatattacagaagcatagttgataaggccatgacagtgtttgagagaattctctctaat

SEQ ID NO: 424 - DNA, 1332 bp, synthetic construct; identical to SEQ ID NO: 422
  misc_feature 1..1332: note = Synthetic polynucleotide
  source 1..1332: mol_type = other DNA

SEQ ID NO: 425 - DNA, 1290 bp, synthetic construct
  misc_feature 1..1290: note = Synthetic polynucleotide
  source 1..1290: mol_type = other DNA
atggcggcgaacgtgttcccgttccgcgacgcccgtgccgcaccggacccagtgctggaggccggcccggtggcacacgggccactgccggtaccgctggtgctggacaacgggtcgttccaagtccgcgctggctgggcgtgtcccgggcaggacccaggtcccgagccgcgcctgcagttccgcgcggtgtgcgcccgcggtcgtggcggggcacggggcgcgtcgggcccgcaggtggggaacgctctgggcagcctggagccactgcgctggatgctgcgctcgcccttcgaccgcaacgtgccggtcaacctggagcttcaggagttgctgctggactacagcttccagcacctgggtgtctcctcacagggctgtgttgatcatcccatagttttgacagaagctgtgtgcaacccactgtattcacggcaaatgatgtctgagcttctttttgagtgctacgggattcccaaggttgcctatggaatagacagcctcttcagcttctaccacaataagccaaagaactcgatgtgcagtgggctaatcatttcatctggataccagtgtacgcatgttttacccatcttagaagggagattagatgctaaaaactgcaagcgcatcaatcttggaggaagccaagcagctggttacctccagcgtctcctccagctgaagtaccctgggcacctggcagccatcaccctcagccgcatggaggagattctgcatgagcacagctacatcgctgaggattatgtggaagaattacacaaatggcggtgtcctgattattatgagaataatgtccacaagatgcagctcccattttccagcaagctcctgggcagcactctgacctctgaggagaaacaagaaaggcggcagcagcaattgcggcggctgcaggagctcaatgcccggcggcgggaggagaagctgcagctggatcaggagcgtctggaccgactgctatatgtgcaggaacttctagaggatggccagatggatcagtttcacaaagctctgatagagctgaatatggactccccagaagagctgcagtcctacatccagaagctcagtatagcagtggagcaggctaagcagaaaatcctccaagcggaagtcaacctcgaggtggatgtggtagacagcaagccagagctgcatgcttggtcgaagaggacgaccatccccaatagaggaggactgatcttccgtcaagagtatacgagtagctgcgctcccctgctagaacctccaaacaagcgctcaagg

SEQ ID NO: 426 - DNA, 569 bp, synthetic construct
  misc_feature 1..569: note = Synthetic polynucleotide
  source 1..569: mol_type = other DNA
atgttttgtggagactatgtgcaaggaaccatcttcccagctcccaatttcaatcccataatggatgcccaaatgctaggaggagcactccaaggatttgactgtgacaaagacatgctgatcaacattctgactcagcgctgcaatgcacaaaggatgatgattgcagaggcataccagagcatgtatggccgggacctgattggggatatgagggagcagctttcggatcacttcaaagatgtgatggctggcctcatgtacccaccaccactgtatgatgctcatgagctctggcatgccatgaagggagtaggcactgatgagaattgcctcattgaaatactagcttcaagaacaaatggagaaattttccagatgcgagaagcctactgcttgcaatacagcaataacctccaagaggacatttattcagagacctcaggacacttcagagatactctcatgaacttggtccaggtgttgatcccaagaacattccataattaacaggctggatgccgatctccgtctcaaagtcatcttcccaggaaacccaactggcaata

SEQ ID NO: 427 - DNA, 247 bp, synthetic construct
  misc_feature 1..247: note = Synthetic polynucleotide
  source 1..247: mol_type = other DNA
atggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaactcatgatttatgaggaaaataatcgactgaaaatcttccttaagaagc

SEQ ID NO: 428 - DNA, 3308 bp, synthetic construct
  misc_feature 1..3308: note = Synthetic polynucleotide
  source 1..3308: mol_type = other DNA
atgcagcggcgcggcgcggggctcgggtggccgcggcagcagcagcagcaacccccgccgctcgcggtcggcccccgggccgcagccatggtcccgagtggcggcgtcccccagggcctcggcggccgctctgcctgcgcgctgctcctgctctgctacctgaatgttgtaccatctttgggtaggcagacttccctgacgacatcagtgatacccaaagctgagcagagcgtggcttacaaagactttatttattttactgtctttgaaggaaacgttcgcaacgtttctgaagtctcggttgagtatttatgctctcagccttgtgttgtcaatttggaagcagttgtttcatctgagttcagaagtagcattcccgtgtacaaaaaaaggtggaagaatgagaaacatcttcacaccagcaggacacaaatagtacatgtgaaatttccaagcattatggtttacagagatgattatttcatcagacattccatctctgtatctgcagtgatagtacgcgcctggattactcacaaatacagtggcagagactggaatgttaaatgggaggaaaacttgctccatgctgtagcaaagaattataccctcctgcagaccatcccgccttttgaacgccctttcaaagatcatcaagtgtgccttgagtggaacatgggttatatttggaaccttcgggcaaacaggattccacagtgtcctctggaaaatgatgtggttgccctgcttggctttccttatgcctccagtggagaaaacacaggcattgtcaagaagttcccgaggtttcggaaccgagagctggaggccactcgacgccagaggatggattacccagtgtttactgtttcattgtggctttatttactccattattgcaaggccaacctctgtgggattctgtactttgttgactctaatgagatgtacggcacaccttctgtatttcttacggaagagggctatttgcatattcagatgcatcttgtcaaaggggaagaccttgctgtaaaaactaaattcatcatacctttgaaggagtggtttcgactggatatctcttttaacggaggccagatagtagtaaccactagcattggacaggatttgaaaagctaccacaatcagaccattagcttccgggaggatttccattataatgacacagctgggtacttcattattggagggagcaggtatgtggctggcattgaagggttttttggacccctgaagtactatcgccttcgcagtctgcaccccgcccagatttttaatcccctccttgagaagcaacttgctgaacaaatcaagttatattatgaaaggtgtgctgaggttcaagaaatagtatctgtgtatgcatctgcagcaaagcacgggggcgagagacaagaagcatgccacctccacaactcctacctggacctccagcgcaggtatgggagaccctcgatgtgcagagccttcccctgggagaaggagctgaaagacaaacaccccagcttgttccaggcattgctggagatggatctgctgaccgtgccaaggaaccaaaatgaatctgtatcagaaatcggtgggaagatatttgagaaggctgtaaagagactctctagcattgatggtcttcaccaaattagctctatcgtcccctttctgacggattccagctgctgtggataccataaagcatcctactaccttgcagtcttttatgagactggattaaatgttcctcgggatcagctgcagggcatgttgtatagtttggttggaggccaggggagtgagaggctgtcttcaatgaatcttgggtataaacactaccagggtattgacaactaccccctggactgggaactgtcgtatgcctactacagcaacattgccaccaagacaccccttgaccagcacacactgcaaggagatcaggcatatgttgaaacaattagactaaaagatgatgaaatactcaaggtacaaaccaaagaagatggagatgtctttatgtggttgaagcatgaagctacccgaggcaatgcagcagctcagcaacgattggcccagatgctgttctgggggcagcaaggtgtggccaagaatcccgaagcagcaattgagtggtacgccaagggcgccctggagacggaggatcctgcgttaatctatgactatgccattgtgctattcaagggtcaaggagtaaaaaagaacagacggcttgccttagagctgatgaagaaagcagcttccaagggattgcatcaggcagtcaatggcctgggatggtattaccacaaattcaagaaaaattacgccaaagcagcaaagtactggttaaaagcagaagaaatggggaacccagatgcgtcatacaatcttggagtcctgcatttggatggcatcttccctggagttcctggaaggaatcaaactttagctggtgaatatttccataaggctgcgcaaggtggacacatggaagggaccttgtggtgttctctctactatatcacaggcaacctggagacattccctagagatcctgagaaagctgttgtatgggcaaaacatgtagctgagaaaaatggctacttgggccatgtcatccgcaaaggcctcaatgcctacctggaaggttcatggcatgaagctttgctgtattatgttttagcagcagaaactggaattgaagtgtcacagacaaatttagcacacatctgtgaggagaggccagacctggccaggagatacttgggtgttaactgtgtttggagatactataatttctctgtttttcaaatcgatgctccttcctttgcatatttgaagatgggagacctttactactatggccaccaaaaccagtcacaagacctggagttgtctgtgcagatgtacgcccaagccgccctggatggagactcccagggattttttaacctggccctgctaatcgaggaaggtacgataatcccacaccatatcttggatttcttggaaattgactcaactctccattctaataacatctccattctccaggaactgtacgaaaggtgctggagccacagtaacgaggagtccttcagcccctgctccttggcctggctttacctgcacttgcggcttctctggggtgctatcctgcactcagccctgatctactttctgggaacctttctgctatccatattgatcgcctggactgtgcagtatttccagtctgtctcagacccccaggaacaaaatataacagagtagtgtaaaagtttgtcctctcc

SEQ ID NO: 429 - DNA, 3203 bp, synthetic construct
  misc_feature 1..3203: note = Synthetic polynucleotide
  source 1..3203: mol_type = other DNA
atggcgccccggccaaaaaagcaaccagacaaaaacccattgcacgggcgggaactgaatgttgtaccatctttgggtaggcagacttccctgacgacatcagtgatacccaaagctgagcagagcgtggcttacaaagactttatttattttactgtctttgaaggaaacgttcgcaacgtttctgaagtctcggttgagtatttatgctctcagccttgtgttgtcaatttggaagcagttgtttcatctgagttcagaagtagcattcccgtgtacaaaaaaaggtggaagaatgagaaacatcttcacaccagcaggacacaaatagtacatgtgaaatttccaagcattatggtttacagagatgattatttcatcagacattccatctctgtatctgcagtgatagtacgcgcctggattactcacaaatacagtggcagagactggaatgttaaatgggaggaaaacttgctccatgctgtagcaaagaattataccctcctgcagaccatcccgccttttgaacgccctttcaaagatcatcaagtgtgccttgagtggaacatgggttatatttggaaccttcgggcaaacaggattccacagtgtcctctggaaaatgatgtggttgccctgcttggctttccttatgcctccagtggagaaaacacaggcattgtcaagaagttcccgaggtttcggaaccgagagctggaggccactcgacgccagaggatggattacccagtgtttactgtttcattgtggctttatttactccattattgcaaggccaacctctgtgggattctgtactttgttgactctaatgagatgtacggcacaccttctgtatttcttacggaagagggctatttgcatattcagatgcatcttgtcaaaggggaagaccttgctgtaaaaactaaattcatcatacctttgaaggagtggtttcgactggatatctcttttaacggaggccagatagtagtaaccactagcattggacaggatttgaaaagctaccacaatcagaccattagcttccgggaggatttccattataatgacacagctgggtacttcattattggagggagcaggtatgtggctggcattgaagggttttttggacccctgaagtactatcgccttcgcagtctgcaccccgcccagatttttaatcccctccttgagaagcaacttgctgaacaaatcaagttatattatgaaaggtgtgctgaggttcaagaaatagtatctgtgtatgcatctgcagcaaagcacgggggcgagagacaagaagcatgccacctccacaactcctacctggacctccagcgcaggtatgggagaccctcgatgtgcagagccttcccctgggagaaggagctgaaagacaaacaccccagcttgttccaggcattgctggagatggatctgctgaccgtgccaaggaaccaaaatgaatctgtatcagaaatcggtgggaagatatttgagaaggctgtaaagagactctctagcattgatggtcttcaccaaattagctctatcgtcccctttctgacggattccagctgctgtggataccataaagcatcctactaccttgcagtcttttatgagactggattaaatgttcctcgggatcagctgcagggcatgttgtatagtttggttggaggccaggggagtgagaggctgtcttcaatgaatcttgggtataaacactaccagggtattgacaactaccccctggactgggaactgtcgtatgcctactacagcaacattgccaccaagacaccccttgaccagcacacactgcaaggagatcaggcatatgttgaaacaattagactaaaagatgatgaaatactcaaggtacaaaccaaagaagatggagatgtctttatgtggttgaagcatgaagctacccgaggcaatgcagcagctcagcaacgattggcccagatgctgttctgggggcagcaaggtgtggccaagaatcccgaagcagcaattgagtggtacgccaagggcgccctggagacggaggatcctgcgttaatctatgactatgccattgtgctattcaagggtcaaggagtaaaaaagaacagacggcttgccttagagctgatgaagaaagcagcttccaagggattgcatcaggcagtcaatggcctgggatggtattaccacaaattcaagaaaaattacgccaaagcagcaaagtactggttaaaagcagaagaaatggggaacccagatgcgtcatacaatcttggagtcctgcatttggatggcatcttccctggagttcctggaaggaatcaaactttagctggtgaatatttccataaggctgcgcaaggtggacacatggaagggaccttgtggtgttctctctactatatcacaggcaacctggagacattccctagagatcctgagaaagctgttgtatgggcaaaacatgtagctgagaaaaatggctacttgggccatgtcatccgcaaaggcctcaatgcctacctggaaggttcatggcatgaagctttgctgtattatgttttagcagcagaaactggaattgaagtgtcacagacaaatttagcacacatctgtgaggagaggccagacctggccaggagatacttgggtgttaactgtgtttggagatactataatttctctgtttttcaaatcgatgctccttcctttgcatatttgaagatgggagacctttactactatggccaccaaaaccagtcacaagacctggagttgtctgtgcagatgtacgcccaagccgccctggatggagactcccagggattttttaacctggccctgctaatcgaggaaggtacgataatcccacaccatatcttggatttcttggaaattgactcaactctccattctaataacatctccattctccaggaactgtacgaaaggtgctggagccacagtaacgaggagtccttcagcccctgctccttggcctggctttacctgcacttgcggcttctctggggtgctatcctgcactcagccctgatctactttctgggaacctttctgctatccatattgatcgcctggactgtgcagtatttccagtctgtctcagacccccaggaacaaaatataacagagtagtgtaaaagtttgtcctctcc

SEQ ID NO: 430 - DNA, 2849 bp, synthetic construct
  misc_feature 1..2849: note = Synthetic polynucleotide
  source 1..2849: mol_type = other DNA
atggtttacagagatgattatttcatcagacattccatctctgtatctgcagtgatagtacgcgcctggattactcacaaatacagtggcagagactggaatgttaaatgggaggaaaacttgctccatgctgtagcaaagaattataccctcctgcagaccatcccgccttttgaacgccctttcaaagatcatcaagtgtgccttgagtggaacatgggttatatttggaaccttcgggcaaacaggattccacagtgtcctctggaaaatgatgtggttgccctgcttggctttccttatgcctccagtggagaaaacacaggcattgtcaagaagttcccgaggtttcggaaccgagagctggaggccactcgacgccagaggatggattacccagtgtttactgtttcattgtggctttatttactccattattgcaaggccaacctctgtgggattctgtactttgttgactctaatgagatgtacggcacaccttctgtatttcttacggaagagggctatttgcatattcagatgcatcttgtcaaaggggaagaccttgctgtaaaaactaaattcatcatacctttgaaggagtggtttcgactggatatctcttttaacggaggccagatagtagtaaccactagcattggacaggatttgaaaagctaccacaatcagaccattagcttccgggaggatttccattataatgacacagctgggtacttcattattggagggagcaggtatgtggctggcattgaagggttttttggacccctgaagtactatcgccttcgcagtctgcaccccgcccagatttttaatcccctccttgagaagcaacttgctgaacaaatcaagttatattatgaaaggtgtgctgaggttcaagaaatagtatctgtgtatgcatctgcagcaaagcacgggggcgagagacaagaagcatgccacctccacaactcctacctggacctccagcgcaggtatgggagaccctcgatgtgcagagccttcccctgggagaaggagctgaaagacaaacaccccagcttgttccaggcattgctggagatggatctgctgaccgtgccaaggaaccaaaatgaatctgtatcagaaatcggtgggaagatatttgagaaggctgtaaagagactctctagcattgatggtcttcaccaaattagctctatcgtcccctttctgacggattccagctgctgtggataccataaagcatcctactaccttgcagtcttttatgagactggattaaatgttcctcgggatcagctgcagggcatgttgtatagtttggttggaggccaggggagtgagaggctgtcttcaatgaatcttgggtataaacactaccagggtattgacaactaccccctggactgggaactgtcgtatgcctactacagcaacattgccaccaagacaccccttgaccagcacacactgcaaggagatcaggcatatgttgaaacaattagactaaaagatgatgaaatactcaaggtacaaaccaaagaagatggagatgtctttatgtggttgaagcatgaagctacccgaggcaatgcagcagctcagcaacgattggcccagatgctgttctgggggcagcaaggtgtggccaagaatcccgaagcagcaattgagtggtacgccaagggcgccctggagacggaggatcctgcgttaatctatgactatgccattgtgctattcaagggtcaaggagtaaaaaagaacagacggcttgccttagagctgatgaagaaagcagcttccaagggattgcatcaggcagtcaatggcctgggatggtattaccacaaattcaagaaaaattacgccaaagcagcaaagtactggttaaaagcagaagaaatggggaacccagatgcgtcatacaatcttggagtcctgcatttggatggcatcttccctggagttcctggaaggaatcaaactttagctggtgaatatttccataaggctgcgcaaggtggacacatggaagggaccttgtggtgttctctctactatatcacaggcaacctggagacattccctagagatcctgagaaagctgttgtatgggcaaaacatgtagctgagaaaaatggctacttgggccatgtcatccgcaaaggcctcaatgcctacctggaaggttcatggcatgaagctttgctgtattatgttttagcagcagaaactggaattgaagtgtcacagacaaatttagcacacatctgtgaggagaggccagacctggccaggagatacttgggtgttaactgtgtttggagatactataatttctctgtttttcaaatcgatgctccttcctttgcatatttgaagatgggagacctttactactatggccaccaaaaccagtcacaagacctggagttgtctgtgcagatgtacgcccaagccgccctggatggagactcccagggattttttaacctggccctgctaatcgaggaaggtacgataatcccacaccatatcttggatttcttggaaattgactcaactctccattctaataacatctccattctccaggaactgtacgaaaggtgctggagccacagtaacgaggagtccttcagcccctgctccttggcctggctttacctgcacttgcggcttctctggggtgctatcctgcactcagccctgatctactttctgggaacctttctgctatccatattgatcgcctggactgtgcagtatttccagtctgtctcagacccccaggaacaaaatataacagagtagtgtaaaagtttgtcctctcc

SEQ ID NO: 431 - DNA, 388 bp, synthetic construct
  misc_feature 1..388: note = Synthetic polynucleotide
  source 1..388: mol_type = other DNA
tgtacgcccaagccgccctggatggagactcccagggattttttaacctggccctgctaatcgaggaaggtacgataatcccacaccatatcttggatttcttggaaattgactcaactctccattctaataacatctccattctccaggaactgtacgaaaggtgctggagccacagtaacgaggagtccttcagcccctgctccttggcctggctttacctgcacttgcggcttctctggggtgctatcctgcactcagccctgatctactttctgggaacctttctgctatccatattgatcgcctggactgtgcagtatttccagtctgtctcagacccccaggaacaaaatataacagagtagtgtaaaagtttgtcctctcc

SEQ ID NO: 432 - DNA, 1188 bp, synthetic construct
  misc_feature 1..1188: note = Synthetic polynucleotide
  source 1..1188: mol_type = other DNA
cacggtctccctctcatgcggagccgaagctggactgtactgctgccatctcggctcactgcaacctccctgcctgattctcctgcctcagcctgccgagtgcctgcgattgcaggcacgcgccgccacgcctgactggttttggtggagaccgggtttcgctgtgttggccgggccggtctccagcccctaaccgcgagtgatccgccaacctcggcctcccgaggtgccgggattgcagacggagtctcgttcactcagtgctcaatggtgcccaggctggagtgcagtggcgtgatctcggctcactacaacctacacctcccagccgcctgccttggcctcccaaagtgccgagattgcagcctctgcccggccgccaccccgtctgggaagtgaggagtgtctctgcctggccgcccatcgtcggggatgtgaggagcccctctgcctggctgcccagtctggaaagtgaggagcgtctccacccggccgccatcccatctaggaagtgaggagcgcctcttcccagccgccatcacatctaggaagtgaggagcgtctctgcccggccgcccatcgtctgagatgtggggagcgcctctgccccgccgccccatctgggatgtgaggagtgcctctgcccggccgagaccccgtctgggaggtgaggagcgtctctgcccggccgccccgtctgagaagtgaggagaccctctgcctggcaaccaccccgtctgagaaattgatgatatatttaacgaaatcaaatttggtgaatatgtggacactggaaagctaatcgacaagatcaacttaccagatttcctaaaagtgtaccttaaccacaagccaccttttggtaacaccatgagtggcatccacaagagctttgaggtgctcggttataccaactccaaagggaaaaaggccattcgaagagaggacttcctgagactgctcgttactaaaggtgagcatatgacggaggaggagatgttggattgctttgcttcactgtttggcctgaatcccgagggatggaaatccgagcctgcaacctgctccgtcaaaggttcagaaatttgccttgaagaagaacttccagacgaaatcactgcagaaatattcgcgactgaaattcttggcttaaccatttcagaagattccggccaggatggtcagtga

SEQ ID NO: 433 - DNA, 1111 bp, synthetic construct
  misc_feature 1..1111: note = Synthetic polynucleotide
  source 1..1111: mol_type = other DNA
cacggtctccctctcatgcggagccgaagctggactgtactgctgccatctcggctcactgcaacctccctgcctgattctcctgcctcagcctgccgagtgcctgcgattgcaggcacgcgccgccacgcctgactggttttggtggagaccgggtttcgctgtgttggccgggccggtctccagcccctaaccgcgagtgatccgccaacctcggcctcccgaggtgccgggattgcagacggagtctcgttcactcagtgctcaatggtgcccaggctggagtgcagtggcgtgatctcggctcactacaacctacacctcccagccgcctgccttggcctcccaaagtgccgagattgcagcctctgcccggccgccaccccgtctgggaagtgaggagtgtctctgcctggccgcccatcgtcggggatgtgaggagcccctctgcctggctgcccagtctggaaagtgaggagcgtctccacccggccgccatcccatctaggaagtgaggagcgcctcttcccagccgccatcacatctaggaagtgaggagcgtctctgcccggccgcccatcgtctgagatgtggggagcgcctctgccccgccgccccatctgggatgtgaggagtgcctctgcccggccgagaccccgtctgggagattgatgatatatttaacgaaatcaaatttggtgaatatgtggacactggaaagctaatcgacaagatcaacttaccagatttcctaaaagtgtaccttaaccacaagccaccttttggtaacaccatgagtggcatccacaagagctttgaggtgctcggttataccaactccaaagggaaaaaggccattcgaagagaggacttcctgagactgctcgttactaaaggtgagcatatgacggaggaggagatgttggattgctttgcttcactgtttggcctgaatcccgagggatggaaatccgagcctgcaacctgctccgtcaaaggttcagaaatttgccttgaagaagaacttccagacgaaatcactgcagaaatattcgcgactgaaattcttggcttaaccatttcagaagattccggccaggatggtcagtga

SEQ ID NO: 434 - DNA, 382 bp, synthetic construct
  misc_feature 1..382: note = Synthetic polynucleotide
  source 1..382: mol_type = other DNA
ctagaatgtaagttccatgaaggagtgtacatttacaaagatgcgttcaaatagtgctctaagagttttgttcagtggctcacttcggctaaaatgcagaaatgcatgctgtcagcgttggtatttcacattcaatggagctgaatgttcaggacctcttcccattgaagctataatttatttggaccaaggaagccctgaaatgaattcaacaattaatattcatcgcacttcttctgtggaaggactttgtgaaggaattggtgctggattagtggatgttgctatctgggttggtacttgttcagattacccaaaaggagatgcttctactggatggaattcagtttctcgcatcattattgaagaactaccaaaataa

SEQ ID NO: 435 - DNA, 382 bp, synthetic construct; identical to SEQ ID NO: 434
  misc_feature 1..382: note = Synthetic polynucleotide
  source 1..382: mol_type = other DNA

SEQ ID NO: 436 - DNA, 1148 bp, synthetic construct
  misc_feature 1..1148: note = Synthetic polynucleotide
  source 1..1148: mol_type = other DNA
cacggtctccctctcatgcggagccgaagctggactgtactgctgccatctcggctcactgcaacctccctgcctgattctcctgcctcagcctgccgagtgcctgcgattgcaggcacgcgccgccacgcctgactggttttggtggagaccgggtttcgctgtgttggccgggccggtctccagcccctaaccgcgagtgatccgccaacctcggcctcccgaggtgccgggattgcagacggagtctcgttcactcagtgctcaatggtgcccaggctggagtgcagtggcgtgatctcggctcactacaacctacacctcccagccgcctgccttggcctcccaaagtgccgagattgcagcctctgcccggccgccaccccgtctgggaagtgaggagtgtctctgcctggccgcccatcgtcggggatgtgaggagcccctctgcctggctgcccagtctggaaagtgaggagcgtctccacccggccgccatcccatctaggaagtgaggagcgcctcttcccagccgccatcacatctaggaagtgaggagcgtctctgcccggccgcccatcgtctgagatgtggggagcgcctctgccccgccgccccatctgggatgtgaggagtgcctctgcccggccgagaccccgtctgggaggtgaggagcgtctctgcccggccgccccgtctgagaaattgatgatatatttaacgaaatcaaatttggtgaatatgtggacactggaaagctaatcgacaagatcaacttaccagatttcctaaaagtgtaccttaaccacaagccaccttttggtaacaccatgagtggcatccacaagagctttgaggtgctcggttataccaactccaaagggaaaaaggccattcgaagagaggacttcctgagactgctcgttactaaaggtgagcatatgacggaggaggagatgttggattgctttgcttcactgtttggcctgaatcccgagggatggaaatccgagcctgcaacctgctccgtcaaaggttcagaaatttgccttgaagaagaacttccagacgaaatcactgcagaaatattcgcgactgaaattcttggcttaaccatttcagaagattccggccaggatggtcagtga

SEQ ID NO: 437 - DNA, 871 bp, synthetic construct
  misc_feature 1..871: note = Synthetic polynucleotide
  source 1..871: mol_type = other DNA
ggctgggtgcagtggctgacacgtgtaatcccagcacttcaggaggctgaggcaggctggtcacctgaggtcaggagttcgagaccagtctggccaacatggtgaaacccccgtctctactaaaaatacaaaaattagccaggcgtggtagtgcacacctgtaatcacagctactcaggaggctgcggcaagagaatcacttgaacccgggaggcagaggttacagcgagacaagattgcaccactggactccagcctgggcggcggaggtgaaattgctcaaataatggagcaaggtgacctctcagtgagagatgctgccgtcgacactctgtttggagacttgaaggaggacaaagtgacgcgtcatgatggagccagctcagacgggcacctggcacacatcttcagacatgcggccaaggagctgttcaacgaggatgtggaggaggtcacttaccgagccctgagaaacaaagacttccaagaggtcacccttgagaagaacggagaggtggtgttacgctttgctgcagcctatggctttcgaaacatccagaacatgatcctgaagcttaagaagggcaagttcccattccactttgtggaggtcctcgcctgtgctggaggatgcttaaatggcagaggccaagcccagactccagacggacatgcggataaggccctgctgcggcagatggaaggcatttacgctgacatccctgtgcggcgtccggagtccagtgcacacgtgcaggagctgtaccaggagtggctggaggggatcaactcccccaaggcccgagaggtgctgcataccacgtaccagagccaggagcgtggcacacacagcctggacatcaagtggtga

SEQ ID NO: 438 - DNA, 871 bp, synthetic construct; identical to SEQ ID NO: 437
  misc_feature 1..871: note = Synthetic polynucleotide
  source 1..871: mol_type = other DNA

SEQ ID NO: 439 - DNA, 871 bp, synthetic construct; identical to SEQ ID NO: 437
  misc_feature 1..871: note = Synthetic polynucleotide
  source 1..871: mol_type = other DNA

SEQ ID NO: 440 - DNA, 871 bp, synthetic construct; identical to SEQ ID NO: 437
  misc_feature 1..871: note = Synthetic polynucleotide
  source 1..871: mol_type = other DNA

SEQ ID NO: 441 - DNA, 421 bp, synthetic construct
  misc_feature 1..421: note = Synthetic polynucleotide
  source 1..421: mol_type = other DNA
ggctgggtgcagtggctgacacgtgtaatcccagcacttcaggaggctgaggcaggctggtcacctgaggtcaggagttcgagaccagtctggccaacatggtgaaacccccgtctctactaaaaatacaaaaattagccaggcgtggtagtgcacacctgtaatcacagctactcaggaggctgcggcaagagaatcacttgaacccgggaggcagaggttacagcgagacaagattgcaccactggactccagcctgggcggcggaggtgaaattgctcaaataatggagcaaggtgacctctcagtgagagatgctgccgtcgacactctgtttggagacttgaaggaggacaaagtgacgcgtcatgatggagccagctcagacgggcacctggcacacatcttcagacatgcggcc

SEQ ID NO: 442 - DNA, 638 bp, synthetic construct
  misc_feature 1..638: note = Synthetic polynucleotide
  source 1..638: mol_type = other DNA
ggctgggtgcagtggctgacacgtgtaatcccagcacttcaggaggctgaggcaggctggtcacctgaggtcaggagttcgagaccagtctggccaacatggtgaaacccccgtctctactaaaaatacaaaaattagccaggcgtggtagtgcacacctgtaatcacagctactcaggaggctgcggcaagagaatcacttgaacccgggaggcagaggttacagcgagacaagattgcaccactggactccagcctgggcggcggaggtgaaattgctcaaataatggagcaaggtgacctctcagtgagagatgctgccgtcgacactctaaacaaagacttccaagaggtcacccttgagaagaacggagaggtggtgttacgctttgctgcagcctatggctttcgaaacatccagaacatgatcctgaagcttaagaagggcaagttcccattccactttgtggaggtcctcgcctgtgctggaggatgcttaaatggcagaggccaagcccagactccagacggacatgcggataaggccctgctgcggcagatggaaggcatttacgctgacatccctgtgcggcgtccggagtccagtgcacacgtgcaggagctgtaccaggagtggc

SEQ ID NO: 443 - DNA, 337 bp, synthetic construct
  misc_feature 1..337: note = Synthetic polynucleotide
  source 1..337: mol_type = other DNA
ggctgggtgcagtggctgacacgtgtaatcccagcacttcaggaggctgaggcaggctggtcacctgaggtcaggagttcgagaccagtctggccaacatggtgaaacccccgtctctactaaaaatacaaaaattagccaggcgtggtagtgcacacctgtaatcacagctactcaggaggctgcggcaagagaatcacttgaacccgggaggcagaggttacagcgagacaagattgcaccactggactccagcctgggcggcggaggtgaaattgctcaaataatggagcaaggtgacctctcagtgagagatgctgccgtcgacactctgtaa

SEQ ID NO: 444 - DNA, 1086 bp, synthetic construct
  misc_feature 1..1086: note = Synthetic polynucleotide
  source 1..1086: mol_type = other DNA
agcccgacgacctggatttaaattctggtgccgccctcctagctaggtgacgtgggccatctctgtcaaccccctgagtcccaggatcctcttctataaaatggaaatgattagtacctgtctcataaaacttgttgtgggatgggaagataaaggcgggtacaacgccccggacatcacctgacacagagttgaccctcgaacccttggaacataatgataaagcaccggcaggtgcagcggaggggccgccgctcacagatgacaacaagtttcacagatcctgccatctccatggatctcctccgagctgtcctgcagcccagcatcaacgaggagatccagactgtcttcaacaagtacatgaagttcttccagaaggcagcactgaacgtgcgagacaatgttggggaggaggtggacgcagagcagctgatccaggaagcctgtcggagctgcctggagcaggctaaactgctcttttcagatggagaaaaagtaatacccagattgacccatgagcttccaggaataaagcgtggccgtcaggcagaagaagaatgtgcccatcgaggaagcccccttcctaaaaagaggaaaggacggcctcctggacacatcctgtcaagcgaccgggcagccgccggcatggtatggaaaccaaaatcctgtgaaccaattcgccgggaaggccccaagtgggacccagctcgcctgaatgaatctaccacctttgtgttgggatctcgagccaacaaagccctggggatggggggcaccagaggaagaatctacatcaagcacccacacctctttaagtatgcagctgacccccaggataagcactggctggctgagcagcatcacatgcgggcaacagggggcaagatggcctacctcctcatcgaggaggacatccgggaccttgcggccagtgatgattacagaggatgcctggatctgaagctagaggaattgaaatcctttgtcctaccctcctggatggtggagaagatgagaaagtatatggagacactacggacagagaatgagcatcgtgctgttgaagcacctccacagacctga

SEQ ID NO: 445 - DNA, 564 bp, synthetic construct
  misc_feature 1..564: note = Synthetic polynucleotide
  source 1..564: mol_type = other DNA
agcccgacgacctggatttaaattctggtgccgccctcctagctaggtgacgtgggccatctctgtcaaccccctgagtcccaggatcctcttctataaaatggaaatgattagtacctgtctcataaaacttgttgtgggatgggaagataaaggcgggtacaacgccccggacatcacctgacacagagttgaccctcgaacccttggaacataatgataaagcaccggcaggtgcagcggaggggccgccgctcacagatgacaacaagtttcacagatcctgccatctccatggatctcctccgagctgtcctgcagcccagcatcaacgaggagatccagactgtcttcaacaagtacatgaagttcttccagaaggcagcactgaacgtgcgagacaatgttggggaggaggtggacgcagagcagctgatccaggaagcctgtcggagctgcctggagcaggtgcgtggtggatcaagttatcatggccccatttggtatcatggggatgagcaccctgctgcctccctgcctctctggtgtggtcaggaagcatga

SEQ ID NO: 446 - DNA, 987 bp, synthetic construct
  misc_feature 1..987: note = Synthetic polynucleotide
  source 1..987: mol_type = other DNA
agcccgacgacctggatttaaattctggtgccgccctcctagctaggtgacgtgggccatctctgtcaaccccctgagtcccaggatcctcttctataaaatggaaatgattagtacctgtctcataaaacttgttgtgggatgggaagataaaggcgggtacaacgccccggacatcacctgacacagagttgaccctcgaacccttggaacataatgataaagcaccggcaggtgcagcggaggggccgccgctcacagatgacaacaagtttcacagatcctgccatctccatggatctcctccgagctgtcctgcagcccagcatcaacgaggagatccagactgtcttcaacaagtacatgaaggctaaactgctcttttcagatggagaaaaagtaatacccagattgacccatgagcttccaggaataaagcgtggccgtcaggcagaagaagaatgtgcccatcgaggaagcccccttcctaaaaagaggaaaggacggcctcctggacacatcctgtcaagcgaccgggcagccgccggcatggtatggaaaccaaaatcctgtgaaccaattcgccgggaaggccccaagtgggacccagctcgcctgaatgaatctaccacctttgtgttgggatctcgagccaacaaagccctggggatggggggcaccagaggaagaatctacatcaagcacccacacctctttaagtatgcagctgacccccaggataagcactggctggctgagcagcatcacatgcgggcaacagggggcaagatggcctacctcctcatcgaggaggacatccgggaccttgcggccagtgatgattacagaggatgcctggatctgaagctagaggaattgaaatcctttgtcctaccctcctggatggtggagaagatgagaaagtatatggagacactacggacagagaatgagcatcgtgctgttgaagcacctccacagacctga

SEQ ID NO: 447 - DNA, 1052 bp, synthetic construct
  misc_feature 1..1052: note = Synthetic polynucleotide
  source 1..1052: mol_type = other DNA
caggatcctgaggtgagtgaccctttggtcccccctgattccgggtcggccatgaggctgcagcgtgggttgtggtacctggtagcagctgtgctgtttggatgggctttggtggaaacctgggtggcgatagatgggtcccctgcaagcatggagaaggctctgaagctgctggaagcacagagcactgagaaggagtgagcttttgctggtagagttggatgggcattttgactgtgctatgagaagcacacacccagtccctgagggatgcagtgcaggtaagcgcccttcaggcagaggtggggcacctggaaacccagctacagagcttggaaaaggaattagaggctgctgtgaatgtaggcatgggtccattgtctcagccagagatccccacttggtctgatacagagaaagaagaactcttgttgtgggctcacccagtggtccaccagaaggtagatcatgaacagctgttggggccccaagagaaggctcagggacccccccccacccaccgtaatgcaacatacttcatatactgcctataccccaactgagttgtgggaattaggcaagcagtgccgccagcatccaggggaatgtctacctgcctggatgcttcatttgtgagacaagagagcagatagtatctcctgttctgcctctgagatggaaaagctggcctctatcacgactcacccctccctctgtcagtggttgcaggtgaacaagcagttggcacaagggcaaagtgatcacatcctgattgagtggctatggacagccatacagactgtgtggaacaacgctggtgaaatacccaaacctctccagagaatacagagggcaaagatggatccaaagtaactaaacaggagcccacaagacggtctgccagattgtcagcgaaacctgctccaccaaaacctgaacccaaaccaagaaaaacatctgctaagaaagaacctggagcaaagattagcagaggtgctaaagggaagaaggaggaaaagcaggaagctggaaaggaaggcacagaaaactga

SEQ ID NO: 448 - DNA, 1118 bp, synthetic construct
  misc_feature 1..1118: note = Synthetic polynucleotide
  source 1..1118: mol_type = other DNA
caggatcctgaggtgagtgaccctttggtcccccctgattccgggtcggccatgaggctgcagcgtgggttgtggtacctggtagcagctgtgctgtttggatgggctttggtggaaacctgggtggcgatagatgggtcccctgcaagcatggagaaggctctgaagctgctggaagcacagagcactgagaaggagtgagcttttgctggtagagttggatgggcattttgactgtgctatgagaagcacacacccagtccctgagggatgcagtgcaggtaagcgcccttcaggcagaggtggggcacctggaaacccagctacagagcttggaaaaggaattagaggctgctgtgaatgtaggcatgggtccattgtctcagccagagatccccacttggtctgatacagagaaagaagaactcttgttgtgggctcacccagtggtccaccagaaggtagatcatgaacagctgttggggccccaagagaaggctcagggacccccccccacccaccgtaatgcaacatacttcatatactgcctataccccaactgagttgtgggaattaggcaagcagtgccgccagcatccaggggaatgtctacctgcctggatgcttcatttgtgagacaagagagcagatagtatctcctgttctgcctctgagatggaaaagctggcctctatcacgactcacccctccctctgtcagtggttgcaggtgaacaagcagttggcacaagggcaaagtgatcacatcctgattgagtggctatggacagccatacagactgtgtggaacaacgctggtgaaatacccaaacctctccagagaatacagagggcaaagatggatccaaagtaactaaacaggagcccacaagacggtctgccagattgtcagcgaaacctgctccaccaaaacctgaacccaaaccaagaaaaacatctgctaagaaagaacctggagcaaagattagcagaggtgctaaagggaagaaggaggaaaagcaggaagctggaaaggaaggtactgcaccatctgaaaatggtgaaactaaagctgaagaggcacagaaaactgaatctgtagataacgagggagaatga

SEQ ID NO: 449 - DNA, 3021 bp, synthetic construct
  misc_feature 1..3021: note = Synthetic polynucleotide
  source 1..3021: mol_type = other DNA
gaccctggagccagagagcctaggcttagtcctagccctgcactgaagacacttctgagaaattcatcaggctgtgaagcgcgccgtgatgaatatcgaacagagtttaccacagctttgcagcgcgttgacttattcatgggtcaattcagcgaagtcctcttaacatctatatccaccttcattaaaggagacctcaccatagctaatcttgggacatcagagggtcgcttcatgcaggttgtggtttctcgatcaggaccatcaacccctcatgtgaattttctcctggactcccatccagtgtctccagaagtgattgtggagcatacattaaaccaaaatggctacacactggttatcactgggaagaagatcacgaagatcccattgaatggcttgggctgcagacatttccagtcctgcagtcaatgcctctctgccccaccctttgttcagtgtggctggtgccacgacaaatgtgtgcgatcggaggaatgcctgagcgggacatggactcaacagatctgtctgcctgcaatctacaaggttttcccaaatagtgcaccccttgaaggagggacaaggctgaccatatgtggctgggactttggatttcggaggaataataaatttgatttaaagaaaactagagttctccttggaaatgagagctgcaccttgactttaagtgagagcacgatgaatacattgaaatgcacagttggtcctgccatgaataagcatttcaatatgtccataattatttcaaatggccacgggacaacacaatacagtacattctcctatgtggatcctgtaataacaagtatttcgccgaaatacggtcctatggctggtggcactttacttactttaactggaaattacctaaacagtgggaattctagacacatttcaattggtggaaaaacatgtactttaaaaagtgtgtcaaacagtattcttgaatgttataccccagcccaaaccatttcaactgagtttgctgttaaattgaaaattgacttagccaaccgagagacaagcatcttcagttaccgtgaagatcccattgtctatgaaattcatccaaccaaatcttttattagtggtgggagcacaataacaggtgttgggaaaaacctgaattcagttagtgtcccgagaatggtcataaatgtgcatgaagcaggaaggaactttacagtggcatgtcaacatcgctctaattcagagataatctgttgtaccactccttccctgcaacagctgaatctgcaactccccctgaaaaccaaagcctttttcatgttagatgggatcctttccaaatactttgatctcatttatgtacataatcctgtgtttaagccttttgaaaagccagtgatgatctcaatgggcaatgaaaatgtactggaaattaagggaaatgatattgaccctgaagcagttaaaggtgaagtgttaaaagttggaaataagagctgtgagaatatacacttacattctgaagccgttttatgcacggtccccaatgacctgctgaaattgaacagcgagctaaatatagagtggaagcaagcaatttcttcaaccgtccttggaaaagtaatagttcaaccagatcagaatttcacaggattgattgctggtgttgtctcaatatcaacagcactgttattactacttgggtttttcctgtggctgaaaaagagaaagcaaattaaagatctgggcagtgaattagttcgctacgatgcaagagtacacactcctcatttggataggcttgtaagtgcccgaagtgtaagcccaactacagaaatggtttcaaatgaatctgtagactaccgagctacttttccagaagatcagtttcctaattcatctcagaacggttcatgccgacaagtgcagtatcctctgacagacatgtcccccatcctaactagtggggactctgatatatccagtccattactgcaaaatactgtccacattgacctcagtgctctaaatccagagctggtccaggcagtgcagcatgtagtgattgggcccagtagcctgattgtgcatttcaatgaagtcataggaagagggcattttggttgtgtatatcatgggactttgttggacaatgatggcaagaaaattcactgtgctgtgaaatccttgaacagaatcactgacataggagaagtttcccaatttctgaccgagggaatcatcatgaaagattttagtcatcccaatgtcctctcgctcctgggaatctgcctgcgaagtgaagggtctccgctggtggtcctaccatacatgaaacatggagatcttcgaaatttcattcgaaatgagactcataatccaactgtaaaagatcttattggctttggtcttcaagtagccaaaggcatgaaatatcttgcaagcaaaaagtttgtccacagagacttggctgcaagaaactgtatgctggatgaaaaattcacagtcaaggttgctgattttggtcttgccagagacatgtatgataaagaatactatagtgtacacaacaaaacaggtgcaaagctgccagtgaagtggatggctttggaaagtctgcaaactcaaaagtttaccaccaagtcagatgtgtggtcctttggcgtgctcctctgggagctgatgacaagaggagccccaccttatcctgacgtaaacacctttgatataactgtttacttgttgcaagggagaagactcctacaacccgaatactgcccagaccccttatatgaagtaatgctaaaatgctggcaccctaaagccgaaatgcgcccatccttttctgaactggtgtcccggatatcagcgatcttctctactttcattggggagcactatgtccatgtgaacgctacttatgtgaacgtaaaatgtgtcgctccgtatccttctctgttgtcatcagaagataacgctgatgatgaggtggacacacgaccagcctccttctgggagacatcatag

SEQ ID NO: 450 - DNA, 3075 bp, synthetic construct
  misc_feature 1..3075: note = Synthetic polynucleotide
  source 1..3075: mol_type = other DNA
gaccctggagccagagagcctaggcttagtcctagccctgcactgaagacacttctgagaaattcatcaggctgtgaagcgcgccgtgatgaatatcgaacagagtttaccacagctttgcagcgcgttgacttattcatgggtcaattcagcgaagtcctcttaacatctatatccaccttcattaaaggagacctcaccatagctaatcttgggacatcagagggtcgcttcatgcaggttgtggtttctcgatcaggaccatcaacccctcatgtgaattttctcctggactcccatccagtgtctccagaagtgattgtggagcatacattaaaccaaaatggctacacactggttatcactgggaagaagatcacgaagatcccattgaatggcttgggctgcagacatttccagtcctgcagtcaatgcctctctgccccaccctttgttcagtgtggctggtgccacgacaaatgtgtgcgatcggaggaatgcctgagcgggacatggactcaacagatctgtctgcctgcaatctacaaggttttcccaaatagtgcaccccttgaaggagggacaaggctgaccatatgtggctgggactttggatttcggaggaataataaatttgatttaaagaaaactagagttctccttggaaatgagagctgcaccttgactttaagtgagagcacgatgaatacattgaaatgcacagttggtcctgccatgaataagcatttcaatatgtccataattatttcaaatggccacgggacaacacaatacagtacattctcctatgtggatcctgtaataacaagtatttcgccgaaatacggtcctatggctggtggcactttacttactttaactggaaattacctaaacagtgggaattctagacacatttcaattggtggaaaaacatgtactttaaaaagtgtgtcaaacagtattcttgaatgttataccccagcccaaaccatttcaactgagtttgctgttaaattgaaaattgacttagccaaccgagagacaagcatcttcagttaccgtgaagatcccattgtctatgaaattcatccaaccaaatcttttattagtacttggtggaaagaacctctcaacattgtcagttttctattttgctttgccagtggtgggagcacaataacaggtgttgggaaaaacctgaattcagttagtgtcccgagaatggtcataaatgtgcatgaagcaggaaggaactttacagtggcatgtcaacatcgctctaattcagagataatctgttgtaccactccttccctgcaacagctgaatctgcaactccccctgaaaaccaaagcctttttcatgttagatgggatcctttccaaatactttgatctcatttatgtacataatcctgtgtttaagccttttgaaaagccagtgatgatctcaatgggcaatgaaaatgtactggaaattaagggaaatgatattgaccctgaagcagttaaaggtgaagtgttaaaagttggaaataagagctgtgagaatatacacttacattctgaagccgttttatgcacggtccccaatgacctgctgaaattgaacagcgagctaaatatagagtggaagcaagcaatttcttcaaccgtccttggaaaagtaatagttcaaccagatcagaatttcacaggattgattgctggtgttgtctcaatatcaacagcactgttattactacttgggtttttcctgtggctgaaaaagagaaagcaaattaaagatctgggcagtgaattagttcgctacgatgcaagagtacacactcctcatttggataggcttgtaagtgcccgaagtgtaagcccaactacagaaatggtttcaaatgaatctgtagactaccgagctacttttccagaagatcagtttcctaattcatctcagaacggttcatgccgacaagtgcagtatcctctgacagacatgtcccccatcctaactagtggggactctgatatatccagtccattactgcaaaatactgtccacattgacctcagtgctctaaatccagagctggtccaggcagtgcagcatgtagtgattgggcccagtagcctgattgtgcatttcaatgaagtcataggaagagggcattttggttgtgtatatcatgggactttgttggacaatgatggcaagaaaattcactgtgctgtgaaatccttgaacagaatcactgacataggagaagtttcccaatttctgaccgagggaatcatcatgaaagattttagtcatcccaatgtcctctcgctcctgggaatctgcctgcgaagtgaagggtctccgctggtggtcctaccatacatgaaacatggagatcttcgaaatttcattcgaaatgagactcataatccaactgtaaaagatcttattggctttggtcttcaagtagccaaaggcatgaaatatcttgcaagcaaaaagtttgtccacagagacttggctgcaagaaactgtatgctggatgaaaaattcacagtcaaggttgctgattttggtcttgccagagacatgtatgataaagaatactatagtgtacacaacaaaacaggtgcaaagctgccagtgaagtggatggctttggaaagtctgcaaactcaaaagtttaccaccaagtcagatgtgtggtcctttggcgtgctcctctgggagctgatgacaagaggagccccaccttatcctgacgtaaacacctttgatataactgtttacttgttgcaagggagaagactcctacaacccgaatactgcccagaccccttatatgaagtaatgctaaaatgctggcaccctaaagccgaaatgcgcccatccttttctgaactggtgtcccggatatcagcgatcttctctactttcattggggagcactatgtccatgtgaacgctacttatgtgaacgtaaaatgtgtcgctccgtatccttctctgttgtcatcagaagataacgctgatgatgaggtggacacacgaccagcctccttctgggagacatcatag

SEQ ID NO: 451 - DNA, 1143 bp, synthetic construct
  misc_feature 1..1143: note = Synthetic polynucleotide
  source 1..1143: mol_type = other DNA
gaccctggagccagagagcctaggcttagtcctagccctgcactgaagacacttctgagaaattcatcaggctgtgaagcgcgccgtgatgaatatcgaacagagtttaccacagctttgcagcgcgttgacttattcatgggtcaattcagcgaagtcctcttaacatctatatccaccttcattaaaggagacctcaccatagctaatcttgggacatcagagggtcgcttcatgcaggttgtggtttctcgatcaggaccatcaacccctcatgtgaattttctcctggactcccatccagtgtctccagaagtgattgtggagcatacattaaaccaaaatggctacacactggttatcactgggaagaagatcacgaagatcccattgaatggcttgggctgcagacatttccagtcctgcagtcaatgcctctctgccccaccctttgttcagtgtggctggtgccacgacaaatgtgtgcgatcggaggaatgcctgagcgggacatggactcaacagatctgtctgcctgcaatctacaaggttttcccaaatagtgcaccccttgaaggagggacaaggctgaccatatgtggctgggactttggatttcggaggaataataaatttgatttaaagaaaactagagttctccttggaaatgagagctgcaccttgactttaagtgagagcacgatgaatacattgaaatgcacagttggtcctgccatgaataagcatttcaatatgtccataattatttcaaatggccacgggacaacacaatacagtacattctcctatgtggatcctgtaataacaagtatttcgccgaaatacggtcctatggctggtggcactttacttactttaactggaaattacctaaacagtgggaattctagacacatttcaattggtggaaaaacatgtactttaaaaagtgtgtcaaacagtattcttgaatgttataccccagcccaaaccatttcaactgagtttgctgttaaattgaaaattgacttagccaaccgagagacaagcatcttcagttaccgtgaagatcccattgtctatgaaattcatccaaccaaatcttttattaggcatgtcaacatcgctctaattcagagataa

SEQ ID NO: 452 - DNA, 347 bp, synthetic construct
  misc_feature 1..347: note = Synthetic polynucleotide
  source 1..347: mol_type = other DNA
ccccagaaaggaatttggccattggaatcgggatccagaatttccccgagggcctggctgtcagccttcccttgcgaggggcaggcttctccacctggagagctttctggtatgggcagctgagcggcatggtggagcccctggccggggtctttggtgcctttgccgtggtgctggctgagcccatcctgccctacgctctggcctttgctgccggtgccatggtctacgtggtcatggacgacatcatccccgaagcccagatcagtggtaatgggaaactggcatcctgggcctccatcctgggatttgtagtgatgatgtcactggacgttggcctgggctag

SEQ ID NO: 453 - DNA, 347 bp, synthetic construct; identical to SEQ ID NO: 452
  misc_feature 1..347: note = Synthetic polynucleotide
  source 1..347: mol_type = other DNA

SEQ ID NO: 454 - DNA, 148 bp, synthetic construct
  misc_feature 1..148: note = Synthetic polynucleotide
  source 1..148: mol_type = other DNA
ccccagaaaggaatttggccattggaatcgggatccagaatttccccgagggcctggctgtcagccttcccttgcgaggggcaggcttctccacctggagagctttctggtatgggcagctgagcggcatggtggagcccctggccgg

SEQ ID NO: 455 - DNA, 594 bp, synthetic construct
  misc_feature 1..594: note = Synthetic polynucleotide
  source 1..594: mol_type = other DNA
ttcctggctgcccaatgtggggcaatgaagaccccagtgaaggaatgctagagtgtgtgaaagtggaggacgcatcgtcaaaggacacctgaggacgtctcaaagaagctcggcgggagagctgagcgctcggaagaaccaaggttccgagaagtaaagctttggaggtcacaaaattagcaatagaagctgggttccgccatatagattctgctcatttatacaataatgaggagcaggttggactggccatccgaagcaagattgcagatggcagtgtgaagagagaagacatattctacacttcaaagctttggtccacttttcatcgaccagagttggtccgaccagccttggaaaactcactgaagaaagctcaattggactatgttgacctctatcttattcattctccaatgtctctaaagccaggtgaggaactttcaccaacagatgaaaatggaaaagtaatatttgacatagtggatctctgtaccacctgggaggccatggagaagtgtaaggatgcaggattggccaagtccattggggtgtcaaacttcaaccgcaggcagctggagatgatcctcaaca

SEQ ID NO: 456 - DNA, 1031 bp, synthetic construct
  misc_feature 1..1031: note = Synthetic polynucleotide
  source 1..1031: mol_type = other DNA
ttcctggctgcccaatgtggggcaatgaagaccccagtgaaggaatgctagagtgtgtgaaagtggaggacgcatcgtcaaaggacacctgaggacgtctcaaagaagctcggcgggagagctgagcgctcggaagaaccaaggttccgagaagtaaagctttggaggtcacaaaattagcaatagaagctgggttccgccatatagattctgctcatttatacaataatgaggagcaggttggactggccatccgaagcaagattgcagatggcagtgtgaagagagaagacatattctacacttcaaagctttggtccacttttcatcgaccagagttggtccgaccagccttggaaaactcactgaagaaagctcaattggactatgttgacctctatcttattcattctccaatgtctctaaagccaggtgaggaactttcaccaacagatgaaaatggaaaagtaatatttgacatagtggatctctgtaccacctgggaggccatggagaagtgtaaggatgcaggattggccaagtccattggggtgtcaaacttcaaccgcaggcagctggagatgatcctcaacaagccaggactcaagtacaagcctgtctgcaaccaggtagaatgtcatccgtatttcaaccggagtaaattgctagatttctgcaagtcgaaagatattgttctggttgcctatagtgctctgggatctcaacgagacaaacgatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtttttgagttccagttgactgcagaggacatgaaagccatagatggcctagacagaaatctccactattttaacagtgatagttttgctagccaccctaattatccatattcagatgaatattaa

SEQ ID NO: 457 - DNA, 1031 bp, synthetic construct; identical to SEQ ID NO: 456
  misc_feature 1..1031: note = Synthetic polynucleotide
  source 1..1031: mol_type = other DNA

SEQ ID NO: 458 - DNA, 1142 bp, synthetic construct
  misc_feature 1..1142: note = Synthetic polynucleotide
  source 1..1142: mol_type = other DNA
gatatggtttggttctgtgtccccaccgaaatatcatgtcaaattgtaattcccggtgttgaaggaggggcctagtgggaggagattgaatcatgagggctgactttccttttactcttctcataatagaattctcatgagatctggttgtttgaaagtgtgtagcacctccaccttctctctctctctccctctccctctcctgccagccaagtgaagacatgcttacttccccttcaccttccttcatgatggttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgtgccacatgggaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaa

SEQ ID NO: 459 - DNA, 1064 bp, synthetic construct
  misc_feature 1..1064: note = Synthetic polynucleotide
  source 1..1064: mol_type = other DNA
gatatggtttggttctgtgtccccaccgaaatatcatgtcaaattgtaattcccggtgttgaaggaggggcctagtgggaggagattgaatcatgagggctgactttccttttactcttctcataatagaattctcatgagatctggttgtttgaaagtgtgtagcacctccaccttctctctctctctccctctccctctcctgccagccaagtgaagacatgcttacttccccttcaccttccttcatgatggttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaa

SEQ ID NO: 460 - DNA, 1142 bp, synthetic construct; identical to SEQ ID NO: 458
  misc_feature 1..1142: note = Synthetic polynucleotide
  source 1..1142: mol_type = other DNA

SEQ ID NO: 461 - DNA, 772 bp, synthetic construct
  misc_feature 1..772: note = Synthetic polynucleotide
  source 1..772: mol_type = other DNA
gatatggtttggttctgtgtccccaccgaaatatcatgtcaaattgtaattcccggtgttgaaggaggggcctagtgggaggagattgaatcatgagggctgactttccttttactcttctcataatagaattctcatgagatctggttgtttgaaagtgtgtagcacctccaccttctctctctctctccctctccctctcctgccagccaagtgaagacatgcttacttccccttcaccttccttcatgatggttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgtgccacatgggaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaa

SEQ ID NO: 462 - DNA, 590 bp, synthetic construct
  misc_feature 1..590: note = Synthetic polynucleotide
  source 1..590: mol_type = other DNA
gatatggtttggttctgtgtccccaccgaaatatcatgtcaaattgtaattcccggtgttgaaggaggggcctagtgggaggagattgaatcatgagggctgactttccttttactcttctcataatagaattctcatgagatctggttgtttgaaagtgtgtagcacctccaccttctctctctctctccctctccctctcctgccagccaagtgaagacatgcttacttccccttcaccttccttcatgatggttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaaggaggacatagggattttaacatggaagaagagccctaaacataactcctaa

SEQ ID NO: 463 - DNA, 1267 bp, synthetic construct
  misc_feature 1..1267: note = Synthetic polynucleotide
  source 1..1267: mol_type = other DNA
ggccaggtgcagtggcttatgcctgaaatcccagcactttgggaggctgaggcaggcagatcacctgaggtcaggagttcaagaccagactggccaacatgaagaaaccccgtctctactagccaggcgtggtggtgtgagcctgtagtcccagctactcgggaggctgaggcacaagaatcacttgaacccaggaggcagaggttgcagtgaactgaaatcgcaccattgcgctccagcctgggtgacagagatcaacggccaccccgggaagtccacgcgcctggcgggcttgtggaagctggaagagtgccacgccagcggctgcatgatggacctcttcgtgcagatggccatcatcatgggcctgaagcagacgctcagcaactgcgtcgagtacctggtcccgtgggtgacccacaagtgccgctctctgcgggcctccgagtccgggcacctgccccgggaccccgagctcagggactggcggcgcaactaccttctgaacccggtcaacaccttcagcctgttcgacgagttcatggagatgatgatccagtacggcttcaccaccatcttcgtggccgccttcccgctggcgccgctgctcgcgctcttcagcaacctcgtggagatccgcctggacgccatcaagatggtctggttgcagcggcgcctggtgccgcgcaaggccaaggacatcgggacctggctgcaggtgctggagaccatcggtgtgctggcggtcattgccaatgggatggtcattgccttcacatctgagttcatcccccgagtggtctacaagtaccgctatagcccatgcctgaaagaaggcaactctactgtcgactgcctcaagggctacgtcaaccacagcctgtccgtcttccacaccaaggacttccaggaccctgatgggattgagggctcagaaaacgtgactctgtgcagatacagggactaccgcaatccccccgattacaacttctccgagcagttctggttcctcctggccatccgcctggccttcgtcatcctctttgagcacgtggccttgtgcatcaagctcatcgccgcctggttcgtgcccgacatccctcagtcggtgaagaacaaggttctggaggtgaagtaccagaggctgcgtgagaagatgtggcatggaaggcagaggctgggtggggtgggggcaggctctcggcccccaatgcctgcccatcccaccccagcatccatcttcagtgccaggagcacagacgtgtag

SEQ ID NO: 464 - DNA, 7329 bp, synthetic construct
  misc_feature 1..7329: note = Synthetic polynucleotide
  source 1..7329: mol_type = other DNA
aactcctatttctgagatttcctttaccacttaggaggtagactatgaccagggaccattgctctcactcctacagtcaaaataacctggaaggagctgagtctccccagaagaggaagtttttgccgaacaagcaaccggaaaagcttaataggcaatgggcagtcaccagcattgcctcgaccacactcacctctctctgctcatgcaggaaatagccctcaagatagtccaagaaatttctcccccagtgcctcagcccatttttcatttgcacggagtctcaataggactgatggacgccgctggtcgttggcttctctcccttcctctggctatgggacaaacacacccagctctacggtctcttcatcctgttcctcccaggagaagttgcatcagttaccataccaaccaacaccagacgagttacacttcttatcaaaacatttctgtaccaccgaaagcatcgccactgagaacagatgcaggaacacgccgatgcgcccccgttcccgaagtctgagccctggacgttctcccgcctgctgtgaccatgaaataattatgatgaaccatgtctacaaagaaaggttcccaaaggctacagctcagatggaagaacgtctaaaggaaattatcaccagctactctcctgacaacgttctacccttagcagatggagtgcttagtttcactcaccaccagattattgaactggctcgagattgcttggataaatcccaccagggcctcatcacctcacgatacttccttgaattacagcacaaattagataagttgctacaggaggctcatgatcgttcagaaagtggagaattggcatttattaaacaactagttcgaaagatcctaattgttattgcccgccctgctcggttattagagtgcctggaatttgatccggaagaattttactacctattggaagcagcagaaggccatgccaaagaaggacagggtattaaaaccgacattcccaggtacatcattagccaactgggactcaataaggatcccttggaagaaatggctcatttgggaaactacgatagtgggacagcagaaacaccagaaacagatgaatcagtgagtagctctaatgcctccctgaaacttcgaaggaaacctcgggaaagtgattttgaaacgattaaattgattagcaatggagcctatggggcagtctactttgttcggcataaagaatcccggcagaggtttgccatgaagaagattaataaacagaacctcatccttcgaaaccagatccagcaggcctttgtggagcgggatatcctgacttttgcagaaaacccctttgttgtcagcatgtattgctcctttgaaacaaggcgccacttgtgcatggtcatggaatatgtggaagggggagactgtgctactttaatgaaaaacatgggtcctctccctgttgatatggccagaatgtactttgctgagacggtcttggccttggaatatttacataattatggaattgtacacagggatttgaaaccagacaacttgttggttacctccatggggcacataaagctgacagattttggattatctaaggtgggactaatgagcatgactaccaacctttacgagggtcatattgagaaggatgctagagagttcctggataaacaggtctgtggcacacctgaatacattgcaccagaagtgattctgaggcagggttatggaaagccggtggactggtgggccatggggattatcctctatgaatttctggttggatgcgtgccattctttggggatactccagaggagctatttggacaagtcatcagtgatgagatcaactggcctgagaaggatgaggcacccccacctgatgcccaggatctgattaccttactcctcaggcagaatcccctggagaggctgggaacaggtggtgcatatgaagtcaaacagcatcgattcttccgttctttagactggaacagtttgctgagacagaaggcagaatttattccccaactggaatctgaggatgacacaagttattttgatactcggtctgagaagtatcatcatatggaaacggaggaagaagatgacacaaatgatgaagactttaatgtggaaataaggcagttttcttcatgttcacacaggttttcaaaagttttcagcagtatagatcgaatcactcagaattcagcagaagagaaggaagactctgtggacaaaaccaaaagcaccaccttgccatccacagaaacactgagctggagttcagaatattctgaaatgcaacagctatcaacatccaactcttcagatactgaaagcaacagacataaactcagttctggcctacttcccaaactggctatttcaacagagggagagcaagatgaagctgcctcctgccctggagacccccatgaggagccaggaaagccagcccttcctcctgaagagtgtgcccaggaggagcctgaggtcaccaccccagccagcaccatcagcagctccaccctgtcagttggcagtttttcagagcacttggatcagataaatggacgaagcgagtgtgtggacagtacagataattcctcaaagccatccagtgaacccgcttctcacatggctcggcagcgattagaaagcacagaaaaaaagaaaatctcggggaaagtcacaaagtccctctctgccagtgctctttccctcatgatcccaggagatatgtttgctgtttcccctctgggaagtccaatgtctccccattccctgtcctcggacccttcttcttcacgagattcctctcccagccgagattcctcagcagcttctgccagtccacatcagccgattgtgatccacagttcggggaagaactacggctttaccatccgagccatccgggtgtatgtgggagacagtgacatctatacagtgcaccatatcgtctggaatgtagaagaaggaagtccggcatgccaggcaggactgaaggctggagatcttatcactcacatcaatggagaaccagtgcatggacttgtccacacagaagttatagaactcctactgaagagtgggaataaggtgtcaatcactactaccccatttgaaaacacatcaatcaaaactggaccagccaggagaaacagctataagagccggatggtgaggcggagcaagaaatccaagaagaaagaaagtctcgaaaggaggagatctcttttcaaaaagctagccaagcagccttctcctttactccacaccagccgaagtttctcctgcttgaacagatccctgtcatcgggtgagagcctcccaggttcccccactcatagcttgtctccccggtctccaacaccaagctaccgctccacccctgacttcccatctggtactaattcctcccagagcagctcccctagttctagtgcccccaattccccagcagggtccgggcacatccggcccagcactctccacggtcttgcacccaaactcggcgggcagcggtaccggtccggaaggcgaaagtccgccggcaacatcccactgtccccgctggcccggacgccctctccaaccccgcaacccacctccccgcagcggtcaccatcccctcttctgggacactcactgggcaattccaagatcgcgcaagcctttcccagcaagatgcactccccgcccaccatcgtcagacacatcgtgaggcccaagagtgcggagccccccaggtccccgctgctcaagcgcgtgcagtccgaggagaagctgtcgccctcttacggcagtgacaagaagcacctgtgctcccgcaagcacagcctggaggtgacccaagaggaggtgcagcgggagcagtcccagcgggaggcgccgctgcagagcctggatgagaacgtgtgcgacgtgccgccgctcagccgcgcccggccagtggagcaaggctgcctgaaacgcccagtctcccggaaggtgggccgccaggagtctgtggacgacctggaccgcgacaagctgaaggccaaggtggtggtgaagaaagcagacggcttcccagagaaacaggaatcccaccagaaatcccatggacccgggagtgatttggaaaactttgctctgtttaagctggaagagagagagaagaaagtctatccgaaggctgtggaaaggtcaagtacttttgaaaacaaagcgtctatgcaggaggcgccaccgctgggcagcctgctgaaggatgctcttcacaagcaggccagcgtgcgcgccagcgagggtgcgatgtcggatggccgggtgcctgcggagcaccgccagggtggcggggacttcagacgggcccccgctcctggcaccctccaggatggtctctgccactccctcgacaggggcatctctgggaagggggaaggcacggagaagtcctcccaggccaaggagcttctccgatgtgaaaagttagacagcaagctggccaacatcgattacctccgaaagaaaatgtcacttgaggacaaagaggacaacctctgccctgtgctgaagcccaagatgacagctggctcccacgaatgcctgccagggaacccagtccgacccacgggtgggcagcaggagcccccgccggcttctgagagccgagcttttgtcagcagcacccatgcagctcagatgagtgccgtctcttttgttcccctcaaggccttaacaggccgggtggacagtggaacggagaagcctggcttggttgctcctgagtcccctgttaggaagagcccctccgagtataagctggaaggtaggtctgtctcatgcctgaagccgatcgagggcactctggacattgctctcctgtccggacctcaggcctccaagacagaactgccttccccagagtctgcacagagccccagcccaagtggtgacgtgagggcctctgtgccaccagttctccccagcagcagtgggaaaaagaacgataccaccagtgcaagagagctttctccttccagcttaaagatgaataaatcctacctgctggagccttggttcctgccccccagccgaggtctccagaattcaccagcagtttccctgcctgacccagagttcaagagggacaggaaaggtccccatcctactgccaggagccctggaacagtcatggaaagcaatccccaacagagagagggcagctcccctaaacaccaagaccacaccactgaccccaagcttctgacctgcctggggcagaacctccacagccctgacctggccaggccacgctgcccgctcccacctgaagcttccccctcaagggagaagccaggcctgagggaatcgtctgaaagaggccctcccacagccagaagcgagcgctctgctgcgagggctgacacatgcagagagccctccatggaactgtgctttccagaaactgcgaaaaccagtgacaactccaaaaatctcctctctgtgggaaggacccacccagatttctatacacagacccaggccatggagaaagcatgggcgccgggtgggaaaacgaaccacaaagatggcccaggtgaggcgaggcccccgcccagagacaactcctctctgcactcagctggaattccctgtgagaaggagctgggcaaggtgaggcgtggcgtggaacccaagcccgaagcgcttcttgccaggcggtctctgcagccacctggaattgagagtgagaagagtgaaaagctctccagtttcccatctttgcagaaagatggtgccaaggaacctgaaaggaaggagcagcctctacaaaggcatcccagcagcatccctccgccccctctgacggccaaagacctgtccagcccggctgccaggcagcattgcagttccccaagccacgcttctggcagagagccgggggccaagcccagcactgcagagcccagctcgagcccccaggaccctcccaagcctgttgctgcgcacagtgaaagcagcagccacaagccccggcctggccctgacccgggccctccaaagactaagcaccccgaccggtccctctcctctcagaaaccaagtgtcggggccacaaagggcaaagagcctgccactcagtccctcggtggctctagcagagaggggaagggccacagtaagagtgggccggatgtgtttcctgctaccccaggctcccagaacaaagccagcgatgggattggccagggagaaggtgggccctctgtcccactgcacactgacagggctcctctagacgccaagccacaacccaccagtggtgggcggcccctggaggtgctggagaagcctgtgcatttgccaaggccgggacacccagggcctagtgagccagcggaccagaaactgtccgctgttggtgaaaagcaaaccctgtctccaaagcaccccaaaccatccactgtgaaagattgccccaccctgtgcaaacagacagacaacagacagacagacaaaagcccgagtcagccggccgccaacaccgacagaagggcggaagggaagaaatgcactgaagcactttatgctccagcagagggcgacaagctcgaggccggcctttcctttgtgcatagcgagaaccggttgaaaggcgcggagcggccagccgcgggggtggggaagggcttccctgaggccagagggaaagggcccggtccccagaagccaccgacggaggcagacaagcccaatggcatgaaacggtccccctcagccactgggcagagttctttccgatccacggccctcccggaaaagtctctgagctgctcctccagcttccctgaaaccagggccggagttagagaggcctctgcagccagcagcgacacctcttctgccaaggccgccgggggcatgctggagcttccagcccccagcaacagggaccataggaaggctcagcctgccggggagggccgaacccacatgacaaagagtgactccctgccctccttccgggtctccaccctgcctctggagtcacaccaccccgacccaaacaccatgggcggggccagccaccgggacagggctctctcggtgactgccaccgtaggggaaaccaaagggaaggaccctgccccagcccagcctcccccagctaggaaacagaacgtgggcagagacgtgaccaagccatccccagccccaaacactgaccgccccatctctctttctaatgagaaggactttgtggtacggcagaggcgggggaaagagagtttgcgtagcagccctcacaaaaaggccttgtaa

SEQ ID NO: 465 - DNA, 7320 bp, synthetic construct
  misc_feature 1..7320: note = Synthetic polynucleotide
  source 1..7320: mol_type = other DNA
aactcctatttctgagatttcctttaccacttaggaggtagactatgaccagggaccattgctctcactcctacagtcaaaataacctggaaggagctgagtctccccagaagaggaagtttttgccgaacaagcaaccggaaaagcttaataggcaatgggcagtcaccagcattgcctcgaccacactcacctctctctgctcatgcaggaaatagccctcaagatagtccaagaaatttctcccccagtgcctcagcccatttttcatttgcacggaggactgatggacgccgctggtcgttggcttctctcccttcctctggctatgggacaaacacacccagctctacggtctcttcatcctgttcctcccaggagaagttgcatcagttaccataccaaccaacaccagacgagttacacttcttatcaaaacatttctgtaccaccgaaagcatcgccactgagaacagatgcaggaacacgccgatgcgcccccgttcccgaagtctgagccctggacgttctcccgcctgctgtgaccatgaaataattatgatgaaccatgtctacaaagaaaggttcccaaaggctacagctcagatggaagaacgtctaaaggaaattatcaccagctactctcctgacaacgttctacccttagcagatggagtgcttagtttcactcaccaccagattattgaactggctcgagattgcttggataaatcccaccagggcctcatcacctcacgatacttccttgaattacagcacaaattagataagttgctacaggaggctcatgatcgttcagaaagtggagaattggcatttattaaacaactagttcgaaagatcctaattgttattgcccgccctgctcggttattagagtgcctggaatttgatccggaagaattttactacctattggaagcagcagaaggccatgccaaagaaggacagggtattaaaaccgacattcccaggtacatcattagccaactgggactcaataaggatcccttggaagaaatggctcatttgggaaactacgatagtgggacagcagaaacaccagaaacagatgaatcagtgagtagctctaatgcctccctgaaacttcgaaggaaacctcgggaaagtgattttgaaacgattaaattgattagcaatggagcctatggggcagtctactttgttcggcataaagaatcccggcagaggtttgccatgaagaagattaataaacagaacctcatccttcgaaaccagatccagcaggcctttgtggagcgggatatcctgacttttgcagaaaacccctttgttgtcagcatgtattgctcctttgaaacaaggcgccacttgtgcatggtcatggaatatgtggaagggggagactgtgctactttaatgaaaaacatgggtcctctccctgttgatatggccagaatgtactttgctgagacggtcttggccttggaatatttacataattatggaattgtacacagggatttgaaaccagacaacttgttggttacctccatggggcacataaagctgacagattttggattatctaaggtgggactaatgagcatgactaccaacctttacgagggtcatattgagaaggatgctagagagttcctggataaacaggtctgtggcacacctgaatacattgcaccagaagtgattctgaggcagggttatggaaagccggtggactggtgggccatggggattatcctctatgaatttctggttggatgcgtgccattctttggggatactccagaggagctatttggacaagtcatcagtgatgagatcaactggcctgagaaggatgaggcacccccacctgatgcccaggatctgattaccttactcctcaggcagaatcccctggagaggctgggaacaggtggtgcatatgaagtcaaacagcatcgattcttccgttctttagactggaacagtttgctgagacagaaggcagaatttattccccaactggaatctgaggatgacacaagttattttgatactcggtctgagaagtatcatcatatggaaacggaggaagaagatgacacaaatgatgaagactttaatgtggaaataaggcagttttcttcatgttcacacaggttttcaaaagttttcagcagtatagatcgaatcactcagaattcagcagaagagaaggaagactctgtggacaaaaccaaaagcaccaccttgccatccacagaaacactgagctggagttcagaatattctgaaatgcaacagctatcaacatccaactcttcagatactgaaagcaacagacataaactcagttctggcctacttcccaaactggctatttcaacagagggagagcaagatgaagctgcctcctgccctggagacccccatgaggagccaggaaagccagcccttcctcctgaagagtgtgcccaggaggagcctgaggtcaccaccccagccagcaccatcagcagctccaccctgtcagttggcagtttttcagagcacttggatcagataaatggacgaagcgagtgtgtggacagtacagataattcctcaaagccatccagtgaacccgcttctcacatggctcggcagcgattagaaagcacagaaaaaaagaaaatctcggggaaagtcacaaagtccctctctgccagtgctctttccctcatgatcccaggagatatgtttgctgtttcccctctgggaagtccaatgtctccccattccctgtcctcggacccttcttcttcacgagattcctctcccagccgagattcctcagcagcttctgccagtccacatcagccgattgtgatccacagttcggggaagaactacggctttaccatccgagccatccgggtgtatgtgggagacagtgacatctatacagtgcaccatatcgtctggaatgtagaagaaggaagtccggcatgccaggcaggactgaaggctggagatcttatcactcacatcaatggagaaccagtgcatggacttgtccacacagaagttatagaactcctactgaagagtgggaataaggtgtcaatcactactaccccatttgaaaacacatcaatcaaaactggaccagccaggagaaacagctataagagccggatggtgaggcggagcaagaaatccaagaagaaagaaagtctcgaaaggaggagatctcttttcaaaaagctagccaagcagccttctcctttactccacaccagccgaagtttctcctgcttgaacagatccctgtcatcgggtgagagcctcccaggttcccccactcatagcttgtctccccggtctccaacaccaagctaccgctccacccctgacttcccatctggtactaattcctcccagagcagctcccctagttctagtgcccccaattccccagcagggtccgggcacatccggcccagcactctccacggtcttgcacccaaactcggcgggcagcggtaccggtccggaaggcgaaagtccgccggcaacatcccactgtccccgctggcccggacgccctctccaaccccgcaacccacctccccgcagcggtcaccatcccctcttctgggacactcactgggcaattccaagatcgcgcaagcctttcccagcaagatgcactccccgcccaccatcgtcagacacatcgtgaggcccaagagtgcggagccccccaggtccccgctgctcaagcgcgtgcagtccgaggagaagctgtcgccctcttacggcagtgacaagaagcacctgtgctcccgcaagcacagcctggaggtgacccaagaggaggtgcagcgggagcagtcccagcgggaggcgccgctgcagagcctggatgagaacgtgtgcgacgtgccgccgctcagccgcgcccggccagtggagcaaggctgcctgaaacgcccagtctcccggaaggtgggccgccaggagtctgtggacgacctggaccgcgacaagctgaaggccaaggtggtggtgaagaaagcagacggcttcccagagaaacaggaatcccaccagaaatcccatggacccgggagtgatttggaaaactttgctctgtttaagctggaagagagagagaagaaagtctatccgaaggctgtggaaaggtcaagtacttttgaaaacaaagcgtctatgcaggaggcgccaccgctgggcagcctgctgaaggatgctcttcacaagcaggccagcgtgcgcgccagcgagggtgcgatgtcggatggccgggtgcctgcggagcaccgccagggtggcggggacttcagacgggcccccgctcctggcaccctccaggatggtctctgccactccctcgacaggggcatctctgggaagggggaaggcacggagaagtcctcccaggccaaggagcttctccgatgtgaaaagttagacagcaagctggccaacatcgattacctccgaaagaaaatgtcacttgaggacaaagaggacaacctctgccctgtgctgaagcccaagatgacagctggctcccacgaatgcctgccagggaacccagtccgacccacgggtgggcagcaggagcccccgccggcttctgagagccgagcttttgtcagcagcacccatgcagctcagatgagtgccgtctcttttgttcccctcaaggccttaacaggccgggtggacagtggaacggagaagcctggcttggttgctcctgagtcccctgttaggaagagcccctccgagtataagctggaaggtaggtctgtctcatgcctgaagccgatcgagggcactctggacattgctctcctgtccggacctcaggcctccaagacagaactgccttccccagagtctgcacagagccccagcccaagtggtgacgtgagggcctctgtgccaccagttctccccagcagcagtgggaaaaagaacgataccaccagtgcaagagagctttctccttccagcttaaagatgaataaatcctacctgctggagccttggttcctgccccccagccgaggtctccagaattcaccagcagtttccctgcctgacccagagttcaagagggacaggaaaggtccccatcctactgccaggagccctggaacagtcatggaaagcaatccccaacagagagagggcagctcccctaaacaccaagaccacaccactgaccccaagcttctgacctgcctggggcagaacctccacagccctgacctggccaggccacgctgcccgctcccacctgaagcttccccctcaagggagaagccaggcctgagggaatcgtctgaaagaggccctcccacagccagaagcgagcgctctgctgcgagggctgacacatgcagagagccctccatggaactgtgctttccagaaactgcgaaaaccagtgacaactccaaaaatctcctctctgtgggaaggacccacccagatttctatacacagacccaggccatggagaaagcatgggcgccgggtgggaaaacgaaccacaaagatggcccaggtgaggcgaggcccccgcccagagacaactcctctctgcactcagctggaattccctgtgagaaggagctgggcaaggtgaggcgtggcgtggaacccaagcccgaagcgcttcttgccaggcggtctctgcagccacctggaattgagagtgagaagagtgaaaagctctccagtttcccatctttgcagaaagatggtgccaaggaacctgaaaggaaggagcagcctctacaaaggcatcccagcagcatccctccgccccctctgacggccaaagacctgtccagcccggctgccaggcagcattgcagttccccaagccacgcttctggcagagagccgggggccaagcccagcactgcagagcccagctcgagcccccaggaccctcccaagcctgttgctgcgcacagtgaaagcagcagccacaagccccggcctggccctgacccgggccctccaaagactaagcaccccgaccggtccctctcctctcagaaaccaagtgtcggggccacaaagggcaaagagcctgccactcagtccctcggtggctctagcagagaggggaagggccacagtaagagtgggccggatgtgtttcctgctaccccaggctcccagaacaaagccagcgatgggattggccagggagaaggtgggccctctgtcccactgcacactgacagggctcctctagacgccaagccacaacccaccagtggtgggcggcccctggaggtgctggagaagcctgtgcatttgccaaggccgggacacccagggcctagtgagccagcggaccagaaactgtccgctgttggtgaaaagcaaaccctgtctccaaagcaccccaaaccatccactgtgaaagattgccccaccctgtgcaaacagacagacaacagacagacagacaaaagcccgagtcagccggccgccaacaccgacagaagggcggaagggaagaaatgcactgaagcactttatgctccagcagagggcgacaagctcgaggccggcctttcctttgtgcatagcgagaaccggttgaaaggcgcggagcggccagccgcgggggtggggaagggcttccctgaggccagagggaaagggcccggtccccagaagccaccgacggaggcagacaagcccaatggcatgaaacggtccccctcagccactgggcagagttctttccgatccacggccctcccggaaaagtctctgagctgctcctccagcttccctgaaaccagggccggagttagagaggcctctgcagccagcagcgacacctcttctgccaaggccgccgggggcatgctggagcttccagcccccagcaacagggaccataggaaggctcagcctgccggggagggccgaacccacatgacaaagagtgactccctgccctccttccgggtctccaccctgcctctggagtcacaccaccccgacccaaacaccatgggcggggccagccaccgggacagggctctctcggtgactgccaccgtaggggaaaccaaagggaaggaccctgccccagcccagcctcccccagctaggaaacagaacgtgggcagagacgtgaccaagccatccccagccccaaacactgaccgccccatctctctttctaatgagaaggactttgtggtacggcagaggcgggggaaagagagtttgcgtagcagccctcacaaaaaggccttgtaa

SEQ ID NO: 466 - DNA, 201 bp, synthetic construct
  misc_feature 1..201: note = Synthetic polynucleotide
  source 1..201: mol_type = other DNA
aactcctatttctgagatttcctttaccacttaggaggtagactatgaccagggaccattgctctcactcctacagtcaaaataacctggaaggagctgagtctccccagaagaggaagtttgatagattcccagaagtggaattgcttggtcaaacgccctgtgtgtccaaatgctgggagaacatcaccccttggatga

SEQ ID NO: 467 - DNA, 165 bp, synthetic construct
  misc_feature 1..165: note = Synthetic polynucleotide
  source 1..165: mol_type = other DNA
aactcctatttctgagatttcctttaccacttaggaggtagactatgaccagggaccattgctctcactcctacagtcaaaataacctggaaggagctgagtctccccagaagaggaagtttccctgtgtgtccaaatgctgggagaacatcaccccttggatga

SEQ ID NO: 468 - DNA, 129 bp, synthetic construct
  misc_feature 1..129: note = Synthetic polynucleotide
  source 1..129: mol_type = other DNA
aactcctatttctgagatttcctttaccacttaggaggtagactatgaccagggaccattgctctcactcctacagtcaaaataacctggaaggagctgagtctccccagaagaggaagtttcaactga

SEQ ID NO: 469 - DNA, 201 bp, synthetic construct
  misc_feature 1..201: note = Synthetic polynucleotide
  source 1..201: mol_type = other DNA
aactcctatttctgagatttcctttaccacttaggaggtagactatgaccagggaccattgctctcactcctacagtcaaaataacctggaaggagctgagtctccccagaagaggaagtttgtgcagaagcagtgattgtgactgggtaatagacaagagaagtgagagaaactgctttctaggcaagatgctgttatga

SEQ ID NO: 470 - DNA, 270 bp, synthetic construct
  misc_feature 1..270: note = Synthetic polynucleotide
  source 1..270: mol_type = other DNA
aactcctatttctgagatttcctttaccacttaggaggtagactatgaccagggaccattgctctcactcctacagtcaaaataacctggaaggagctgagtctccccagaagaggaagtttgatagattcccagaagtggaattgcttggtcaaacggagcctgagtccaaccccatccagcccaggcagtccttgtagtcctctcttggcctttcacttttggagccctgtgtgtccaaatgctgggagaacatcaccccttggatga

SEQ ID NO: 471 - DNA, 201 bp, synthetic construct; identical to SEQ ID NO: 469
  misc_feature 1..201: note = Synthetic polynucleotide
  source 1..201: mol_type = other DNA

SEQ ID NO: 472 - DNA, 1104 bp, synthetic construct
  misc_feature 1..1104: note = Synthetic polynucleotide
  source 1..1104: mol_type = other DNA
aactcctatttctgagatttcctttaccacttaggaggtagactatgaccagggaccattgctctcactcctacagtcaaaataacctggaaggagctgagtctccccagaagaggaagtttgatagattcccagaagtggaattgcttggtcaaacgttgccgaacaagcaaccggaaaagcttaataggcaatgggcagtcaccagcattgcctcgaccacactcacctctctctgctcatgcaggaaatagccctcaagatagtccaagaaatttctcccccagtgcctcagcccatttttcatttgcacggaggactgatggacgccgctggtcgttggcttctctcccttcctctggctatgggacaaacacacccagctctacggtctcttcatcctgttcctcccaggagaagttgcatcagttaccataccaaccaacaccagacgagttacacttcttatcaaaacatttctgtaccaccgaaagcatcgccactgagaacagatgcaggaacacgccgatgcgcccccgttcccgaagtctgagccctggacgttctcccgcctgctgtgaccatgaaataattatgatgaaccatgtctacaaagaaaggttcccaaaggctacagctcagatggaagaacgtctaaaggaaattatcaccagctactctcctgacaacgttctacccttagcagatggagtgcttagtttcactcaccaccagattattgaactggctcgagattgcttggataaatcccaccagggcctcatcacctcacgatacttccttgaattacagcacaaattagataagttgctacaggaggctcatgatcgttcagaaagtggagaattggcatttattaaacaactagttcgaaagatcctaattgttattgcccgccctgctcggttattagagtgcctggaatttgatccggaagaattttactacctattggaagcagcagaaggccatgccaaagaaggacagggtattaaaaccgacattcccaggtacatcattagccaactgggactcaataaggatcccttggaaggtgagtccctgggttgttcctacctttga

SEQ ID NO: 473 - DNA, 7356 bp, synthetic construct
  misc_feature 1..7356: note = Synthetic polynucleotide
  source 1..7356: mol_type = other DNA
aactcctatttctgagatttcctttaccacttaggaggtagactatgaccagggaccattgctctcactcctacagtcaaaataacctggaaggagctgagtctccccagaagaggaagtttgatagattcccagaagtggaattgcttggtcaaacgttgccgaacaagcaaccggaaaagcttaataggcaatgggcagtcaccagcattgcctcgaccacactcacctctctctgctcatgcaggaaatagccctcaagatagtccaagaaatttctcccccagtgcctcagcccatttttcatttgcacggaggactgatggacgccgctggtcgttggcttctctcccttcctctggctatgggacaaacacacccagctctacggtctcttcatcctgttcctcccaggagaagttgcatcagttaccataccaaccaacaccagacgagttacacttcttatcaaaacatttctgtaccaccgaaagcatcgccactgagaacagatgcaggaacacgccgatgcgcccccgttcccgaagtctgagccctggacgttctcccgcctgctgtgaccatgaaataattatgatgaaccatgtctacaaagaaaggttcccaaaggctacagctcagatggaagaacgtctaaaggaaattatcaccagctactctcctgacaacgttctacccttagcagatggagtgcttagtttcactcaccaccagattattgaactggctcgagattgcttggataaatcccaccagggcctcatcacctcacgatacttccttgaattacagcacaaattagataagttgctacaggaggctcatgatcgttcagaaagtggagaattggcatttattaaacaactagttcgaaagatcctaattgttattgcccgccctgctcggttattagagtgcctggaatttgatccggaagaattttactacctattggaagcagcagaaggccatgccaaagaaggacagggtattaaaaccgacattcccaggtacatcattagccaactgggactcaataaggatcccttggaagaaatggctcatttgggaaactacgatagtgggacagcagaaacaccagaaacagatgaatcagtgagtagctctaatgcctccctgaaacttcgaaggaaacctcgggaaagtgattttgaaacgattaaattgattagcaatggagcctatggggcagtctactttgttcggcataaagaatcccggcagaggtttgccatgaagaagattaataaacagaacctcatccttcgaaaccagatccagcaggcctttgtggagcgggatatcctgacttttgcagaaaacccctttgttgtcagcatgtattgctcctttgaaacaaggcgccacttgtgcatggtcatggaatatgtggaagggggagactgtgctactttaatgaaaaacatgggtcctctccctgttgatatggccagaatgtactttgctgagacggtcttggccttggaatatttacataattatggaattgtacacagggatttgaaaccagacaacttgttggttacctccatggggcacataaagctgacagattttggattatctaaggtgggactaatgagcatgactaccaacctttacgagggtcatattgagaaggatgctagagagttcctggataaacaggtctgtggcacacctgaatacattgcaccagaagtgattctgaggcagggttatggaaagccggtggactggtgggccatggggattatcctctatgaatttctggttggatgcgtgccattctttggggatactccagaggagctatttggacaagtcatcagtgatgagatcaactggcctgagaaggatgaggcacccccacctgatgcccaggatctgattaccttactcctcaggcagaatcccctggagaggctgggaacaggtggtgcatatgaagtcaaacagcatcgattcttccgttctttagactggaacagtttgctgagacagaaggcagaatttattccccaactggaatctgaggatgacacaagttattttgatactcggtctgagaagtatcatcatatggaaacggaggaagaagatgacacaaatgatgaagactttaatgtggaaataaggcagttttcttcatgttcacacaggttttcaaaagttttcagcagtatagatcgaatcactcagaattcagcagaagagaaggaagactctgtggacaaaaccaaaagcaccaccttgccatccacagaaacactgagctggagttcagaatattctgaaatgcaacagctatcaacatccaactcttcagatactgaaagcaacagacataaactcagttctggcctacttcccaaactggctatttcaacagagggagagcaagatgaagctgcctcctgccctggagacccccatgaggagccaggaaagccagcccttcctcctgaagagtgtgcccaggaggagcctgaggtcaccaccccagccagcaccatcagcagctccaccctgtcagttggcagtttttcagagcacttggatcagataaatggacgaagcgagtgtgtggacagtacagataattcctcaaagccatccagtgaacccgcttctcacatggctcggcagcgattagaaagcacagaaaaaaagaaaatctcggggaaagtcacaaagtccctctctgccagtgctctttccctcatgatcccaggagatatgtttgctgtttcccctctgggaagtccaatgtctccccattccctgtcctcggacccttcttcttcacgagattcctctcccagccgagattcctcagcagcttctgccagtccacatcagccgattgtgatccacagttcggggaagaactacggctttaccatccgagccatccgggtgtatgtgggagacagtgacatctatacagtgcaccatatcgtctggaatgtagaagaaggaagtccggcatgccaggcaggactgaaggctggagatcttatcactcacatcaatggagaaccagtgcatggacttgtccacacagaagttatagaactcctactgaagagtgggaataaggtgtcaatcactactaccccatttgaaaacacatcaatcaaaactggaccagccaggagaaacagctataagagccggatggtgaggcggagcaagaaatccaagaagaaagaaagtctcgaaaggaggagatctcttttcaaaaagctagccaagcagccttctcctttactccacaccagccgaagtttctcctgcttgaacagatccctgtcatcgggtgagagcctcccaggttcccccactcatagcttgtctccccggtctccaacaccaagctaccgctccacccctgacttcccatctggtactaattcctcccagagcagctcccctagttctagtgcccccaattccccagcagggtccgggcacatccggcccagcactctccacggtcttgcacccaaactcggcgggcagcggtaccggtccggaaggcgaaagtccgccggcaacatcccactgtccccgctggcccggacgccctctccaaccccgcaacccacctccccgcagcggtcaccatcccctcttctgggacactcactgggcaattccaagatcgcgcaagcctttcccagcaagatgcactccccgcccaccatcgtcagacacatcgtgaggcccaagagtgcggagccccccaggtccccgctgctcaagcgcgtgcagtccgaggagaagctgtcgccctcttacggcagtgacaagaagcacctgtgctcccgcaagcacagcctggaggtgacccaagaggaggtgcagcgggagcagtcccagcgggaggcgccgctgcagagcctggatgagaacgtgtgcgacgtgccgccgctcagccgcgcccggccagtggagcaaggctgcctgaaacgcccagtctcccggaaggtgggccgccaggagtctgtggacgacctggaccgcgacaagctgaaggccaaggtggtggtgaagaaagcagacggcttcccagagaaacaggaatcccaccagaaatcccatggacccgggagtgatttggaaaactttgctctgtttaagctggaagagagagagaagaaagtctatccgaaggctgtggaaaggtcaagtacttttgaaaacaaagcgtctatgcaggaggcgccaccgctgggcagcctgctgaaggatgctcttcacaagcaggccagcgtgcgcgccagcgagggtgcgatgtcggatggccgggtgcctgcggagcaccgccagggtggcggggacttcagacgggcccccgctcctggcaccctccaggatggtctctgccactccctcgacaggggcatctctgggaagggggaaggcacggagaagtcctcccaggccaaggagcttctccgatgtgaaaagttagacagcaagctggccaacatcgattacctccgaaagaaaatgtcacttgaggacaaagaggacaacctctgccctgtgctgaagcccaagatgacagctggctcccacgaatgcctgccagggaacccagtccgacccacgggtgggcagcaggagcccccgccggcttctgagagccgagcttttgtcagcagcacccatgcagctcagatgagtgccgtctcttttgttcccctcaaggccttaacaggccgggtggacagtggaacggagaagcctggcttggttgctcctgagtcccctgttaggaagagcccctccgagtataagctggaaggtaggtctgtctcatgcctgaagccgatcgagggcactctggacattgctctcctgtccggacctcaggcctccaagacagaactgccttccccagagtctgcacagagccccagcccaagtggtgacgtgagggcctctgtgccaccagttctccccagcagcagtgggaaaaagaacgataccaccagtgcaagagagctttctccttccagcttaaagatgaataaatcctacctgctggagccttggttcctgccccccagccgaggtctccagaattcaccagcagtttccctgcctgacccagagttcaagagggacaggaaaggtccccatcctactgccaggagccctggaacagtcatggaaagcaatccccaacagagagagggcagctcccctaaacaccaagaccacaccactgaccccaagcttctgacctgcctggggcagaacctccacagccctgacctggccaggccacgctgcccgctcccacctgaagcttccccctcaagggagaagccaggcctgagggaatcgtctgaaagaggccctcccacagccagaagcgagcgctctgctgcgagggctgacacatgcagagagccctccatggaactgtgctttccagaaactgcgaaaaccagtgacaactccaaaaatctcctctctgtgggaaggacccacccagatttctatacacagacccaggccatggagaaagcatgggcgccgggtgggaaaacgaaccacaaagatggcccaggtgaggcgaggcccccgcccagagacaactcctctctgcactcagctggaattccctgtgagaaggagctgggcaaggtgaggcgtggcgtggaacccaagcccgaagcgcttcttgccaggcggtctctgcagccacctggaattgagagtgagaagagtgaaaagctctccagtttcccatctttgcagaaagatggtgccaaggaacctgaaaggaaggagcagcctctacaaaggcatcccagcagcatccctccgccccctctgacggccaaagacctgtccagcccggctgccaggcagcattgcagttccccaagccacgcttctggcagagagccgggggccaagcccagcactgcagagcccagctcgagcccccaggaccctcccaagcctgttgctgcgcacagtgaaagcagcagccacaagccccggcctggccctgacccgggccctccaaagactaagcaccccgaccggtccctctcctctcagaaaccaagtgtcggggccacaaagggcaaagagcctgccactcagtccctcggtggctctagcagagaggggaagggccacagtaagagtgggccggatgtgtttcctgctaccccaggctcccagaacaaagccagcgatgggattggccagggagaaggtgggccctctgtcccactgcacactgacagggctcctctagacgccaagccacaacccaccagtggtgggcggcccctggaggtgctggagaagcctgtgcatttgccaaggccgggacacccagggcctagtgagccagcggaccagaaactgtccgctgttggtgaaaagcaaaccctgtctccaaagcaccccaaaccatccactgtgaaagattgccccaccctgtgcaaacagacagacaacagacagacagacaaaagcccgagtcagccggccgccaacaccgacagaagggcggaagggaagaaatgcactgaagcactttatgctccagcagagggcgacaagctcgaggccggcctttcctttgtgcatagcgagaaccggttgaaaggcgcggagcggccagccgcgggggtggggaagggcttccctgaggccagagggaaagggcccggtccccagaagccaccgacggaggcagacaagcccaatggcatgaaacggtccccctcagccactgggcagagttctttccgatccacggccctcccggaaaagtctctgagctgctcctccagcttccctgaaaccagggccggagttagagaggcctctgcagccagcagcgacacctcttctgccaaggccgccgggggcatgctggagcttccagcccccagcaacagggaccataggaaggctcagcctgccggggagggccgaacccacatgacaaagagtgactccctgccctccttccgggtctccaccctgcctctggagtcacaccaccccgacccaaacaccatgggcggggccagccaccgggacagggctctctcggtgactgccaccgtaggggaaaccaaagggaaggaccctgccccagcccagcctcccccagctaggaaacagaacgtgggcagagacgtgaccaagccatccccagccccaaacactgaccgccccatctctctttctaatgagaaggactttgtggtacggcagaggcgggggaaagagagtttgcgtagcagccctcacaaaaaggccttgtaa

SEQ ID NO: 474 - DNA, 246 bp, synthetic construct
  misc_feature 1..246: note = Synthetic polynucleotide
  source 1..246: mol_type = other DNA
aactcctatttctgagatttcctttaccacttaggaggtagactatgaccagggaccattgctctcactcctacagtcaaaataacctggaaggagctgagtctccccagaagaggaagtttgatagattcccagaagtggaattgcttggtcaaacgtctcactcccaggagcctgagtccaaccccatccagcccaggcagtccttgtagtcctctcttggcctttcacttttggagggaatga

SEQ ID NO: 475 - DNA, 1201 bp, synthetic construct
  misc_feature 1..1201: note = Synthetic polynucleotide
  source 1..1201: mol_type = other DNA
ccaagatggctgaataggaacagctccagtctacagctcccagcgtgagtgacacagaagacgaatgatttctgcatttccaaatgaggttatcaagtgcaaggctgcagttgcttgggaggctggaaagcctctctccatagaggagatagaggtggcacccccaaaggctcatgaagttcgaatcaagatcattgccactgcggtttgccacaccgatgcctataccctgagtggagctgatcctgagggttgttttccagtgatcttgggacatgaaggtgctggaattgtggaaagtgttggtgagggagttactaagctgaaggcgggtgacactgtcatcccactttacatcccacagtgtggagaatgcaaattttgtctaaatcctaaaactaacctttgccagaagataagagtcactcaagggaaaggattaatgccagatggtaccagcagatttacttgcaaaggaaagacaattttgcattacatgggaaccagcacattttctgaatacacagttgtggctgatatctctgttgctaaaatagatcctttagcacctttggataaagtctgccttctaggttgtggcatttcaaccggttatggtgctgctgtgaacactgccaagttggagcctggctctgtttgtgccgtctttggtctgggaggagtcggattggcagttatcatgggctgtaaagtggctggtgcttcccggatcattggtgtggacatcaataaagataaatttgcaagggccaaagagtttggagccactgaatgtattaaccctcaggattttagtaaacccatccaggaagtgctcattgagatgaccgatggaggagtggactattcctttgaatgtattggtaatgtgaaggtcatgagagcagcacttgaggcatgtcacaagggctggggcgtcagcgtcgtggttggagtagctgcttcaggtgaagaaattgccactcgtccattccagctggtaacaggtcgcacatggaaaggcactgcctttggaggatggaagagtgtagaaagtgtcccaaagttggtgtctgaatatatgtccaaaaagataaaagttgatgaatttgtgactcacaatctgtcttttgatgaaatcaacaaagcctttgaactgatgcattctggaaagagcattcgaactgttgtaaagatttaa

SEQ ID NO: 476 - DNA, 247 bp, synthetic construct
  misc_feature 1..247: note = Synthetic polynucleotide
  source 1..247: mol_type = other DNA
ccaagatggctgaataggaacagctccagtctacagctcccagcgtgagtgacacagaagacgaatgatttctgcatttccaaatgaggttatcaagtgcaaggctgcagttgcttgggaggctggaaagcctctctccatagaggagatagaggtggcacccccaaaggctcatgaagttcgaatcaaggtgacactgtcatcccactttacatcccacagtgtggagaatgcaaattttgtctaa

SEQ ID NO: 477 - DNA, 874 bp, synthetic construct
  misc_feature 1..874: note = Synthetic polynucleotide
  source 1..874: mol_type = other DNA
ccaagatggctgaataggaacagctccagtctacagctcccagcgtgagtgacacagaagacgaatgatttctgcatttccaaatgaggttatcaagtgcaaggctgcagttgcttgggaggctggaaagcctctctccatagaggagatagaggtggcacccccaaaggctcatgaagttcgaatcaagatcattgccactgcggtttgccacaccgatgcctataccctgagtggagctgatcctgagggttgttttccagtgatcttgggacatgaaggtgctggaattgtggaaagtgttggtgacactgtcatcccactttacatcccacagtgtggagaatgcaaattttgtctaaatcctaaaactaacctttgccagaagataagagtcactcaagggaaaggattaatgccagatggtaccagcagatttacttgcaaaggaaagacaattttgcattacatgggaaccagcacattttctgaatacacagttgtggctgatatctctgttgctaaaatagatcctttagcacctttggataaagtctgccttctaggttgtggcatttcaaccggttatggtgctgctgtgaacactgccaagttggagcctggctctgtttgtgccgtctttggtctgggaggagtcggattggcagttatcatgggctgtaaagtggctggtgcttcccggatcattggtgtggacatcaataaagataaatttgcaagggccaaagagtttggagccactgaatgtattaaccctcaggattttagtaaacccatccaggaagtgctcattgagatgaccgatggaggagtggactattcctttgaatgtattggtaatgtgaaggtcatg

SEQ ID NO: 478 - DNA, 364 bp, synthetic construct
  misc_feature 1..364: note = Synthetic polynucleotide
  source 1..364: mol_type = other DNA
ccaagatggctgaataggaacagctccagtctacagctcccagcgtgagtgacacagaagacgaatgatttctgcatttccaaatgaggttatcaagtgcaaggctgcagttgcttgggaggctggaaagcctctctccatagaggagatagaggtggcacccccaaaggctcatgaagttcgaatcaagatcattgccactgcggtttgccacaccgatgcctataccctgagtggagctgatcctgagggttgttttccagtgatcttgggacatgaaggtgctggaattgtggaaagtgttggtgagggagttactaagctgaaggcggtgtggagaatgcaaattttgtctaaatcctaa

SEQ ID NO: 479 - DNA, 424 bp, synthetic construct
  misc_feature 1..424: note = Synthetic polynucleotide
  source 1..424: mol_type = other DNA
ccaagatggctgaataggaacagctccagtctacagctcccagcgtgagtgacacagaagacgaatgatttctgcatttccaaatgaggttatcaagtgcaaggctgcagttgcttgggaggctggaaagcctctctccatagaggagatagaggtggcacccccaaaggctcatgaagttcgaatcaagatcattgccactgcggtttgccacaccgatgcctataccctgagtggagctgatcctgagggttgttttccagtgatcttgggacatgaaggtgctggaattgtggaaagtgttggtgagggagttactaagctgaaggcgggtgacactgtcatcccactttacatcccacagtgtggagaatgcaaattttgtctaaatcctaaaactaacctttgccagaagataagataa

SEQ ID NO: 480 - DNA, 163 bp, synthetic construct
  misc_feature 1..163: note = Synthetic polynucleotide
  source 1..163: mol_type = other DNA
ggccaggtgcaatgggtcaagcctgcaatccccacaccaaggtgggagtattgcttgaaaccaggagttcaagaccagcctaggcaagaaagcttttatcttgagaacatggtgtctggagttaaaggtattggcatactccacacatctgtaccattcttga

SEQ ID NO: 481 - DNA, 104 bp, synthetic construct
  misc_feature 1..104: note = Synthetic polynucleotide
  source 1..104: mol_type = other DNA
ggccaggtgcaatgggtcaagcctgcaatccccacaccaaggtgggagtattgcttgaaaccaggagttcaagaccagcctaggcaagaaagcttttatcttga

SEQ ID NO: 482 - DNA, 721 bp, synthetic construct
  misc_feature 1..721: note = Synthetic polynucleotide
  source 1..721: mol_type = other DNA
tgatagaaaaattgggggaaagatgtgaccagataattcaccaaaacacgttttaaaaatcatcctcaagcagatgagaaaaacgctgaaactcacctcctcattataaacatgctagttgtaacaacactaggacaccatttctgacctatcagtggggaaaatgtaaaactgtgaaattatactctgtgatgaggatatggagaaatggctctctcataccttgctggtgggcatgcaaattggtacaacccttctggagagaaatttggcaatatctaataaaagtacatacgcatttcctttttgatccaggaaacccactcctaagaatctaccctaaagatacacctccaagaatatgaaactacgtagacacacaaggaatttggccattggaatcgggatccagaatttccccgagggcctggctgtcagccttcccttgcgaggggcaggcttctccacctggagagctttctggtatgggcagctgagcggcatggtggagcccctggccggggtctttggtgcctttgccgtggtgctggctgagcccatcctgccctacgctctggcctttgctgccggtgccatggtctacgtggtcatggacgacatcatccccgaagcccagatcagtggtaatgggaaactggcatcctgggcctccatcctgggatttgtagtgatgatgtcactggacgttggcctgggctag

SEQ ID NO: 483 - DNA, 721 bp, synthetic construct; identical to SEQ ID NO: 482
  misc_feature 1..721: note = Synthetic polynucleotide
  source 1..721: mol_type = other DNA

SEQ ID NO: 484 - DNA, 522 bp, synthetic construct
  misc_feature 1..522: note = Synthetic polynucleotide
  source 1..522: mol_type = other DNA
tgatagaaaaattgggggaaagatgtgaccagataattcaccaaaacacgttttaaaaatcatcctcaagcagatgagaaaaacgctgaaactcacctcctcattataaacatgctagttgtaacaacactaggacaccatttctgacctatcagtggggaaaatgtaaaactgtgaaattatactctgtgatgaggatatggagaaatggctctctcataccttgctggtgggcatgcaaattggtacaacccttctggagagaaatttggcaatatctaataaaagtacatacgcatttcctttttgatccaggaaacccactcctaagaatctaccctaaagatacacctccaagaatatgaaactacgtagacacacaaggaatttggccattggaatcgggatccagaatttccccgagggcctggctgtcagccttcccttgcgaggggcaggcttctccacctggagagctttctggtatgggcagctgagcggcatggtggagcccctggccgg

SEQ ID NO: 485 - DNA, 299 bp, synthetic construct
  misc_feature 1..299: note = Synthetic polynucleotide
  source 1..299: mol_type = other DNA
tagatgaatggaacaaactggaaactccagaaacaagcccttctttacatttctaatgtttggcttaaatggaaggtgccaaggaaggggatgaagacccgtgtccatctgcacttggagccaaggccaggaactcccggctgatttgcaggcgcctgtgtcagttctccactcgtgtacacccagacgggggctcgatggcacaggaagcagatgatgccccgagtatatctacacttgggctgcaacaagaaacaacagagcccatgaaaactgacagtgctgaaagtgaagactga

SEQ ID NO: 486 - DNA, 299 bp, synthetic construct; identical to SEQ ID NO: 485
  misc_feature 1..299: note = Synthetic polynucleotide
  source 1..299: mol_type = other DNA

SEQ ID NO: 487 - DNA, 239 bp, synthetic construct
  misc_feature 1..239: note = Synthetic polynucleotide
  source 1..239: mol_type = other DNA
ggctgggcacgatggctccacaccggtaatcccagcactttgggaggctgagacacagccaaatcatcaacaagttcgtgaatagcgtgatcaacacgctgaaaagcactgtatcctccctgctgcagaaggagatatgtccactgatccgcatcttcatccactccctggatgtgaatgtcattcagcaggtcgtcgataatcctcagcacaaaacccagctgcaaaccctcatctga

SEQ ID NO: 488 - DNA, 239 bp, synthetic construct; identical to SEQ ID NO: 487
  misc_feature 1..239: note = Synthetic polynucleotide
  source 1..239: mol_type = other DNA

SEQ ID NO: 489 - DNA, 750 bp, synthetic construct
  misc_feature 1..750: note = Synthetic polynucleotide
  source 1..750: mol_type = other DNA
ttctcgcaccatgagctcacttcgtgtctccacgtcacatgttgggccttgggtgtctccgtgactgactacacgttcgaggactgccagctggccctggcggaaggacagctccgtctccccgctgacacttgccttttagaatttgccaggctcgtgcggggcctcgggctaaaaccagaaaagcttgaaaaagatctggacagatactcagaaagagccaggatgaagggaggagagaagataggtattgcggagtttgccgcctccctggaagtccccgtttctgacttgctggaagacatgttttcactgttcgacgagagcggcagcggcgaggtggacctgcgagagtgtgtggttgccctgtctgtcgtctgccggccggcccggaccctggacaccatccagctggctttcaagatgtacggagcgcaagaggacggcagcgtcggcgaaggtgacctgtcctgcatcctcaagacggccctgggggtggcagagctcaccgtgaccgacctattccgagccattgaccaagaggagaaggggaagatcacattcgctgacttccacaggtttgcagaaatgtaccctgccttcgcagaggaatacctgtacccggatcagacacatttcgaaagctgtgcagagacctcacctgcgccaatcccaaacggcttctgtgccgatttcagcccggaaaactcagacgctgggcggaagcctgttcgcaagaagctggattag

SEQ ID NO: 490 - DNA, 750 bp, synthetic construct; identical to SEQ ID NO: 489
  misc_feature 1..750: note = Synthetic polynucleotide
  source 1..750: mol_type = other DNA

SEQ ID NO: 491 - DNA, 38 bp, synthetic construct
  misc_feature 1..38: note = Synthetic polynucleotide
  source 1..38: mol_type = other DNA
tgttaaaacggagataccttcccggatgcagatgctga

SEQ ID NO: 492 - DNA, 249 bp, synthetic construct
  misc_feature 1..249: note = Synthetic polynucleotide
  source 1..249: mol_type = other DNA
tgttaaaacggagataccttcccggatgcagatgctgatgaagacagtctggcaggcgagctggatgaggccatggggtccagcgagtggctggccctgaccaagtcaccccaggccttttacagggggcgacccagctggcaaggaacccctggggttcttcggggcagccgagatgtcctggctggcctttccagcagctgctgcaagtgggggtgtagcaaaagtgaaatcagtagcctttgctag

SEQ ID NO: 493 - DNA, 503 bp, synthetic construct
  misc_feature 1..503: note = Synthetic polynucleotide
  source 1..503: mol_type = other DNA
gatgaggagcctccatcattgaagctgggacctcagaaagttataaaaataataaagcaaaattgtactggcatgggataggtttcctaaatcatgaaatgcctccagatattattcttcagccggatgtctaccctggaaagtgctgggcttttccaggttcccagggtcataccctaatcaagcttgctacaaagatcataccaactgctgttaccatggagcacatctcagagaaggtgtctccgtcaggaaacatctccagtgcacccaaggaattttctgtctatggcatcacaaaaaaatgtgaaggagaagaaattttcctaggtcagtttatatataacaaaacaggaaccaccgttcaaacatttgaactccagcatgcagtttctgaatatttattatgtgtgaaacttaatatctttagcaactggggacacccgaagtatacttgtttatatcgattcagggtccatggcacaccaggcaagcacatctag

SEQ ID NO: 494 - DNA, 503 bp, synthetic construct; identical to SEQ ID NO: 493
  misc_feature 1..503: note = Synthetic polynucleotide
  source 1..503: mol_type = other DNA

SEQ ID NO: 495 - DNA, 476 bp, synthetic construct
  misc_feature 1..476: note = Synthetic polynucleotide
  source 1..476: mol_type = other DNA
gatgaggagcctccatcattgaagctgggacctcagaaagttataaaaataataaagcaaaattgtactggcatgggataggtttcctaaatcatgaaatgcctccagatattattcttcagccggatgtctaccctggaaagtgctgggcttttccaggttcccagggtcataccctaatcaagcttgctacaaagatcataccaactgctgttaccatggagcacatctcagagaaggtgtctccgtcaggaaacatctccagtgcacccaaggaattttctgtctatggcatcacaaaaaaatgtgaaggagaagaaattttcctaggtcagtttatatataacaaaacaggaaccaccgttcaaacatttgaactccagggtccatggcacaccaggcaagcacatctagaagagttggtacagaaggccatgccacatgtccagaatattcaagaatgcttattctcttag

SEQ ID NO: 496 - DNA, 539 bp, synthetic construct
  misc_feature 1..539: note = Synthetic polynucleotide
  source 1..539: mol_type = other DNA
gatgaggagcctccatcattgaagctgggacctcagaaagttataaaaataataaagcaaaattgtactggcatgggataggtttcctaaatcatgaaatgcctccagatattattcttcagccggatgtctaccctggaaagtgctgggcttttccaggttcccagggtcataccctaatcaagcttgctacaaagatcataccaactgctgttaccatggagcacatctcagagaaggtgtctccgtcaggaaacatctccagtgcacccaaggaattttctgtctatgttcagaggtatatgtgcaggtttgttatacaggcgggcatcacaaaaaaatgtgaaggagaagaaattttcctaggtcagtttatatataacaaaacaggaaccaccgttcaaacatttgaactccagcatgcagtttctgaatatttattatgtgtgaaacttaatatctttagcaactggggacacccgaagtatacttgtttatatcgattcagggtccatggcacaccaggcaagcacatctag

SEQ ID NO: 497 - DNA, 503 bp, synthetic construct; identical to SEQ ID NO: 493
  misc_feature 1..503: note = Synthetic polynucleotide
  source 1..503: mol_type = other DNA

SEQ ID NO: 498 - DNA, 503 bp, synthetic construct; identical to SEQ ID NO: 493
  misc_feature 1..503: note = Synthetic polynucleotide
  source 1..503: mol_type = other DNA

SEQ ID NO: 499 - DNA, 539 bp, synthetic construct; identical to SEQ ID NO: 496
  misc_feature 1..539: note = Synthetic polynucleotide
  source 1..539: mol_type = other DNA

SEQ ID NO: 500 - DNA, 566 bp, synthetic construct
  misc_feature 1..566: note = Synthetic polynucleotide
  source 1..566: mol_type = other DNA
ggctggatatggtggctcaagcctgtgaccccagcactttgggaggccaaaatgattatccttgctctggaatgttgggtatggtgtctggacttatttctgactcccagatcacatcatccaaccaaggggacagaaactggatgcctgaaaacatccgcctggtaaccagtcgctctggctgggcacttccacccgcacctcattcctacatcaatgagtggctccaaatagacctgggggaggagaagatcgtgaggggcatcatcattcagggtgggaagcaccgagagaacaaggtgttcatgaggaagttcaagatcgggtacagcaacaacggctcggactggaagatgatcatggatgacagcaaacgcaaggcgaaggtgagggctggggactgggaggaggtcatcccttatgtccttgacttcaatcaagggcctctggcattctcccgaggaagggcttcttatttccttccagccatgacattagaggaggtgtgtgatggggtcagtaagacccttgattctaggaagacaggaatatggcatgaaaagtga

SEQ ID NO: 501 - DNA, 1523 bp, synthetic construct
  misc_feature 1..1523: note = Synthetic polynucleotide
  source 1..1523: mol_type = other DNA
ggctggatatggtggctcaagcctgtgaccccagcactttgggaggccaaaatgattatccttgctctggaatgttgggtatggtgtctggacttatttctgactcccagatcacatcatccaaccaaggggacagaaactggatgcctgaaaacatccgcctggtaaccagtcgctctggctgggcacttccacccgcacctcattcctacatcaatgagtggctccaaatagacctgggggaggagaagatcgtgaggggcatcatcattcagggtgggaagcaccgagagaacaaggtgttcatgaggaagttcaagatcgggtacagcaacaacggctcggactggaagatgatcatggatgacagcaaacgcaaggcgaagtcttttgagggcaacaacaactatgatacacctgagctgcggacttttccagctctctccacgcgattcatcaggatctaccccgagagagccactcatggcggactggggctcagaatggagctgctgggctgtgaagtggaagcccctacagctggaccgaccactcccaacgggaacttggtggatgaatgtgatgacgaccaggccaactgccacagtggaacaggtggcaccactgtgctggccacagaaaagcccacggtcatagacagcaccatacaatcagagtttccaacatatggttttaactgtgaatttggctggggctctcacaagaccttctgccactgggaacatgacaatcacgtgcagctcaagtggagtgtgttgaccagcaagacgggacccattcaggatcacacaggagatggcaacttcatctattcccaagctgacgaaaatcagaagggcaaagtggctcgcctggtgagccctgtggtttattcccagaactctgcccactgcatgaccttctggtatcacatgtctgggtcccacgtcggcacactcagggtcaaactgcgctaccagaagccagaggagtacgatcagctggtctggatggccattggacaccaaggtgaccactggaaggaagggcgtgtcttgctccacaagtctctgaaactttatcaggtgattttcgagggcgaaatcggaaaaggaaaccttggtgggattgctgtggatgacattagtattaataaccacatttcacaagaagattgtgcaaaaccagcagacctggataaaaagaacccagaaattaaaattgatgaaacagggagcacgccaggatacgaaggtgaaggagaaggtgacaagaacatctccaggaagccaggcaatgtgttgaagaccttagaccccatcctcatcaccatcatagccatgagtgccctgggggtcctcctgggggctgtctgtggggtcgtgctgtactgtgcctgttggcataatgggatgtcagaaagaaacttgtctgccctggagaactataactttgaacttgtggatggtgtgaagttgaaaaaagacaaactgaatacacagagtacttattcggaggcatga

SEQ ID NO: 502 - DNA, 1544 bp, synthetic construct
  misc_feature 1..1544: note = Synthetic polynucleotide
  source 1..1544: mol_type = other DNA
ggctggatatggtggctcaagcctgtgaccccagcactttgggaggccaaaatgattatccttgctctggaatgttgggtatggtgtctggacttatttctgactcccagatcacatcatccaaccaaggggacagaaactggatgcctgaaaacatccgcctggtaaccagtcgctctggctgggcacttccacccgcacctcattcctacatcaatgagtggctccaaatagacctgggggaggagaagatcgtgaggggcatcatcattcagggtgggaagcaccgagagaacaaggtgttcatgaggaagttcaagatcgggtacagcaacaacggctcggactggaagatgatcatggatgacagcaaacgcaaggcgaagtcttttgagggcaacaacaactatgatacacctgagctgcggacttttccagctctctccacgcgattcatcaggatctaccccgagagagccactcatggcggactggggctcagaatggagctgctgggctgtgaagtggaagcccctacagctggaccgaccactcccaacgggaacttggtggatgaatgtgatgacgaccaggccaactgccacagtggaacaggtgatgacttccagctcacaggtggcaccactgtgctggccacagaaaagcccacggtcatagacagcaccatacaatcagagtttccaacatatggttttaactgtgaatttggctggggctctcacaagaccttctgccactgggaacatgacaatcacgtgcagctcaagtggagtgtgttgaccagcaagacgggacccattcaggatcacacaggagatggcaacttcatctattcccaagctgacgaaaatcagaagggcaaagtggctcgcctggtgagccctgtggtttattcccagaactctgcccactgcatgaccttctggtatcacatgtctgggtcccacgtcggcacactcagggtcaaactgcgctaccagaagccagaggagtacgatcagctggtctggatggccattggacaccaaggtgaccactggaaggaagggcgtgtcttgctccacaagtctctgaaactttatcaggtgattttcgagggcgaaatcggaaaaggaaaccttggtgggattgctgtggatgacattagtattaataaccacatttcacaagaagattgtgcaaaaccagcagacctggataaaaagaacccagaaattaaaattgatgaaacagggagcacgccaggatacgaaggtgaaggagaaggtgacaagaacatctccaggaagccaggcaatgtgttgaagaccttagaccccatcctcatcaccatcatagccatgagtgccctgggggtcctcctgggggctgtctgtggggtcgtgctgtactgtgcctgttggcataatgggatgtcagaaagaaacttgtctgccctggagaactataactttgaacttgtggatggtgtgaagttgaaaaaagacaaactgaatacacagagtacttattcggaggcatga

SEQ ID NO: 503 - DNA, 1544 bp, synthetic construct; identical to SEQ ID NO: 502
  misc_feature 1..1544: note = Synthetic polynucleotide
  source 1..1544: mol_type = other DNA

SEQ ID NO: 504 - DNA, 1493 bp, synthetic construct
  misc_feature 1..1493: note = Synthetic polynucleotide
  source 1..1493: mol_type = other DNA
ggctggatatggtggctcaagcctgtgaccccagcactttgggaggccaaaatgattatccttgctctggaatgttgggtatggtgtctggacttatttctgactcccagatcacatcatccaaccaaggggacagaaactggatgcctgaaaacatccgcctggtaaccagtcgctctggctgggcacttccacccgcacctcattcctacatcaatgagtggctccaaatagacctgggggaggagaagatcgtgaggggcatcatcattcagggtgggaagcaccgagagaacaaggtgttcatgaggaagttcaagatcgggtacagcaacaacggctcggactggaagatgatcatggatgacagcaaacgcaaggcgaagtcttttgagggcaacaacaactatgatacacctgagctgcggacttttccagctctctccacgcgattcatcaggatctaccccgagagagccactcatggcggactggggctcagaatggagctgctgggctgtgaagtggaagcccctacagctggaccgaccactcccaacgggaacttggtggatgaatgtgatgacgaccaggccaactgccacagtggaacaggtgatgacttccagctcacaggtggcaccactgtgctggccacagaaaagcccacggtcatagacagcaccatacaatcagagtttccaacatatggttttaactgtgaatttggctggggctctcacaagaccttctgccactgggaacatgacaatcacgtgcagctcaagtggagtgtgttgaccagcaagacgggacccattcaggatcacacaggagatggcaacttcatctattcccaagctgacgaaaatcagaagggcaaagtggctcgcctggtgagccctgtggtttattcccagaactctgcccactgcatgaccttctggtatcacatgtctgggtcccacgtcggcacactcagggtcaaactgcgctaccagaagccagaggagtacgatcagctggtctggatggccattggacaccaaggtgaccactggaaggaagggcgtgtcttgctccacaagtctctgaaactttatcaggtgattttcgagggcgaaatcggaaaaggaaaccttggtgggattgctgtggatgacattagtattaataaccacatttcacaagaagattgtgcaaggagcacgccaggatacgaaggtgaaggagaaggtgacaagaacatctccaggaagccaggcaatgtgttgaagaccttagaccccatcctcatcaccatcatagccatgagtgccctgggggtcctcctgggggctgtctgtggggtcgtgctgtactgtgcctgttggcataatgggatgtcagaaagaaacttgtctgccctggagaactataactttgaacttgtggatggtgtgaagttgaaaaaagacaaactgaatacacagagtacttattcggaggcatga

SEQ ID NO: 505 - DNA, 602 bp, synthetic construct
  misc_feature 1..602: note = Synthetic polynucleotide
  source 1..602: mol_type = other DNA
ggctggatatggtggctcaagcctgtgaccccagcactttgggaggccaaaatgattatccttgctctggaatgttgggtatggtgtctggacttatttctgactcccagatcacatcatccaaccaaggggacagaaactggatgcctgaaaacatccgcctggtaaccagtcgctctggctgggcacttccacccgcacctcattcctacatcaatgagtggctccaaatagacctgggggaggagaagatcgtgaggggcatcatcattcagggtgggaagcaccgagagaacaaggtgttcatgaggaagttcaagatcgggtacagcaacaacggctcggactggaagatgatcatggatgacagcaaacgcaaggcgaagtcttttgagggcaacaacaactatgatacacctgagctgcggacttttccagctctctccacgcgattcatcaggatctaccccgagagagccactcatggcggactggggctcagaatggagctgctgggctgtgaagtggaaggtggcaccactgtgctggccacagaaaagcccacggtcatagacagcaccatacaatcaggtatcaaataa

SEQ ID NO: 506 - DNA, 707 bp, synthetic construct
  misc_feature 1..707: note = Synthetic polynucleotide
  source 1..707: mol_type = other DNA
ggctggatatggtggctcaagcctgtgaccccagcactttgggaggccaaaatgattatccttgctctggaatgttgggtatggtgtctggacttatttctgactcccagatcacatcatccaaccaaggggacagaaactggatgcctgaaaacatccgcctggtaaccagtcgctctggctgggcacttccacccgcacctcattcctacatcaatgagtggctccaaatagacctgggggaggagaagatcgtgaggggcatcatcattcagggtgggaagcaccgagagaacaaggtgttcatgaggaagttcaagatcgggtacagcaacaacggctcggactggaagatgatcatggatgacagcaaacgcaaggcgaagtcttttgagggcaacaacaactatgatacacctgagctgcggacttttccagctctctccacgcgattcatcaggatctaccccgagagagccactcatggcggactggggctcagaatggagctgctgggctgtgaagtggaagcccctacagctggaccgaccactcccaacgggaacttggtggatgaatgtgatgacgaccaggccaactgccacagtggaacaggtgatgacttccagctcacaggtggcaccactgtgctggccacagaaaagcccacggtcatagacagcaccatacaatcaggtatcaaataa

SEQ ID NO: 507 - DNA, 887 bp, synthetic construct
  misc_feature 1..887: note = Synthetic polynucleotide
  source 1..887: mol_type = other DNA
ggctggatatggtggctcaagcctgtgaccccagcactttgggaggccaaaatgattatccttgctctggaatgttgggtatggtgtctggacttatttctgactcccagatcacatcatccaaccaaggggacagaaactggatgcctgaaaacatccgcctggtaaccagtcgctctggctgggcacttccacccgcacctcattcctacatcaatgagtggctccaaatagacctgggggaggagaagatcgtgaggggcatcatcattcagggtgggaagcaccgagagaacaaggtgttcatgaggaagttcaagatcgggtacagcaacaacggctcggactggaagatgatcatggatgacagcaaacgcaaggcgaagtcttttgagggcaacaacaactatgatacacctgagctgcggacttttccagctctctccacgcgattcatcaggatctaccccgagagagccactcatggcggactggggctcagaatggagctgctgggctgtgaagtggaagcccctacagctggaccgaccactcccaacgggaacttggtggatgaatgtgatgacgaccaggccaactgccacagtggaacaggtgatgacttccagctcacaggtgcagaaaccatcttcatcccattgctgtaccatttcagttcatgtcttagttgggaccagctaacgcctgtgtgtgtgcttgtaactccgcatggcagagagctgcccaggaatagaagctgccttgccagaacacgtgcatcttcatttcctcatgtcatctggatagatgagttgttcttaatagccacaaccatttgtaacaataatttgagccatttcgagagccaaaggctaggattatcttaa

SEQ ID NO: 508 - DNA, 698 bp, synthetic construct
  misc_feature 1..698: note = Synthetic polynucleotide
  source 1..698: mol_type = other DNA
ggctggatatggtggctcaagcctgtgaccccagcactttgggaggccaaaatgattatccttgctctggaatgttgggtatggtgtctggacttatttctgactcccagatcacatcatccaaccaaggggacagaaactggatgcctgaaaacatccgcctggtaaccagtcgctctggctgggcacttccacccgcacctcattcctacatcaatgagtggctccaaatagacctgggggaggagaagatcgtgaggggcatcatcattcagggtgggaagcaccgagagaacaaggtgttcatgaggaagttcaagatcgggtacagcaacaacggctcggactggaagatgatcatggatgacagcaaacgcaaggcgaagtcttttgagggcaacaacaactatgatacacctgagctgcggacttttccagctctctccacgcgattcatcaggatctaccccgagagagccactcatggcggactggggctcagaatggagctgctgggctgtgaagtggaaggcactatcaacacagaccaagaatgtccatgtgccagggctttggcaaaggatgccaagaaaaagaagagatgggcagactccactcactgcagatgcgttcgttcaattcacggagaaatgtggtcatctggaaaaggagtctgctccctggatgcgaatctgtag

SEQ ID NO: 509 - DNA, 1477 bp, synthetic construct
  misc_feature 1..1477: note = Synthetic polynucleotide
  source 1..1477: mol_type = other DNA
agatttctggtctggacatgtagtacagacctgtttttcattgttcctccctgctaagcacaagtataaaccctggaaataatgcaagagacaaccagggtagaactctggaaggttgtaaggagaaggcaaactggtttgagacccagggaaaaacaaagagcaagggtatcctatgtttcccacccagcagaagaaagaaacctagtcctggccattcctgatacccaactgaacaacagagggcagcccaggtcaggttagtgtggtgcaagtgaccatcccagacggtttcgtgaacgtgactgttggatctaatgtcactctcatctgcatctacaccaccactgtggcctcccgagaacagctttccatccagtggtctttcttccataagaaggagatggagccaatttctcacagctcgtgcctcagtactgagggtatggaggaaaaggcagtcagtcagtgtctaaaaatgacgcacgcaagagacgctcggggaagatgtagctggacctctgagatttacttttctcaaggtggacaagctgtagccatcgggcaatttaaagatcgaattacagggtccaacgatccaggtaatgcatctatcactatctcgcatatgcagccagcagacagtggaatttacatctgcgatgttaacaaccccccagactttctcggccaaaaccaaggcatcctcaacgtcagtgtgttagtgaaaccttctaagcccctttgtagcgttcaaggaagaccagaaactggccacactatttccctttcctgtctctctgcgcttggaacaccttcccctgtgtactactggcataaacttgagggaagagacatcgtgccagtgaaagaaaacttcaacccaaccaccgggattttggtcattggaaatctgacaaattttgaacaaggttattaccagtgtactgccatcaacagacttggcaatagttcctgcgaaatcgatctcacttcttcacatccagaagttggaatcattgttggggccttgattggtagcctggtaggtgccgccatcatcatctctgttgtgtgcttcgcaaggaataaggcaaaagcaaaggcaaaagaaagaaattctaagaccatcgcggaacttgagccaatgacaaagataaacccaaggggagaaagcgaagcaatgccaagagaagacgctacccaactagaagtaactctaccatcttccattcatgagactggccctgataccatccaagaaccagactatgagccaaagcctactcaggagcctgccccagagcctgccccaggatcagagcctatggcagtgcctgaccttgacatcgagctggagctggagccagaaacgcagtcggaattggagccagagccagagccagagccagagtcagagcctggggttgtagttgagcccttaagtgaagatgaaaagggagtggttaaggcatag

SEQ ID NO: 510 - DNA, 1369 bp, synthetic construct
  misc_feature 1..1369: note = Synthetic polynucleotide
  source 1..1369: mol_type = other DNA
agatttctggtctggacatgtagtacagacctgtttttcattgttcctccctgctaagcacaagtataaaccctggaaataatgcaagagacaaccagggtagaactctggaaggttgtaaggagaaggcaaactggtttgagacccagggaaaaacaaagagcaagggtatcctatgtttcccacccagcagaagaaagaaacctagtcctggccattcctgatacccaactgaacaacagagggcagcccaggtcaggttagtgtggtgcaagtgaccatcccagacggtttcgtgaacgtgactgttggatctaatgtcactctcatctgcatctacaccaccactgtggcctcccgagaacagctttccatccagtggtctttcttccataagaaggagatggagccaatttctatttacttttctcaaggtggacaagctgtagccatcgggcaatttaaagatcgaattacagggtccaacgatccaggtaatgcatctatcactatctcgcatatgcagccagcagacagtggaatttacatctgcgatgttaacaaccccccagactttctcggccaaaaccaaggcatcctcaacgtcagtgtgttagtgaaaccttctaagcccctttgtagcgttcaaggaagaccagaaactggccacactatttccctttcctgtctctctgcgcttggaacaccttcccctgtgtactactggcataaacttgagggaagagacatcgtgccagtgaaagaaaacttcaacccaaccaccgggattttggtcattggaaatctgacaaattttgaacaaggttattaccagtgtactgccatcaacagacttggcaatagttcctgcgaaatcgatctcacttcttcacatccagaagttggaatcattgttggggccttgattggtagcctggtaggtgccgccatcatcatctctgttgtgtgcttcgcaaggaataaggcaaaagcaaaggcaaaagaaagaaattctaagaccatcgcggaacttgagccaatgacaaagataaacccaaggggagaaagcgaagcaatgccaagagaagacgctacccaactagaagtaactctaccatcttccattcatgagactggccctgataccatccaagaaccagactatgagccaaagcctactcaggagcctgccccagagcctgccccaggatcagagcctatggcagtgcctgaccttgacatcgagctggagctggagccagaaacgcagtcggaattggagccagagccagagccagagccagagtcagagcctggggttgtagttgagcccttaagtgaagatgaaaagggagtggttaaggcatag

SEQ ID NO: 511 - DNA, 709 bp, synthetic construct
  misc_feature 1..709: note = Synthetic polynucleotide
  source 1..709: mol_type = other DNA
agatttctggtctggacatgtagtacagacctgtttttcattgttcctccctgctaagcacaagtataaaccctggaaataatgcaagagacaaccagggtagaactctggaaggttgtaaggagaaggcaaactggtttgagacccagggaaaaacaaagagcaagggtatcctatgtttcccacccagcagaagaaagaaacctagtcctggccattcctgatacccaactgaacaacagagggcagcccaggtcaggttagtgtggtgcaagtgaccatcccagacggtttcgtgaacgtgactgttggatctaatgtcactctcatctgcatctacaccaccactgtggcctcccgagaacagctttccatccagtggtctttcttccataagaaggagatggagccaatttctcacagctcgtgcctcagtactgagggtatggaggaaaaggcagtcagtcagtgtctaaaaatgacgcacgcaagagacgctcggggaagatgtagctggacctctgagatttacttttctcaaggtggacaagctgtagccatcgggcaatttaaagatcgaattacagggtccaacgatccaggtaatgcatctatcactatctcgcatatgcagccagcagacagtggaatttacatctgcgatgttaacaaccccccagactttctcggccaaaaccaaggcatcctc

SEQ ID NO: 512 - DNA, 2850 bp, synthetic construct
  misc_feature 1..2850: note = Synthetic polynucleotide
  source 1..2850: mol_type = other DNA
tgatatgctttggttatgtccccactcaaatctcatcttgaattgtacgtagctcccatgattcccacatgtggtgggagagactggtgggaggtaattaaatcatagggggcgggtctttcccatgctgttcttgtgatagtgagtaagtcacatgagatctgatggttttataaggggaagttcccctacataagctctcttgcctgtcaccatgtaagatgtggctttgttcctgcttcaccttcctccatgattatgaggtctccccagcactgtggaactggcaacgctcaaaaaggagaagctggagaaagaggtccagggggaattcctgggtacaagggtgacaagggtgaacgtggggaatgtggtaaaccagggataaaaggtgacaagggatccccagggccatatggaccaaagggacccagaggaattcagggaattactggacctccaggagacccaggcccaaaggggtttcaaggcaataagggtgagccaggtcctcctggtccttatggttctccaggagctcctggaattggacagcaaggtattaagggagaaagaggccaagaaggaagaccgggagctccaggacccattggagttggtgagcctggacagccaggtccccgtggtcctgagggagtaccaggagagaggggcttacccggagaaggatttccaggaccaaagggtgaaaaaggttctgaaggaccaactggcccacagggattacaaggcctgtcaatcaaaggggagaagggggatataggacctgtgggaccccaaggaccaatgggtatccctggaatcgggagtcaaggggaacagggaatccaaggtcctattggtccacctggtccacaagggcccgcaggacagggcttacctggttccaagggagaagtaggccaaatgggacctacaggccctcgaggaccagtgggaattggagtacaaggtccaaagggagagccaggctcaatagggctcccaggacaaccaggagtaccaggagaagatggagctgcagggaagaagggagaagcggggcttccgggagcaagaggcccagaaggaccacctggaaaaggacagcctggccccaagggtgacgaaggcaagaaagggagcaaaggaaatcaaggacagaggggacttccagggcccgaaggaccaaagggtgaaccgggcattatgggcccttttggaatgcctggaacatcaattcctggaccacctgggccaaagggagatagaggaggacctgggatacctggatttaagggagaacctggactttctattcgaggaccaaagggtgtccaaggccctcggggaccagtgggtgctccaggactcaaaggtgatggctatcctggtgtgcctggacctcgtggattaccaggaccccctgggccgatgggtttacgtggagtgggagacactggagcaaagggagagcctggggtcagaggccctccaggtccttctgggcctcggggcgtaggaacccaagggccaaagggtgatactgggcagaaaggcttgcctggccctcctggcccccctggctatggatcacagggaattaaaggggaacaaggaccacaaggcttcccaggcccaaagggcacaatgggccatggcctcccaggccagaagggagagcacggagaacggggcgatgtgggaaagaaaggtgataaaggagaaattggagagcctggatctccaggaaaacagggtttacaaggacccaaaggagacctaggacttacaaaagaagaaattatcaaacttattacagaaatatgtggttgtgggcccaaatgcaaagagactccactagagctggtgtttgtgatcgacagctcagaaagcgtggggccagagaactttcagatcattaaaaattttgtgaagactatggctgaccgggttgctctggaccttgccacggcccgcataggcataatcaactatagccataaggtggagaaggtggctaatttgaagcagttctccagcaaggatgacttcaagttggctgtggacaacatgcagtatctgggggaaggcacatacacagccactgctctgcaagcagccaacgacatgtttgaagatgcaaggccaggtgtaaaaaaagtggccttggtcatcactgatggacagacagattctcgtgataaagagaaactgacagaggtggtgaagaatgccagtgacaccaatgtggagatatttgtgataggggtggtgaagaaaaatgatcccaactttgaaatattccacaaagaaatgaatctaattgctactgacccagagcatgtttaccagtttgatgatttctttaccctgcaagacaccctgaagcaaaaattgtttcaaaaaatttgtgaggattttgattcctatctcgttcaaatttttggttcatcgtcacctcaacctggatttgggatgtcaggggaagaactcagtgaatctactccagagcctcaaaaagaaatttctgagtcattgagtgtcaccagagaccaggatgaagatgataaggctccagagccaacgtgggctgatgatctgcctgccactacctcatctgaggccaccaccacccccaggccactgctcagcacccctgtggatggggcagaggatcctagatgtttggaagccttgaagcctggaaactgtggtgaatatgtggttcgatggtattatgacaaacaggtcaactcttgtgcccgattttggttcagtggctgtaatggctcaggaaatagattcaacagtgaaaaggaatgtcaagaaacctgcattcaaggatga

SEQ ID NO: 513 - DNA, 477 bp, synthetic construct
  misc_feature 1..477: note = Synthetic polynucleotide
  source 1..477: mol_type = other DNA
tgatatgctttggttatgtccccactcaaatctcatcttgaattgtacgtagctcccatgattcccacatgtggtgggagagactggtgggaggtaattaaatcatagggggcgggtctttcccatgctgttcttgtgatagtgagtaagtcacatgagatctgatggttttataaggggaagttcccctacataagctctcttgcctgtcaccatgtaagatgtggctttgttcctgcttcaccttcctccatgattatgaggtctccccagcactgtggaactggcaacgctcaaaaaggagaagctggagaaagaggtccagggggaattcctgggtacaagggtgacaagcaatattctagggaagacagggaagtagagcataataatgaaaaatatgtagcatgcttgctgccaagcccggctctcctacagcagtcctcgctaactcatcatggcacctgttcccactaa

SEQ ID NO: 514 - DNA, 2158 bp, synthetic construct
  misc_feature 1..2158: note = Synthetic polynucleotide
  source 1..2158: mol_type = other DNA
taagtaggggaagagacaacacacacccaaaatggcaagaatccgctggcacggacaggctggacccaggacatgggtgtggaggcaaagaaccatgaagtacacaacagccacaggaagaaacattaccaaggtcctcattgcaaacagaggagaaattgcctgcagggtgatgcgcacagccaaaaaactgggtgtacagactgtggcggtttatagtgaggctgacagaaattccatgcatgtagatatggcagatgaagcatattccatcggccccgctccctcccagcagagctacctatctatggagaaaatcattcaagtggccaagacctctgctgcacaggctatccatccaggatgcggttttctctcagaaaacatggaatttgctgaactttgtaagcaagaaggaattatttttataggccctcctccatctgcaattagagacatgggtataaagagcacatccaaatccataatggctgctgctggagtacctgttgtggagggttatcatggtgaggaccaatcagaccagtgcctgaaggaacacgccaggagaattggctatcctgtcatgattaaagccgtccggggtggaggaggaaaaggaatgaggattgttagatcagaacaagaatttcaagaacagttagagtcagcacggagagaagctaagaagtctttcaatgatgatgctatgctgatcgagaagtttgtagacacaccgaggcatgtagaagtccaggtgtttggtgatcaccatggcaatgctgtgtacttgtttgaaagagactgtagtgtgcagaggcgacatcagaagatcattgaggaggccccagcgcctggtattaaatctgaagtaagaaaaaagctgggagaagctgcagtcagagctgctaaagctgtaaattatgttggagcagggactgtggagtttattatggactcaaaacataatttctgtttcatggagatgaatacaaggctgcaagtggaacatcctgttactgagatgatcacaggaactgacttggtggagtggcagcttagaattgcagcaggagagaagattcctttgagccaggaagaaataactctgcagggccatgccttcgaagctagaatatatgcagaagatcctagcaataacttcatgcctgtggcaggcccattagtgcacctctctactcctcgagcagacccttccaccaggattgaaactggagtacggcaaggagacgaagtttccgtgcattatgaccccatgattgcgaagctggtcgtgtgggcagcagatcgccaggcggcattgacaaaactgaggtacagccttcgtcagtacaatattgttggactgcacaccaacattgacttcttactcaacctgtctggccacccagagtttgaagctgggaacgtgcacactgatttcatccctcaacaccacaaacagttgttgctcagtcggaaggctgcagccaaagagtctttatgccaggcagccctgggtctcatcctcaaggagaaagccatgaccgacactttcactcttcaggcacatgatcaattctctccattttcgtctagcagtggaagaagactgaatatctcgtataccagaaacatgactcttaaagatggtaaaaacaatgtagccatagctgtaacgtataaccatgatgggtcttatagcatgcagattgaagataaaactttccaagtccttggtaatctttacagcgagggagactgcacttacctgaaatgttctgttaatggagttgctagtaaagcgaagctgattatcctggaaaacactatttacctattttccaaggaaggaagtattgagattgacattccagtccccaaatacttatcttctgtgagctcacaagaaactcagggcggccccttagctcctatgactggaaccattgaaaaggtgtttgtcaaagctggagacaaagtgaaagcgggagattccctcatggttatgatcgccatgaagatggagcataccataaagtctccaaaggatggcacagtaaagaaagtgttctacagagaaggtgctcaggccaacagacacactcctttagtcgagtttgaggaggaagaatcagacaaaagggaatcggaataa

SEQ ID NO: 515 - DNA, 124 bp, synthetic construct
  misc_feature 1..124: note = Synthetic polynucleotide
  source 1..124: mol_type = other DNA
taagtaggggaagagacaacacacacccaaaatggcaagaatccgctggcacggacaggctggacccaggacatgggtgtggaggcaaagaaccatgaagtacacaacagccacaggcagatga

SEQ ID NO: 516 - DNA, 166 bp, synthetic construct
  misc_feature 1..166: note = Synthetic polynucleotide
  source 1..166: mol_type = other DNA
taagtaggggaagagacaacacacacccaaaatggcaagaatccgctggcacggacaggctggacccaggacatgggtgtggaggcaaagaaccatgaagtacacaacagccacaggctatccatccaggatgcggttttctctcagaaaacatggaatttgctga

SEQ ID NO: 517 - DNA, 1776 bp, synthetic construct
  misc_feature 1..1776: note = Synthetic polynucleotide
  source 1..1776: mol_type = other DNA
taagtaggggaagagacaacacacacccaaaatggcaagaatccgctggcacggacaggctggacccaggacatgggtgtggaggcaaagaaccatgaagtacacaacagccacagatgaagcatattccatcggccccgctccctcccagcagagctacctatctatggagaaaatcattcaagtggccaagacctctgctgcacaggctatccatccaggatgcggttttctctcagaaaacatggaatttgctgaactttgtaagcaagaaggaattatttttataggccctcctccatctgcaattagagacatgggtataaagagcacatccaaatccataatggctgctgctggagtacctgttgtggagggttatcatggtgaggaccaatcagaccagtgcctgaaggaacacgccaggagaattggctatcctgtcatgattaaagccgtccggggtggaggaggaaaaggaatgaggattgttagatcagaacaagaatttcaagaacagttagagtcagcacggagagaagctaagaagtctttcaatgatgatgctatgctgatcgagaagtttgtagacacaccgaggcatgtagaagtccaggtgtttggtgatcaccatggcaatgctgtgtacttgtttgaaagagactgtagtgtgcagaggcgacatcagaagatcattgaggaggccccagcgcctggtattaaatctgaagtaagaaaaaagctgggagaagctgcagtcagagctgctaaagctgtaaattatgttggagcagggactgtggagtttattatggactcaaaacataatttctgtttcatggagatgaatacaaggctgcaagtggaacatcctgttactgagatgatcacaggaactgacttggtggagtggcagcttagaattgcagcaggagagaagattcctttgagccaggaagaaataactctgcagggccatgccttcgaagctagaatatatgcagaagatcctagcaataacttcatgcctgtggcaggcccattagtgcacctctctactcctcgagcagacccttccaccaggattgaaactggagtacggcaaggagacgaagtttccgtgcattatgaccccatgattgcgaagctggtcgtgtgggcagcagatcgccaggcggcattgacaaaactgaggtacagccttcgtcagtacaatattgttggactgcacaccaacattgacttcttactcaacctgtctggccacccagagtttgaagctgggaacgtgcacactgatttcatccctcaacaccacaaacagttgttgctcagtcggaaggctgcagccaaagagtctttatgccaggcagccctgggtctcatcctcaaggagaaagccatgaccgacactttcactcttcaggcacatgatcaattctctccattttcgtctagcagtggaagaagactgaatatctcgtataccagaaacatgactcttaaagatggtaaaaacaatgtagccatagctgtaacgtataaccatgatgggtcttatagcatgcagattgaagataaaactttccaagtccttggtaatctttacagcgagggagactgcacttacctgaaatgttctgttaatggagttgctagtaaagcgaagctgattatcctggaaaacactatttacctattttccaaggaaggaagtattgagattgacattccagtccccaaatacttatcttctgtgagctcacaagaaactca

SEQ ID NO: 518 - DNA, 166 bp, synthetic construct; identical to SEQ ID NO: 516
  misc_feature 1..166: note = Synthetic polynucleotide
  source 1..166: mol_type = other DNA

SEQ ID NO: 519 - DNA, 124 bp, synthetic construct; identical to SEQ ID NO: 515
  misc_feature 1..124: note = Synthetic polynucleotide
  source 1..124: mol_type = other DNA

SEQ ID NO: 520 - DNA, 319 bp, synthetic construct
  misc_feature 1..319: note = Synthetic polynucleotide
  source 1..319: mol_type = other DNA
taagtaggggaagagacaacacacacccaaaatggcaagaatccgctggcacggacaggctggacccaggacatgggtgtggaggcaaagaaccatgaagtacacaacagccacaggaagaaacattaccaaggtcctcattgcaaacagaggagaaattgcctgcagggtgatgcgcacagccaaaaaactgggtgtacagactgtggcggtttatagtgaggctgacagaaattccatgcatgtagatatgcaggatgatcttgatttcacagagaaaataaaattgaggttcctgccacagaatctgctgacttag

SEQ ID NO: 521 - DNA, 372 bp, synthetic construct
  misc_feature 1..372: note = Synthetic polynucleotide
  source 1..372: mol_type = other DNA
ataaaatacctaggaatccaacttacaagggctgtgaaggacctcttcaaggagaactacaaaccactgctcaatgaaataaaagaggacacaaatggaagaacattccatgctcatggataggaagaatcaatatcgtgaaaatggctatactgcccaaggcaaatactgtggtctggggttgcaaatgaaccattcaattgaatcaaaaggcaatgaaatcacattgctgttcatgagtggaatccatgtttctggacgcggatttttggcctcatactctgttatagataaacaaggtaattttcaccttttgcaatggttcctacagtttgtaatttctaacaacaaaaataaaatgctttttttaag

SEQ ID NO: 522 - DNA, 2056 bp, synthetic construct
  misc_feature 1..2056: note = Synthetic polynucleotide
  source 1..2056: mol_type = other DNA
ataaaatacctaggaatccaacttacaagggctgtgaaggacctcttcaaggagaactacaaaccactgctcaatgaaataaaagaggacacaaatggaagaacattccatgctcatggataggaagaatcaatatcgtgaaaatggctatactgcccaaggcaaatactgtggtctggggttgcaaatgaaccattcaattgaatcaaaaggcaatgaaatcacattgctgttcatgagtggaatccatgtttctggacgcggatttttggcctcatactctgttatagataaacaagatctaattacttgtttggacactgcatccaattttttggaacctgagttcagtaagtactgcccagctggttgtctgcttccttttgctgagatatctggaacaattcctcatggatatagagattcctcgccattgtgcatggctggtgtgcatgcaggagtagtgtcaaacacgttgggcggccaaatcagtgttgtaattagtaaaggtatcccctattatgaaagttctttggctaacaacgtcacatctgtggtgggacacttatctacaagtctttttacatttaagacaagtggatgttatggaacactggggatggagtctggtgtgatcgcggatcctcaaataacagcatcatctgtgctggagtggactgaccacacagggcaagagaacagttggaaacccaaaaaagccaggctgaaaaaacctggaccgccttgggctgcttttgccactgatgaataccagtggttacaaatagatttgaataaggaaaagaaaataacaggcattataaccactggatccaccatggtggagcacaattactatgtgtctgcctacagaatcctgtacagtgatgatgggcagaaatggactgtgtacagagagcctggtgtggagcaagataagatatttcaaggaaacaaagattatcaccaggatgtgcgtaataactttttgccaccaattattgcacgttttattagagtgaatcctacccaatggcagcagaaaattgccatgaaaatggagctgctcggatgtcagtttattcctaaaggtcgtcctccaaaacttactcaacctccacctcctcggaacagcaatgacctcaaaaacactacagcccctccaaaaatagccaaaggtcgtgccccaaaatttacgcaaccactacaacctcgcagtagcaatgaatttcctgcacagacagaacaaacaactgccagtcctgatatcagaaatactaccgtaactccaaatgtaaccaaagatgtagcgctggctgcagttcttgtccctgtgctggtcatggtcctcactactctcattctcatattagtgtgtgcttggcactggagaaacagaaagaaaaaaactgaaggcacctatgacttaccttactgggaccgggcaggttggtggaaaggaatgaagcagtttcttcctgcaaaagcagtggaccatgaggaaaccccagttcgctatagcagcagcgaagttaatcacctgagtccaagagaagtcaccacagtgctgcaggctgactctgcagagtatgctcagccactggtaggaggaattgttggtacacttcatcaaagatctacctttaaaccagaagaaggaaaagaagcaggctatgcagacctagatccttacaactcaccagggcaggaagtttatcatgcctatgctgaaccactcccaattacggggcctgagtatgcaaccccaatcatcatggacatgtcagggcaccccacaacttcagttggtcagccctccacatccactttcaaggctacggggaaccaacctcccccactagtgggaacttacaatacacttctctccaggactgacagctgctcctcagcccaggcccagtatgataccccgaaagctgggaagccaggtctacctgccccagacgaattggtgtaccaggtgccacagagcacacaagaagtatcaggagcaggaagggatggggaatgtgatgtttttaaagaaatcctttga

SEQ ID NO: 523 - DNA, 2098 bp, synthetic construct
  misc_feature 1..2098: note = Synthetic polynucleotide
  source 1..2098: mol_type = other DNA
ataaaatacctaggaatccaacttacaagggctgtgaaggacctcttcaaggagaactacaaaccactgctcaatgaaataaaagaggacacaaatggaagaacattccatgctcatggataggaagaatcaatatcgtgaaaatggctatactgcccaaggcaaatactgtggtctggggttgcaaatgaaccattcaattgaatcaaaaggcaatgaaatcacattgctgttcatgagtggaatccatgtttctggacgcggatttttggcctcatactctgttatagataaacaagatctaattacttgtttggacactgcatccaattttttggaacctgagttcagtaagtactgcccagctggttgtctgcttccttttgctgagatatctggaacaattcctcatggatatagagattcctcgccattgtgcatggctggtgtgcatgcaggagtagtgtcaaacacgttgggcggccaaatcagtgttgtaattagtaaaggtatcccctattatgaaagttctttggctaacaacgtcacatctgtggtgggacacttatctacaagtctttttacatttaagacaagtggatgttatggaacactggggatggagtctggtgtgatcgcggatcctcaaataacagcatcatctgtgctggagtggactgaccacacagggcaagagaacagttggaaacccaaaaaagccaggctgaaaaaacctggaccgccttgggctgcttttgccactgatgaataccagtggttacaaatagatttgaataaggaaaagaaaataacaggcattataaccactggatccaccatggtggagcacaattactatgtgtctgcctacagaatcctgtacagtgatgatgggcagaaatggactgtgtacagagagcctggtgtggagcaagataagatatttcaaggaaacaaagattatcaccaggatgtgcgtaataactttttgccaccaattattgcacgttttattagagtgaatcctacccaatggcagcagaaaattgccatgaaaatggagctgctcggatgtcagtttattcctaaaggtcgtcctccaaaacttactcaacctccacctcctcggaacagcaatgacctcaaaaacactacagcccctccaaaaatagccaaaggtcgtgccccaaaatttacgcaaccactacaacctcgcagtagcaatgaatttcctgcacagacagaacaaacaactgccagtcctgatatcagaaatactaccgtaactccaaatgtaaccaaagatgtagcgctggctgcagttcttgtccctgtgctggtcatggtcctcactactctcattctcatattagtgtgtgcttggcactggagaaacagaaagaaaaaaactgaaggcacctatgacttaccttactgggaccgggcaggtttttatttaatggtctctttggcttgccgtcacaatgaaggttggtggaaaggaatgaagcagtttcttcctgcaaaagcagtggaccatgaggaaaccccagttcgctatagcagcagcgaagttaatcacctgagtccaagagaagtcaccacagtgctgcaggctgactctgcagagtatgctcagccactggtaggaggaattgttggtacacttcatcaaagatctacctttaaaccagaagaaggaaaagaagcaggctatgcagacctagatccttacaactcaccagggcaggaagtttatcatgcctatgctgaaccactcccaattacggggcctgagtatgcaaccccaatcatcatggacatgtcagggcaccccacaacttcagttggtcagccctccacatccactttcaaggctacggggaaccaacctcccccactagtgggaacttacaatacacttctctccaggactgacagctgctcctcagcccaggcccagtatgataccccgaaagctgggaagccaggtctacctgccccagacgaattggtgtaccaggtgccacagagcacacaagaagtatcaggagcaggaagggatggggaatgtgatgtttttaaagaaatcctttga

SEQ ID NO: 524 - DNA, 463 bp, synthetic construct
  misc_feature 1..463: note = Synthetic polynucleotide
  source 1..463: mol_type = other DNA
ctgaggccaggaacctggtggcaagtactctctccctcaatggacacgaagtgtgaccttacacaagcaacaactccctttggatgtatttgccttattttttaaaatctttaagcaagcgacaatgaaggcattgcggaaaaaatctgttttgctaactggctatctggaatacctgatcaagcataactatggcaaagataaagcagcaaccaagaaaccagttgtgaacataattactccgtctcatgtagaggagcgggggtgccagctaacaataacattttctgttccaaacaaagatgttttccaagaactagaaaaaagaggagtggtttgtgacaagcggaatccaaatggcattcgagtggctccagttcctctctataattctttccatgatgtttataaatttaccaatctgctcacttctatacttgactctgcagaaacaaaaaattag

SEQ ID NO: 525 - DNA, 463 bp, synthetic construct; identical to SEQ ID NO: 524
  misc_feature 1..463: note = Synthetic polynucleotide
  source 1..463: mol_type = other DNA

SEQ ID NO: 526 - DNA, 1211 bp, synthetic construct
  misc_feature 1..1211: note = Synthetic polynucleotide
  source 1..1211: mol_type = other DNA
aatgaaactacagggcactggagccttagaccctgccactttgttgacacctactgggcaaccaaaggaactagtacacaactgcctagtggttatagatcaagagtcttccaggcgaccagatctgaaggacacagccctccagggtggagactggatgctctttgtggacagaagcagcctagtcaccaacagaaggaggaatgctgtctaggctatagtgactctcttggaggtaatagctgcaagaactctcccaacagggacttctgtgcaaaaggctgagtaaattgcccttatgagagccttgcatctgtccaaaggttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgtgccacatgggaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaa

SEQ ID NO: 527 - DNA, 1133 bp, synthetic construct
  misc_feature 1..1133: note = Synthetic polynucleotide
  source 1..1133: mol_type = other DNA
aatgaaactacagggcactggagccttagaccctgccactttgttgacacctactgggcaaccaaaggaactagtacacaactgcctagtggttatagatcaagagtcttccaggcgaccagatctgaaggacacagccctccagggtggagactggatgctctttgtggacagaagcagcctagtcaccaacagaaggaggaatgctgtctaggctatagtgactctcttggaggtaatagctgcaagaactctcccaacagggacttctgtgcaaaaggctgagtaaattgcccttatgagagccttgcatctgtccaaaggttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaa

SEQ ID NO: 528 - DNA, 1211 bp, synthetic construct; identical to SEQ ID NO: 526
  misc_feature 1..1211: note = Synthetic polynucleotide
  source 1..1211: mol_type = other DNA

SEQ ID NO: 529 - DNA, 841 bp, synthetic construct
  misc_feature 1..841: note = Synthetic polynucleotide
  source 1..841: mol_type = other DNA
aatgaaactacagggcactggagccttagaccctgccactttgttgacacctactgggcaaccaaaggaactagtacacaactgcctagtggttatagatcaagagtcttccaggcgaccagatctgaaggacacagccctccagggtggagactggatgctctttgtggacagaagcagcctagtcaccaacagaaggaggaatgctgtctaggctatagtgactctcttggaggtaatagctgcaagaactctcccaacagggacttctgtgcaaaaggctgagtaaattgcccttatgagagccttgcatctgtccaaaggttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgtgccacatgggaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaa

SEQ ID NO: 530 - DNA, 659 bp, synthetic construct
  misc_feature 1..659: note = Synthetic polynucleotide
  source 1..659: mol_type = other DNA
aatgaaactacagggcactggagccttagaccctgccactttgttgacacctactgggcaaccaaaggaactagtacacaactgcctagtggttatagatcaagagtcttccaggcgaccagatctgaaggacacagccctccagggtggagactggatgctctttgtggacagaagcagcctagtcaccaacagaaggaggaatgctgtctaggctatagtgactctcttggaggtaatagctgcaagaactctcccaacagggacttctgtgcaaaaggctgagtaaattgcccttatgagagccttgcatctgtccaaaggttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaaggaggacatagggattttaacatggaagaagagccctaaacataactcctaa

SEQ ID NO: 531 - DNA, 1636 bp, synthetic construct
  misc_feature 1..1636: note = Synthetic polynucleotide
  source 1..1636: mol_type = other DNA
cacggtctccctctcatgcggagccgaagctggactgtactgctgccatctcggctcactgcaacctccctgcctgattctcctgcctcagcctgccgagtgcctgcgattgcaggcacgcgccgccacgcctgactggttttggtggagaccgggtttcgctgtgttggccgggccggtctccagcccctaaccgcgagtgatccgccaacctcggcctcccgaggtgccgggattgcagacggagtctcgttcactcagtgctcaatggtgcccaggctggagtgcagtggcgtgatctcggctcactacaacctacacctcccagccgcctgccttggcctcccaaagtgccgagattgcagcctctgcccggccgccaccccgtctgggaagtgaggagtgtctctgcctggccgcccatcgtcggggatgtgaggagcccctctgcctggctgcccagtctggaaagtgaggagcgtctccacccggccgccatcccatctaggaagtgaggagcgcctcttcccagccgccatcacatctaggaagtgaggagcgtctctgcccggccgcccatcgtctgagatgtggggagcgcctctgccccgccgccccatctgggatgtgaggagtgcctctgcccggccgagaccccgtctgggaggtgaggagcgtctctgcccggccgccccgtctgagaagtgaggagaccctctgcctggcaaccaccccgtctgagaagtgaggagcccctctgcccggccagcaccccgtccgggagggaggtgggggggtcagccccccgcccggccagccgccccgtccgggagggaggtggggggggtcagcccccccgcccggccagccgccccgtccgggaggtgaggggcgcctctgcccggccgcccctactgggaagtgaggagcccctctgcccggccagcaccccgtccgggagggaggtgggggggtcagccccccgcccggccagccgccccgtccgggagggaggtggggggggggtcagcccccccgcctggccagccgccccatccgggaggtgaggggcgcctctgcccggcggcccctactgggaagtgaggagcccctctgcccggccagccgccccgtccgggagggaggtggggggggtcagcccccccgcccggccagccgccccgtccgggagattgatgatatatttaacgaaatcaaatttggtgaatatgtggacactggaaagctaatcgacaagatcaacttaccagatttcctaaaagtgtaccttaaccacaagccaccttttggtaacaccatgagtggcatccacaagagctttgaggtgctcggttataccaactccaaagggaaaaaggccattcgaagagaggacttcctgagactgctcgttactaaaggtgagcatatgacggaggaggagatgttggattgctttgcttcactgtttggcctgaatcccgagggatggaaatccgagcctgcaacctgctccgtcaaaggttcagaaatttgccttgaagaagaacttccagacgaaatcactgcagaaatattcgcgactgaaattcttggcttaaccatttcagaagattccggccaggatggtcagtga

SEQ ID NO: 532 - DNA, 1328 bp, synthetic construct
  misc_feature 1..1328: note = Synthetic polynucleotide
  source 1..1328: mol_type = other DNA
cacggtctccctctcatgcggagccgaagctggactgtactgctgccatctcggctcactgcaacctccctgcctgattctcctgcctcagcctgccgagtgcctgcgattgcaggcacgcgccgccacgcctgactggttttggtggagaccgggtttcgctgtgttggccgggccggtctccagcccctaaccgcgagtgatccgccaacctcggcctcccgaggtgccgggattgcagacggagtctcgttcactcagtgctcaatggtgcccaggctggagtgcagtggcgtgatctcggctcactacaacctacacctcccagccgcctgccttggcctcccaaagtgccgagattgcagcctctgcccggccgccaccccgtctgggaagtgaggagtgtctctgcctggccgcccatcgtcggggatgtgaggagcccctctgcctggctgcccagtctggaaagtgaggagcgtctccacccggccgccatcccatctaggaagtgaggagcgcctcttcccagccgccatcacatctaggaagtgaggagcgtctctgcccggccgcccatcgtctgagatgtggggagcgcctctgccccgccgccccatctgggatgtgaggagtgcctctgcccggccgagaccccgtctgggaggtgaggagcgtctctgcccggccgccccgtctgagaagtgaggagaccctctgcctggcaaccaccccgtctgagaagtgaggagcccctctgcccggccagcaccccgtccgggagggaggtgggggggtcagccccccgcccggccagccgccccgtccgggagggaggtggggggggtcagcccccccgcccggccagccgccccgtccgggagattgatgatatatttaacgaaatcaaatttggtgaatatgtggacactggaaagctaatcgacaagatcaacttaccagatttcctaaaagtgtaccttaaccacaagccaccttttggtaacaccatgagtggcatccacaagagctttgaggtgctcggttataccaactccaaagggaaaaaggccattcgaagagaggacttcctgagactgctcgttactaaaggtgagcatatgacggaggaggagatgttggattgctttgcttcactgtttggcctgaatcccgagggatggaaatccgagcctgcaacctgctccgtcaaaggttcagaaatttgccttgaagaagaacttccagacgaaatcactgcagaaatattcgcgactgaaattcttggcttaaccatttcagaagattccggccaggatggtcagtga

SEQ ID NO: 533 - DNA, 334 bp, synthetic construct
  misc_feature 1..334: note = Synthetic polynucleotide
  source 1..334: mol_type = other DNA
gaaaaacggttccattcagagccgatacatcagcatgagtgtgtggacaagcccacggagacttgtggagctggcagggcagagcctgctgaaggatgaggccctggccattgccgccctggagttgctgcccagggagctcttcccgccactcttcatggcagcctttgacgggagacacagccagaccctgaaggcaatggtgcaggcctggcccttcacctgcctccctctgggagtgctgatgaagggacaacatcttcacctggagaccttcaaagctgtgcttgatggacttgatgtgctccttgcccaggaggttcgccccaggtaa

SEQ ID NO: 534 - DNA, 1516 bp, synthetic construct
  misc_feature 1..1516: note = Synthetic polynucleotide
  source 1..1516: mol_type = other DNA
gaaaaacggttccattcagagccgatacatcagcatgagtgtgtggacaagcccacggagacttgtggagctggcagggcagagcctgctgaaggatgaggccctggccattgccgccctggagttgctgcccagggagctcttcccgccactcttcatggcagcctttgacgggagacacagccagaccctgaaggcaatggtgcaggcctggcccttcacctgcctccctctgggagtgctgatgaagggacaacatcttcacctggagaccttcaaagctgtgcttgatggacttgatgtgctccttgcccaggaggttcgccccaggaggtggaaacttcaagtgctggatttacggaagaactctcatcaggacttctggactgtatggtctggaaacagggccagtctgtactcatttccagagccagaagcagctcagcccatgacaaagaagcgaaaagtagatggtttgagcacagaggcagagcagcccttcattccagtagaggtgctcgtagacctgttcctcaaggaaggtgcctgtgatgaattgttctcctacctcattgagaaagtgaagcgaaagaaaaatgtactacgcctgtgctgtaagaagctgaagatttttgcaatgcccatgcaggatatcaagatgatcctgaaaatggtgcagctggactctattgaagatttggaagtgacttgtacctggaagctacccaccttggcgaaattttctccttacctgggccagatgattaatctgcgtagactcctcctctcccacatccatgcatcttcctacatttccccggagaaggaagagcagtatatcgcccagttcacctctcagttcctcagtctgcagtgcctgcaggctctctatgtggactctttatttttccttagaggccgcctggatcagttgctcaggcacgtgatgaaccccttggaaaccctctcaataactaactgccggctttcggaaggggatgtgatgcatctgtcccagagtcccagcgtcagtcagctaagtgtcctgagtctaagtggggtcatgctgaccgatgtaagtcccgagcccctccaagctctgctggagagagcctctgccaccctccaggacctggtctttgatgagtgtgggatcacggatgatcagctccttgccctcctgccttccctgagccactgctcccagcttacaaccttaagcttctacgggaattccatctccatatctgccttgcagagtctcctgcagcacctcatcgggctgagcaatctgacccacgtgctgtatcctgtccccctggagagttatgaggacatccatggtaccctccacctggagaggcttgcctatctgcatgccaggctcagggagttgctgtgtgagttggggcggcccagcatggtctggcttagtgccaacccctgtcctcactgtggggacagaaccttctatgacccggagcccatcctgtgcccctgtttcatgcctaactag

SEQ ID NO: 535 - DNA, 1516 bp, synthetic construct; identical to SEQ ID NO: 534
  misc_feature 1..1516: note = Synthetic polynucleotide
  source 1..1516: mol_type = other DNA

SEQ ID NO: 536 - DNA, 1516 bp, synthetic construct; identical to SEQ ID NO: 534
  misc_feature 1..1516: note = Synthetic polynucleotide
  source 1..1516: mol_type = other DNA

SEQ ID NO: 537 - DNA, 1516 bp, synthetic construct; identical to SEQ ID NO: 534
  misc_feature 1..1516: note = Synthetic polynucleotide
  source 1..1516: mol_type = other DNA

SEQ ID NO: 538 - DNA, 1516 bp, synthetic construct; identical to SEQ ID NO: 534
  misc_feature 1..1516: note = Synthetic polynucleotide
  source 1..1516: mol_type = other DNA

SEQ ID NO: 539 - DNA, 591 bp, synthetic construct
  misc_feature 1..591: note = Synthetic polynucleotide
  source 1..591: mol_type = other DNA
gaaaaacggttccattcagagccgatacatcagcatgagtgtgtggacaagcccacggagacttgtggagctggcagggcagagcctgctgaaggatgaggccctggccattgccgccctggagttgctgcccagggagctcttcccgccactcttcatggcagcctttgacgggagacacagccagaccctgaaggcaatggtgcaggcctggcccttcacctgcctccctctgggagtgctgatgaagggacaacatcttcacctggagaccttcaaagctgtgcttgatggacttgatgtgctccttgcccaggaggttcgccccaggaggtggaaacttcaagtgctggatttacggaagaactctcatcaggacttctggactgtatggtctggaaacagggccagtctgtactcatttccagagccagaagcagctcagcccatgacaaagaagcgaaaagtagatggtttgagcacagaggcagagcagcccttcattccagtagaggtgctcgtagacctgttcctcaaggaaggtgcctgtgatgaattgttctcctacctcattgagaaagtgaagcgaaa

SEQ ID NO: 540 - DNA, 482 bp, synthetic construct
  misc_feature 1..482: note = Synthetic polynucleotide
  source 1..482: mol_type = other DNA
gaaaaacggttccattcagagccgatacatcagcatgagtgtgtggacaagcccacggagacttgtggagctggcagggcagagcctgctgaaggatgaggccctggccattgccgccctggagttgctgcccagggagctcttcccgccactcttcatggcagcctttgacgggagacacagccagaccctgaaggcaatggtgcaggcctggcccttcacctgcctccctctgggagtgctgatgaagggacaacatcttcacctggagaccttcaaagctgtgcttgatggacttgatgtgctccttgcccaggaggttcgccccaggaggtggaaacttcaagtgctggatttacggaagaactctcatcaggacttctggactgtatggtctggaaacagggccagtctgtactcatttccagagccagaagcagctcagcccatgacaaagaagcgaaaagtagatggtttgagca

SEQ ID NO: 541 - DNA, 444 bp, synthetic construct
  misc_feature 1..444: note = Synthetic polynucleotide
  source 1..444: mol_type = other DNA
gaaaaacggttccattcagagccgatacatcagcatgagtgtgtggacaagcccacggagacttgtggagctggcagggcagagcctgctgaaggatgaggccctggccattgccgccctggagttgctgcccagggagctcttcccgccactcttcatggcagcctttgacgggagacacagccagaccctgaaggcaatggtgcaggcctggcccttcacctgcctccctctgggagtgctgatgaagggacaacatcttcacctggagaccttcaaagctgtgcttgatggacttgatgtgctccttgcccaggaggttcgccccaggaggtggaaacttcaagtgctggatttacggaagaactctcatcaggacttctggactgtatggtctggaaacagggccagtctgtactcatttccagagccagaagcagctca

SEQ ID NO: 542 - DNA, 245 bp, synthetic construct
  misc_feature 1..245: note = Synthetic polynucleotide
  source 1..245: mol_type = other DNA
gaaaaacggttccattcagagccgatacatcagcatgagtgtgtggacaagcccacggagacttgtggagctggcagggcagagcctgctgaaggatgaggccctggccattgccgccctggagttgctgcccagggagctcttcccgccactcttcatggcagcctttgacgggagacacagccagaccctgaaggcaatggtgcaggcctggcccttcacctgcctccctctgggagtgctga

SEQ ID NO: 543 - DNA, 38 bp, synthetic construct
  misc_feature 1..38: note = Synthetic polynucleotide
  source 1..38: mol_type = other DNA
gaaaaacggttccattcagagccgatacatcagcatga

SEQ ID NO: 544 - DNA, 387 bp, synthetic construct
  misc_feature 1..387: note = Synthetic polynucleotide
  source 1..387: mol_type = other DNA
agagtcgggcagcagggtatctgcaaggagaacttcaacaatgtcccggacctggagctcaaccccatccgatccaaaattgttcgtgccttcttcgacaacaggaacctgcgcaagggacccagtggcctggctgatgagatcaatttcgaggacttcctgaccatcatgtcctacttccggcccatcgacaccaccatggacgaggaacaggtggagctgtcccggaaggagaagctgagatttctgttccacatgtacgactcggacagcgacggccgcatcactctggaagaatatcgaaatgtaaagtggtcgaggagctgctgtcgggaaaccctcacatcgagaaggagtccgctcgctccatcgccgacggggccatga

SEQ ID NO: 545 - DNA, 540 bp, synthetic construct
  misc_feature 1..540: note = Synthetic polynucleotide
  source 1..540: mol_type = other DNA
agagtcgggcagcagggtatctgcaaggagaacttcaacaatgtcccggacctggagctcaaccccatccgatccaaaattgttcgtgccttcttcgacaacaggaacctgcgcaagggacccagtggcctggctgatgagatcaatttcgaggacttcctgaccatcatgtcctacttccggcccatcgacaccaccatggacgaggaacaggtggagctgtcccggaaggagaagctgagatttctgttccacatgtacgactcggacagcgacggccgcatcactctggaagaatatcgaaatgtggtcgaggagctgctgtcgggaaaccctcacatcgagaaggagtccgctcgctccatcgccgacggggccatgatggaggcggccagcgtgtgcatggggcagatggagcctgatcaggtgtacgaggggatcaccttcgaggacttcctgaagatctggcaggggatcgacattgagaccaagatgcacgtccgcttccttaacatggaaaccatggccctctgccactga

SEQ ID NO: 546 - DNA, 540 bp, synthetic construct; identical to SEQ ID NO: 545
  misc_feature 1..540: note = Synthetic polynucleotide
  source 1..540: mol_type = other DNA

SEQ ID NO: 547 - DNA, 303 bp, synthetic construct
  misc_feature 1..303: note = Synthetic polynucleotide
  source 1..303: mol_type = other DNA
agagtcgggcagcagggtatctgcaaggagaacttcaacaatgtcccggacctggagctcaaccccatccgatccaaaattgttcgtgccttcttcgacaacaggaacctgcgcaagggacccagtggcctggctgatgagatcaatttcgaggacttcctgaccatcatgtcctacttccggcccatcgacaccaccatggacgaggaacaggtggagctgtcccggaaggagaagctgagatcttgtggcttcctgggactagaagggggttgtgcggtggatgtgaaacaaggcccttga

SEQ ID NO: 548 - DNA, 367 bp, synthetic construct
  misc_feature 1..367: note = Synthetic polynucleotide
  source 1..367: mol_type = other DNA
ctagaatgagtgtacatttacaaagatgcgttcaaatagtgctctaagagttttgttcagtggctcacttcggctaaaatgcagaaatgcatgctgtcagcgttggtatttcacattcaatggagctgaatgttcaggacctcttcccattgaagctataatttatttggaccaaggaagccctgaaatgaattcaacaattaatattcatcgcacttcttctgtggaaggactttgtgaaggaattggtgctggattagtggatgttgctatctgggttggtacttgttcagattacccaaaaggagatgcttctactggatggaattcagtttctcgcatcattattgaagaactaccaaaataa

SEQ ID NO: 549 - DNA, 367 bp, synthetic construct; identical to SEQ ID NO: 548
  misc_feature 1..367: note = Synthetic polynucleotide
  source 1..367: mol_type = other DNA

SEQ ID NO: 550 - DNA, 1331 bp, synthetic construct
  misc_feature 1..1331: note = Synthetic polynucleotide
  source 1..1331: mol_type = other DNA
ccctccccctccccctctccctcttcctctccccacggtctccctctccctctctttccacggtctccctctaatgccgagccgaagctggactgtactgctgccatctcggctcactgcaacctccctgcctgattctcctgcctcagcctgcccagtgcctgcgactgcaggcgtgcgccgccacgcctgactggttttcgtatttttttggtggagacggggtttcactgtgttggcccggctggtctccagctcctaaccgcgaatgatccgccagcctcggcctcctgaggtgctgggattgcagacggagtctcgttcactcagtgctcaatggtgcccaggagtgatctcggctcgctacaacctccacctcccagccgcctgccttggcctcccaaagtgccgagattgcagcctctgcccggccgccaccccgtctgggaagtgaggagcgtttctgcctgggtgcccatcgtctgggatgtgaggagcccctctgcctggctgcccagtctggaaagtgaggagcgtctctgcccggccgccatcccatctaggaagtgaggagcgtctctgcccggccgcccatcgtctgagatgtggggagcgcctctgtcccgctgccccttctgggagaaaccaaggtgtatgttggtaacctgggaactggcgctggcaaaggagagttagaaagggctttcagttattatggtcctttaagaactgtatggattgcgagaaatcctccaggatttgcctttgtggaattcgaagatcctagagatgcagaagatgcagtacgaggactggatggaaaggtgatttgtggctcccgagtgagggttgaactatcgacaggcatgcctcggagatcacgttttgatagaccacctgcccgacgtccctttgatccaaatgatagatgctatgagtgtggcgaaaagggacattatgcttatgattgtcatcgttacagccggcgaagaagaagcaggtcacggtctagatcacattctcgatccagaggaaggcgatactctcgctcacgcagcaggagcaggggacgaaggtcaaggtcagcatctcctcgacgatcaagatctatctctcttcgtagatcaagatcagcttcactcagaagatctaggtctggttctataaaaggatcgaggtatttccaatccccgtcgaggtcaagatcaagatccaggtctatttcacgaccaagaagcagccgatcaaagtccagatctccatctccaaaaagaagtcgttccccatcaggaagtcctcgcagaagtgcaagtcctgaaagaatggactga

SEQ ID NO: 551 - DNA, 1028 bp, synthetic construct
  misc_feature 1..1028: note = Synthetic polynucleotide
  source 1..1028: mol_type = other DNA
ccctccccctccccctctccctcttcctctccccacggtctccctctccctctctttccacggtctccctctaatgccgagccgaagctggactgtactgctgccatctcggctcactgcaacctccctgcctgattctcctgcctcagcctgcccagtgcctgcgactgcaggcgtgcgccgccacgcctgactggttttcgtatttttttggtggagacggggtttcactgtgttggcccggctggtctccagctcctaaccgcgaatgatccgccagcctcggcctcctgaggtgctgggattgcagacggagtctcgttcactcagtgctcaatggtgcccaggagtgatctcggctcgctacaacctccacctcccagccgcctgccttggcctcccaaagtgccgagattgcagcctctgcccggccgccaccccgtctgggaagtgaggagcgtttctgcctgggtgcccatcgtctgggatgtgaggagcccctctgcctggctgcccagtctggaaagtgaggagcgtctctgcccggccgccatcccatctaggaagtgaggagcgtctctgcccggccgcccatcgtctgagatgtggggagcgcctctgtcccgctgccccttctgggagaaaccaaggtgtatgttggtaacctgggaactggcgctggcaaaggagagttagaaagggctttcagttattatggtcctttaagaactgtatggattgcgagaaatcctccaggatttgcctttgtggaattcgaagatcctagagatgcagaagatgcagtacgaggactggatggaaaggtgatttgtggctcccgagtgagggttgaactatcgacaggcatgcctcggagatcacgttttgatagaccacctgcccgacgtccctttgatccaaatgatagatgctatgagtgtggcgaaaagggacattatgcttatgattgtcatcgttacagccggcgaagaagaagcaggtttcttcgtttgagtcagtcgccttga

SEQ ID NO: 552 - DNA, 1028 bp, synthetic construct; identical to SEQ ID NO: 551
  misc_feature 1..1028: note = Synthetic polynucleotide
  source 1..1028: mol_type = other DNA

SEQ ID NO: 553 - DNA, 1295 bp, synthetic construct
  misc_feature 1..1295: note = Synthetic polynucleotide
  source 1..1295: mol_type = other DNA
ccctccccctccccctctccctcttcctctccccacggtctccctctccctctctttccacggtctccctctaatgccgagccgaagctggactgtactgctgccatctcggctcactgcaacctccctgcctgattctcctgcctcagcctgcccagtgcctgcgactgcaggcgtgcgccgccacgcctgactggttttcgtatttttttggtggagacggggtttcactgtgttggcccggctggtctccagctcctaaccgcgaatgatccgccagcctcggcctcctgaggtgctgggattgcagacggagtctcgttcactcagtgctcaatggtgcccaggagtgatctcggctcgctacaacctccacctcccagccgcctgccttggcctcccaaagtgccgagattgcagcctctgcccggccgccaccccgtctgggaagtgaggagcgtttctgcctgggtgcccatcgtctgggatgtgaggagcccctctgcctggctgcccagtctggaaagtgaggagcgtctctgcccggccgccatcccatctaggaagtgaggagcgtctctgcccggccgcccatcgtctgagatgtggggagcgcctctgtcccgctgccccttctgggagaaaccaaggtgtatgttggtaacctgggaactggcgctggcaaaggagagttagaaagggctttcagttattatggtcctttaagaactgtatggattgcgagaaatcctccaggatttgcctttgtggaattcgaagatcctagagatgcagaagatgcagtacgaggactggatggaaaggtgatttgtggctcccgagtgagggttgaactatcgacaggcatgcctcggagatcacgttttgatagaccacctgcccgacgtccctttgatccaaatgatagatgctatgagtgtggcgaaaagggacattatgcttatgattgtcatcgttacagccggcgaagaagaagcaggtcacggtctagatcacattctcgatccagaggaaggcgatactctcgctcacgcagcaggagcaggggacgaaggtcaaggtcagcatctcctcgacgatcaagatctatctctcttcgtagatcaagatcagcttcactcagaagatctaggtctggttctataaaaggatcgaggtatttccaatccccgtcgaggtcaagatcaagatccaggtctatttcacgaccaagaagcagtcgttccccatcaggaagtcctcgcagaagtgcaagtcctgaaagaatggactga

SEQ ID NO: 554 - DNA, 1322 bp, synthetic construct
  misc_feature 1..1322: note = Synthetic polynucleotide
  source 1..1322: mol_type = other DNA
ccctccccctccccctctccctcttcctctccccacggtctccctctccctctctttccacggtctccctctaatgccgagccgaagctggactgtactgctgccatctcggctcactgcaacctccctgcctgattctcctgcctcagcctgcccagtgcctgcgactgcaggcgtgcgccgccacgcctgactggttttcgtatttttttggtggagacggggtttcactgtgttggcccggctggtctccagctcctaaccgcgaatgatccgccagcctcggcctcctgaggtgctgggattgcagacggagtctcgttcactcagtgctcaatggtgcccaggagtgatctcggctcgctacaacctccacctcccagccgcctgccttggcctcccaaagtgccgagattgcagcctctgcccggccgccaccccgtctgggaagtgaggagcgtttctgcctgggtgcccatcgtctgggatgtgaggagcccctctgcctggctgcccagtctggaaagtgaggagcgtctctgcccggccgccatcccatctaggaagtgaggagcgtctctgcccggccgcccatcgtctgagatgtggggagcgcctctgtcccgctgccccttctgggagaaaccaaggtgtatgttggtaacctgggaactggcgctggcaaaggagagttagaaagggctttcagttattatggtcctttaagaactgtatggattgcgagaaatcctccaggatttgcctttgtggaattcgaagatcctagagatgcagaagatgcagtacgaggactggatggaaaggtgatttgtggctcccgagtgagggttgaactatcgacaggcatgcctcggagatcacgttttgatagaccacctgcccgacgtccctttgatccaaatgatagatgctatgagtgtggcgaaaagggacattatgcttatgattgtcatcgttacagccggcgaagaagaagcaggtcacggtctagatcacattctcgatccagaggaaggcgatactctcgctcacgcagcaggagcaggggacgaaggtcaaggtcagcatctcctcgacgatcaagatctatctctcttcgtagatcaagatcagcttcactcagaagatctaggtctggttctataaaaggatcgagatccccgtcgaggtcaagatcaagatccaggtctatttcacgaccaagaagcagccgatcaaagtccagatctccatctccaaaaagaagtcgttccccatcaggaagtcctcgcagaagtgcaagtcctgaaagaatggactga

SEQ ID NO: 555 - DNA, 1013 bp, synthetic construct
  misc_feature 1..1013: note = Synthetic polynucleotide
  source 1..1013: mol_type = other DNA
ccctccccctccccctctccctcttcctctccccacggtctccctctccctctctttccacggtctccctctaatgccgagccgaagctggactgtactgctgccatctcggctcactgcaacctccctgcctgattctcctgcctcagcctgcccagtgcctgcgactgcaggcgtgcgccgccacgcctgactggttttcgtatttttttggtggagacggggtttcactgtgttggcccggctggtctccagctcctaaccgcgaatgatccgccagcctcggcctcctgaggtgctgggattgcagacggagtctcgttcactcagtgctcaatggtgcccaggagtgatctcggctcgctacaacctccacctcccagccgcctgccttggcctcccaaagtgccgagattgcagcctctgcccggccgccaccccgtctgggaagtgaggagcgtttctgcctgggtgcccatcgtctgggatgtgaggagcccctctgcctggctgcccagtctggaaagtgaggagcgtctctgcccggccgccatcccatctaggaagtgaggagcgtctctgcccggccgcccatcgtctgagatgtggggagcgcctctgtcccgctgccccttctgggagaaaccaaggtgtatgttggtaacctgggaactggcgctggcaaaggagagttagaaagggctttcagttattatggtcctttaagaactgtatggattgcgagaaatcctccaggatttgcctttgtggaattcgaagatcctagagatgcagaagatgcagtacgaggactggatggaaaggtgatttgtggctcccgagtgagggttgaactatcgacaggcatgcctcggagatcacgttttgatagaccacctgcccgacgtccctttgatccaaatgatagatgctatgagtgtggcgaaaagggacattatgcttatgattgtcatcgttacagccggcgaagaagaagcaggtatttattttaa

SEQ ID NO: 556 - DNA, 1013 bp, synthetic construct; identical to SEQ ID NO: 555
  misc_feature 1..1013: note = Synthetic polynucleotide
  source 1..1013: mol_type = other DNA

SEQ ID NO: 557 - DNA, 7501 bp, synthetic construct
  misc_feature 1..7501: note = Synthetic polynucleotide
  source 1..7501: mol_type = other DNA
aactcctatttctgagatttcctttaccacttaggaggtagactatgaccagggaccattgctctcactcctacagtcaaaataacctgggtaagtaataaaaatcatagtttaaaaaatcataaaatatgctaaggacataaataaaccttgaaaatgtaaattccagaaatgggcaaactcttcaaaggaaagaagaggcccatggtttctctcacccctggtggattggcaggaggaggaggaatctgctatggatgggaaggagctgagtctccccagaagaggaagtttttgccgaacaagcaaccggaaaagcttaataggcaatgggcagtcaccagcattgcctcgaccacactcacctctctctgctcatgcaggaaatagccctcaagatagtccaagaaatttctcccccagtgcctcagcccatttttcatttgcacggagtctcaataggactgatggacgccgctggtcgttggcttctctcccttcctctggctatgggacaaacacacccagctctacggtctcttcatcctgttcctcccaggagaagttgcatcagttaccataccaaccaacaccagacgagttacacttcttatcaaaacatttctgtaccaccgaaagcatcgccactgagaacagatgcaggaacacgccgatgcgcccccgttcccgaagtctgagccctggacgttctcccgcctgctgtgaccatgaaataattatgatgaaccatgtctacaaagaaaggttcccaaaggctacagctcagatggaagaacgtctaaaggaaattatcaccagctactctcctgacaacgttctacccttagcagatggagtgcttagtttcactcaccaccagattattgaactggctcgagattgcttggataaatcccaccagggcctcatcacctcacgatacttccttgaattacagcacaaattagataagttgctacaggaggctcatgatcgttcagaaagtggagaattggcatttattaaacaactagttcgaaagatcctaattgttattgcccgccctgctcggttattagagtgcctggaatttgatccggaagaattttactacctattggaagcagcagaaggccatgccaaagaaggacagggtattaaaaccgacattcccaggtacatcattagccaactgggactcaataaggatcccttggaagaaatggctcatttgggaaactacgatagtgggacagcagaaacaccagaaacagatgaatcagtgagtagctctaatgcctccctgaaacttcgaaggaaacctcgggaaagtgattttgaaacgattaaattgattagcaatggagcctatggggcagtctactttgttcggcataaagaatcccggcagaggtttgccatgaagaagattaataaacagaacctcatccttcgaaaccagatccagcaggcctttgtggagcgggatatcctgacttttgcagaaaacccctttgttgtcagcatgtattgctcctttgaaacaaggcgccacttgtgcatggtcatggaatatgtggaagggggagactgtgctactttaatgaaaaacatgggtcctctccctgttgatatggccagaatgtactttgctgagacggtcttggccttggaatatttacataattatggaattgtacacagggatttgaaaccagacaacttgttggttacctccatggggcacataaagctgacagattttggattatctaaggtgggactaatgagcatgactaccaacctttacgagggtcatattgagaaggatgctagagagttcctggataaacaggtctgtggcacacctgaatacattgcaccagaagtgattctgaggcagggttatggaaagccggtggactggtgggccatggggattatcctctatgaatttctggttggatgcgtgccattctttggggatactccagaggagctatttggacaagtcatcagtgatgagatcaactggcctgagaaggatgaggcacccccacctgatgcccaggatctgattaccttactcctcaggcagaatcccctggagaggctgggaacaggtggtgcatatgaagtcaaacagcatcgattcttccgttctttagactggaacagtttgctgagacagaaggcagaatttattccccaactggaatctgaggatgacacaagttattttgatactcggtctgagaagtatcatcatatggaaacggaggaagaagatgacacaaatgatgaagactttaatgtggaaataaggcagttttcttcatgttcacacaggttttcaaaagttttcagcagtatagatcgaatcactcagaattcagcagaagagaaggaagactctgtggacaaaaccaaaagcaccaccttgccatccacagaaacactgagctggagttcagaatattctgaaatgcaacagctatcaacatccaactcttcagatactgaaagcaacagacataaactcagttctggcctacttcccaaactggctatttcaacagagggagagcaagatgaagctgcctcctgccctggagacccccatgaggagccaggaaagccagcccttcctcctgaagagtgtgcccaggaggagcctgaggtcaccaccccagccagcaccatcagcagctccaccctgtcagttggcagtttttcagagcacttggatcagataaatggacgaagcgagtgtgtggacagtacagataattcctcaaagccatccagtgaacccgcttctcacatggctcggcagcgattagaaagcacagaaaaaaagaaaatctcggggaaagtcacaaagtccctctctgccagtgctctttccctcatgatcccaggagatatgtttgctgtttcccctctgggaagtccaatgtctccccattccctgtcctcggacccttcttcttcacgagattcctctcccagccgagattcctcagcagcttctgccagtccacatcagccgattgtgatccacagttcggggaagaactacggctttaccatccgagccatccgggtgtatgtgggagacagtgacatctatacagtgcaccatatcgtctggaatgtagaagaaggaagtccggcatgccaggcaggactgaaggctggagatcttatcactcacatcaatggagaaccagtgcatggacttgtccacacagaagttatagaactcctactgaagagtgggaataaggtgtcaatcactactaccccatttgaaaacacatcaatcaaaactggaccagccaggagaaacagctataagagccggatggtgaggcggagcaagaaatccaagaagaaagaaagtctcgaaaggaggagatctcttttcaaaaagctagccaagcagccttctcctttactccacaccagccgaagtttctcctgcttgaacagatccctgtcatcgggtgagagcctcccaggttcccccactcatagcttgtctccccggtctccaacaccaagctaccgctccacccctgacttcccatctggtactaattcctcccagagcagctcccctagttctagtgcccccaattccccagcagggtccgggcacatccggcccagcactctccacggtcttgcacccaaactcggcgggcagcggtaccggtccggaaggcgaaagtccgccggcaacatcccactgtccccgctggcccggacgccctctccaaccccgcaacccacctccccgcagcggtcaccatcccctcttctgggacactcactgggcaattccaagatcgcgcaagcctttcccagcaagatgcactccccgcccaccatcgtcagacacatcgtgaggcccaagagtgcggagccccccaggtccccgctgctcaagcgcgtgcagtccgaggagaagctgtcgccctcttacggcagtgacaagaagcacctgtgctcccgcaagcacagcctggaggtgacccaagaggaggtgcagcgggagcagtcccagcgggaggcgccgctgcagagcctggatgagaacgtgtgcgacgtgccgccgctcagccgcgcccggccagtggagcaaggctgcctgaaacgcccagtctcccggaaggtgggccgccaggagtctgtggacgacctggaccgcgacaagctgaaggccaaggtggtggtgaagaaagcagacggcttcccagagaaacaggaatcccaccagaaatcccatggacccgggagtgatttggaaaactttgctctgtttaagctggaagagagagagaagaaagtctatccgaaggctgtggaaaggtcaagtacttttgaaaacaaagcgtctatgcaggaggcgccaccgctgggcagcctgctgaaggatgctcttcacaagcaggccagcgtgcgcgccagcgagggtgcgatgtcggatggccgggtgcctgcggagcaccgccagggtggcggggacttcagacgggcccccgctcctggcaccctccaggatggtctctgccactccctcgacaggggcatctctgggaagggggaaggcacggagaagtcctcccaggccaaggagcttctccgatgtgaaaagttagacagcaagctggccaacatcgattacctccgaaagaaaatgtcacttgaggacaaagaggacaacctctgccctgtgctgaagcccaagatgacagctggctcccacgaatgcctgccagggaacccagtccgacccacgggtgggcagcaggagcccccgccggcttctgagagccgagcttttgtcagcagcacccatgcagctcagatgagtgccgtctcttttgttcccctcaaggccttaacaggccgggtggacagtggaacggagaagcctggcttggttgctcctgagtcccctgttaggaagagcccctccgagtataagctggaaggtaggtctgtctcatgcctgaagccgatcgagggcactctggacattgctctcctgtccggacctcaggcctccaagacagaactgccttccccagagtctgcacagagccccagcccaagtggtgacgtgagggcctctgtgccaccagttctccccagcagcagtgggaaaaagaacgataccaccagtgcaagagagctttctccttccagcttaaagatgaataaatcctacctgctggagccttggttcctgccccccagccgaggtctccagaattcaccagcagtttccctgcctgacccagagttcaagagggacaggaaaggtccccatcctactgccaggagccctggaacagtcatggaaagcaatccccaacagagagagggcagctcccctaaacaccaagaccacaccactgaccccaagcttctgacctgcctggggcagaacctccacagccctgacctggccaggccacgctgcccgctcccacctgaagcttccccctcaagggagaagccaggcctgagggaatcgtctgaaagaggccctcccacagccagaagcgagcgctctgctgcgagggctgacacatgcagagagccctccatggaactgtgctttccagaaactgcgaaaaccagtgacaactccaaaaatctcctctctgtgggaaggacccacccagatttctatacacagacccaggccatggagaaagcatgggcgccgggtgggaaaacgaaccacaaagatggcccaggtgaggcgaggcccccgcccagagacaactcctctctgcactcagctggaattccctgtgagaaggagctgggcaaggtgaggcgtggcgtggaacccaagcccgaagcgcttcttgccaggcggtctctgcagccacctggaattgagagtgagaagagtgaaaagctctccagtttcccatctttgcagaaagatggtgccaaggaacctgaaaggaaggagcagcctctacaaaggcatcccagcagcatccctccgccccctctgacggccaaagacctgtccagcccggctgccaggcagcattgcagttccccaagccacgcttctggcagagagccgggggccaagcccagcactgcagagcccagctcgagcccccaggaccctcccaagcctgttgctgcgcacagtgaaagcagcagccacaagccccggcctggccctgacccgggccctccaaagactaagcaccccgaccggtccctctcctctcagaaaccaagtgtcggggccacaaagggcaaagagcctgccactcagtccctcggtggctctagcagagaggggaagggccacagtaagagtgggccggatgtgtttcctgctaccccaggctcccagaacaaagccagcgatgggattggccagggagaaggtgggccctctgtcccactgcacactgacagggctcctctagacgccaagccacaacccaccagtggtgggcggcccctggaggtgctggagaagcctgtgcatttgccaaggccgggacacccagggcctagtgagccagcggaccagaaactgtccgctgttggtgaaaagcaaaccctgtctccaaagcaccccaaaccatccactgtgaaagattgccccaccctgtgcaaacagacagacaacagacagacagacaaaagcccgagtcagccggccgccaacaccgacagaagggcggaagggaagaaatgcactgaagcactttatgctccagcagagggcgacaagctcgaggccggcctttcctttgtgcatagcgagaaccggttgaaaggcgcggagcggccagccgcgggggtggggaagggcttccctgaggccagagggaaagggcccggtccccagaagccaccgacggaggcagacaagcccaatggcatgaaacggtccccctcagccactgggcagagttctttccgatccacggccctcccggaaaagtctctgagctgctcctccagcttccctgaaaccagggccggagttagagaggcctctgcagccagcagcgacacctcttctgccaaggccgccgggggcatgctggagcttccagcccccagcaacagggaccataggaaggctcagcctgccggggagggccgaacccacatgacaaagagtgactccctgccctccttccgggtctccaccctgcctctggagtcacaccaccccgacccaaacaccatgggcggggccagccaccgggacagggctctctcggtgactgccaccgtaggggaaaccaaagggaaggaccctgccccagcccagcctcccccagctaggaaacagaacgtgggcagagacgtgaccaagccatccccagccccaaacactgaccgccccatctctctttctaatgagaaggactttgtggtacggcagaggcgggggaaagagagtttgcgtagcagccctcacaaaaaggccttgtaa

SEQ ID NO: 558 - DNA, 7492 bp, synthetic construct
  misc_feature 1..7492: note = Synthetic polynucleotide
  source 1..7492: mol_type = other DNA
aactcctatttctgagatttcctttaccacttaggaggtagactatgaccagggaccattgctctcactcctacagtcaaaataacctgggtaagtaataaaaatcatagtttaaaaaatcataaaatatgctaaggacataaataaaccttgaaaatgtaaattccagaaatgggcaaactcttcaaaggaaagaagaggcccatggtttctctcacccctggtggattggcaggaggaggaggaatctgctatggatgggaaggagctgagtctccccagaagaggaagtttttgccgaacaagcaaccggaaaagcttaataggcaatgggcagtcaccagcattgcctcgaccacactcacctctctctgctcatgcaggaaatagccctcaagatagtccaagaaatttctcccccagtgcctcagcccatttttcatttgcacggaggactgatggacgccgctggtcgttggcttctctcccttcctctggctatgggacaaacacacccagctctacggtctcttcatcctgttcctcccaggagaagttgcatcagttaccataccaaccaacaccagacgagttacacttcttatcaaaacatttctgtaccaccgaaagcatcgccactgagaacagatgcaggaacacgccgatgcgcccccgttcccgaagtctgagccctggacgttctcccgcctgctgtgaccatgaaataattatgatgaaccatgtctacaaagaaaggttcccaaaggctacagctcagatggaagaacgtctaaaggaaattatcaccagctactctcctgacaacgttctacccttagcagatggagtgcttagtttcactcaccaccagattattgaactggctcgagattgcttggataaatcccaccagggcctcatcacctcacgatacttccttgaattacagcacaaattagataagttgctacaggaggctcatgatcgttcagaaagtggagaattggcatttattaaacaactagttcgaaagatcctaattgttattgcccgccctgctcggttattagagtgcctggaatttgatccggaagaattttactacctattggaagcagcagaaggccatgccaaagaaggacagggtattaaaaccgacattcccaggtacatcattagccaactgggactcaataaggatcccttggaagaaatggctcatttgggaaactacgatagtgggacagcagaaacaccagaaacagatgaatcagtgagtagctctaatgcctccctgaaacttcgaaggaaacctcgggaaagtgattttgaaacgattaaattgattagcaatggagcctatggggcagtctactttgttcggcataaagaatcccggcagaggtttgccatgaagaagattaataaacagaacctcatccttcgaaaccagatccagcaggcctttgtggagcgggatatcctgacttttgcagaaaacccctttgttgtcagcatgtattgctcctttgaaacaaggcgccacttgtgcatggtcatggaatatgtggaagggggagactgtgctactttaatgaaaaacatgggtcctctccctgttgatatggccagaatgtactttgctgagacggtcttggccttggaatatttacataattatggaattgtacacagggatttgaaaccagacaacttgttggttacctccatggggcacataaagctgacagattttggattatctaaggtgggactaatgagcatgactaccaacctttacgagggtcatattgagaaggatgctagagagttcctggataaacaggtctgtggcacacctgaatacattgcaccagaagtgattctgaggcagggttatggaaagccggtggactggtgggccatggggattatcctctatgaatttctggttggatgcgtgccattctttggggatactccagaggagctatttggacaagtcatcagtgatgagatcaactggcctgagaaggatgaggcacccccacctgatgcccaggatctgattaccttactcctcaggcagaatcccctggagaggctgggaacaggtggtgcatatgaagtcaaacagcatcgattcttccgttctttagactggaacagtttgctgagacagaaggcagaatttattccccaactggaatctgaggatgacacaagttattttgatactcggtctgagaagtatcatcatatggaaacggaggaagaagatgacacaaatgatgaagactttaatgtggaaataaggcagttttcttcatgttcacacaggttttcaaaagttttcagcagtatagatcgaatcactcagaattcagcagaagagaaggaagactctgtggacaaaaccaaaagcaccaccttgccatccacagaaacactgagctggagttcagaatattctgaaatgcaacagctatcaacatccaactcttcagatactgaaagcaacagacataaactcagttctggcctacttcccaaactggctatttcaacagagggagagcaagatgaagctgcctcctgccctggagacccccatgaggagccaggaaagccagcccttcctcctgaagagtgtgcccaggaggagcctgaggtcaccaccccagccagcaccatcagcagctccaccctgtcagttggcagtttttcagagcacttggatcagataaatggacgaagcgagtgtgtggacagtacagataattcctcaaagccatccagtgaacccgcttctcacatggctcggcagcgattagaaagcacagaaaaaaagaaaatctcggggaaagtcacaaagtccctctctgccagtgctctttccctcatgatcccaggagatatgtttgctgtttcccctctgggaagtccaatgtctccccattccctgtcctcggacccttcttcttcacgagattcctctcccagccgagattcctcagcagcttctgccagtccacatcagccgattgtgatccacagttcggggaagaactacggctttaccatccgagccatccgggtgtatgtgggagacagtgacatctatacagtgcaccatatcgtctggaatgtagaagaaggaagtccggcatgccaggcaggactgaaggctggagatcttatcactcacatcaatggagaaccagtgcatggacttgtccacacagaagttatagaactcctactgaagagtgggaataaggtgtcaatcactactaccccatttgaaaacacatcaatcaaaactggaccagccaggagaaacagctataagagccggatggtgaggcggagcaagaaatccaagaagaaagaaagtctcgaaaggaggagatctcttttcaaaaagctagccaagcagccttctcctttactccacaccagccgaagtttctcctgcttgaacagatccctgtcatcgggtgagagcctcccaggttcccccactcatagcttgtctccccggtctccaacaccaagctaccgctccacccctgacttcccatctggtactaattcctcccagagcagctcccctagttctagtgcccccaattccccagcagggtccgggcacatccggcccagcactctccacggtcttgcacccaaactcggcgggcagcggtaccggtccggaaggcgaaagtccgccggcaacatcccactgtccccgctggcccggacgccctctccaaccccgcaacccacctccccgcagcggtcaccatcccctcttctgggacactcactgggcaattccaagatcgcgcaagcctttcccagcaagatgcactccccgcccaccatcgtcagacacatcgtgaggcccaagagtgcggagccccccaggtccccgctgctcaagcgcgtgcagtccgaggagaagctgtcgccctcttacggcagtgacaagaagcacctgtgctcccgcaagcacagcctggaggtgacccaagaggaggtgcagcgggagcagtcccagcgggaggcgccgctgcagagcctggatgagaacgtgtgcgacgtgccgccgctcagccgcgcccggccagtggagcaaggctgcctgaaacgcccagtctcccggaaggtgggccgccaggagtctgtggacgacctggaccgcgacaagctgaaggccaaggtggtggtgaagaaagcagacggcttcccagagaaacaggaatcccaccagaaatcccatggacccgggagtgatttggaaaactttgctctgtttaagctggaagagagagagaagaaagtctatccgaaggctgtggaaaggtcaagtacttttgaaaacaaagcgtctatgcaggaggcgccaccgctgggcagcctgctgaaggatgctcttcacaagcaggccagcgtgcgcgccagcgagggtgcgatgtcggatggccgggtgcctgcggagcaccgccagggtggcggggacttcagacgggcccccgctcctggcaccctccaggatggtctctgccactccctcgacaggggcatctctgggaagggggaaggcacggagaagtcctcccaggccaaggagcttctccgatgtgaaaagttagacagcaagctggccaacatcgattacctccgaaagaaaatgtcacttgaggacaaagaggacaacctctgccctgtgctgaagcccaagatgacagctggctcccacgaatgcctgccagggaacccagtccgacccacgggtgggcagcaggagcccccgccggcttctgagagccgagcttttgtcagcagcacccatgcagctcagatgagtgccgtctcttttgttcccctcaaggccttaacaggccgggtggacagtggaacggagaagcctggcttggttgctcctgagtcccctgttaggaagagcccctccgagtataagctggaaggtaggtctgtctcatgcctgaagccgatcgagggcactctggacattgctctcctgtccggacctcaggcctccaagacagaactgccttccccagagtctgcacagagccccagcccaagtggtgacgtgagggcctctgtgccaccagttctccccagcagcagtgggaaaaagaacgataccaccagtgcaagagagctttctccttccagcttaaagatgaataaatcctacctgctggagccttggttcctgccccccagccgaggtctccagaattcaccagcagtttccctgcctgacccagagttcaagagggacaggaaaggtccccatcctactgccaggagccctggaacagtcatggaaagcaatccccaacagagagagggcagctcccctaaacaccaagaccacaccactgaccccaagcttctgacctgcctggggcagaacctccacagccctgacctggccaggccacgctgcccgctcccacctgaagcttccccctcaagggagaagccaggcctgagggaatcgtctgaaagaggccctcccacagccagaagcgagcgctctgctgcgagggctgacacatgcagagagccctccatggaactgtgctttccagaaactgcgaaaaccagtgacaactccaaaaatctcctctctgtgggaaggacccacccagatttctatacacagacccaggccatggagaaagcatgggcgccgggtgggaaaacgaaccacaaagatggcccaggtgaggcgaggcccccgcccagagacaactcctctctgcactcagctggaattccctgtgagaaggagctgggcaaggtgaggcgtggcgtggaacccaagcccgaagcgcttcttgccaggcggtctctgcagccacctggaattgagagtgagaagagtgaaaagctctccagtttcccatctttgcagaaagatggtgccaaggaacctgaaaggaaggagcagcctctacaaaggcatcccagcagcatccctccgccccctctgacggccaaagacctgtccagcccggctgccaggcagcattgcagttccccaagccacgcttctggcagagagccgggggccaagcccagcactgcagagcccagctcgagcccccaggaccctcccaagcctgttgctgcgcacagtgaaagcagcagccacaagccccggcctggccctgacccgggccctccaaagactaagcaccccgaccggtccctctcctctcagaaaccaagtgtcggggccacaaagggcaaagagcctgccactcagtccctcggtggctctagcagagaggggaagggccacagtaagagtgggccggatgtgtttcctgctaccccaggctcccagaacaaagccagcgatgggattggccagggagaaggtgggccctctgtcccactgcacactgacagggctcctctagacgccaagccacaacccaccagtggtgggcggcccctggaggtgctggagaagcctgtgcatttgccaaggccgggacacccagggcctagtgagccagcggaccagaaactgtccgctgttggtgaaaagcaaaccctgtctccaaagcaccccaaaccatccactgtgaaagattgccccaccctgtgcaaacagacagacaacagacagacagacaaaagcccgagtcagccggccgccaacaccgacagaagggcggaagggaagaaatgcactgaagcactttatgctccagcagagggcgacaagctcgaggccggcctttcctttgtgcatagcgagaaccggttgaaaggcgcggagcggccagccgcgggggtggggaagggcttccctgaggccagagggaaagggcccggtccccagaagccaccgacggaggcagacaagcccaatggcatgaaacggtccccctcagccactgggcagagttctttccgatccacggccctcccggaaaagtctctgagctgctcctccagcttccctgaaaccagggccggagttagagaggcctctgcagccagcagcgacacctcttctgccaaggccgccgggggcatgctggagcttccagcccccagcaacagggaccataggaaggctcagcctgccggggagggccgaacccacatgacaaagagtgactccctgccctccttccgggtctccaccctgcctctggagtcacaccaccccgacccaaacaccatgggcggggccagccaccgggacagggctctctcggtgactgccaccgtaggggaaaccaaagggaaggaccctgccccagcccagcctcccccagctaggaaacagaacgtgggcagagacgtgaccaagccatccccagccccaaacactgaccgccccatctctctttctaatgagaaggactttgtggtacggcagaggcgggggaaagagagtttgcgtagcagccctcacaaaaaggccttgtaa

SEQ ID NO: 559 - DNA, 373 bp, synthetic construct
  misc_feature 1..373: note = Synthetic polynucleotide
  source 1..373: mol_type = other DNA
aactcctatttctgagatttcctttaccacttaggaggtagactatgaccagggaccattgctctcactcctacagtcaaaataacctgggtaagtaataaaaatcatagtttaaaaaatcataaaatatgctaaggacataaataaaccttgaaaatgtaaattccagaaatgggcaaactcttcaaaggaaagaagaggcccatggtttctctcacccctggtggattggcaggaggaggaggaatctgctatggatgggaaggagctgagtctccccagaagaggaagtttgatagattcccagaagtggaattgcttggtcaaacgccctgtgtgtccaaatgctgggagaacatcaccccttggatga

SEQ ID NO: 560 - DNA, 337 bp, synthetic construct
  misc_feature 1..337: note = Synthetic polynucleotide
  source 1..337: mol_type = other DNA
aactcctatttctgagatttcctttaccacttaggaggtagactatgaccagggaccattgctctcactcctacagtcaaaataacctgggtaagtaataaaaatcatagtttaaaaaatcataaaatatgctaaggacataaataaaccttgaaaatgtaaattccagaaatgggcaaactcttcaaaggaaagaagaggcccatggtttctctcacccctggtggattggcaggaggaggaggaatctgctatggatgggaaggagctgagtctccccagaagaggaagtttccctgtgtgtccaaatgctgggagaacatcaccccttggatga

SEQ ID NO: 561 - DNA, 301 bp, synthetic construct
  misc_feature 1..301: note = Synthetic polynucleotide
  source 1..301: mol_type = other DNA
aactcctatttctgagatttcctttaccacttaggaggtagactatgaccagggaccattgctctcactcctacagtcaaaataacctgggtaagtaataaaaatcatagtttaaaaaatcataaaatatgctaaggacataaataaaccttgaaaatgtaaattccagaaatgggcaaactcttcaaaggaaagaagaggcccatggtttctctcacccctggtggattggcaggaggaggaggaatctgctatggatgggaaggagctgagtctccccagaagaggaagtttcaactga

SEQ ID NO: 562 - DNA, 373 bp, synthetic construct
  misc_feature 1..373: note = Synthetic polynucleotide
  source 1..373: mol_type = other DNA
aactcctatttctgagatttcctttaccacttaggaggtagactatgaccagggaccattgctctcactcctacagtcaaaataacctgggtaagtaataaaaatcatagtttaaaaaatcataaaatatgctaaggacataaataaaccttgaaaatgtaaattccagaaatgggcaaactcttcaaaggaaagaagaggcccatggtttctctcacccctggtggattggcaggaggaggaggaatctgctatggatgggaaggagctgagtctccccagaagaggaagtttgtgcagaagcagtgattgtgactgggtaatagacaagagaagtgagagaaactgctttctaggcaagatgctgttatga

SEQ ID NO: 563 - DNA, 442 bp, synthetic construct
  misc_feature 1..442: note = Synthetic polynucleotide
  source 1..442: mol_type = other DNA
aactcctatttctgagatttcctttaccacttaggaggtagactatgaccagggaccattgctctcactcctacagtcaaaataacctgggtaagtaataaaaatcatagtttaaaaaatcataaaatatgctaaggacataaataaaccttgaaaatgtaaattccagaaatgggcaaactcttcaaaggaaagaagaggcccatggtttctctcacccctggtggattggcaggaggaggaggaatctgctatggatgggaaggagctgagtctccccagaagaggaagtttgatagattcccagaagtggaattgcttggtcaaacggagcctgagtccaaccccatccagcccaggcagtccttgtagtcctctcttggcctttcacttttggagccctgtgtgtccaaatgctgggagaacatcaccccttggatga

SEQ ID NO: 564 - DNA, 373 bp, synthetic construct; identical to SEQ ID NO: 562
  misc_feature 1..373: note = Synthetic polynucleotide
  source 1..373: mol_type = other DNA

SEQ ID NO: 565 - DNA, 1276 bp, synthetic construct
  misc_feature 1..1276: note = Synthetic polynucleotide
  source 1..1276: mol_type = other DNA
aactcctatttctgagatttcctttaccacttaggaggtagactatgaccagggaccattgctctcactcctacagtcaaaataacctgggtaagtaataaaaatcatagtttaaaaaatcataaaatatgctaaggacataaataaaccttgaaaatgtaaattccagaaatgggcaaactcttcaaaggaaagaagaggcccatggtttctctcacccctggtggattggcaggaggaggaggaatctgctatggatgggaaggagctgagtctccccagaagaggaagtttgatagattcccagaagtggaattgcttggtcaaacgttgccgaacaagcaaccggaaaagcttaataggcaatgggcagtcaccagcattgcctcgaccacactcacctctctctgctcatgcaggaaatagccctcaagatagtccaagaaatttctcccccagtgcctcagcccatttttcatttgcacggaggactgatggacgccgctggtcgttggcttctctcccttcctctggctatgggacaaacacacccagctctacggtctcttcatcctgttcctcccaggagaagttgcatcagttaccataccaaccaacaccagacgagttacacttcttatcaaaacatttctgtaccaccgaaagcatcgccactgagaacagatgcaggaacacgccgatgcgcccccgttcccgaagtctgagccctggacgttctcccgcctgctgtgaccatgaaataattatgatgaaccatgtctacaaagaaaggttcccaaaggctacagctcagatggaagaacgtctaaaggaaattatcaccagctactctcctgacaacgttctacccttagcagatggagtgcttagtttcactcaccaccagattattgaactggctcgagattgcttggataaatcccaccagggcctcatcacctcacgatacttccttgaattacagcacaaattagataagttgctacaggaggctcatgatcgttcagaaagtggagaattggcatttattaaacaactagttcgaaagatcctaattgttattgcccgccctgctcggttattagagtgcctggaatttgatccggaagaattttactacctattggaagcagcagaaggccatgccaaagaaggacagggtattaaaaccgacattcccaggtacatcattagccaactgggactcaataaggatcccttggaaggtgagtccctgggttgttcctacctttga

SEQ ID NO: 566 - DNA, 7528 bp, synthetic construct
  misc_feature 1..7528: note = Synthetic polynucleotide
  source 1..7528: mol_type = other DNA
aactcctatttctgagatttcctttaccacttaggaggtagactatgaccagggaccattgctctcactcctacagtcaaaataacctgggtaagtaataaaaatcatagtttaaaaaatcataaaatatgctaaggacataaataaaccttgaaaatgtaaattccagaaatgggcaaactcttcaaaggaaagaagaggcccatggtttctctcacccctggtggattggcaggaggaggaggaatctgctatggatgggaaggagctgagtctccccagaagaggaagtttgatagattcccagaagtggaattgcttggtcaaacgttgccgaacaagcaaccggaaaagcttaataggcaatgggcagtcaccagcattgcctcgaccacactcacctctctctgctcatgcaggaaatagccctcaagatagtccaagaaatttctcccccagtgcctcagcccatttttcatttgcacggaggactgatggacgccgctggtcgttggcttctctcccttcctctggctatgggacaaacacacccagctctacggtctcttcatcctgttcctcccaggagaagttgcatcagttaccataccaaccaacaccagacgagttacacttcttatcaaaacatttctgtaccaccgaaagcatcgccactgagaacagatgcaggaacacgccgatgcgcccccgttcccgaagtctgagccctggacgttctcccgcctgctgtgaccatgaaataattatgatgaaccatgtctacaaagaaaggttcccaaaggctacagctcagatggaagaacgtctaaaggaaattatcaccagctactctcctgacaacgttctacccttagcagatggagtgcttagtttcactcaccaccagattattgaactggctcgagattgcttggataaatcccaccagggcctcatcacctcacgatacttccttgaattacagcacaaattagataagttgctacaggaggctcatgatcgttcagaaagtggagaattggcatttattaaacaactagttcgaaagatcctaattgttattgcccgccctgctcggttattagagtgcctggaatttgatccggaagaattttactacctattggaagcagcagaaggccatgccaaagaaggacagggtattaaaaccgacattcccaggtacatcattagccaactgggactcaataaggatcccttggaagaaatggctcatttgggaaactacgatagtgggacagcagaaacaccagaaacagatgaatcagtgagtagctctaatgcctccctgaaacttcgaaggaaacctcgggaaagtgattttgaaacgattaaattgattagcaatggagcctatggggcagtctactttgttcggcataaagaatcccggcagaggtttgccatgaagaagattaataaacagaacctcatccttcgaaaccagatccagcaggcctttgtggagcgggatatcctgacttttgcagaaaacccctttgttgtcagcatgtattgctcctttgaaacaaggcgccacttgtgcatggtcatggaatatgtggaagggggagactgtgctactttaatgaaaaacatgggtcctctccctgttgatatggccagaatgtactttgctgagacggtcttggccttggaatatttacataattatggaattgtacacagggatttgaaaccagacaacttgttggttacctccatggggcacataaagctgacagattttggattatctaaggtgggactaatgagcatgactaccaacctttacgagggtcatattgagaaggatgctagagagttcctggataaacaggtctgtggcacacctgaatacattgcaccagaagtgattctgaggcagggttatggaaagccggtggactggtgggccatggggattatcctctatgaatttctggttggatgcgtgccattctttggggatactccagaggagctatttggacaagtcatcagtgatgagatcaactggcctgagaaggatgaggcacccccacctgatgcccaggatctgattaccttactcctcaggcagaatcccctggagaggctgggaacaggtggtgcatatgaagtcaaacagcatcgattcttccgttctttagactggaacagtttgctgagacagaaggcagaatttattccccaactggaatctgaggatgacacaagttattttgatactcggtctgagaagtatcatcatatggaaacggaggaagaagatgacacaaatgatgaagactttaatgtggaaataaggcagttttcttcatgttcacacaggttttcaaaagttttcagcagtatagatcgaatcactcagaattcagcagaagagaaggaagactctgtggacaaaaccaaaagcaccaccttgccatccacagaaacactgagctggagttcagaatattctgaaatgcaacagctatcaacatccaactcttcagatactgaaagcaacagacataaactcagttctggcctacttcccaaactggctatttcaacagagggagagcaagatgaagctgcctcctgccctggagacccccatgaggagccaggaaagccagcccttcctcctgaagagtgtgcccaggaggagcctgaggtcaccaccccagccagcaccatcagcagctccaccctgtcagttggcagtttttcagagcacttggatcagataaatggacgaagcgagtgtgtggacagtacagataattcctcaaagccatccagtgaacccgcttctcacatggctcggcagcgattagaaagcacagaaaaaaagaaaatctcggggaaagtcacaaagtccctctctgccagtgctctttccctcatgatcccaggagatatgtttgctgtttcccctctgggaagtccaatgtctccccattccctgtcctcggacccttcttcttcacgagattcctctcccagccgagattcctcagcagcttctgccagtccacatcagccgattgtgatccacagttcggggaagaactacggctttaccatccgagccatccgggtgtatgtgggagacagtgacatctatacagtgcaccatatcgtctggaatgtagaagaaggaagtccggcatgccaggcaggactgaaggctggagatcttatcactcacatcaatggagaaccagtgcatggacttgtccacacagaagttatagaactcctactgaagagtgggaataaggtgtcaatcactactaccccatttgaaaacacatcaatcaaaactggaccagccaggagaaacagctataagagccggatggtgaggcggagcaagaaatccaagaagaaagaaagtctcgaaaggaggagatctcttttcaaaaagctagccaagcagccttctcctttactccacaccagccgaagtttctcctgcttgaacagatccctgtcatcgggtgagagcctcccaggttcccccactcatagcttgtctccccggtctccaacaccaagctaccgctccacccctgacttcccatctggtactaattcctcccagagcagctcccctagttctagtgcccccaattccccagcagggtccgggcacatccggcccagcactctccacggtcttgcacccaaactcggcgggcagcggtaccggtccggaaggcgaaagtccgccggcaacatcccactgtccccgctggcccggacgccctctccaaccccgcaacccacctccccgcagcggtcaccatcccctcttctgggacactcactgggcaattccaagatcgcgcaagcctttcccagcaagatgcactccccgcccaccatcgtcagacacatcgtgaggcccaagagtgcggagccccccaggtccccgctgctcaagcgcgtgcagtccgaggagaagctgtcgccctcttacggcagtgacaagaagcacctgtgctcccgcaagcacagcctggaggtgacccaagaggaggtgcagcgggagcagtcccagcgggaggcgccgctgcagagcctggatgagaacgtgtgcgacgtgccgccgctcagccgcgcccggccagtggagcaaggctgcctgaaacgcccagtctcccggaaggtgggccgccaggagtctgtggacgacctggaccgcgacaagctgaaggccaaggtggtggtgaagaaagcagacggcttcccagagaaacaggaatcccaccagaaatcccatggacccgggagtgatttggaaaactttgctctgtttaagctggaagagagagagaagaaagtctatccgaaggctgtggaaaggtcaagtacttttgaaaacaaagcgtctatgcaggaggcgccaccgctgggcagcctgctgaaggatgctcttcacaagcaggccagcgtgcgcgccagcgagggtgcgatgtcggatggccgggtgcctgcggagcaccgccagggtggcggggacttcagacgggcccccgctcctggcaccctccaggatggtctctgccactccctcgacaggggcatctctgggaagggggaaggcacggagaagtcctcccaggccaaggagcttctccgatgtgaaaagttagacagcaagctggccaacatcgattacctccgaaagaaaatgtcacttgaggacaaagaggacaacctctgccctgtgctgaagcccaagatgacagctggctcccacgaatgcctgccagggaacccagtccgacccacgggtgggcagcaggagcccccgccggcttctgagagccgagcttttgtcagcagcacccatgcagctcagatgagtgccgtctcttttgttcccctcaaggccttaacaggccgggtggacagtggaacggagaagcctggcttggttgctcctgagtcccctgttaggaagagcccctccgagtataagctggaaggtaggtctgtctcatgcctgaagccgatcgagggcactctggacattgctctcctgtccggacctcaggcctccaagacagaactgccttccccagagtctgcacagagccccagcccaagtggtgacgtgagggcctctgtgccaccagttctccccagcagcagtgggaaaaagaacgataccaccagtgcaagagagctttctccttccagcttaaagatgaataaatcctacctgctggagccttggttcctgccccccagccgaggtctccagaattcaccagcagtttccctgcctgacccagagttcaagagggacaggaaaggtccccatcctactgccaggagccctggaacagtcatggaaagcaatccccaacagagagagggcagctcccctaaacaccaagaccacaccactgaccccaagcttctgacctgcctggggcagaacctccacagccctgacctggccaggccacgctgcccgctcccacctgaagcttccccctcaagggagaagccaggcctgagggaatcgtctgaaagaggccctcccacagccagaagcgagcgctctgctgcgagggctgacacatgcagagagccctccatggaactgtgctttccagaaactgcgaaaaccagtgacaactccaaaaatctcctctctgtgggaaggacccacccagatttctatacacagacccaggccatggagaaagcatgggcgccgggtgggaaaacgaaccacaaagatggcccaggtgaggcgaggcccccgcccagagacaactcctctctgcactcagctggaattccctgtgagaaggagctgggcaaggtgaggcgtggcgtggaacccaagcccgaagcgcttcttgccaggcggtctctgcagccacctggaattgagagtgagaagagtgaaaagctctccagtttcccatctttgcagaaagatggtgccaaggaacctgaaaggaaggagcagcctctacaaaggcatcccagcagcatccctccgccccctctgacggccaaagacctgtccagcccggctgccaggcagcattgcagttccccaagccacgcttctggcagagagccgggggccaagcccagcactgcagagcccagctcgagcccccaggaccctcccaagcctgttgctgcgcacagtgaaagcagcagccacaagccccggcctggccctgacccgggccctccaaagactaagcaccccgaccggtccctctcctctcagaaaccaagtgtcggggccacaaagggcaaagagcctgccactcagtccctcggtggctctagcagagaggggaagggccacagtaagagtgggccggatgtgtttcctgctaccccaggctcccagaacaaagccagcgatgggattggccagggagaaggtgggccctctgtcccactgcacactgacagggctcctctagacgccaagccacaacccaccagtggtgggcggcccctggaggtgctggagaagcctgtgcatttgccaaggccgggacacccagggcctagtgagccagcggaccagaaactgtccgctgttggtgaaaagcaaaccctgtctccaaagcaccccaaaccatccactgtgaaagattgccccaccctgtgcaaacagacagacaacagacagacagacaaaagcccgagtcagccggccgccaacaccgacagaagggcggaagggaagaaatgcactgaagcactttatgctccagcagagggcgacaagctcgaggccggcctttcctttgtgcatagcgagaaccggttgaaaggcgcggagcggccagccgcgggggtggggaagggcttccctgaggccagagggaaagggcccggtccccagaagccaccgacggaggcagacaagcccaatggcatgaaacggtccccctcagccactgggcagagttctttccgatccacggccctcccggaaaagtctctgagctgctcctccagcttccctgaaaccagggccggagttagagaggcctctgcagccagcagcgacacctcttctgccaaggccgccgggggcatgctggagcttccagcccccagcaacagggaccataggaaggctcagcctgccggggagggccgaacccacatgacaaagagtgactccctgccctccttccgggtctccaccctgcctctggagtcacaccaccccgacccaaacaccatgggcggggccagccaccgggacagggctctctcggtgactgccaccgtaggggaaaccaaagggaaggaccctgccccagcccagcctcccccagctaggaaacagaacgtgggcagagacgtgaccaagccatccccagccccaaacactgaccgccccatctctctttctaatgagaaggactttgtggtacggcagaggcgggggaaagagagtttgcgtagcagccctcacaaaaaggccttgtaa

SEQ ID NO: 567 - DNA, 418 bp, synthetic construct
  misc_feature 1..418: note = Synthetic polynucleotide
  source 1..418: mol_type = other DNA
aactcctatttctgagatttcctttaccacttaggaggtagactatgaccagggaccattgctctcactcctacagtcaaaataacctgggtaagtaataaaaatcatagtttaaaaaatcataaaatatgctaaggacataaataaaccttgaaaatgtaaattccagaaatgggcaaactcttcaaaggaaagaagaggcccatggtttctctcacccctggtggattggcaggaggaggaggaatctgctatggatgggaaggagctgagtctccccagaagaggaagtttgatagattcccagaagtggaattgcttggtcaaacgtctcactcccaggagcctgagtccaaccccatccagcccaggcagtccttgtagtcctctcttggcctttcacttttggagggaatga

SEQ ID NO: 568 - DNA, 1775 bp, synthetic construct
  misc_feature 1..1775: note = Synthetic polynucleotide
  source 1..1775: mol_type = other DNA
tgtccccagcctacccctttcctgaatcccaggctcatagccaactgcccacctatttccacgtggatgcctgctgagcacctcaaatgtcacacagccaagacagaactctggatctcctttcccagccacaagctgcccctcttccagtctgccactccccacctgtcctgcctttgtgtgcctctgtgtctttgctgggtggcctgacctttggttatgaactggcagtcatatcaggtgccctgctgccactgcagcttgactttgggctaagctgcttggagcaggagttcctggtgggcagcctgctcctgggggctctcctcgcctccctggttggtggcttcctcattgactgctatggcaggaagcaagccatcctcgggagcaacttggtgctgctggcaggcagcctgaccctgggcctggctggttccctggcctggctggtcctgggccgcgctgtggttggcttcgccatttccctctcctccatggcttgctgtatctacgtgtcagagctggtggggccacggcagcggggagtgctggtgtccctctatgaggcaggcatcaccgtgggcatcctgctctcctatgccctcaactatgcactggctggtaccccctggggatggaggcacatgttcggctgggccactgcacctgctgtcctgcaatccctcagcctcctcttcctccctgctggtacagatgagactgcaacacacaaggacctcatcccactccagggaggtgaggcccccaagctgggcccggggaggccacggtactcctttctggacctcttcagggcacgcgataacatgcgaggccggaccacagtgggcctggggctggtgctcttccagcaactaacagggcagcccaacgtgctgtgctatgcctccaccatcttcagctccgttggtttccatgggggatcctcagccgtgctggcctctgtggggcttggcgcagtgaaggtggcagctaccctgaccgccatggggctggtggaccgtgcaggccgcagggctctgttgctagctggctgtgccctcatggccctgtccgtcagtggcataggcctcgtcagctttgccgtgcccatggactcaggcccaagctgtctggctgtgcccaatgccaccgggcagacaggcctccctggagactctggcctgctgcaggactcctctctacctcccattccaaggaccaatgaggaccaaagggagccaatcttgtccactgctaagaaaaccaagccccatcccagatctggagacccctcagcccctcctcggctggccctgagctctgccctccctgggccccctctgcccgctcgggggcatgcactgctgcgctggaccgcactgctgtgcctgatggtctttgtcagtgccttctcctttgggtttgggccagtgacctggcttgtcctcagcgagatctaccctgtggagatacgaggaagagccttcgccttctgcaacagcttcaactgggcggccaacctcttcatcagcctctccttcctcgatctcattggcaccatcggcttgtcctggaccttcctgctctacggactgaccgctgtcctcggcctgggcttcatctatttatttgttcctgaaacaaaaggccagtcgttggcagagatagaccagcagttccagaagagacggttcaccctgagctttggccacaggcagaactccactggcatcccgtacagccgcatcgagatctctgcggcctcctga

SEQ ID NO: 569 - DNA, 898 bp, synthetic construct
  misc_feature 1..898: note = Synthetic polynucleotide
  source 1..898: mol_type = other DNA
ctctccctctcctccctctccctctccctctccctctccccacggtctccctctccctctctttccatggtctccctctgatgccgagccgaagctggactgtactgctgccatctcggctcactgcaacctccctgcctgattctcctgcctcagcctgctgactgcctgcgattgcaggcacgcgccgccacgcctgactggttttcatatttttttggtggagacggggtttcgctgtgttggcggggctggtctccagctcctaaccgcgagtgatctgccagcctcggcctcctgaggtgccgggattgcagacggagtctcgttcactcagtgctcaatggtgcccaggctggagtgcagtggcgtgatctcagctcgctacaacctccacctcccagccgcccgccttggcctcccaaagtgccgagattgcagcctctgcctggccgccaccccgtctgggaagtgaggagcgtctctgcccggccgcccattgtctgagatgtggggagcgcctctgccccgcaaccccgtctgggaggtgaggagcgtctctgcccggccgccccgtctgagaagtgaggagaccctccgcccggcaaccgccccgtctgagaagtgaggagcccctccgcccggcagccgccccctctgagaacgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagacccagaaatggtttaagcagcgcctggcaaagtggcggcgctcagaaggcctgccctcagagtgcagatccgtcacagactaa

SEQ ID NO: 570 - DNA, 961 bp, synthetic construct
  misc_feature 1..961: note = Synthetic polynucleotide
  source 1..961: mol_type = other DNA
ctctccctctcctccctctccctctccctctccctctccccacggtctccctctccctctctttccatggtctccctctgatgccgagccgaagctggactgtactgctgccatctcggctcactgcaacctccctgcctgattctcctgcctcagcctgctgactgcctgcgattgcaggcacgcgccgccacgcctgactggttttcatatttttttggtggagacggggtttcgctgtgttggcggggctggtctccagctcctaaccgcgagtgatctgccagcctcggcctcctgaggtgccgggattgcagacggagtctcgttcactcagtgctcaatggtgcccaggctggagtgcagtggcgtgatctcagctcgctacaacctccacctcccagccgcccgccttggcctcccaaagtgccgagattgcagcctctgcctggccgccaccccgtctgggaagtgaggagcgtctctgcccggccgcccattgtctgagatgtggggagcgcctctgccccgcaaccccgtctgggaggtgaggagcgtctctgcccggccgccccgtctgagaagtgaggagaccctccgcccggcaaccgccccgtctgagaagtgaggagcccctccgcccggcagccgccccctctgagaacgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagacccagggtagtgatttgatctccaggagcaaaatatggcacccagaaagtagcccccaaagagaaggctacccccatgatagtctgccgtgcttggctttcgattacttttctctactgccgccccagtgtaaagaaatggtttaa

SEQ ID NO: 571 - DNA, 898 bp, synthetic construct; identical to SEQ ID NO: 569
  misc_feature 1..898: note = Synthetic polynucleotide
  source 1..898: mol_type = other DNA

SEQ ID NO: 572 - DNA, 818 bp, synthetic construct
  misc_feature 1..818: note = Synthetic polynucleotide
  source 1..818: mol_type = other DNA
ctctccctctcctccctctccctctccctctccctctccccacggtctccctctccctctctttccatggtctccctctgatgccgagccgaagctggactgtactgctgccatctcggctcactgcaacctccctgcctgattctcctgcctcagcctgctgactgcctgcgattgcaggcacgcgccgccacgcctgactggttttcatatttttttggtggagacggggtttcgctgtgttggcggggctggtctccagctcctaaccgcgagtgatctgccagcctcggcctcctgaggtgccgggattgcagacggagtctcgttcactcagtgctcaatggtgcccaggctggagtgcagtggcgtgatctcagctcgctacaacctccacctcccagccgcccgccttggcctcccaaagtgccgagattgcagcctctgcctggccgccaccccgtctgggaagtgaggagcgtctctgcccggccgcccattgtctgagatgtggggagcgcctctgccccgcaaccccgtctgggaggtgaggagcgtctctgcccggccgccccgtctgagaagtgaggagaccctccgcccggcaaccgccccgtctgagaagtgaggagcccctccgcccggcagccgccccctctgagaacgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagaccc

SEQ ID NO: 573 - DNA, 427 bp, synthetic construct
  misc_feature 1..427: note = Synthetic polynucleotide
  source 1..427: mol_type = other DNA
cccactgctgtttaaaggtgaccaaagccacgtaatgtccgtagttcgctcatccgtccatgccagatggattgtggggaaggtgattgggacaaaaatgcaaaagactgctaaagtgagagtgaccaggcttgttctggatccctatttattaaagtattttaataagcggaaaacctactttgctcacgatgcccttcagcagtgcacagttggggatattgtgcttctcagagctttacctgttccacgagcaaagcatgtgaaacatgaactggctgagatcgttttcaaagttggaaaagtcatagatccagtgacaggaaagccctgtgctggaactacctacctggagagtccgttgagttcggaaaccacccagctaagcaaaaatctggaagaactcaatatctcttcagcacagtga

SEQ ID NO: 574 - DNA, 7177 bp, synthetic construct
  misc_feature 1..7177: note = Synthetic polynucleotide
  source 1..7177: mol_type = other DNA
tgatatggtttgtctgtgtccgcacagccaaatctcatcttgaattcccatgtgttgtgggaggcacctggtgggaggtaattgaatcatgggggcgggtctttcccatgctgttctcatgatagcgcataagtctcatgagatctgatggttttgaaaagggggagtttccctgcccaaactctctttttgcctgctgccatccgtgtaagatgtgacttggtcctccttgccttccgccatgattgtgaggtctccccagccacgtggaactggccagcagcttgaccttggcacaccacataatctgagtgaaccgtgtatccaaggatgtcacttttggaactctgtagatcagaaaaactgtgctttaaagtgtaatgatacttatgccaccgtttgtgagcgggagtcgtgtgaggttggctgtagcagcgcggaaggtgcatatgaagaggaagtactggaaaatgcagacctaccaactgctccctttgcttcttccattggaagccacaatatgacattacgatggaaatctgcaaacttctctggagtaaaatacatcattcagtggaaatatgcacaacttctgggaagctggacttatactaagactgtgtccagaccgtcctatgtggtcaagcccctgcaccccttcactgagtacattttccgagtggtttggatcttcacagcgcagctgcagctctactcccctccaagtcccagttacaggactcatcctcatggagttcctgaaactgcacctttgattaggaatattgagagctcaagtcccgacactgtggaagtcagctgggatccacctcaattcccaggtggacctattttgggttataacttaaggctgatcagcaaaaatcaaaaattagatgcagggacacagagaaccagtttccagttttactccactttaccaaatactatctacaggttttctattgcagcagtaaatgaagttggtgagggtccagaagcagaatctagtattaccacttcatcttcagcagttcaacaagaggaacagtggctctttttatccagaaaaacttctctaagaaagagatctttaaaacatttagtagatgaagcacattgccttcggttggatgctatataccataatattacaggaatatctgttgatgtccaccagcaaattgtttatttctctgaaggaactctcatatgggcgaagaaggctgccaacatgtctgatgtatctgacctgagaattttttacagaggttcaggattaatttcttctatctccatagattggctttatcaaagaatgtatttcatcatggatgaactggtatgtgtctgtgatttagagaactgctcaaacatcgaggaaattactccaccctctattagtgcacctcaaaaaattgtggctgattcatacaatgggtatgtcttttacctcctgagagatggcatttatagagcagaccttcctgtaccatctggccggtgtgcagaagctgtgcgtattgtggagagttgcacgttaaaggactttgcaatcaagccacaagccaagcgaatcatttacttcaatgacactgcccaagtcttcatgtcaacatttctggatggctctgcttcccatctcatcctacctcgcatcccctttgctgatgtgaaaagttttgcttgtgaaaacaatgactttcttgtcacagatggcaaggtcattttccaacaggatgctttgtcttttaatgaattcatcgtgggatgtgacctgagtcacatagaagaatttgggtttggtaacttggtcatctttggctcatcctcccagctgcaccctctgccaggccgcccgcaggagctttcggtgctgtttggctctcaccaggctcttgttcaatggaagcctcctgcccttgccataggagccagcccttctgcctggcagaactggacctatgaggtgaaagtatccacccaagaccctcctgaagtcactcatattttcttgaacataagtggaaccatgctgaatgtacctgagctgcagagtgctatgaaatacaaggtttctgtgagagcaagttctccaaagaggccaggcccctggtcagagccctcagtgggtactaccctggtgccagctagtgaaccaccatttatcatggctgtgaaagaagatgggctttggagtaaaccattaaatagctttggcccaggagagttcttatcctctgatataggaaatgtgtcagacatggattggtataacaacagcctctactacagtgacacgaaaggcgacgtttttgtgtggctgctgaatgggacggatatctcagagaattatcacctacccagcattgcaggagcaggggctttagcttttgagtggctgggtcactttctctactgggctggaaagacatatgtgatacaaaggcagtctgtgttgacgggacacacagacattgttacccacgtgaagctattggtgaatgacatggtggtggattcagttggtggatatctctactggaccacactctattcagtggaaagcaccagactaaatggggaaagttcccttgtactacagacacagccttggttttctgggaaaaaggtaattgctctaactttagacctcagtgatgggctcctgtattggttggttcaagacagtcaatgtattcacctgtacacagctgttcttcggggacagagcactggggataccaccatcacagaatttgcagcctggagtacttctgaaatttcccagaatgcactgatgtactatagtggtcggctgttctggatcaatggctttaggattatcacaactcaagaaataggtcagaaaaccagtgtctctgttttggaaccagccagatttaatcagttcacaattattcagacatcccttaagcccctgccagggaacttttcctttacccctaaggttattccagattctgttcaagagtcttcatttaggattgaaggaaatgcttcaagttttcaaatcctgtggaatggtccccctgcggtagactggggtgtagttttctacagtgtagaatttagtgctcattctaagttcttggctagtgaacaacactctttacctgtatttactgtggaaggactggaaccttatgccttatttaatctttctgtcactccttatacctactggggaaagggccccaaaacatctctgtcacttcgagcacctgaaacagttccatcagcaccagagaaccccagaatatttatattaccaagtggaaaatgctgcaacaagaatgaagttgtggtggaatttaggtggaacaaacctaagcatgaaaatggggtgttaacaaaatttgaaattttctacaatatatccaatcaaagtattacaaacaaaacatgtgaagactggattgctgtcaatgtcactccctcagtgatgtcttttcaacttgaaggcatgagtcccagatgctttattgccttccaggttagggcctttacatctaaggggccaggaccatatgctgacgttgtaaagtctacaacatcagaaatcaacccatttcctcacctcataactcttcttggtaacaagatagtttttttagatatggatcaaaatcaagttgtgtggacgttttcagcagaaagagttatcagtgccgtttgctacacagctgataatgagatgggatattatgctgaaggggactcactctttcttctgcacttgcacaatcgctctagctctgagcttttccaagattcactggtttttgatatcacagttattacaattgactggatttcaaggcacctctactttgcactgaaagaatcacaaaatggaatgcaagtatttgatgttgatcttgaacacaaggtgaaatatcccagagaggtgaagattcacaataggaattcaacaataatttctttttctgtatatcctcttttaagtcgcttgtattggacagaagtttccaattttggctaccagatgttctactacagtattatcagtcacaccttgcaccgaattctgcaacccacagctacaaaccaacaaaacaaaaggaatcaatgttcttgtaatgtgactgaatttgagttaagtggagcaatggctattgatacctctaacctagagaaaccattgatatactttgccaaagcacaagagatctgggcaatggatctggaaggctgtcagtgttggagagttatcacagtacctgctatgctcggaaaaacccttgttagcttaactgtggatggagatcttatatactggatcatcacagcaaaggacagcacacagatttatcaggcaaagaaaggaaatggggccatcgtttcccaggtgaaggccctaaggagtaggcatatcttggcttacagttcagttatgcagccttttccagataaagcgtttctgtctctagcttcagacactgtggaaccaactatacttaatgccactaacactagcctcacaatcagattacctctggccaagacaaacctcacatggtatggcatcaccagccctactccaacatacctggtttattatgcagaagttaatgacaggaaaaacagctctgacttgaaatatagaattctggaatttcaggacagtatagctcttattgaagatttacaaccattttcaacatacatgatacagatagctgtaaaaaattattattcagatcctttggaacatttaccaccaggaaaagagatttggggaaaaactaaaaatggagtaccagaggcagtgcagctcattaatacaactgtgcggtcagacaccagcctcattatatcttggagagaatctcacaagccaaatggacctaaagaatcagtccgttatcagttggcaatctcacacctggccctaattcctgaaactcctctaagacaaagtgaatttccaaatggaaggctcactctccttgttactagactgtctggtggaaatatttatgtgttaaaggttcttgcctgccactctgaggaaatgtggtgtacagagagtcatcctgtcactgtggaaatgtttaacacaccagagaaaccttattccttggttccagagaacactagtttgcaatttaattggaaggctccattgaatgttaacctcatcagattttgggttgagctacagaagtggaaatacaatgagttttaccatgttaaaacttcatgcagccaaggtcctgcttatgtctgtaatatcacaaatctacaaccttatacttcatataatgtcagagtagtggtggtttataagacgggagaaaatagcacctcacttccagaaagctttaagacaaaagctggagtcccaaataaaccaggcattcccaaattactagaagggagtaaaaattcaatacagtgggagaaagctgaagataatggatgtagaattacatactatatccttgagataagaaagagcacttcaaataatttacagaaccagaatttaaggtggaagatgacatttaatggatcctgcagtagtgtttgcacatggaagtccaaaaacctgaaaggaatatttcagttcagagtagtagctgcaaataatctagggtttggtgaatatagtggaatcagtgagaatattatattagttggagatgatttttggataccagaaacaagtttcatacttactattatagttggaatatttctggttgttacaatcccactgacctttgtctggcatagaagattaaagaatcaaaaaagtgccaaggaaggggtgacagtgcttataaacgaagacaaagagttggctgagctgcgaggtctggcagccggagtaggcctggctaatgcctgctatgcaatacatactcttccaacccaagaggagattgaaaatcttcctgccttccctcgggaaaaactgactctgcgtctcttgctgggaagtggagcctttggagaagtgtatgaaggaacagcagtggacatcttaggagttggaagtggagaaatcaaagtagcagtgaagactttgaagaagggttccacagaccaggagaagattgaattcctgaaggaggcacatctgatgagcaaatttaatcatcccaacattctgaagcagcttggagtttgtctgctgaatgaaccccaatacattatcctggaactgatggagggaggagaccttcttacttatttgcgtaaagcccggatggcaacgttttatggtcctttactcaccttggttgaccttgtagacctgtgtgtagatatttcaaaaggctgtgtctacttggaacggatgcatttcattcacagggatctggcagctagaaattgccttgtttccgtgaaagactataccagtccacggatagtgaagattggagactttggactcgccagagacatctataaaaatgattactatagaaagagaggggaaggcctgctcccagttcggtggatggctccagaaagtttgatggatggaatcttcactactcaatctgatgtatggtcttttggaattctgatttgggagattttaactcttggtcatcagccttatccagctcattccaaccttgatgtgttaaactatgtgcaaacaggagggagactggagccaccaagaaattgtcctgatgatctgtggaatttaatgacccagtgctgggctcaagaacccgaccaaagacctacttttcatagaattcaggaccaacttcagttattcagaaattttttcttaaatagcatttataagtccagagatgaagcaaacaacagtggagtcataaatgaaagctttgaaggtgaagatggcgatgtgatttgtttgaattcagatgacattatgccagttgctttaatggaaacgaagaaccgagaagggttaaactatatggtacttgctacagaatgtggccaaggtgaagaaaagtctgagggtcctctaggctcccaggaatctgaatcttgtggtctgaggaaagaagagaaggaaccacatgcagacaaagatttctgccaagaaaaacaagtggcttactgcccttctggcaagcctgaaggcctgaactatgcctgtctcactcacagtggatatggagatgggtctgattaa

(The sequence listing continues in the following parts.)

The invention claimed is:

1. A method of antibody production comprising a step of contacting multiple antibodies or antigen-binding fragments thereof with a tumor neoantigen peptide and selecting an antibody, or antigen-binding fragment thereof, that binds to the tumor neoantigen peptide, the improvement comprising:
   using a tumor neoantigen peptide identified by a method comprising
      selecting, among mRNA sequences from cancer cells, a fusion transcript comprising a junction between a transposable element (TE) sequence and an exonic sequence, and including an Open Reading Frame (ORF), and
      selecting a tumor neoantigen peptide of at least 8 amino acids in length, encoded by part of the ORF of the fusion transcript.

2. The method of claim 1 wherein the antibody, or antigen-binding fragment thereof, is selected from a library of human antibody sequences.

3. The method of claim 1 wherein the antibody, or antigen-binding fragment thereof, is generated by immunizing an animal with a polypeptide comprising the tumor neoantigen peptide, followed by the selection step.

4. The method of claim 1 wherein the antibody or antigen-binding fragment thereof is part of a T-Cell Receptor (TCR).

5. The method of claim 4 wherein the TCR comprises a TCRa and/or TCRb chain or TCRg and/or TCRd chain.

6. The method of claim 1, wherein the tumor neoantigen peptide is encoded by a canonical open reading frame of an exon.

7. The method of claim 1, wherein the tumor neoantigen peptide is encoded by a non-canonical open reading frame of an exon.

8. The method of claim 1, wherein the tumor neoantigen peptide is in association with an MHC or HLA molecule.

9. The method of claim 1, wherein the antibody is a multispecific antibody that further targets an immune cell antigen.

\* \* \* \* \*